United States Patent 9,200,291 (COMPOSITIONS AND METHODS FOR CREATING ALTERED AND IMPROVED CELLS AND ORGANISMS) - sequence listing, part 2

SEQ ID NO: 3307 - DNA, 1398 bp, Saccharomyces cerevisiae
atggacgggcataatcagaaccagtaccagaatcagaatcaaattcagcagtcacaacaaccacctctgaagaaatatgtgacacagagacgatcggtagacgtgagttctccgtatattaacctatattacaacagacgacatggattaccgaacctagtggtagagccagaaacttcatacacaatagatataatgccgcctaatgcctacagaggtcgagatcgagtcataaatttgcccagcaaatttacgcatttaagctcgaataaagtgaaacatgtgatacccgccatccaatggaccccagaaggcagaagacttgtagtagcaacttatagcggagaattttctctatggaacgcatcttcgtttacgtttgaaaccctcatgcaagcacatgattcggctgtgactacaatgaaatattctcacgacagtgattggatgattagtggggacgcagatggaatgattaagatatggcaaccaaactttagtatggttaaagaaattgatgctgcacacacggaaagtattagggatatggcattcagtagtaacgactcgaaatttgttacctgttcagatgataatatcttgaagatttggaacttcagcaatggcaaacaagaaagagtattatcggggcaccactgggacgtgaaaagttgtgattggcatcccgagatggggttaattgcctccgcatctaaggacaatttagtaaaactgtgggatccgcgttccggaaactgcatatcatcaattctgaagttcaaacatactgtcttgaagacgcgatttcaacccaccaagggaaatctattaatggcgatttcaaaagataaatcgtgtcgtgtgttcgacattagatacagtatgaaggaactaatgtgtgtaagagatgaaacggattatatgacactagaatggcacccaataaatgaatctatgttcactctggcgtgctatgacggctcgctaaagcattttgatcttttacaaaatctaaacgaacctattttgactattccatacgcccatgataagtgtatcacctcgttatcatataatccagtaggacatatatttgccacagcagctaaggatagaaccataagattttggactagagcgaggccaattgatcctaatgcatatgatgatccaacttataacaataagaagataaatggatggttttttggcatcaataacgacatcaatgctgtgagagagaagagtgaattcggtgcggccccgccaccaccagctacacttgaaccacatgcgttaccaaacatgaatggattcatcaacaagaaaccgcgtcaagaaatcccaggcatcgattcaaacatcaagagttccacattgccaggtttaagcatataa

SEQ ID NO: 3308 - DNA, 1398 bp, Saccharomyces cerevisiae
atggcccgcaatagacaagcgtgcgactgttgttgcattcgtcgagtaaagtgtgatcgtaaaaaaccatgtaaatgttgtcttcaacacaatctgcaatgtacatatcttcgacctttgaagaaaagaggtccaaaacccgtcaaggtgagaaatttaaagaaagtagatgatgtacaggtatttagtaaaagtagtagtggtggcataatgaaggttccaaaggcactaattgatcagtgtctgcggctctataatgataagttgtatgtgatctggcctttgctgtgttatgatgatctttacgaacttttagagaaaagatatgacgaaacctgtgtgtattggttcctggtatctctttctgccgccacgcttagcgatttgcagactgaaattgagtcggaaggaggggttacctttactgggatacagttatccagtttctgcatgtcatcacgccaagaatttgacgattttaacggtagtgatatattcaagattatgacgtactattgtctaaaccgctgctacgcacagatgtccaactcaagaacttcgtatcggctttcttgtgaagccgtggggctcattaagttggcggggttccatcgcgaggaaactttgaaacttcttcctttcgatgagcagcagcttggaaggaaagtttattatttgcttctcttaacggaaagatacttttctgtgtatacgcattgcgccacgagcctggataccacgattgctccaccacaaccggagaacgtaacggacccccgactatctctcgacagcttcttggagatgattagggtatttactgtaccgggaaaatgcttctttgatgctctagctaccgactctgctaatgtaacctgtactgaagactcccttaaaaagatatggagggaacttcatacggtgccacttgagatagaaccatggtcttacggctatgtagacatatctttttcacggcattggattagaacacttgcttggaagctagtgcttcaaataagcggtatgcgaatcagtttcctttcaaatagcaagaatacgcatattccagtagaaattgctagagacatgttagaagacacatttttaatcccaaaaaatctttatgcagttcacggtccagggatatcagtgaaagcactagaaatagccgacgcattggtagatgttgtgaatcagtacgatcaaaatgcagagtcggaggcttggaattttttgttcgatatatccaaatttgtcttctctcttaagcattgtgatagcacattagttgataagtttacgacaaagtgtcagtgtgcgcttatcacgcttcctctttctaatccgcttgaatcgacagatggttctaaagaagatgtagatgcgcttccttaa

SEQ ID NO: 3309 - DNA, 1398 bp, Saccharomyces cerevisiae
atggcgtttgaggattatttttctttccagatattcttcattttcttaagggaatccttagaaattgttgtcattgtttctatcctgttgacgatcgtcaaacaaggtctgtctgttgaggacgacagcccgtttgaaggaagttcctcttctgctggtcttccaagtccaaatacgaacacaaacgcagattcgaccactgccttcttacaagcagggccttcagacggtaatgctattggaacgtccgctacggctgctaataataaatcgaggccgctaaatgtggaggaagaagaagaaatttacgagtactctaatgagcttagagaccaggaccgcgagtccgatgaacatacggctgacaacgttaagctatatcagaaattaaaaatacaaattctagcgggcggcgcatttggtttgttgctgtgtatgttaatcgggggtgcgtttgttagtatcttttatcatattggaaccgacttatggacactgagtgaacattattatgaaggtgtcttaagtcttgtcgcgtccgttattatttctgtcatggggttgttttttttaagaatggggaagttaagagagaagttcagagtgaaattagcttctatcatttattcaaaggacaataatttgctgggaaacaaaacccaaaaaggtgtgaaattcagtgaaaagtactccttcttcatattaccatttataacgactttgagagaagggttagaagctgttgtattcattggaggtatcggtattgaccaaccactatcctcgattcccctctctatggtccttgctactgcaatcagtacggtgttcggtatttttttcttcaggtactcaagttctctttcacttaagatatgccttgtagtcgccacctgcttcctctacttgatcgcggctggtttgttttccaaaggtgtatggcaacttgaattgcaagactacgtcaacaaatgtaacggtcaagacatgagtgaagtaggaaatggacccggttcgtacgacatatctcgttctgtttggcatgttaattgttgcaatggtgaaaaagatggaggttggatgatttttactgccatttttggttggacgaatagtgctaccgtcggctctgtaattagctacaacgcctactggttggtattaatatgcgctttgaaactgctaatgatagaagaaaaatacggatatatcccatatctacctattagctggcaaaagaaacgtattatgaaaagattaagcattgccaaggcatcgctcgatctcaaacatcatacttctgaactcaactctagcacatcagagccagacagtcaaagacggtccaaagatagttctgtgcccctaataattgatagcagtggttcagcaaattga

SEQ ID NO: 3310 - DNA, 1401 bp, Saccharomyces cerevisiae
atgccatttaatcataatagcaaggcaaaaagaccaaagtttctactggacctgcaaatcaaagaattggtaaatattcctcaatcttctggctattgctacacgaaatggcgtttgaaggatggaacaggtacgtcgggacacaaagtggctctggacggtgagcatcaaaccacttcgacccagagtagaggtacaacaaaacacgtgcatgtgcaacatcatagagcacaatggaattattcattagacaaaccaatcctggtgaagctccacttggataaaaacggcagattcttgaagaaaattttggtgttggatgttttttttgagtttgctgatgcgaattcctcgttgacttctagttctagtcccaatggcaaagtgaagaaaacgacctatgctaacgccactgcactaacggccacaggaaacaattcatattctcaaaagataacgggtaaacttctattgggaacagtagacatagatataacagaatacgtcaaagaagacgaaactcccacaacaaacagatttctcctaaagcactcaaaggtcaattctataatcaacgtctcattgcagttgaagctagttagaggctcttacgaagatttcaacatttccaaatcgtttactaatggccagctcgctaattacaggccaggaataaatactatactggataacacgtctgaactatctagccccacatcaacaacaaaccagatgtcacccaagaatacattctccaattttaacggtattggaacaactgtagcgaaacccggtacaaatgcgacaggaaacagcacaagtattaaatcaccgacttctaccaaccacaagagtagcgaaatgacaacaaagccagggctgtcaacaacaatatcttcctctatgagcccactgattgagagcttgtaccagaaaacgtttaaattaccgtgggatcctcgaccaggtgaatttacgccaagagaatgcgtggaagatattttacaaggcggaaacggttgggctaagaacgagaagggcataaatttaatcgatttacaggcattgagattgaacgaaatggaagaagagtactacaatccaaattatggcaataaccttgggaacaaggcaagtagttggcctccaaatccaagcgatgacggctacagcacaatgggcaaaagagagtatttggagaaaaagcagaattggagtcatatgtcacgagcacaacgtgcaaaactgaggactcataatgacgaggataacgaaaatacggctaatgataaagggagcgacaaggataataactctgtcgaagacaataaccccacggactttttaacagatagaataagagaaaacaaaaactggtctataataaccccatcgggctag

SEQ ID NO: 3311 - DNA, 1401 bp, Saccharomyces cerevisiae
atgtctagtactcaagtaggaaatgctctatctagttccactactactttagtggacttgtctaattctacggttacccaaaagaagcaatattataaagatggcgagacgctgcacaatcttttgcttgaactaaagaataaccaagatttggaacttttaccgcatgaacaagcgcatcctaaaatatttcaagcgctcaaggctcgtattggtagaattaataatgaaacgtgcgaccccggtgaggagaactcgtttttcatatgcgatttgggagaagtcaagagattattcaacaactgggtgaaggagcttcctagaattaagccattttatgccgtcaaatgtaatcctgataccaaggttttgtcattattagcagagttgggcgttaatttcgattgcgcttccaaagtggaaattgacagagtattatcgatgaacatctcgccggatagaattgtttacgctaatccttgtaaagtagcatctttcattagatatgcagcttcaaaaaatgtaatgaagtctacttttgacaatgtagaagaattgcataaaatcaaaaagtttcatcctgagtctcagttgttattaagaatcgctaccgatgactctaccgctcaatgtcgactttccaccaaatatggctgtgaaatggaaaacgtagacgttttattaaaggctataaaggaactaggtttaaacctggctggtgtttctttccacgtcggttcaggcgcttctgattttacaagcttatacaaagccgttagagatgcaagaacggtatttgacaaagctgctaacgaatacgggttgccccctttgaagattttggatgtaggtggtggatttcaatttgaatccttcaaagaatcaactgctgttttgcgtctagcgctagaggaatttttccctgtaggttgtggtgttgatataattgcagagcctggcagatactttgtagctacagcgttcactttggcatctcatgtgattgcgaagagaaaactgtctgagaatgaagcaatgatttacactaacgatggtgtatacgggaacatgaattgtattttattcgatcatcaagagccccatccaagaaccctttatcataatttggaatttcattacgacgattttgaatccactactgcggtcctcgactctatcaacaaaacaagatctgagtatccatataaagtttccatctggggacccacatgtgatggtttggattgtattgccaaagagtattacatgaagcatgatgttatagtcggtgattggttttattttcctgccctgggtgcctacacatcatcggcggctactcaattcaacggctttgagcagactgcggatatagtatacatagactctgaactcgattga

SEQ ID NO: 3312 - DNA, 1403 bp, Saccharomyces cerevisiae
atgtacgagtactgctcagttgtaataaagaaatactccaagtatacaattccctccttcgctccaaatggttttcaatcaatgcttgagcctcctcagatagacaagtggcaacacctttccgctaactgcactctccaatttcgggttcttctaatggactctagacaaattctgatcaatgtggttctcaataattcaacacttctcgaaaatattcgcctgccgctgggggataatcaagatttaatacaattttcatgtaaaagccccataatctcttgtaaatatatctccgaagaattcggacccagaatgttaaggaggtttcagatgaatttgccaaatgacgttgagttcaacaggactgtagtttctttaaagaaccttaattttgttttaaggacagctaggacatcaatagcccagagtacaataacaagccaggtgcaaggcaataataacggtacaaaggtctgtttcacagaaggtccaaaagttagtagctacacaaatccgaacacgcaatttcaaactcaaaacatgattatggatttcagtcaacgttatcaggaagaatctgaaagagagtcaaataatcgttcaaatataactttaccacacgacagcattcaaatagctcaacaaatatggccaaacacggatttaaatgtagtacaatcttcacaagacctcaacactccaatggctacgcaaactgttttgggtcgtcctgagtcgctaattgtacagccattggaggtttctcaatctccaccaaacactaccaactgccttcctaatgcagaaaacaaaaagaaaaaagtcgacaccacttctgattttacttcaagaaaggagattgctctgtgtaaaactggtttattagaaactattcatataccaaaggaaagggaaagtcagatgcaaagcgtcactggtttagatgcaacaccaacgattatatggagccccgggaaagacaacacggcgaagaaaaataccagtaataagaaaaatattgatgataaactaacaaacccccaaaaatctggaaatacacatacccctgatagaaataaagaagtgctacctaacggcacacttaatgaaacgaggaaagaagcatcgccaagcgaaggattaacgataagagttaaaaacgttaatcggaatgcgtcaagaaaaatatctaagcggctaatcaaggaaaagttgaaagacgaagaattcatgaaatgggtatgtatgcatttgcaagaaactgagctgtttccccctcttatccactcattttctctgacttgacaaagaaatactaactaacaacttttgccactacaaatatgaatgaaaaggttaataaggttgaaacggttctcaataaaatgttcgaaaagtga

SEQ ID NO: 3313 - DNA, 1404 bp, Saccharomyces cerevisiae
atgttgaagtcagccgtttattcaattttagccgcttctttggttaatgcaggtaccatacccctcggaaagttatctgacattgacaaaatcggaactcaaacggaaattttcccatttttgggtggttctgggccatactactctttccctggtgattatggtatttctcgtgatttgccggaaagttgtgaaatgaagcaagtgcaaatggttggtagacacggtgaaagataccccactgtcagcaaagccaaaagtatcatgacaacgtggtacaaattgagtaactataccggtcaattcagcggagcattgtctttcttgaacgatgactacgaatttttcattcgtgacaccaaaaacctagaaatggaaaccacacttgccaattcggtcaatgttttgaacccatataccggtgagatgaatgctaagagacacgctcgtgatttcttggcgcaatatggctacatggtcgaaaaccaaaccagttttgccgtttttacgtctaactcgaacagatgtcatgatactgcccagtatttcattgacggtttgggtgataaattcaacatatccttgcaaaccatcagtgaagccgagtctgctggtgccaatactctgagtgcccaccattcgtgtcctgcttgggacgatgatgtcaacgatgacattttgaaaaaatatgataccaaatatttgagtggtattgccaagagattaaacaaggaaaacaagggtttgaatctgacttcaagtgatgcaaacactttttttgcatggtgtgcatatgaaataaacgctagaggttacagtgacatctgtaacatcttcaccaaagatgaattggtccgtttctcctacggccaagacttggaaacttattatcaaacgggaccaggctatgacgtcgtcagatccgtcggtgccaacttgttcaacgcttcagtgaaactactaaaggaaagtgaggtccaggaccaaaaggtttggttgagtttcacccacgataccgatattctgaactatttgaccactatcggcataatcgatgaccaaaataacttgaccgccgaacatgttccattcatggaaaacactttccacagatcctggtacgttccacaaggtgctcgtgtttacactgaaaagttccagtgttccaatgacacctatgttagatacgtcatcaacgatgctgtcgttccaattgaaacctgttctactggtccagggttctcttgtgaaataaatgacttctacggctatgctgaaaagagagtagccggtactgacttcctaaaggtctgtaacgtcagcagcgtcagtaactctactgaattgacctttttctgggactggaataccaagcactacaacgacactttattaaaacagtaa

SEQ ID NO: 3314 - DNA, 1404 bp, Saccharomyces cerevisiae
atgcaattcgctgggaagaaaactgatcaagtgaccacatctaatccgggctttgaagaagaagaagaagaagaagaagaactacaacaagattggtcgcaactcgcatcgctcgttagcaaaaatgctgctctttcacttccaaagaggggtgaaaaagactatgaaccagatgggactaatttgcaagatctgcttctctataatgcaagtaaagccatgtttgataccatatcagactcaataagaggcacaacagtaaaatctgaagtaagaggatactatgttccccataaacatcaagccgttctacttaaacccaaaggcagctttatgcaaacgatgggaagggctgatagcacaggcgaactctggcttgacttccatgagtttgtttatttggcagagagaggcactattcttccttattatagattagaagcaggctctaacaaaagctcaaagcacgaaacagagattttactcagtatggaggatttgtattcgctgttttcatcgcaacaggaaatggaccaatattttgtgtttgctcatttaaaaaggttgggttttattctaaaacccagcaatcaagaagcagcagtcaagacttcctttttcccattgaaaaagcaacgaagtaatttacaagcaatcacttggagattactttcattgtttaaaatacaagagttatcgctgtttagtggtttcttctattctaagtggaattttttttttcgtaaatatacgacttcaccacagttataccagggtttaaataggcttgttcgttccgtggctgtaccaaagaataaaaaagagctattggatgcacaatctgatagggaatttcaaaaggtaaaggatattcccttgacatttaaagtatggaaaccccattctaatttcaagaaaagagaccccggtcttcctgatttccaagttttcgtttacaataaaaatgacgatcttcagcattttcctacctataaagagctgcgatctatgttttcctcacttgattataaattcgaatttttaagcgaaatcgaggatgatgacgattgggagacaaactcctacgttgaagatatcccacgaaaggaatatattcataagaggagcgcgaaatctcaaactgaaaaaagtgagtcgtctatgaaagcaagttttcaaaaaaaaactgcacagtctagcacgaaaaagaagagaaaggcgtacccacctcacatacagcaaaatcgtagattgaagacgggatatcggagctttattatcgctattatggataatggccttatttcgtttgtaaaaatgtccgaggctgattttggatctgaaagtgtatggtatacacctaatactcaaaagaaagtagatcaaagatggaagaagcattaa

SEQ ID NO: 3315 - DNA, 1404 bp, Saccharomyces cerevisiae
atgcattgcgtactagcgcgaatattgttatggttcttaatagtagatctaagcgtcatacgggcgcttgtccttccaccattgaaagattatgatccgttagagcctttgatgaaaagagacatggccatgggtcaacggaacagattcaaagtcgacggccaattgccgcccatactaaattccacagatgtgacagatgatcagagaagtctgcatacgcctggagagattccatcttatgtcatcaatcattgtcccttagtgcacttgtatagcgaagagaaatattggccatcggacattgctgagtacgttcaaaacttccaaattaaagataaaaacggcaattctatatccactcatgaaaatttgacactgcatgacttgaaggcggaataccacgtagatttatttggcaacaaaacggaaacgcatatccccagtagcgaggtatttttaaccagtttggacgatttcgacaaggaccctaaatggttgctcggtcatctacccgaatacggaacaggctacaactctaaggcgcctgctattctgatcgtagtcgacaaggggaacgggtgggttgatgcgttctggtttttcttctacccattcaatcatggcccttttattatgggccatggaccctggggcaatcacgtcggtgactgggaacactctttggttcggttttataaaggtattccaaaatatctttggatgagtgcgcattccagtggaacaggctacagatacgaagctgttgagaaatttaagaaactacggaaaagaaaacagcaagatagtgacgatggtggggatactatactggaaagaccgttgatttttagtgctagaggcacgcatgctaattatgcatccgctgggcagcatgctcatgacattcctttttttttcatgcctttgagtgattttaccgatcgtggtcccctgtgggatccatctttgaacttttactcctatacttttgatggtaaaactgtgacaccctcctcagagagagaagaatctctcggtttggattggttgcattttcaaggtggatggggtgatcaacaactaccagctagagatccaagacagaaatggtgcgtagctcaatggaagtatatcggaggtcctcgtggccccctgtttaagaaattggatagattgaatctatgcggcggtgtgaaaaagtggaatttctggaatggtggctgccccgcaagaagattgataaaaaaagcagaaggcttggactctgagagcactgatcttatgggtgataattgtggtgtcctactctatagaatcagaccaaaatggctgagaggaattctaagatttctaatgtggagaggtatactctgttctcttatggaatttttcaccaattga

SEQ ID NO: 3316 - DNA, 1404 bp, Saccharomyces cerevisiae
atgccaccaaaagaagactgggaaaaatacaaggcacctttggaagacgatgataaaaaacctgatgatgacaagatcgtacccttaacagaaggtgacattcaagtcttaaaatcatacggtgcagctccatacgcagccaaattaaagcaaactgagaatgacttaaaagacattgaagcgagaatcaaagaaaaggccggtgtgaaagaaagcgatacagggttagcaccctcccatctatgggatattatgggtgataggcagagactgggcgaagaacatcccttacaagtcgctcgttgcacgaagatcattaaggggaatggtgaaagtgacgaaactacgacagataataataacagcggcaatagcaatagtaatagcaatcaacagtctactgatgcagacgaagacgatgaagatgccaagtacgtgataaatcttaagcaaattgccaaatttgtcgtcggattaggtgaacgtgtttctccaacagatatagaagaaggtatgcgtgtaggtgtcgataggtcgaaatataatattgaacttccattgcctccaaggattgacccatcagttactatgatgaccgttgaagaaaagcctgacgttacttatagcgatgtcggtggctgtaaagaccaaattgaaaagctgagagaagttgtcgagctgcccttattatctccagaaagatttgctactcttggtattgatccaccaaagggtatcttattatatgggccacctggtactggtaagacattatgtgctcgtgctgttgctaatagaactgatgcaacttttattagggtcattgggtctgagctagtgcaaaaatatgtcggtgaaggtgctcgtatggttagagaattatttgaaatggctcgtaccaaaaaggcttgcattatattcttcgatgaaatcgacgctgttggtggtgctcgttttgatgatggtgctggtggtgataatgaagttcaaagaactatgttagaactgattacacagttagacgggtttgaccctcgtggtaacattaaagtgatgtttgccaccaataggcccaacactttagatccagctttattgagacccggtagaattgatcgtaaggtagagttttcattacctgacttggaaggtcgtgcaaatatcttccgtattcactctaaatcaatgagtgtggaacgtggcatcagatgggaacttatctccagactgtgtccaaactctaccggtgcagaattaagatctgtttgcacagaagccggtatgtttgccattagagcaagaagaaaggtggctactgaaaaggatttcctgaaggctgttgataaagttattagcggatacaagaagtttagttccacatcgcgttatatgcaatataattga

SEQ ID NO: 3317 - DNA, 1404 bp, Saccharomyces cerevisiae
atgcgaatctcaaaaaatagtcataagcggcaaagaacgaggctatatttcctcgttacatttattatttattcgataataccctgccgtgcggtactcgtgccttggctggatgatgacccatttgaagcaacgcttctagaaatgggggatgaaccatggagtaaggacatcctttcaagcacacctccgttacatccatctgaagttaccgaggataacaaaagcttaaaacaaaggggcaatgtaccgcaatatgtcatcgataatagccctctgctccatttatatagtgaagaaaagtactggccagctgatgttaaggattttgtaaaaagattccagttgagagaccacagtggggagaaaattatcaatgaacaccttcgtgacttaagtgacttacaagagtattattcggtagagttagagaacggaacgtggggccgagtatccagtgaaggtacatatatgacaagtttagatgattttgataagggccctgactggttgttgggtgaacaaccagaatatggtacaggtcacataaagaaagcaccagcagttctttttgtcgttgacaaaggaaatggttgggtagacgcgttctggttttatttctaccccttcaattggggtccttatattatgggctccggaccatggggaaatcatgtaggggactgggaacattctttagtacgattctataaaggagaaccacaatatctatggatgagtgcgcatgggggtggtagtgcctataagttcgaagccattgagaaaatcaaaagattgcgtcgtgttgacggtaaattgacaaacgaggttattaagaagcctttaatatttagtgcaagaggcacacatgcacattatgcatcagtcggtcaacatgcgcacgatgttccgtttttctttatgccattgagtgactttactgatagagggccattatgggatccttctttaaactattatgcctatacagtgactgtgggggaaaaaatgacaccatgcggcgctgaagaaactaaaatgggactagaatggctatcgttcaaaggcgcttggggcgataaacaattaagacctagggatcccagacaaaaatggtgcccatttcaatggaaatatattgacggaccaaaaggtccactattcaaaaatatggaaagggtttctttatgccaaagatttaaatggtggaatttttggaagggctgcccggcaagaagatatataaaaagaggggaaggtttggatgcagaaaagaatgatcttgtgggtgacaattgtggtatcttgctgtacaacataaggccaaagtggctgcgtagcatactccgttttttgacgtggaggggaagcgtatgtttcattatggactactttacagggtaa

SEQ ID NO: 3318 - DNA, 1404 bp, Saccharomyces cerevisiae
atggcaatcgttaatagttggctaatttgtttagtcagtattttttccttcgtggtacgtgtagaggccgctacattttgcaatgcaactcaagcatgtcccgaagataaaccatgttgctcacaatatggtgaatgtggtactggtcaatattgtctgaacaactgtgatgtaagatattcgtttagtcatgattcatgtatgcctgtacctatctgcaagagttcatccactaaattcaaagattattcctctaagttggggaatgctaacactttcttaggaaatgttagtgaggctgattggttgtatactggtgacgttttggattatgatgatgaagaaagtttaattttggcgatgcccaagaacagtggtggtaccgttctttcctccacgagggctgtttggtatggtaaggtcagtgctagaataaagacgtcacatcttgctggtgtggtcactgggttcattctgtattccggcgcaggtgatgaacttgattacgaattcgtcggtgctgatctagaaactgctcaaaccaatttctattgggaaagtgttttgaactacacgaattctgccaatatttccactactgatacatttgaaaactaccatacttacgaattagattggcacgaagattatgtaacatggtccatcgatggtgtcgtcggtagaaccttgtacaagaacgaaacttataacgccaccacccaaaaatatcaatacccacaaaccccatccaaggtggatatttccatttggccaggtggtaattctaccaacgctccaggaaccattgcatggtctggtggtgaaattaattgggacgcatccgatatcagcaacccaggatattattatgctattgtcaatgaagttaatatcacatgttatgatccaccaagcgataccaagaagaatggtacttctgcttatgtgtatacttcgtccagtgaatttttggccaaagacattgctattaccgatgatgaggtcatgatggacagtgatgagggatctggcttggacccacataagggagctaccacatcttccacccaaaagagttcttcctcaactgcaacctcttcctccaaaacgtcatccgatcacagcagttcaactaagaagagtagtaagactagttccaccgcttcatcatcatcatcatcatcttcttcttcttcttcttcttcctctactgctactaagaacggagataaagtcgtatcctccgtatcctcttccgtcacttcccaaactcaaacaacatcttctgtaagcggaagcgcctccagcagtacaagctcaatgagcggtaataacgcaggtgccaacgtagcggcaaactggcgtttgactgttttatgtgtcatcctaggttatgtcttatag

SEQ ID NO: 3319 - DNA, 1404 bp, Saccharomyces cerevisiae
atggcgaaaagcaaatccagtcagggtgcgagtggagcacgccgtaaaccggcaccttctttataccaacacatttctagctttaaaccacaattcagcacaagagtcgacgatgttttacattttagcaagacactgacatggagaagtgagattattccagacaaatccaagggcaccttgacgactagtcttttatattctcaaggtagtgatatttacgaaatagacactactttaccattaaagacattctatgacgacgacgacgacgacgacaacgacgacgacgacgaagaaggtaacggcaagacgaagtctgcagccaccccaaatccagagtatggtgatgctttccaagatgttgaggggaaaccattgcgcccaaagtggatttaccagggcgaaacagtggcaaaaatgcaatacttggaaagctcagacgacagtacggcgatcgcgatgtccaagaacggctctttggcatggttcagagatgagatcaaggttcccgttcatatcgtacaggaaatgatgggccctgctactagatactctagtattcactctctaaccagaccaggttcattagcagtgtcagattttgatgtgtcgacaaatatggatacggtagtaaagtcacaaagtaacggctacgaggaggacagcatcttgaaaatcatcgacaactccgatagaccgggagatatattacgtacagtgcacgttccagggaccaacgtggctcactcagttagattttttaacaaccatttatttgcatcttgttcagatgacaacattttaagattctgggacacaagaacagcggacaaaccgctttggacgctaagcgaaccgaaaaatggacgactaacgtccttcgattcctctcaagttactgaaaacctatttgtcactgggttcagcacgggtgtcatcaagctatgggatgcgcgtgctgtgcaactggctactactgacctcacacataggcagaacggcgaggaaccgatccaaaacgaaatagccaagttgttccattctggcggcgattccgttgtcgatatcctgttctcacaaacctctgcaacagaatttgttacggttggaggaacgggtaatgtctaccactgggacatggagtactctttttcaagaaacgacgatgacaacgaagacgaagttcgagtggctgctccggaggaacttcagggtcaatgtttaaaatttttccacacaggtggcacaagaagatcgagcaaccaattcgggaagaggaacactgtggcgctacaccccgtaatcaatgattttgttggcactgttgattcagatagtcttgttactgcctacaaaccatttctggccagtgacttcattggcagaggttacgacgattaa

SEQ ID NO: 3320 - DNA, 1404 bp, Saccharomyces cerevisiae
atgttgcttagtgcgcctgttaacagtaccgtgcggcgcaagccacacagtccaaataaaaaaaagccaaaagagacaggtacagctgcttccttttcgtcgtcctcttcaactgtcgtcctttcatccaataatgatggcagctttgatgctctttgggacccctctataagtaaggcctcggattttgagagtagctatattagtgctaaacgattaaaaccagaaagtagtaatagacagaaaaaaaaaaattcttataaatattctagggaggaaaacaccaacgaggtagaggaaaagacgtctcttggcagcagctctaagacagaagcagataatatatttaatgaccagctcacgtcagctggcaatactacatatgtcagtaataagcgcgatgtaaacttcggggcgaattcggctgtagtactgctcggtttgccaacaagtaaaagtgaatctcaccgacaataccacagtccttcggcttcaacaactaatgaagatgaagaggacattggtgttgatattttagtagacaaccacatcgatagttgcgaaacagtatcgataaataataatagaggtattacacaccaatatccagaaacggaatcagatgtcgactttgatgaggccgtgatattgacaccaatggatggtacggataagggagtgaaaaatccaagaccactcgaaaaaaaatatagtagcagttgttttgaggaccgtacgccccttaacttggatgatggtcatttcagtgaatgcaatcatttttctacattagatgtgtctagcttttttcatctcaacgagcatgtgcataaaatcgacgaagtagagctcgatggacctgatcgcacctttagtctagacaacgtcgctattaatacaaggaaaaaggatattgattgcctctataatagttcaagagaagacttatccaacctcacatgttcttcggaaggcccaaggaatgatagttatgatagtgattacaacattgatgaggtcacttatagagatgatgaatcaacagatgaagacgagagcttaccaaccccagatcgaaaaaggaagaaaattggccataaagcttgcgaaatattggattctaaaagaattggaataaaagtaccaaagttatacgtttggtctttaagtgataaaccgtttagtgttatcgatgggttgtgcacaaaatcgctgtacccattgagtgatgacataaatactcctgaaagtttgagctcatgctcaagctcagtaagttcacgggaaaatcaaaaaggagatgcaacatttgataatgatgctatgatagccgaccttctaaacataggcggactcgaagtagagaaggcatccaatggccatattgagctcataggcgagtga

SEQ ID NO: 3321 - DNA, 1404 bp, Saccharomyces cerevisiae
atgtttaaatctgttgtttattcaattttagccgcttctttggccaatgcaggtaccattcccttaggcaaactagccgatgtcgacaagattggtacccaaaaagatatcttcccatttttgggtggtgccggaccatactactctttccctggcgactatggtatttctcgtgatttgcctgaaggttgtgaaatgaagcaactgcaaatggttggtagacatggtgaaagataccctactgtcagtctggctaagactatcaagagtacatggtataagttgagcaattacactcgtcaattcaacggctcattgtcattcttgaacgatgattacgagtttttcatccgtgatgacgatgatttggaaatggaaaccacttttgccaactcggacgatgttttgaacccatacactggtgaaatgaacgccaagagacatgctcgtgacttcttggctcaatacggttacatggtcgaaaaccaaaccagtttcgccgtttttacctctaattctaagagatgtcatgacactgctcaatatttcattgatggtttaggtgaccaattcaacatcaccttgcagactgtcagtgaagctgaatccgctggtgccaacactttgagtgcttgtaactcatgtcctgcttgggactacgatgccaatgatgacattgtaaatgaatacgacacaacctacttggatgacattgccaagagattgaacaaggaaaacaagggtttgaacttgacctcaactgacgctagtactttattctcgtggtgtgcatttgaagtgaacgctaaaggttacagtgatgtctgtgatattttcaccaaggatgaattagtccattactcctactaccaagacttgcacacttattaccatgagggtccaggttacgacattatcaagtctgtcggttccaacttgttcaatgcctcagtcaaattattaaagcaaagtgagattcaagaccaaaaggtttggttgagttttacccacgataccgatatcctaaactttttgaccaccgctggtataattgacgacaaaaacaacttaactgccgaatacgttccattcatgggcaacactttccacagatcctggtacgttcctcaaggtgctcgtgtctacaccgaaaaattccaatgttctaacgacacctacgtcagatacgtcattaacgatgctgttgttccaattgaaacctgttccactggtccagggttctcttgtgaaatcaatgacttctacgactatgctgaaaagagagtagccggtactgacttcctaaaggtctgtaacgtcagcagcgtcagtaactctactgaattgaccttctactgggactggaacactactcattacaacgccagtctattgagacaatag

SEQ ID NO: 3322 - DNA, 1404 bp, Saccharomyces cerevisiae
atgtttaagtctgttgtttattcggttctagccgctgctttagttaatgcaggtacaattcccctcggagagttagccgatgttgccaaaattggcactcaggaagacatattcccattcctgggtggtgccgggccatacttctctttccctggcgactatggtatttctcgtgacttgcctgaaggttgtgaaatgaaacaattgcaaatgcttgccagacatggtgaaagatacccaacttacagtaaaggtgctaccatcatgaaaacatggtataagttgagcaattacacacgtcaattcaacggctcattgtcattcttgaacgatgattacgagtttttcatccgtgatgacgatgatttggaaatggaaaccacttttgccaactcagacaatgttttgaatccatacactggtgagatggatgctaagagacatgctcgtgagtttttagcgcaatatggctacatgttcgaaaatcaaaccagtttcccaattttcgccgctagttctgaaagggttcatgacactgctcaatatttcattgatggtttaggtgaccaattcaacatctccttgcagactgtcagtgaagccatgtccgccggcgcaaacactttgagtgctggtaatgcgtgcccaggatgggatgaagatgctaacgatgacattttggacaaatacgataccacatacttggatgacattgccaagagattaaacaaagaaaacaagggtttgaatttgacctcaaaggacgccaacactttgtttgcatggtgtgcatacgaattgaacgctagaggctacagtgatgtttgtgatatcttcaccgaagatgaattggtacgttactcatacggccaggacctggtatcgttttaccaggatggaccaggttatgatatgatcagatccgtcggtgccaacttgtttaacgctactttgaagttgttaaagcaaagtgaaactcaagacttaaaagtctggttgagttttacccacgataccgatatcctaaactatttgaccaccgctggtataattgacgacaaaaacaacttaactgccgaatacgttccattcatgggcaacaccttccataagtcctggtacgttcctcaaggtgctcgtgtctacaccgaaaaattccaatgttctaacgacacctacgtcagatacgtcattaacgatgctgtcgttccaattgaaacctgttccaccggcccagggttctcttgtgaaatcaatgatttctacgactatgctgaaaagagagtagctggtactgacttcctaaaggtctgtaacgtcagcagtgtcagtaacgtcaccgaattgaccttctactgggactggaatactactcactacaacgataccctattaaaacaataa

SEQ ID NO: 3323 - DNA, 1407 bp, Saccharomyces cerevisiae
atgaatcttaaactttctgctattgaaagttactttttccatagaagcagactaaatttgcattcatgtttttatgtcggaatcaaactcaacgaattgcccaaaaaaagtcaactgatagcggctcttaagtatactgtaatccaacatgaacgtttgacttgtaatgtattctatgatgaattgaaaaaggaaaacttcctacaaaacattcttgagccactgaaattttgcgatctagtagaataccgccacgattgggaccagttaggggaaaccgaaattaaccacatctttcaaaggtataacttttcatacaacgagaataaacctttatggaaaattctgatcctccctaatcaaaatcaaatgctattgctgacagatcatgttctcatggatgggatgtccgctattcatgtgtgggaaacgtttatggaaggcctacagatgcaacagccggttgaaattgatgaaacaatatattcaccatcattaaattcatcaactgaaaaaataatgtcagccccactatacggagattggcccataccttggaattggcatatagtgcgacaattggtcagtagactacattattggtttccacaaacagtcgtaaaaaacaatagaaatttaatccaatttgccaactactcatttccaaaagacctgctggatgataaaccgagcgatggaactcaaaaatacaaagttaaaaacacgaaccatcaatgggagtttcgattatcgccgacccatctcaacgacattttacaagaatgcaaggccaataatacttcgttgacttcccttttaggtgccctggtctgcaccagtttcgaaaaaatagctgcacatgagtataccggatcatttttgaaaattgaattaccaatgaatattagaaagccttttgaacgagtcttgaaattaccttcagatgataagctcgccgtgggaaattttattgcggtcatagaattcaaccataaactacatcaaaaccgtggaatatgggatatcgcttctcaaattcaaagggccataagaagcagttccgaggataaaataatagataaagtaaacgaagtaaagttattggaggttatttcttctcaacaatacatagaagataaaattagcttgaataacggaccttcttccacatttgaagtaacaaacttaggatttcaaacatttaaagatgcatgcaacaccagtttaccgttttatatagtggatgctacattcaacgagccgcaaggaatatcttcaattttctcactaagcgtaatctctactcctggtaacggactacattgttgtatcagttatccaaatactctcactaaagtgctagaaccccactggcaatatatgaaagattacttaaatttatactag

SEQ ID NO: 3324 - DNA, 1407 bp, Saccharomyces cerevisiae
atgaattttgttacctgccatgttcagatgaggcttcttctccaaaggagactagtgcgtttacgagaatcagagctgtttagaccccagacatcattgtcaactttcaaaagacatgcttcgcaaaagacacgccctatacaaaaatgctcgagaaaatacgcacgtatacttctgttgtctgttttggtaccttacacaggatatgcgttttatgtatcattggctacagtgaagcaaattgatttaagaaacgaaatgtgtcaaagattagaggagaataataacgaggtcacttataagggatccttgctaaaatatagccctttggaagttttaggcagatttgagaacccgttcgaagaatacaggattcagaccgtttttgaattctttgcaaatagagtgttcgaattatttgaaagaaataggggaggtattccacgtgatgtacaccaaatgaataagttaatgcctgtacacaagccaacatgggggcctaacttagtggacgtcgaccccgcagaggaaacggcattgccgctagaatgcaaagtgttagacgaattgcacataccgactgcagtagaagaaaatgaaggatcaaagtgcccagtctataacacatggctgggccagtcctgtaactacacggtttataatggattgaggatacttactgatcctctgttcagtgactttcttatccacaagaccctgggtcctaaaagaattactcaaatgccatctcaaattacagaggtgcccaaaccagatatcatccttgtatcccataatcaccccgatcacctggatttagaaagcttggaatactggagtggcaaagactctcccttatggatagtacctaaaggaatgaaatcttatatgacaagtaacggctgtgataatgtcctagaattatcttggtgggaaactttgcaagtaaagaaaaacaatgagatataccacatatcggctactcctgccatgcattggtctgggagatcgctcttagatacgaacaagtctctatggtgctcctttttattaacacaccatggtaatcccatactttttcatgctggtgacactggatatgtgaaagatttattcgttagaattaaagaacgctttggcaaaggttgtaaattagcgctgcttccatgtggtcagtattgccctgagtggcaccaaaaaccacgacatattaatcctcaagaggttctcaagattatgaaagatctagaagctcgaaatgtattaggcgttcattgggggacctttgtattaagcggagaatatttcttagagccaaaggaaaaattagaaatgttggccgagtggggtgggtttaaagaccgctgctactgtccagaattgggcaagacagaatgcttcgactaa

SEQ ID NO: 3325 - DNA, 1407 bp, Saccharomyces cerevisiae
atgactttagtcaagtatgcatgcgactattgtcgtgtccgtcgagtaaagtgtgatggtaaaaaaccatgtagtcgctgtattgagcacaatttcgattgcacatatcagcaaccattaaaaaaaagaggctcaaagcctattggaactagaagcttaaagtatataccaaaggccaaaatgtttatagataataaaagttgtacggcagcggcagaaatattaatgaaggttcctaaaaaggtgattgatcagtgtttgaggctttatcacgacaatctatatgttatctggcctttactctcttatgatgaccttcacaagcttttggacgaagaatacaatgaccattacgtttattggtttctcgtagctctttcagcagccaatcttagcgatctacaaagcgaattagaatctgaggggggattttcgtttactggaaaacaattagccgttctctgtatgtcctcacgccaacaatttgatgaccttagcggcagagacattttccgaattatgacatattattgcttgctacgttgtttttcacagtcttctgatgtaagaaattcatacagactttgtcgtgaagctattggccttgttattgtagcagggttacatcgtgaaaaagcatacgaatcactatcatttcgtgagcaacagcttttacgcaaggtgtattatttgcttctcttgacggaaagatactattccgtatatgttcattgtgttacaagtttggataccacaatagctccacctcagccagagttcgtaacggaccctcgactttctttggatagcttttttgagatgattagagtatttactgtaccaggtaaatgcttttttgatgctttggctacggagtctactagcggttcttgcactgaagactcactgaaaaaaatatggaaagagcttcacacagcatcccttgaaatagaaccatggtcttatggctatgtggacatttcattttctcgacattggattagggcgctggcttggaagctagtgtttcagatgaatggtaccaagtttttctcaaacgccaataatgctcacatattggtcgaaattgcaaaggatatgctggacgacatattcttaactccaaacaacctgtatgatgtacatggtcctggaataccaatgaaatcattggaagtagccaatgcattggtagatatcgtaaataagtatgatcacaatatgaagttggaggcttggaatattttgtgcgatgtatccaagttcgttttctccctgaaacattgcaatcataaaatgtttcaaaggttttcaactaaatgtcagagtgctctaatcgatttgcctatctctagaccactgcgcctaaatgatgattccaaagatgaagacgacataattccttaa

SEQ ID NO: 3326 - DNA, 1407 bp, Saccharomyces cerevisiae
atggaagcttcacatttgcaaatctactggcatgattcacaacccgtttactcgctcacattccaaaagaacagtgcgaacgacaagcttttcaccgctggtggtgataacaaggttaggatatggaagttgaacagagatgaaaacggacaaaatgggggggtgcgtaagattgaaagccttgactttcttggctcgctgacgcatcacgaacaggccataaatgtaatccgattcaactcgaagggtgacgtactggcgtctgcgggcgatgacggccaagtgctgctatggaagcaagaagatccaaatacacagcaagaatctgtggtcagaccattcggaatggatgcggagactagtgaagcagacgagaacaaggagaaatgggttgtgtggaaacggctgcgtggtggtagcggtgctactgcggcggcagagatttacgatctagcgtggtcacctgataacaggaacatagtggtggcatgtatggacaattcgatacgactgttcgatgttggagctgggatgctggtatgcggccagtcggatcatggtcactacgtccaaggtgttgcatgggacccattaaatcagtttattctctcacagtctgcggaccggtctctgcatgtatatggagtcattctttcatctgcaggagtggttacagggctgaaacttagaagtaagattgccaaggcagaactgccttgtccaggtgatgtcctgaggacaaattacctttttcacaacgagacgctaccttcattctttaggcgatgcagcatatcgccttgtggtggtttggtcgtaattcccagtggtgtgtataaggtggctggtgatgaagtcgcgaactgcgtatacgtgtatactagatctggaatactgaacagcgctggtggcgttaaaaaccggcctgcgattagaatcccatctttgaagaaaccagcgctgatggcggctttctcgcccgtattttacgaaacgtgccagaagagtgtgcttaagctgccctataagctagtatttgccatagcaacgactaacgaagtactcgtgtacgacacggatgtattggagccgttatgcgttgtgggaaatatacattactcacccataactgatttagcatggtctgaggatggctcgaccctactaatctcatcaacagacggattctgttcgtatgtatcgatcgacacagaaacgcaattcggttcaaggatagagccgccagcgatgcatgcagagccactagacactgacgagagcgcggtagcggctaagaaccagcgcgaggcaggtgggatcgtgaacatgctgccggtgaagaagatcccctgcaatagtagcgatagtaaaaagaggcgcatacatcctacgccagtcgatttgtga

SEQ ID NO: 3327 - DNA, 1407 bp, Saccharomyces cerevisiae
atgggtcaaatattgtccaatccaattatcgacaaagagcatcattctggtacggactgtttgacagcgtttggactatgtgccatgcaaggctggcgtatgtccatggaagatgcccatattgttgagccgaaccttttggctgagtctgacgaggaacatctcgcattttatggtatatttgacggtcatggtggttcttctgtagcggagttttgtggctctaaaatgatatctatactgaaaaaacaggagagcttcaagagcggtatgttagagcagtgcttaatagatacctttttagctacagatgttgagttgttgaaagatgaaaaattaaaagatgaccatagtggttgtacagcaactgtgatattggtatctcaattgaaaaagctactaatttgcgccaattccggtgatagtagaacagttctatctactggtggtaatagtaaagcaatgtcatttgatcataagcccacattgttaagtgaaaaatctcgtattgtagctgctgatggttttgttgagatggaccgtgttaatggaaatttagcgttatcaagagccataggtgattttgaattcaaatctaacacaaaattgggacctcatgagcaagtcgttacatgtgttcctgatatcatttgtcacaatttgaattatgatgaggatgaatttgttattttagcatgtgatggtatttgggattgtttaacttctcaagagtgtgttgacttggttcactacggtataagtcaaggtaatatgacgttgagcgacatttcatctagaatcgtagatgtttgttgttcacccacaactgaaggctcaggaattggctgtgataatatgagtatttccattgttgctttactaaaggaaaatgaatctgagtcacaatggtttgagcgtatgagatcaaaaaattacaatatccaaacgtcttttgtccaaagaaggaaaagtatttttgatttccatgatttttcggatgatgataacgaagtgttcgcaataaccaccaaaaaattacaagaccgcttgaatcgtagtaaagataatgacgacatggaaattgatgatcttgataccgaattaggcagcagtgctactccctcaaagttatcaggtgaggatagaactggccctattgacttgttttcgttggaggctctattagaagccgggattcaaataaggcagaggcccagctccgacagtgacggcaacacttcttatttccatggtgcttctttatcagatatgttggcatctttaagcaatgcggctgcaggagaaacagaacctaatgatgctgatgataacgatgataacgacggcgaagaaaacggcaagaatgaaaatgcgaagaagggttccaagattgaagaaattgaataa

SEQ ID NO: 3328 - DNA, 1407 bp, Saccharomyces cerevisiae
atggtgaagcccgttatttttgccatttgtttaggtgttctattatctaaggcactctccatcccactcagaagttttgcggatattgaactaattggctctcagaagagtctgtttccctttcttggagggtctgcgccatatttctcctttcccgctaactacggtatacccactgatattcctgaaggttgtagattaacgcaagttcaaatgattggcagacatggcgaaaggtatcctaccagaagtgaggccaaggatatttttgaagtatggtataaaatatccaattacacaggtaagtacgagggatcattatcgtttttgaataatggatatgaattttttattcccgatgaaagtcttctagaaatggagacaactttgcaaaattcgattgatgtgttgaacccgtatacaggagaaatgaatgcaaagagacatgcaagggagtttttagcaaaatatggaaaattgatggagaactgtaccaactttcctatcttcaccacaaattcgaaaagaatctacgatactgcgcaatattttgccgaggctttgggcgatggctttaatatatcacttcaaacacttagcgaaaattcctcgtcaggagcaaacacattagctgccaaaagttcgtgccccaattggaattcgaatgccaacaatgatatattaatgtcatattcgagggactacttagaaaatatttccgatcgtcttaatgacgaaaataaagggctgaacttgagcaggaaagatgcagcggccttgttttcttggtgtgccttcgagttgaacgcaaaaggttatagtaacatttgtgacattttctccgcggcagagttaatacattattcttatgagactgatttgacgagcttctaccaaaatggtcccggatacaaattgattaaatctataggtgctaatttgttcaatgcaacagtgaagctaatacgacaaagtgcgcacttggaccaaaaagtttggctgagctttacgcacgatactgatattctaaattatttgacaactgctggattgattgatgacactagaaatttaacaaccaatcatgttccctttcgtgatcattcctaccacaggtcgtggtacattcctcagggagctagagtctacacagaaaagtttcaatgctcaaacgattcgtacgtccgttatgtggtcaacgatgctgtggttcctatagagagttgctccagtggtccaggtttttcatgtgaagagggcacattttacgagtatgccaaagacagattacgaggtgtgagcttctatgaagattgcgacgtctccaaagttagcaaagaaaaggaattgacgttttactgggattggaacacaacaaggtataacgcatccttagtgaatcaataa

SEQ ID NO: 3329 - DNA, 1407 bp, Saccharomyces cerevisiae
atgttactgaatactacttatactgtcttcattttttttttgcttagaattataaagttcaagatcaaggccgaaaattttttagaacatgaaaaattgaaaactcatggtacctcatctcgaaaagatcctaagggccaagtcaagaattcgtgtagaaaaatgagtgctataggcgacaagaaccaatttcgtatcattgtgggctcatacgagcacaacattttgtgtttatccttagatatcccaaatcaaaaggaaaatgatgcagcaaagacaccacattttatgccaatatttcattttcaagcccattcgttgagtattaaatgtttggctgtttcaagaagatacctagtttctggatccaatgacgagcacatcagaatttatgatttgcaaaagaggaaggaactgggtactttgttaagtcatcagggctctattactgctctacaattctcacatccagcttcttccagtgaggatgctgctgtttcaaaggggagcaagaatagcaaatggttattatcagcatcagaagaccacaaaattatggtttggagagtaaaggactgggaaacagtggggactttaaagggacacacggcaagggttaatgatgtggatattcaccccaccaatagaattgccatcagtgttagtgatgaccattctatacgtctttggaatttgatgactctaagaaatgctgctgtactaaaactaagaaaatataatacaaacgggacttgtgttagatggttaggcgccaaaggtgattattttgccgtgggtttaagggatagggtgcttatttatgaaactggatcggctaaagtttttaaagaaatagtctttcaaaggaaaactcttatgcatattgaaacacatattttaccattcgataataaggaatacctttctgttggtatcagcgatggtaatgttcatttctatccttgtgaggagttattcgaaaaagttgaagaaaatgaaaagcaggaagatgatgacgacaaggaggatatcagccccgctttttctttattgggtcacacaaaccgtattaaagatttcaagttttatacgaatgaatttggtacctacctagtcaccattggttctgatggtaaaattgtcgtatgggatatgtctacaaaagaacaagtagcagtctacgactgtggcgaaaggctaaattgcttaacgctatgcgatgaaagcattgagaaatacaacacaatgaagaagagggatgctgaaacagctgatataggtgaccaaagtgaggtggaaagtgataccgaagaattaaagaagataatgtttggtgagaagaagaaactcaataaaaagaagcggaagcaattgaagaagagtaaagtatcagtagaacttgaataa

SEQ ID NO: 3330 - DNA, 1410 bp, Saccharomyces cerevisiae
atgacaagcattgacattaacaacttacaaaatacctttcaacaagctatgaatatgagcggctccccaggcgctgtttgtacttcacctacgcaatctttcatgaataccgttccacagcgcttgaatgctgtaaagcacccaaaaattttgaagcctttctcaacgggtgatatgaagattttactattagaaaacgttaatcaaactgctattacaatcttcgaagagcaaggttaccaagtcgaattctataaatcttcattgcccgaggaagagttgatcgaaaagatcaaggacgttcatgctattggtatcagatcaaagactagattaacttcaaatgtcttacaacatgcgaagaatctggtttgtattggttgtttctgtatcggtaccaaccaagttgacttagactacgctaccagcagaggtattgctgttttcaactcgcctttctccaactcaagatcagtagcagaattggtcatcgctgaaatcattagtttagcaagacaactaggtgatagatctatcgaattacataccggtacatggaataaggttgctgctagatgttgggaggtaagaggaaaaactcttggtattattgggtacggtcacattggttcccaattatcagttcttgcagaagctatgggtttgcatgtgttgtactacgatattgtaactatcatggccttgggtactgccagacaagtttctacattagatgaattgttgaataaatctgattttgtgacactacatgtaccagctactcctgaaactgaaaaaatgttatctgccccacaatttgctgctatgaaggatggcgcttatgttattaatgcttcaagaggtactgtcgtggacattccatctttgatccaagccgtgaaagccaacaaaattgcaggtgctgctttggatgtttatccacatgaaccagctaagaacggtgaaggttcatttaacgatgagctaaatagctggacttctgaattagtttcattaccaaatatcatcttgacaccacacattggtggctctaccgaagaagcccaaagctcaatcggtattgaagtggctaccgcattgtccaaatacatcaatgaaggtaactctgtcggttcagtcaacttcccagaagtggcattgaaatcattgtcttacgaccaagagaacactgtgcgtgtgttatacattcaccaaaatgtaccaggtgttttgaagaccgtcaatgatattttatcgaaccataacatcgaaaagcaattttccgattcaaatggtgaaattgcttatttaatggctgatatctcttctgttgaccaaagcgatattaaagatatttatgaacaactaaatcaaacctctgctaagatctcaattagattgctatattaa

SEQ ID NO: 3331 - DNA, 1410 bp, Saccharomyces cerevisiae
atgcccccaagaaatacctatgaaaaaggtaatccgaaacgccaaaatagtccatattataagccaagtttcttacggcgtgaagaaactaccaatgatgaggagaagtttcagggccatggtctgaaaaccgaacttcactcagcgttaaagtcttcaaatttgaatcttatccgaagaacttatcaaactggtgaaaatccctatcttagtgatccacacgatcgaggctcatcgagcagatttaacaggcgttatgaacggggtctgaagttttaccaaaagggagaaatcagtaaaagaattgcccaagaaagaacattacaaaaacagcaggaggaggaagaattaaaaagaaagttaaaacaagaagaagacgagaaagataaaagaaaattaattgagtcaggtgatttacccaatttagagttacatgaggataagttcctattagatttgtcaaagttcaagatatactatgataataatcatggctatgaatggtgggacacggcttatttagatgaaaagggtgagttgatggaaaaatatgacatgaatggcacatcgcctgccgaagaaaagctagcagaagatattgatgaagtagacgatgatgatgatgatgagcacccatctataagatatgtagcacatcccttacctgaaaagatcaacgaggcaaaagtatcaatcaaagcatatctaacgcaacatgaaaggaaaagattaaggagaaatagaaggaaaatggcaagagaagcacgggagataaaaattaagttaggactattacctaagcctgaaccgaaagttaaactaagcaacatgatgagtgttttcgagaatgatcaaaacataacggacccaactgcctgggaaaaagtagtgaaagaccaagtggacctcaggaagagaaaacatctggaagaaaacgaaagaagacatgaagatgctattaaaagaaggaaagaagcagtcaatatgaacgttgaaaagccgacagtataccattgtaaggtgttccagttcaaaaacttacagaacccaaaaataagattcaagttgaaaatgaatagtaaagaactatcactaaagggtttatgcctccgtatacgtgatgacggaccaggaataattatagtcgtgggtaacgaaaaatcatgcaaattttatgagaatttggtgatgaagaggataaaatggaatgaagattttgagttgcacacaaacactggggatataaaaatggacatgcataataattcaatatcaaaaacttgggaaggctatttacaagattgtaaattcaaaggctggtttatgaaagtatgcaatgatcaggattctttattacgtacgctgggtcagtttgattcagagcatttttattcacctgttcaaacgtga

SEQ ID NO: 3332 - DNA, 1410 bp, Saccharomyces cerevisiae
atgccttacactctatccgacgctcatcataagttgatcacctctcatttggtggacaccgaccctgaagtggactccattatcaaggatgaaattgaaagacaaaagcactccatcgatttgattgcttctgaaaatttcacctcaacctccgttttcgatgcccttggaactccattgtccaacaaatactctgaaggttatccaggtgctcgttactacggtggtaatgaacacattgacagaatggaaattctatgtcaacaaagagctttgaaagctttccatgttactccagacaaatggggtgttaacgtccaaactttatctggttctcctgctaacttgcaggtttatcaagctattatgaagcctcatgaaagattgatgggtctatacctaccagatggtggtcatttgtctcacggttacgctactgaaaacagaaaaatttctgctgtttccacatacttcgaatctttcccatacagagttaacccagaaaccggtattatcgactacgatactttagaaaagaacgccatcctatatagaccaaaggttcttgttgctggtacttcagcatactgtcgtttaattgactacaagagaatgagagaaatcgccgacaaatgtggtgcttacttgatggtagacatggcccacatttctggtttgatcgccgcaggtgtcatcccatctcctttcgaatacgctgatatcgttaccaccaccactcacaagtctttgagaggtccacgtggtgctatgattttcttcagaagaggtgtgagatctatcaaccctaagaccggtaaggaagttctatacgacttggaaaacccaattaacttctctgttttcccaggtcaccaaggtggtccacacaaccataccattgctgctttggccactgctttgaagcaagctgccactccagaattcaaggaataccaaactcaagtcttgaagaatgctaaggctttggaaagtgaatttaagaacttgggctacagattagtttccaacggtaccgattctcacatggttctagtatccttgagagaaaagggtgttgatggtgctcgtgttgaatacatttgtgaaaagattaacattgctttgaacaaaaactctattccaggtgacaaatctgctttggttccaggtggtgtccgtattggggctccagccatgaccactagaggaatgggtgaagaagatttccacagaattgttcaatacattaacaaggctgtagaattcgctcaacaagttcaacaaagcttgccaaaggatgcttgtagattaaaggacttcaaagccaaggtcgacgaaggctctgatgttttgaacacctggaaaaaggaaatttacgactgggctggcgaatacccattggctgtgtaa

SEQ ID NO: 3333 - DNA, 1410 bp, Saccharomyces cerevisiae
atggataatcagcaggaaagtatatctgaagatatcaccggtgatctggccgctgctgtgagaaagtcatggtccgagtcacaagataatccattactgttaaattttaataattctcccataggtactcccactgataggtactcccctgaaccagcaacgatgatggaaggaaatgcaatgaatctttcatcacttgcgagagggtcgacacagcagcagcaaaggctttatggatcttctcaaacacgcgaaaaatctgatcaacagcagcaggattatcagctgttcaaacatcattattctttgggacaggagacgagagagtctgtttcagatatccttaacgatttgactctaggatctccggaaccaagcgaaagggcatcaccaataaggcaaccatcggtggatgttccacctttaactacaaggcgtagttctatacaggacgttcagtggataagacatttactgaacccaagaagttcgttttccggcgcatcttccaatgaaccaaccaactctcctggggattttcttaatcagagcagggcttggataacaatactgcacgattcatcggcagaatctttacaggctgtcatcgtattggccgagtcattgaagaatgtcaattctcagtataatctctgggtattgcattccagtgaagtcaacgcctttcaattggcccaggtaggaatcaagacgctgataatagatgaatatatcaatttattcatgaatttcggcactggctcgggatttagcgcaagttcgcaatcgaccgaaaccaagggcgaattgaattttaagtggtgcaagctatttctttttttttcgttaattgatcgattcgaattgatttgctatttatcccctacatgcctggtactgcaaaatattgatgagcttctagagagcactgaagtatctgacgagattgataacgaaacttgtgtattgttatcgaataaggtaaattatataaatgaagatctcgttagcgtgaaccaagaccaatcttccgctgaaaattatgatgacgatcctcaaattattatactgaagccgaacagggcagtagcaatgtgcattaaggaatactttactatttacgggaacgattttgaaggtgaaagtaaaaggtcgatgtttcatcaaatgaacgatttacagattatgaaagcattgtttggcgataaatggagttatatagatagcgttggatactgtgctgttcccatagctagcgtgccagcgaatagattgaattataagataatcgaatttaaaatcctgaaaccttgggaaagacaaaactacattgctgccggtcaacatcgagaatctattatgaacaagtggctagatctttggcgagactttttgaaccaagcaaactaa

SEQ ID NO: 3334 - DNA, 1410 bp, Saccharomyces cerevisiae
atgtcttattcagctgccgataatttacaagattcattccaacgtgccatgaacttttctggctctcctggtgcagtctcaacctcaccaactcagtcatttatgaacacactacctcgtcgtgtaagcattacaaagcaaccaaaggctttaaaacctttttctactggtgacatgaatattctactgttggaaaatgtcaatgcaactgcaatcaaaatcttcaaggatcagggttaccaagtagagttccacaagtcttctctacctgaggatgaattgattgaaaaaatcaaagacgtacacgctatcggtataagatccaaaactagattgactgaaaaaatactacagcatgccaggaatctagtttgtattggttgtttttgcataggtaccaatcaagtagacctaaaatatgccgctagtaaaggtattgctgttttcaattcgccattctccaattcaagatccgtagcagaattggtaattggtgagatcattagtttagcaagacaattaggtgatagatccattgaactgcatacaggtacatggaataaagtcgctgctaggtgttgggaagtaagaggaaaaactctcggtattattgggtatggtcacattggttcgcaattatcagttcttgcagaagctatgggcctgcatgtgctatactatgatatcgtgacaattatggccttaggtactgccagacaagtttctacattagatgaattgttgaataaatctgattttgtaacactacatgtaccagctactccagaaactgaaaaaatgttatctgctccacaattcgctgctatgaaggacggggcttatgttattaatgcctcaagaggtactgtcgtggacattccatctctgatccaagccgtcaaggccaacaaaattgcaggtgctgctttagatgtttatccacatgaaccagctaagaacggtgaaggttcatttaacgatgaacttaacagctggacttctgagttggtttcattaccaaatataatcctgacaccacatattggtggctctacagaagaagctcaaagttcaatcggtattgaggtggctactgcattgtccaaatacatcaatgaaggtaactctgtcggttctgtgaacttcccagaagtcagtttgaagtctttggactacgatcaagagaacacagtacgtgtcttgtatattcatcgtaacgttcctggtgttttgaagaccgttaatgatatcttatccgatcataatatcgagaaacagttttctgattctcacggcgagatcgcttatctaatggcagacatctcttctgttaatcaaagtgaaatcaaggatatatatgaaaagttgaaccaaacttctgccaaagtttccatcaggttattatactaa

SEQ ID NO: 3335 - DNA, 1410 bp, Saccharomyces cerevisiae
atgtttctcaatagaatgatgaagaccaggactggtctttatcgcttatattcaacccttaaagttccacatgtagaaatcaatggcataaaatacaagaccgacccacagactaccaatgttacagattcaataataaagcttaccgacagatcattacatttgaaagaatcacatccagtaggcattcttcgcgatctaattgaaaagaaattaaactcagtcgacaacacatttaagatctttaataatttcaagcccgtggtaaccacaatggaaaacttcgattctttagggtttcctaaggatcatcctggaagatcaaaatctgacacatattatataaatgagacgcacctactgagaacacatacttcagcccacgaattagagtgctttcaaaaaataagaaacgattcagataatattaaaagtggatttttaatatctgcagatgtgtacagaagagatgaaattgacaaaactcactatccggtattccaccaaatggaaggagccacaatttggaaacgaacgaaggctgatgtgggcgtaaaggagccaatgtatatcgagaaaatccgtgaagatatcagacaggtagagaaccttttaaataaagaaaatgtaaagattacggttgacgatgatactatacctttgaaagaaaataatcctaaacaagagtatatgtccgatctggaggttgatttgtgctctcaacatttgaagaggtccattgaactgatagtttctgaagtttttaacaaaaaaatatctagcatgatcaagaacaaagcgaataatacacccaaagagctaaaagtccgttggattaacgcttacttcccctggaccgcgccctcatgggaaatagaggtttggtggcagggcgaatggctcgaactctgcggatgcggattgattcgtcaagatgtgctactaagagccggatataaaccttctgaaacaattgggtgggcttttggcttgggtttggaccgcattgctatgcttctttttgaaattccagatattagactgctttggagtcgtgatgaaagattttcaagacaattctccaagggattaattacttccttcaaaccttattcaaaacacccgggatcatttagggatgttgcgttttggttaccagaagataaaccagatattcatcaagttcatgaaaatgatttgatggaaattatcagaaatatagctggcgatttggtagagagtgtcaagctagtcgatagctttacgcatccgaaaactgggagaaaatctatgtgctacaggatcaactatcaatcaatggacagaaatttgacaaacgccgaagttaacactttgcaagacatggtgtgttctaaattggtaaaagaatacagcgtagaactcagatag

SEQ ID NO: 3336 - DNA, 1413 bp, Saccharomyces cerevisiae
atgaatcggcgtctcctggtacgttctatatcttgtttccaacctttgtcgagaataacttttggaagaccaaacacgccatttcttagaaagtatgctgacacatccactgctgcaaacaccaacagcaccatattgcggaaacagttactatcgttgaagcccatttctgcctctgattcactgttcatttcgtgtacggtattcaattctaagggaaatattatctcaatgtccgagaagtttcctaaatggtcctttttaactgaacattcccttttccccagagacctgaggaaaatagataactcctctattgatattattccaaccatcatgtgtaagccaaactgtattgtcatcaacttattgcatatcaaagctcttatcgaacgagataaggtctacgtcttcgatacaacaaacccttccgccgctgccaaactgagtgtacttatgtatgacttggagtctaagttgtcctccaccaagaataactctcaattttacgagcatagagccctcgagagtattttcatcaacgtaatgagcgcactggaaacagatttcaagcttcactcacaaatctgtattcaaatcttaaatgatctggaaaacgaggtcaatagacttaaactgcggcatcttttaattaagtccaaagatcttacgcttttttaccaaaaaactttattgattagagatctattagatgaactattagaaaacgacgatgatttagcaaacatgtacttgacagttaagaagtctcctaaggacaatttttcggacttggaaatgcttatagagacgtactacacccaatgtgatgaatacgttcagcaatcagaatctttgattcaggatatcaaatctactgaagaaattgtcaacatcatattggacgcaaatagaaattccttaatgttgttggagttgaaagttaccatctacacgttgggattcacagtagcatctgttctgccggcattctatggtatgaatttaaagaatttcatcgaggagagtgaatgggggtttacttcagtggcggtattttctattgtttctgccctttatatcaccaagaaaaattttaattctttaagatccgtgacaaagatgaccatgtatccaaactcacccgcaaactccagtgtgtatcctaaaacatcagcgtctattgccctgacaaataaactaaagcgaaggcggaagtggtggaaatcaaccaagcagcggttgggagtgctactttatggcagcagctacactaataaggctaacctgtcgaataataagattaataaaggtttttcaaaggtgaagaaatttaacatggagaatgatattaagaacaagcagaacagagatatgatttggaaatggttgatagaagacaagaaaaattga

SEQ ID NO: 3337 - DNA, 1413 bp, Saccharomyces cerevisiae
atgactatccctggaagatttatgacaattgataagggcacttttggtgaatacactgctagcacccgttggcccattatcattcagaatgctatagacgatttaagtaagcatcaagaaacggagaagagtaacggcactaagttcgaacaaggtgaagttatcaaaaaggagctcaaggaattccgtcaggagataattgatcgtgtacctttgagaccctttactgaagaagagatcaaaattgccaacgtcccgctttcgttcaatgaatatctaaagaaacaccctgaagtcaattggggggctgtagagtggctgttctcggaggtttacttgtatagaagagtaaatgttcttttccaacgccaatgcgaatgggctaaatttgacatattcaacagacttaaacagtcaacttttgagtcctcgttttatggtgtcgtggaattggcgttaaggtatgaaaatctgttaccacagctgagagaaatgaagcaaaatccaggaaatgagattgacgatatattgaaagttctttttaaagagtttattgagatttctttgtggggcaatgccactgatttatctttattgaccaacgctacgttagaagacattaaatcaatccaaggggcgaaagcaagagctgcatccgagtccaagattgttgttaatgacacggagaaagcatgggaggtattaaccaaagccagggccgatgccaatagcagagaaattcgtgttgattttgtattagacaattctggctttgaattgtatgctgacttgatgttggcagcttttctgttacaaagtggtttggctaccaaatgtattttccacgctaaagacattccatacatggttagcgatgttatgttaaaagattttgatatattagttcatgacctgagagatcgtgagttcttcccaagtggtgaaccctcgacaaaggaatccagagctcttgatttatttgctggtgaaatggaaaagttcgtctctagcggtaagatagaattccgcgaagattctttctggaccacggaattagattattggaatttggacgcaaacgaaaccaaataccatggatccattttgcacaaagatttgcaaaaatccaatttggttatttttaagggtgatctaaactatagaaaattaactggcgacagaaaatggccccgcaccactaaatgggaaacggctatcggacctcttgctacgaatggtattacatcattgagcttgagaacctgtaaagccgatgtacaagttgctttacctgaaggtctagacgcgaaattaagtcaagaatgggaaaaggaaaatcctggccgtggttcttggtggtgttgtagcggtaaatgggcagtcatttgtttctgctctggtatacataaataa

SEQ ID NO: 3338 - DNA, 1413 bp, Saccharomyces cerevisiae
atgagtattgtaagacagtcatgtgattgctgtcgcgttcgtcgagtgaagtgtgataggaatagaccgtgtgatcgttgccgtcagcgcaatttgagatgcacttatttacaaccgttaaggaaacgaggtcccaagtccatcggagaaagcaaccttgaaagagcagctgaaatacagatggtgactgtaaacaataacatcatggcggccccagtaatgtataaaaaggttccaaagaaggtgattgatcaatgtttgagactatatcacgatcaactatacgtgatttggccaatgctcagttacgatgatctttacaagcttttggaggaaaattatgaggactgcagcacttattggtttttagtgtctctatctgcagcaactcttagtgatctgcatacaaaaatagaatacaagaagggatttttttttgctggagaacaattgtgtaatctttgtatgtcatcgcgacggtttttcgacgatctcagtaatagtgatatatttcgaattatgacatattattgtttgcatcgttgttatgcacagtttgctgatacaagaacctcatacagactttcttgtgaggctattggcctcataaaaatagctggatttcatcgggaagaaacttatgagtttcttccatttggtgagcaacaacttataagaaaggtttactatctgcttctcatgacagagaggtactatgccgtatacattaaatgtgtaacaagtttggataccactatatctccaccacaacccgaaatcgtaactgattcccgactttctttggatagttttcttgaggtgattaaagtattcactgttcctgggaaatacttttacgatgccttagctaccaacagtgttaatggttcctatactgaagactctctaaaaaggatatggaatgaacttcacataagctcacttgatatagagccatactcttacggatacatagactatctcttttctcggcactgggtcaggactctagcatggaagttggtactaaataagaaggatatgcggatgaattttttttcgaatactaacgccacacacattccagtcgaaatagccaaggatatgttacaggatacacttttaactccaatcgacctatatgatgtgcatggtcctgtgataccaatgaaggcgctagaaatagccaatgcattggtagacgtcgtaagtaagtatgatcacaatatgaagttggaggcttggaatattttgtgcgatgtatctaagttcgttttctccctgaaacattgcaatcataaaatgtttcaaaggttttcaactaaatgtcagagtgctctaatcgatttgcctatctctagaccactgcgcctaaatgatgattccaaggatgaagtcgacattattccctaa

SEQ ID NO: 3339 - DNA, 1413 bp, Saccharomyces cerevisiae
atgcagaatccttacggtcactttactaacaataccacggaggacagggaagcttcatctcaaggaggaccattcggccaaagcctgaataggcccctagattacgccggatctttcccttctctgacatacaataataataatttcattgccaatcaacaaccttctctgcctttgccagaaccacgtttatcttggaacaacgtcaaccaggtttctaaccctttgatggtaacaccgcttccgggattacaaaaacgtatgaacaaaaacattaaaaagaaattaccaagagtatctaagaaggcatcagccctttctaacggggtatccggcaatgtaatgagcaacagtaatatagtagggcatggtgctgtaggttcggcatcgggatggaaagttgaaatgggtggcagtgatgaattagagagaagaaagagaagggcagaaagattcagtcagggaccatcagcgacgacgaatagtaacgataatttgaatgaagactttgccaacctaaatgccattagtagcaaatctcatcaatatgacaaaaagattcatgtggtagggcgttgccaaactctagagaaatcttatctgagactaacttcagagcctaatcctgacttgatcagacccccaaatattctacaaaaaatgtattgcttgttaatggacaaataccaatctaaaacagccacttatacttacctttgcgaccagtttaaatcaatgagacaagacctaagagtgcaaatgatcgagaactctttcactattaaagtgtaccaaacgcatgcacgtattgccttggagaacggagatcttggggaatttaatcaatgtcaaaataggattatggcgttattcgaaaaccctacaataccaaaaaaatcttattccgaatttatatgctattctgttttgtattcgatgttaaccgaagactatccgtcgatttctcatttaaaacttaagttaatagacgatggctcttcggaaatcttggaggacgaacatgtcaaaatgatatttgagttgagcgatatgaaactagtcggcaattatcactacttcatgaaaaactacctaaaactgcacaaatttgaaaaatgtctaattaattcattcttaaatctagaaaagttgatatttttgaccataatttgtaagagttataaccaggtcaatttagattttgttaaaagtgagtttaatttcaacagtatagaagagacaacaaatttcttgaatgagcaaaacttgacggagttcatattaaacaaacaaatcactgacagtaatggcaaaagtagtaatatcaagattttgaataccaagggatgtagggtacagttgatacaaaattatatgaagtctaaaaaaattgatataaagggacaaaaatga

SEQ ID NO: 3340 - DNA, 1413 bp, Saccharomyces cerevisiae
atgtcatacaagtcagcaataatagggctttgtttgctagctgtgatactattagctccccctttagcatggcattcacataccaagaatattccagcaatcattttgataacatggcttcttacaatgaatttaacgtgtattgtagatgcggcaatatggagtgacgacgatttcctcacgagatgggatggtaaaggttggtgtgatattgtcatcaagttgcaggttggtgcgaatattggcatatcatgtgccgttaccaacatcatttacaacttgcatacaattttgaaggcagatagtgttttaccggatctttcatcatggacgaaaatcgtcaaggaccttgtgattagcttgttcacacctgtcatggtcatgggattttcatatctgttacaagtatttagatatggtatcgctcgttacaacggttgccaaaacttattgtctccgacatggattaccactgttttgtataccatgtggatgcttatatggtcatttgtgggcgctgtttatgccaccttagtactgttcgtgttttataaaaaacgcaaggacgttagggatattttacactgtaccaattcaggtttaaacctgacaaggttcgcaaggctgttgatattctgtttcattattattttagtcatgttccctttttctgtttacacctttgttcaagatttacagcaggtagaaggacactatacttttaaaaatacccattccagcaccatctggaataccattattaaatttgaccctggcagaccaatttataatatatggctttatgttttgatgtcttacctagtatttctaatctttggcttaggttctgatgctttgcatatgtactctaaattcctgcgttccatcaaactaggatttgtacttgacatgtggaaaagattcattgataagaataaggaaaaacgagtaggcatattgctaaacaagctgtcctcacgcaaagagagccgtaacccattttctacagactctgagaactatatctccacgtgtacagaaaactattctccctgtgtaggtacaccaatatcacaagcgcatttctatgtcgactataggattccagatgatcctagaaaatctcaaaataaaagcaaaaaatatttgtttgctgataaagaaacagatgatattcttgatgaaatagacctaaaagaaagtaggcacatcccttacgtcacgcaaggacagagctttgacgacgaaatatcacttggaggattctcaaaagttactctcgattattcagaaaagcttcataattctgcaagctccaattttgaaggggaaagtctttgctactctccagcttcaaaagaagagaattcaagctcaaacgaacatagttcagaaaatactgcaggcccttaa

SEQ ID NO: 3341 - DNA, 1413 bp, Saccharomyces cerevisiae
atgtcctcccaacaacacaagttcaagcgcccagatgtctccgttagagacaagaaattggacactcttaacgttcaattgaaaaaaatcgacactgaaatcggtttaattagaaagcaaatcgatcaacaccaggtcaacgataccacccaacaagaacgtaagaagttacaggataagaacaaggagatcatcaagatccaagctgacttgaaaacccgtagaagcaacattcacgactctattaagcaattggatgctcaaatcaagagaaaaaacaaccaaattgaggagaagttaggcaaaaaggccaagttctcgtccactgcagaagccaagcaaagaatcaatgagattgaagagtctattgcctctggtgacctttctttggttcaagaaaaactactagtcaaagaaatgcaatctttgaacaaattgattaaggacttagttaacatcgagccaatcagaaagtctgttgatgctgacaaggctaaaatcaatcaattgaaggaagaattgaacggattgaatccaaaggatgtctccaaccaattcgaagagaaccagcaaaaattgaacgatatccattcaaaaactcaaggtgtttacgacaaaagacaaactttattcaacaaacgtgctgccttgtacaagaagcgtgacgaattatacagtcaaatcagacagatcagagctgactttgacaacgaattcaaatcattcagagccaaattggacaaagaacgtttgaaacgtgaagaagaacaaagattatccaaacttttggaacagaaagatgttgatatgggtaaattgcaagaaaagttgactcatgccaagattccagccttcacttatgaaatcggtgccattgagaattctttgcttgtcctggacccaacttatgtgaaaccaaagaaaaacatcctgcctgacttgagtagcaatgctttggagaccaagcctgccagaaaagttgttgctgatgatttggttttggtcactccaaagaaggatgattttgtcaatgttgctccatctaaatctaagaaatacaagaagaagaaccaacagaagaacactgaaaatgagcaacctgcttctattttcaacaaagtcgatggcaagtttactttagaaccaacactaattgctactttggccgaattagacgtaactgtcccaatcaacagtgatgatgtcaagatcaccgttgagcaattgaagaagaagcatgaagagcttttgtcgaaacaagaagagcaaacaaaacaaaacattgaatctgtcgaaaaggaaattgagaaattaaatttggactactctaacaaagagcaacaagtaaaaaaggaattggaagaaaaaagattgaaagaacaggaagagtctgaaaaagataaagaaaattaa

SEQ ID NO: 3342 - DNA, 1413 bp, Saccharomyces cerevisiae
atgtcgaaattggtcatatcaacgtcaatatttcagtctcaagtagcagatttactcccatgtaacaatcatcaaaaatcgcagctgacatattccctaataaacgcgtacgatcttctccagcactttgacgaagtgctaacatttccctacgccagaaaggatgatctgctggagttccattcgaaatcatatatcgattatttgataaatggcagattcaataaaatgatggcacaagatgtaaataatcccatggtagagtccaaatggagtgagttgagtgaattggccgataattggaacgaaaaaatcgactacaatccatcgcaagatcttcagagattcaccactagagagaatctctataattattatctgaatcactcacaagcgctcgaaaataatatggactgtattaataacagtgaggtgcccaccaatgataaaccaacagatacttatattttaaattctgaaacaaaacagtataatttagagggagattgcccgattttttcataccttcctatgtactgtcaagttattacaggtgcgactttaaacttgttggatcatctatcgcctacagaacgtcttatcggtataaattgggatggtggaagacatcatgcctttaaacagagggcaagcggattctgctatataaatgacgtggtactgttaatacagagattgcgcaaagcaaagctaaataaaatcacgtacgttgacttcgacttgcatcatggtgacggtgtagaaaaggctttccaatattctaaacaaatacagacaatttcagtacatctctacgagcctggtttttttcctggaactggttctttaagtgattcaagaaaggataagaacgtggttaatattcctttaaagcatggttgtgatgacaactacttggaattgatcgcatccaaaatcgtcaatcctctaatagaaagacacgaacctgaggccttaataattgaatgtggtggtgatgggcttctgggtgatagattcaatgaatggcagctaacaatacgagggctttctcgaatcatcataaatatcatgaaaagttatcctcgagcgcacatattcctacttggagggggtgggtacaacgatttactaatgagtagattttatacgtacttgacttggtgtgttacaaagcagttttccaacttaagatgtggtgacaataattcgttccaaatcgatccatttgatgtctgtgatggtgatgattctgaacaatttatacgtgaacatgatcttgttgaaatgtataatgaagagaactatcagtattggatatatgagatggaaggaagttctcgaatgaaaatgttaaggaatgacaataaggatagagatatggtcgaacttatgaagttttacgaactgtaa

SEQ ID NO: 3343 - DNA, 1413 bp, Saccharomyces cerevisiae
atgtctctctctcccgttgttgttattggaaccggtttggccgggctggctgctgccaatgaattggttaacaagtataacatccctgtaaccatcctcgaaaaggcttcctcgatcggtgggaactctatcaaggcctccagtggtattaacggtgcttgcaccgagactcaacgtcacttccacatcgaggactccccacgcttatttgaagatgacaccatcaagtctgctaaaggtaaaggtgtccaagaattaatggctaagttggccaatgattctcccctggctattgaatggttgaaaaacgaatttgatttgaaattggacctattggctcaattgggtggccactctgtggcaagaactcacagatcgtctgggaagttgcctccaggtttcgaaattgtttctgccttatctaacaatttgaagaaattagctgagactaaaccagagttagttaagattaacttagacagtaaagtcgtagacatccatgaaaaggatggctccatttctgctgtagtgtacgaggacaagaatggcgaaaagcacatggtgagtgctaacgatgtcgttttttgttctggagggtttggcttttctaaggaaatgcttaaagaatacgcacccgaactggtgaacttgccaacaacaaacgggcaacaaacaactggtgatggtcaaaggcttctgcagaagttaggcgctgatctgattgacatggaccaaattcaagttcatccaactgggttcattgatccaaatgaccgtagctcaagctggaaattcttggctgccgaatccttaagaggtcttggtggtatcctattaaaccctattaccggtagaagatttgtcaacgaattgaccacaagagatgtagtcactgcagctattcaaaaggtttgtcctcaagaggataacagagcactattggttatgggcgaaaaaatgtacacagatttgaagaataatttagatttttacatgttcaagaaacttgtacagaaattgacattatctcaagttgtttctgaatataatttaccaatcactgtcgcccaattatgcgaggaattgcaaacatactcttccttcactaccaaggctgatccgttgggacgtaccgttattctcaacgaatttggctctgacgttactccagaaactgtggtttttattggtgaagtaacaccggttgtccatttcaccatgggtggtgctagaatcaatgtcaaggctcaagtcattggcaagaacgacgaaaggctactaaaaggcctgtacgcggccggtgaagtttctggcggtgttcatggcgccaataggttgggtggttcaagtttgttagaatgcgttgtctttgggagaaccgcagctgaatctattgccaatgaccgcaagtaa

SEQ ID NO: 3344 - DNA, 1416 bp, Saccharomyces cerevisiae
atgaagttcgtgacagctagttataacgtcgggtatcctgcgtacggtgcaaaatttttgaataacgacacattacttgtggcaggcggtggaggagaaggaaacaatggcataccaaacaagctgacggtcttgcgcgtggatcctaccaaagatactgagaaggaacagtttcatatattgagcgagtttgcattggaagacaacgacgactctcctactgcaattgacgcttccaagggtatcattttggttggctgcaatgaaaatagcactaagattacccaaggtaaaggtaataagcacttgagaaaatttaaatacgataaagtgaatgatcaattggagttcctcactagtgtagactttgacgcatctacaaatgcggatgactacacgaagctggtttatatttcacgagaaggtaccgttgcagctatcgcatcatctaaagtacctgctataatgagaatcattgacccgagcgacttgacagagaagtttgagatcgagactaggggtgaagtaaaggatttacacttttccactgatggtaaggttgttgcttatatcaccggttctagcttggaagtgatttcaacagtgactggaagttgcattgctaggaaaacagattttgataagaattggagtttatctaaaataaacttcatagccgatgacacagtattgatagcagcctctttaaaaaaagggaaaggtattgtgctgaccaaaataagcatcaaatcaggaaacacttccgtattaagatccaaacaagtgacaaacagattcaaagggattacttctatggatgtcgacatgaagggtgaattggcggtactggcaagtaatgacaattccatagctcttgtgaaactaaaagacctgtcaatgtctaaaatattcaaacaagctcatagttttgccattacagaggtcactatctctccggactctacatatgtggcgagtgtttcggcagccaacactatccacataataaaattaccgcttaactacgccaactacacctcaatgaaacaaaaaatctctaaatttttcaccaacttcatccttattgtgctgctttcttacattttacagttctcctataagcacaatttgcattccatgcttttcaattacgcgaaggacaattttctaacgaaaagagacaccatctcttcgccctacgtagttgatgaagacttacatcaaacaactttgtttggcaaccacggtacaaaaacatctgtacctagcgtagattccataaaagtgcatggcgtgcatgagacgagttctgtgaatggaactgaagtcttatgtactgaaagtaacattattaatactggaggggcagagtttgagatcaccaacgcaacttttcgagaaatagatgatgcttga

SEQ ID NO: 3345 - DNA, 1416 bp, Saccharomyces cerevisiae
atgaatgaaattatggatatggatgagaagaagcccgttttcggtaaccattccgaggacatacagaccaaattggacaagaaattaggacctgagtatatctccaagagagttgggtttggaacaagcaggattgcatacatcgaaggttggagagtaattaatcttgctaatcaaatctttggatataatggctggtctacggaggtaaaaagtgtagttatcgattttttggatgagcgacagggaaagtttagcatagggtgtactgcaattgttcgtgttacgttgactagcgggacttatagggaagatattgggtatggtaccgtggagaacgaaagacggaaacctgccgctttcgaaagggccaagaaatctgccgttacggatgccttgaaaagatctttgagagggtttggtaatgctctaggaaattgtctttacgataaagattttctggcaaagatcgataaggtgaagttcgatccgccagattttgacgaaaacaatttgtttaggccaacggatgaaatcagcgaaagctcaagaacgaatactttgcatgaaaatcaagaacaacaacaatacccgaataaaagaaggcaattgactaaagttacaaataccaatcccgactcgacgaagaacctggtgaaaatagaaaatacagtaagtcgaggtaccccaatgatggccgcacctgctgaggctaacagtaaaaacagcagtaataaagatactgatctcaaatctctcgatgcttccaaacaggatcaagatgaccttctcgatgattctcttatgtttagcgatgattttcaagacgacgacttgataaatatgggcaacacaaacagtaatgttttaacgacagagaaggatcccgttgtagctaagcaaagcccaactgctagctcaaacccagaggcagaacaaatcacctttgttacagctaaggctgcaacttccgtacaaaatgaacgttatattggtgaagagagcatttttgatcccaaataccaggcacaatccattaggcacaccgttgatcagactacgtccaagcatattccagcgagtgtgctaaaagacaaaacgatgaccaccgcgagggattctgtctatgaaaaatttgcaccaaagggaaaacaattgagcatgaagaacaatgataaagaactggggcctcatatgctagaaggggctgggaatcaagtaccgcgtgaaaccacaccaattaaaacgaacgctacagcttttccgcctgcagctgctccacggtttgcgccgccttctaaggtagtacatcctaatggaaatggtgcagtgccagccgttccgcaacaaagatcgacacgaagagaagttggaagaccaaagatcaatcccctgcatgcacgcaagcctacttga

SEQ ID NO: 3346 - DNA, 1416 bp, Saccharomyces cerevisiae
atgagcatttgtccacatatacagcaagtatttcagaatgaaaagtctaaagatggggttctaaaaacgtgcaatgctgccaggtatatattaaatcattccgtacccaaggaaaaattcttaaacaccatgaaatgtggtacatgccacgaaataaactctggtgcaactttcatgtgtctacaatgtggattttgtggatgttggaaccattcgcattttctctctcacagtaaacagattggtcacatatttggtatcaactcaaataatggccttttattttgcttcaaatgtgaggactatatagggaatatcgatctgattaacgatgctatcctagcgaagtattgggacgacgtgtgcacaaagaccatggttcctagcatggaaagaagagatgggctttctggcctgatcaacatgggatccacttgtttcatgagtagtattctccaatgtctaatccataacccttactttattaggcactcaatgagtcaaattcattctaataattgtaaagtgcgttctccagataaatgtttttcatgtgcactcgataaaattgttcatgaactttatggagcgctgaatacaaagcaagcttcttcgtcatctacatctactaatcggcaaaccggattcatatatcttttaacttgtgcctggaaaatcaatcaaaatctagcagggtattcacaacaagatgctcatgaattttggcagtttataattaaccaaatccaccaaagctatgttcttgatttgccaaatgccaaggaagtcagcagagcaaataataagcagtgtgaatgcatagtgcatactgtgtttgagggctccttggaaagttctattgtgtgtccaggctgtcaaaataattcaaagacaaccattgatccattcttggatctttctctggatatcaaggataagaaaaaactttatgaatgtcttgacagtttccataaaaaagaacagttgaaggatttcaactatcattgtggggagtgtaacagcactcaagatgcaataaagcaactaggcatacacaaattaccatcggttttggttttgcaattgaaaagattcgaacacctacttaatggaagtaacagaaaactagacgattttattgaatttccaacttatttaaatatgaaaaattactgttcaacgaaggaaaaagataagcattctgaaaatggcaaggttccagacattatttacgaattaatcggtattgtttcccacaaggggacggttaatgagggacattatattgcattttgtaaaatttctggagggcaatggtttaaattcaatgattccatggtctcctctatatctcaagaagaggttttaaaggaacaggcatatttattattctacaccattcgtcaagtaaattga

SEQ ID NO: 3347 - DNA, 1416 bp, Saccharomyces cerevisiae
atgatcgtatttcgtcgctttcctacgtgccttttacatcacattcgacaaccggcatccaggagtcttttgttggaatcacaaaggcgatcattatcttttacatcttataaatataacagcagccacattgatgatgataaaagtaaaaaaaagcttaaaaatgttttccaaatgaatagcaatagagtcattcgtaagcaaaaaacaaaagaagaattggccaaagagaggttcgaagaacaactgaggtcacctaatagatttgtgaggtggggagctattgcgagatcagaaaagttttcaaagggaatgaccaagtacatgatcggtgcttatgtgatatttttaatctatggtctcttctttaccaaaaaactgtttgcgaaagacaaagaactggaaagattgttgaagaaacaagaagaagggaatgccaatgaatacgaagcattaaggattaaagaattgaaaggaaaactaaggaggagagatgaattgaaattagaagaatacaaaaaaatgcaagaagaaggcattgaaaacttcgatgatattcgggtacagaattttgatcaaaacaaattgaatgaacaaatattgccagcaagagacacaacaaacttttaccaagaaaaagctaacgaatatgataaggcaattaatatggaagagagagtaatatttctcggtaaaagaaggaaatggttaatgaaacattgtcaaggggatgttttggaagtttcatgcggtacaggaagaaatatcaagtaccttgatatgtcacgcatcaactctataacattcttagactcttctgaaaatatgatggaaattacacataaaaaattccgagaaaagtttcctaagtataaaaaagttgcatttgttgttggaaaggcggaaaatctagtagacttagcagagaaaggtaagccctctctagagaatgaaaaggaaaaccaagtaaaatatgatactatcgtggaggcgtttggtttgtgttcccatgaagatccggttaaggcacttaataattttggcaagttattaaagccagatggaagaattattttactggaacatggtagaggtcaatacgattttataaataagatattagacaacagagctgaaagaagactgaatacttggggctgtcgatggaatctcgacttaggcgaagtgttagatgattctgacctagaattggtggaagaaaaacggactcacttaggcactacttggtgtatcgttgcaaagagaaaaggtgatgtgaaaaagaaagacgagcttgggtttgtagaaaaatacttgcaatcaagtattagaaagagaatggaatcattcgaaaaaaaagacgatatggcatctaaaaaagaacttgagccagtacctcctgtaagtaaaagttaa

SEQ ID NO: 3348 - DNA, 1416 bp, Saccharomyces cerevisiae
atgatggttttttcgagcacctttatttttctaattttggagttagttgtactgtgtgaagcttcagtccacaccattcaaattaaggacaagcatttcgttgacacagtgactggaaaaccattcttcatcaaaggtgtggattatcagccaggaggctcttccgacgttagtgaaaagcaggatccgttatccaatccagatgcatgcgctcgtgatattttattatttcaagaattgggaataaacacagtaagaatttattctataaacccggacctgaaccatgatgcgtgcatgactatgctcgcaatggcaggtatctatcttatattggatgtcaattccccattgcaaaaccagcacttaaacagatatgaaccttggactacctataatgaagtttatttagaacacgttttcaaggttgtcgaacaattttctcattacaataatactttaggattttttgctgggaatgaaattgtaaacgacaaaagatcagcacaatattctcctgcctatgtcaaggagttgattggaactatgaagaattacataagcgcacactcgcccagaacaattccggtaggttactctgctgcagatgacctgaactatagggtatcactgtccgaatatttggagtgtaaagatgatgataagccagagaatagcgttgatttttacggagttaactcctaccaatggtgtggccaacaaactatgcaaacttcagggtacgatacattggtggatgcttacaggagctattccaagccagtttttttttcagaatttggatgcaataaagtattgccaaggcaattccaggaaataggttatttgttttctgaggagatgtattcagtattctgtggaggtctggtttacgaattttcacaggaggataataattatgggttagttgaatatcaagaagatgattcagtacagctcttagcagattttgagaagcttaaatcgcactaccaaaacattgagtttccttctatgaagactttaaaggaaactgttcagatggaggagacgccatcatgtgcggaagattatgaaaatttgaagattgaatctaaaattgctaaaaatttaggaagttctttgataaaaaaaggcgtgaaagttgaaaaaggcaaatacatagatattcacgaggatcagctgtccaccaatgtcacgattttagacaagcatggtgacagatggaatgggcccaaaaagattgaaattaggcaaagcctgacattggcagacctggaaggagaagaacaagaagacgcagatgaagacaaagatgatttaaaacgaaaacaccggaattctgcctctatttccggcccattgttacctcttgggttgtgtttgcttttttttacttttagtttatttttttag

SEQ ID NO: 3349 - DNA, 1416 bp, Saccharomyces cerevisiae
atggaaagttttgaaaatttgagcataagagacagtttcactagcggaatggaacacgttgacgaggagttaggaggcctctccgacctaagtatatctaagcaggggccaactttgtcaccacagcttatcaaccgatttatgccccattttccctcgagcccatcacctctgcgaaatacattggattttagtgctgctaaagctgatgaggaagaagatgaccgaatggaaatagatgaggttgatgatacaagttttgaagaagaatataataacgagccaatcgaaactcatactgaagcgactgagaatgccgtggtggaagaaatcgaggctaccccagaagaaagacaaaagcaagagaagaatgaaagccaagaccaaagtgtagaagaggtcgagaacattgtttcaccgcatcgttcaactgtcataaaggcattattatcaccgaccgatttaggtgtggccgcagctactaaagttgaaggtgttgtgccattaccaccatcggccaatcaagatgacaatgaaagttcgaataacaacgcagagggtgaagacataatcagaaatgaagaagtcgaagatgagatcaaatcatcacttggcaaccacaagtcaagccagtacgcaaatgcgttcgattcggaaataatcaagagggaattaagatcaagatcaaaatatcaaccaattcaggtttcattcaatacacacaactacttctattcagataaggacggcattaaaacttattctcttactaaaccaaatcacaataaaatagatgaattttacgaccaaaatgaagctttcaagttgcctaaaccatggtcacccaattcacatccggcatcaagagcgtcatatgccctaatgtcatatttacagttatttctcaatgcgatcactacagtagtgatttttagttttatactctcatttatcatagcgcttcaaaaggacttgaaatccacatgggaacaaagaaaacatgaactgcagtacgaatccagaatttgtcaagagcagtacctcacaaatcgttgtaaccagacgcctggcttgccggctctgggcgaacaatgtgctatatggaaacagtgtatggacagaaataacgatatctttttccgtgcaagatcaacgttgagcgcaaaattgttcggagacattatcaactcattcatagatccattaaactggaaaacactatttgttattttttgtggtgtgataacttggtgtttcagttcgaatttcttactgggttttgtaagagccaagagctactatggcaatggcatcaaaacatatcccttgccatcttcaccgaaatcgccgacatcagaagaaacacactcatctatgacagcatctggagaggactcacacctacttaagcaatag

SEQ ID NO: 3350 - DNA, 1416 bp, Saccharomyces cerevisiae
atgggctcaaaagtagcaggtaaaaagaaaacccagaatgataataaactagataacgaaaatggttcacagcagcgcgaaaatatcaataccaagacgcttttgaaaggcaaccttaagatatcaaattacaaatatcttgaggtgattcaactagaacatgctgtgacaaaattggtggagtcttacaataaaataattgaactttcaccaaatttggtagcttacaatgaagccgttaacaatcaagatagagtgcctgttcagatacttccttctctatcacgttatcaattaaaactggcagctgaattaaaaaccttacatgatcttaaaaaagacgcaattttgacagaaattactgattatgaaaatgaatttgatactgaacaaaagcaacctatattgcaagaaatcagtaaagctgatatggaaaagttagagaagctagaacaagttaaaagggaaaagcgagagaaaatagatgtaaatgtgtacgaaaatttaaatgaaaaggaagatgaagaagaagacgaaggagaagatagctatgacccaacaaaggctggtgatatcgtcaaggcaacaaaatggcctccaaaattaccagagattcaagatttagcgattagggccagggtatttattcacaaatccacaataaaggataaagtttacttgtctggatcagaaatgatcaacgcacataatgaaagactagaattcctaggcgattcgatcttaaattctgttatgacattaattatttataacaagtttcccgattacagcgagggtcagttatcaacattaaggatgaatttggtaagcaacgaacagatcaaacaatggtcaataatgtacaatttccatgagaaacttaagacaaattttgacttgaaggatgaaaattccaattttcaaaacggcaaactaaaactgtatgcagatgtgttcgaagcttacattggcggcttgatggaagatgatccaaggaataatttgcccaaaataagaaaatggttaagaaagcttgccaaacctgtcattgaggaggctacccgtaatcaagttgccttggagaagacggataaacttgatatgaatgctaaaaggcagctttactctttgattggctatgcttcattacgtctacattatgttaccgtaaaaaaacccactgcagttgatcctaattccatagttgagtgcagagtaggtgatggaacagttttagggaccggtgtgggcagaaatatcaaaattgcgggtattagggctgcagaaaatgctcttcgtgacaaaaaaatgttagatttttacgccaaacaaagagctgccattcctaggagtgaatctgtgttaaaagatccctcacaaaagaataagaaaagaaaattctcagatacaagctga

SEQ ID NO: 3351 - DNA, 1416 bp, Saccharomyces cerevisiae
atgtcacgatcccttttggtagagaatagtagaaccattaatagtaatgaagagaagggggtaaacgaaagtcaatatatcttacaaaagagaaacgtcccaaggaccattctcggtaatgtcacaaataatgcaaatatcctgcaagagatttctatgaacagaaaaattgggatgaagaacttctcaaaattgaacaacttctttcctttaaaggatgatgtttcgagagccgatgacttcacctcctcttttaatgacagtagacagggggtgaaacaagaagtactaaacaataaggaaaatattcctgaatatggatattccgagcaagaaaagcagcagtgctcaaatgatgactcttttcatacgaattcgactgccttgagctgtaatcggttgatatactctgagaacaagtctatttccactcaaatggaatggcagaaaaaaataatgagagaagattccaaaaaaaaaaggccaatatcaactcttgtagagcaggatgaccagaaaaagttcaaactccatgaattgactacagaagaagaggttctggaggagtacgaatgggatgacctagatgaagaagattgtgatgatcccttaatggtgagcgaagaggttaatgatatcttcgattatttgcatcacttggaaataatcacattgccaaataaggcgaatctctataagcataaaaatattaagcaaaacagagacattttggtgaactggataatcaagattcataataagtttggccttctgccggaaactctatatttggccataaacataatggatagatttctttgtgaagaggtggttcagttaaatagattgcaactggttggtacatcatgcctgttcatcgcatctaagtatgaggaaatatactcccctagcataaaacattttgcgtacgagacagacggtgcatgctctgtggaagatattaaagagggtgaaagatttatattggaaaaactcgattttcaaattagtttcgctaacccaatgaatttcttaaggagaatatcaaaagcggatgactatgatatccagtctaggacgttagcgaagttcctaatggaaatatctatagtggacttcaagttcatcgggatattaccgtcattatgtgcctcagcggcaatgttcctttcgagaaaaatgctgggcaagggcacctgggatggcaacttaatccattatagtggtggttacacaaaggcaaaactatatcccgtttgccaattactgatggattatcttgttggatctactattcacgacgagttcttgaaaaaatatcaatcgagaagatttttaaaggcttccataatttctatcgaatgggcattgaaggtaaggaaaaatggatatgatattatgacattgcatgagtga

SEQ ID NO: 3352 - DNA, 1416 bp, Saccharomyces cerevisiae
atgtcgattcaaactagtgatccaaatgaaacatcagatttaaagtcgttatctttaattgctgcccactcccatattacaggtttaggtctagatgaaaacttgcaaccacgtcccacatccgaaggtatggttgggcaattgcaagcccgtcgtgctgctggtgtgatattgaaaatggttcaaaatggcaccatagcaggtagggctgttttggtagcgggccccccttcaactggtaagaccgctcttgccatgggtgtttcccagtctctgggtaaagatgtaccattcactgctattgcgggctcagaaatcttttctttagaattgagtaaaactgaagcactaactcaagcttttaggaaatccatcggtatcaaaatcaaggaggagacagaattgattgaaggtgaagtcgtggaaattcaaattgatagatctattactggtggacacaaacaaggaaaattgactattaaaactaccgatatggaaacaatttatgaattaggcaataaaatgattgatggcctaactaaagaaaaggtattggctggcgatgttatttctattgataaagctagtgggaagattaccaagctaggcagatcctttgctagatctagggattatgatgccatgggtgctgataccagatttgttcaatgtccggaaggcgaactgcaaaaaaggaaaacagtggttcacacggtgtcactgcatgaaattgatgttattaattcaagaacacaaggatttttggcattatttactggtgacaccggtgaaattaggtcagaggtaagagaccagataaacacaaaagtggcagaatggaaagaagaaggtaaagcagaaattgttcctggtgtattatttatcgacgaagtccacatgttggatatagaatgtttttcctttataaatagggctttggaagatgagtttgccccaatcgtcatgatggctacaaatagaggagtttccaaaaccagagggactaattacaaatctccacatgggttacctctcgatcttttggataggtcaattattattacaactaaaagttataatgagcaggagattaagacaattttatctataagagcacaagaggaggaagttgaactgtcatccgatgccttagatctattgaccaaaacaggtgtggaaactagtttgcgttacagcagtaatttaatctctgttgctcagcaaattgcaatgaagagaaaaaacaacactgttgaagtggaagatgtcaaaagggcttatttgctatttttggacagcgctagatctgttaagtatgttcaagagaacgagtcacaatatattgatgatcagggcaacgttcaaatatccattgctaaatcagcagaccctgatgccatggatactacggaataa

SEQ ID NO: 3353 - DNA, 1416 bp, Saccharomyces cerevisiae
atgtctatttgtgaacaatactacccagaagagccaaccaaaccaactgttaagaccgagtccattcctggtcctgaatcccagaagcagttaaaggaactgggtgaagtttttgacacaagaccagcatattttttggctgattatgagaaatctttaggtaactatatcactgatgtggatgggaacacatatttggatttgtatgcccaaatctcttcaattgcacttggttataacaaccctgctttgatcaaggcagcacaatcaccagaaatgatccgtgctttggtcgaccgtcctgccttaggtaacttcccatctaaggatttagacaagatattgaagcaaatattgaaatctgcgccaaagggtcaagatcacgtctggtcagggctttccggtgcagatgccaatgaattagcgttcaaggctgcctttatttattaccgtgccaaacaaaggggctatgatgccgatttttctgaaaaggaaaacttgtctgtcatggacaatgacgcccctggcgcccctcatcttgccgtactatcgttcaagagagcgttccacggtagattgtttgcctccggttccacaacttgttctaaaccaattcacaagttggatttcccagccttccactggcctcatgctgagtatccatcttaccaatacccattagatgaaaattctgatgcaaaccgtaaagaggatgaccattgcttggccattgttgaagaattaatcaaaacctggtctattccagttgctgccttaatcatcgaaccaattcaatctgagggaggtgataaccacgcttctaagtatttcttacaaaagctaagagacattaccttgaagtataacgttgtctacatcatagatgaagtgcaaacaggtgtcggagccaccggtaagctatggtgtcatgagtacgccgatattcaaccacctgtggatttagtgaccttttccaagaaattccaaagtgcaggatatttcttccacgaccctaaattcattccaaacaaaccatacagacaattcaacacatggtgtggtgaacctgcaagaatgatcattgcaggtgccattggacaggaaatctccgacaagaagttgactgaacaatgttcaagagtaggtgattatttgttcaagaaattggagggtttgcagaagaaataccctgaaaactttcaaaacttgagaggtaaaggaagaggcacattcattgcctgggatttgcctactggtgagaagagagacttactattgaagaaattgaagttgaatggttgcaacgttggtggatgtgcagtccatgcagtgagattaagaccttcattaacattcgaggagaagcatgctgatatctttattgaagcattagccaaatcagttaatgaattatga

SEQ ID NO: 3354 - DNA, 1419 bp, Saccharomyces cerevisiae
atggggtgtacagtgagtacgcaaacaataggagacgaaagtgatccttttctacagaacaaaagagccaatgatgtcatcgagcaatcgttgcagctggagaaacaacgtgacaagaatgaaataaaactgttactattaggtgccggtgagtcaggtaaatcaacggttttaaaacaattaaaattattacatcaaggcggtttctcccatcaagaaaggttacagtatgctcaagtgatatgggcagatgccatacaatcaatgaaaattttgattattcaggccagaaaactaggtattcaacttgactgtgatgatccgatcaacaataaagatttgtttgcatgcaagagaatactgctaaaggctaaagctttagattatatcaacgccagtgttgccggtggttctgattttctaaatgattatgtactgaagtactcagaaaggtatgaaactaggaggcgtgttcagagtaccggacgagcaaaagctgctttcgatgaagacggaaatatttctaatgtcaaaagtgacactgacagagatgctgaaacggtgacgcaaaatgaggatgctgatagaaacaacagtagtagaattaacctacaggatatttgcaaggacttgaaccaagaaggcgatgaccagatgtttgttagaaaaacatcaagggaaattcaaggacaaaatagacgaaatcttattcacgaagacattgctaaggcaataaagcaactttggaataacgacaaaggtataaagcagtgttttgcacgttctaatgagtttcaattggagggctcagctgcatactactttgataacattgagaaatttgctagtccgaattatgtctgtacggatgaagacattttgaagggccgtataaagactacaggcattacagaaaccgaatttaacatcggctcgtccaaattcaaggttctcgacgctggtgggcagcgttctgaacgtaagaagtggattcattgtttcgaaggaattacagcagttttatttgttttagcaatgagtgaatacgaccagatgttgtttgaggatgaaagagtgaacagaatgcatgaatcaataatgctatttgacacgttattgaactctaagtggttcaaagatacaccgtttattttgtttttaaataaaattgatttgttcgaggaaaaggtaaaaagcatgcccataagaaagtactttcctgattaccagggacgtgtcggcgatgcagaagcgggtctaaaatattttgagaagatatttttgagcttgaataagacaaacaaaccaatctacgtgaaacgaacctgcgctaccgatacccaaactatgaagttcgtattgagtgcagtcaccgatctaatcatccagcaaaaccttaaaaaaattggtattatatga

SEQ ID NO: 3355 - DNA, 1419 bp, Saccharomyces cerevisiae
atgtttggattaaataaagcatcttcgacacctgcaggtgggctctttggtcaggccagcggagctagcactggaaacgcgaatactgggttttcgtttggtgggactcaaactggacaaaacaccggcccaagtacaggtggactatttggcgctaaaccagccggatctacaggaggattaggtgcatcatttggtcagcagcaacaacaatctcagacaaatgcatttggaggaagcgccaccaccggagggggccttttcggtaacaaacctaacaatacggcgaacactgggggcgggttatttggcgctaattcgaacagtaattctggcagtttgtttggttccaacaatgcacagacgagtcgtggtttgtttggtaataataacactaataatatcaataatagtagtagtggcatgaataatgcaagcgctggactatttggctctaaacctgcaggaggcacttctttgttcggtaatacaagcacctcttcggcccctgcgcagaaccagggcatgtttggtgcaaaaccagctggtacatctctattcggcaataatgcaggtaatacgaccactggtggagggttatttggctccaaaccgacaggagcaacgtctttgtttggttcatcaaataacaacaacaataacaataatagtaacaacatcatgagtgcgtcaggcgggctatttggtaatcagcagcagcaactgcagcaacaaccacaaatgcagtgcgcattgcaaaatctatctcagctccctattaccccaatgacacggatttccgaattaccacctcaaatacgtcaagaaattgaacaactagatcaatatattcaaaaacaagtgcagatctcgcaccatttgaaggccgatacaatcgatcatgatgaattgatagattccattcctcgtgatgttgcatacctactgaagtcagaatctgcaacaagtcaatatttaaagcaagatttgaagaaaatatcctcatttaaatcgctaatcgatgaggaccttctagacacgcaaactttttcggtgctcttacagcaactattaactccgggaagcaaaatttcttctaatgacttagacaaattctttcaaaagaaaattcatctctacgagaagaagttagaggattactgccgtattctctctgatatagaaactgcggtaaatggcattgatacagatttatttggcgccccaaataaccctaattctacagctatcacagcagatctaggttcatccgaagcagagaacctactgcagttgaagacaggcttagctgccatagtctctactgtcattgaggaattcacactgtttatggatatcgctgagagaatcgccgtgttacatcaaaaaacgaaaacactggcatcattgagcatatga

SEQ ID NO: 3356 - DNA, 1422 bp, Saccharomyces cerevisiae
atgactttaactaagcaaacatgcgccaagcaggcatgcgactgctgtcgtattcgtcgagtgaaatgcgatggtaaaaggccgtgtagcagttgcctacagaatagtttggattgcacttatctgcaaccgtcgagaaaaagaggtccgaagtccattaggttgaggagcttgaaaagaatagcagaagtgcagagggaaagcggtcctaacaccattgcaactgctcctgtaatatataagagggttcccaaaaagctaatcgatcagtgcttgcggctctatcacgataatttatacgtaatctggccccttctttcgtacgatgaccttcacaaacttctggaggaaaaatacaatgacaattacgtatattggtttctgaccgctttatcagcggccaccctcagtgatttacaaactgaaataaaatctgaagaggaagtcactttcacgggaaaacagttatctaatctttgcatctcatcgtgtcagcaatttgacgatttggataacagcaatatattcaatattatgacgtactactgtttgcatcgtagctttgcacaaatatcgaacgcaagaacttcttacagactctgttgtgaagcggtcggtctgattacggtagcagggttacatcgggaagaaacttacggatcccttacatttgaagaacagcaacttagacggaaactttattacttgcttctcatgacggagagatactatgccatatatcttcattgtgcgacgagcctggatgccacaatagcaccaccgcaacttgaacttgtaactgatcctcagctttctatggacagtttccttgaaatgattagggtatttactgtaccaggaaaatgtttcttcgatgctttagccgctgactctacagatgcttcttgcactgaagagtcattgaaaaagatatggaacgaactccacacaacttcctcggaaatagagccatggtctaacggttacatagacatctcattttcccggcattggattaggatactagcatggaagctagcttatcaaatgaggggtagcaacttttcattgaacgctaacaatgggcaaataccaatagaaattgcgagagatatgttaatagacacttacttaaccccagagaatctttacgatgtccatggtcccggggtaccagtgaaaacattagaaatagctactgctttggtggacattgtaggccagtatgatcataacatgaaattagaagcatggaatgttttgcatgatgtatgcaaatttgctttttctttaaaccactataacaatgatatgctgaagagattttccaccaaatgccagaatgccctaattactctgcccatttctaaacctttacaattggatggttatcccaaggataatgaagacatagacccttga

SEQ ID NO: 3357 - DNA, 1422 bp, Saccharomyces cerevisiae
atgcgatcttatatgcagattcttcaaaaatttgccaaatttattgggccagggatattagtcagtgtggcttatatggacccaggaaattatgccactagtgtttccggtggtgctcaatacaaatataccttattattctctatttttatatccaacatttttgccgtacttttgcaatgtctctgtgtgaagctgggtactatcactggctatgatttggctgaaaactgtcgtcataatttgcctaaaaagctaaactataccctttaccttttcgctgaagtggcaatcattgctactgatctggccgaggttgtaggcactgccatcgctttacaaattcttttcaaaataccactaacttggggtgtcttattaacggtgctagatgttttggtaattttaatgttctacacaccaaacggccagtccttaaaaaaagttagggttttcgaatttggcgttgggattttggtcattggaacttgcatttgctttgttttggagctgtttaaagtttcaatcccagacaaagctgaattgtttaaagggtttttgccttcaaatatcatttttaaggaacaacaagctctttacatttcattgggtatcttaggtgccactgtgatgcctcattcattatacttgggctcatccattgttaaaccaagattgcacgattacgatttgaagaaatacggtaaggttaatgcccgcccaagtttaagcgctataaaatatacgttaaactatgcgtacgctgaactaatcatttctttgttcttaattgccacctttgttaattccgctattttaattgttgcaggtgctactttatcaggccaacctgaggcagaggatgctgatttgttatctatttacaaattactggtccactacatatctcctgcggcagggttaatctttgcattggccatgttatgttctggtcaatctgccggtatcatctgtacacttgccgggcaaatcgtttctgagggatttttacagtggtctttaccaccttgggccacaagattgtgcaccagattgattgccattgtaccatgtttatttgttactttaaccatgggggaaaagggaatttcagatattttgaatttttctcaagtggtcttgtccttaattttaccaatcgtatccgctcctttaatttattttaccgcaaatagaaagttgatggttgttcatgacgaaaatggtgtggtaagagcacctgccgatgttaacgccattgctgatgaaaccactccattgaactccaagcacagtaaaatagttgattttactaacagtcgtttgttgacctatacctctgttttcgtatgggctttaatcgggagcttgaattgctatttggtgatttcctatctcttaggtgccgacatccatttttaa

SEQ ID NO: 3358 - DNA, 1422 bp, Saccharomyces cerevisiae
atgctcaggtgtgcggtcaagaagtttgcatattttgccaccttcctcactatcgtcgctaatatttacatctatacttatccatctttccatccagaacagtgttcatggaactgctctaacaagaacgcaccactacagaaagatttgacttttgtggacaaagtgaagaattacttcagtgatgttcgagagcaatggcatggtagccatgcctctgcaggtaacgatgaggatattcatattttggccttcggtgatcctcagattaaaggcatctggccaaagacgccatatgtgtcccgattagatacatacggtaatgactactatcttggtcacatctatgatatgatgcagcagagactgaagcctcaggtggtgactgttatgggtgatcttttctccagtcaatggatcggtgattccgaattccataatagaacgaaaaggtatattagcagaattttcaaaagagacccaacttctattgaaaatatcaaacaacagaacctcgatgagaaaggtcaatataaggcgaattggcctgaatggggagaccgttttaatgagattttagacaatgtcaaggaaaacgaggctgataatcaagaactttcttttgggtttggttatgaaaatatccactcatggaatccagacttggaagactttttaatcatcaacatcacaggtaatcatgatgtaggttactcaggcgacgcgacttatcaacatatgacaaggttccacgaccttttcggtaaggacaactattggattgaatacgaaaccaacactacccatccttggagaattgtagtgttgaatgatcttttactagaaggtcccgctttacaaccagaatttgttgaagctacttggatctttttaaaccaactaaatgaacgtaaattcaatggtagtactgttttgttgacgcatgttccattttacaagcgtgaagggttatgcgttgatggcccagacactaggtattatccagatgcccatgccccagaatcatataaatctgggcttttgagatcccaaaatcatttgagtgaatccgtttcaaatcaagttttgaatatgatatttgaaaatgggaagccaggtatcatattaactggtcatgaccatgagggctgtgaaacagtttataataaaaaatctacatctacttgggaagcgactaaaaatatcgaaagtgacgttttcgttaaagaaatcacagttaagtctatgatgggtgaatttaatgggaatactggtttggttacaggacacttcaacacagattcaatgacttgggagtggactttcagtttatgcccattcgctattcaacatgtttggtggttcgctaaagtgtccctgctcgtcaccatattcacttggtcctcgctactatttgtctaa

SEQ ID NO: 3359 - DNA, 1422 bp, Saccharomyces cerevisiae
atggcaaaggataatagtgagaagctgcaggtgcagggagaggagaaaaagtccaagcaaccggttaatttcctgcctcagggtaaatggctgaagccaaatgaaatcgaatatgagtttggtgggactactggtgttattggtatgctgatcgggtttccactgctaatgtactatatgtggatttgtgcggaattttatcacggtaaggttgccctacccaaggctggtgaatcgtggatgcactttatcaagcacctataccagttagtcttggagaacggtatcccagaaaagtatgactggactattttcttaacattttgggtgtttcagatcattttctactatacgttgcccgggatttggacaaaaggtcaaccattgtctcatttgaagggaaaacaattgccttacttttgtaatgccatgtggaccttgtatgtaactaccactttggtcttggttttgcactttaccaatctttttagattgtatgtcattattgaccgttttgggaggatcatgacatgtgccattatttcagggtttgccttctccatcatattgtacttatggactttatttatctcacatgactatcatagaatgacaggaaaccatctatatgatttcttcatgggagctccactaaaccctaggtgggggattttggacttgaagatgtttttcgaggttagattaccttggttcaccctttactttatcactttgggtgcctgtttgaagcagtgggagacttacggctatgtgacaccacaattgggggttgtcatgttagctcattggttgtacgcgaacgcatgtgctaaaggtgaagaattgattgttccaacctgggacatggcttacgaaaagtttggatttatgctgatcttctggaatattgccggtgtcccatacacttactgtcattgtacgttgtatttgtactaccatgacccatctgaatatcactggtctacactgtacaatgtttcgctgtacgttgttctattatgcgcctactacttctttgacacggcaaatgctcagaaaaatgccttcagaaagcaaatgtctggtgacaagacaggtaggaagactttcccatttttgccataccaaattttgaagaatccaaagtatatggttacctccaatggatcgtacctattgattgatggttggtacactttggctagaaaaattcactacactgccgattggactcaatctctcgtttgggccttgtcttgcgggttcaactcggtgttcccatggtttttcccagtattcttccttgttgtcctgattcacagagccttcagagaccaagcaaaatgtaagagaaagtacggaaaagattgggatgagtattgtaaacattgcccttacgtctttattccttatgttttctag

SEQ ID NO: 3360 - DNA, 1422 bp, Saccharomyces cerevisiae
atgggtgccgtaatttctttgccagttagcatggcgggctcattcgtggcgtcctgttttggaggttgctgctcaaacttggtgactaagactgcatcttccctaggatcttcttctttagggacaagacttctgtacgccgtttggcttttacttaactcattgatatcatgggtgtcctattctgcgaacaaatcaatcctatggccagggaagacatgtactgggactggggaatgtggattttttacagttcataggttgaattttgcattgggatgcttacatttgatattggcgcttgtactaacgggcgtaaagtcgactaatgacgtaagagcagcattacagaattcgtggtggagtttaaaatttatactgtatttatgtctcattgttttgtcatttgtcatccccaatgacttttatattttcttttccaagtgggtgtcagtccctagtggagcaattttcatcctggttgggcttatattattagtagacttcgctcatgagtgggctgaaacgtgtattagtcacgttgagtcagaagatgaagattcctcattctggcaacgatttttggttttagggacaacttcaatgtataccgcatcgattatcatgactgttgttatgtatgttatgttttgtcatcaacaatgtaacatgaatcaaacagcggtaacagtcaatttaatattaactgttataacgcttgtcttatcggtgaatcctaagatccaagaggccaaccctaaaagtgggctggcccaaagtagtatggtttctgtttactgtacttatttgacaatgagtgccatgtcttccgaaccggatgacaaaatgtgtaatccgttggttagatctagtggaacccgtaagtttagtatcattttgggctctttatttacttttattgcgattgcttacaccacaactagagccgctgctaatagtgcttttcaaggcaccaatactaatggtgctatatatctcgggaatgatatcgagtacgaaggactaggtggacagacaagaaatcagttgaggtatgaagctattaaacaagctgtagaagaaggatctttaccggaaagtgccttatatgataccgcttggttagggacatcatctcctacaggcgcaatggataaccaaaatgatgatgaaaggactggaaccaagtacaattacactctgttccacgttatattctttctggcaacccagtggattgcaattttactaacaataaacgttacccaggatgatgtaggtgattttatacccgtaggaagaacatatttttattcttgggtaaaaatagttagtgcatggatatgttatgccctttacggttggacagtggtagccccagcgattatgcccgatagatttgattacgagaattactattaa

SEQ ID NO: 3361 - DNA, 1422 bp, Saccharomyces cerevisiae
atgggtggagaaattattactttgcaagcaggtcaatgcgggaaccacgttggtaagtttctctggtctcaattggcgaaagaacacgctataggcaccgatgggctatctcagcttcctgattccagtacggaaagagatgatgacacaaagcctttcttccgcgaaaacagtaggaataagtttacgccaagggctattatgatggattccgagcctagtgtcatcgccgacgtggagaacacatttcgtgggtttttcgacccaagaaatacctgggtagcttctgatggcgctagcgctggtaattcttgggccaatgggtatgatataggaactcgtaaccaggatgatattcttaacaagatcgacaaggagattgattctaccgacaatttcgaaggtttccagttgctgcactcagtagccggagggaccggttcagggctcggatccaacctcttagaagcgctgtgtgatcgatatcctaaaaaaatactcacgacatattctgtgttccctgcaagatcttctgaggttgttgttcaatcttataacactattctggctttgagaagactgatagaagatagcgatgcaacggtggtgtttgataacgcttcgttgctgaatatttccggtaaagtgtttagaaatccgaacatcgatttacaacacacgaatcaattgatatcgaccataatatcttcagtaacgaacagtatacggtttccgagttacatgtattcatccatgtccagtatttactctaccttgattccttctcctgaacttcatttcctaagccctagtttcactccatttacatcagattatattcacgatgatatagcgcataaaggccattccagttatgacgtcatgttagatttattagacccttccaattctcttgtctctaccgcgatgaacaatccaacatattttaacgtttataatacaatcattggtaatgtagaacctcgtcagatatcgcgtgctatgaccaaattacaacaacgcatcaaattcccctcatggtcctcttctgcgatgcacgttaacattggaagaagatcgccatacttgcctttacaaccaaatgaaaacgaagttagcggcatgatgttaagcaatatgtctaccgtggtgaacgtctttgagaatgcgtgcaatacttttgacaaagtatttgccaagggcgcatttttaaataattataatgtaggcgacttgttccaatcaatgcagaacgttcaagatgaattcgccgagtcaagagaagtagtacaaagcctgatggaggattatgtagctgcagaacaagattcgtacttggacgatgtacttgttgatgatgaaaatatggttggcgagttggaagaggacctggatgccgacggtgatcataaattagtataa

SEQ ID NO: 3362 - DNA, 1422 bp, Saccharomyces cerevisiae
atgtccgaagaacggcatgaagatcatcatagggatgttgaaaataaattgaatttaaatggtaaagacgatattaacgggaatacctcaatctcgatcgaggtgcctgatggaggatatgggtggtttattcttcttgcttttattctgtacaacttttctacttggggggcaaattctggttatgctatttatttagcgcattatttagagaataatacttttgctggtgggagtaaattagactatgcttctataggtgggttagcattcagttgtggacttttttttgccccagttataacatggctttatcatatattttcaattcaattcattataggcttagggatactgtttcaaggggcagcgctactgcttgcagctttttctgtcacactctgggaaatttatctcacgcaaggcgttttaattggattcggtttagcatttattttcatacccagtgtcacactcatcccactatggttcagaaataaaagatctttagcctctggtataggaactgctggaagcgggttaggtggtattgtctttaacttgggaatgcaaagtattctacaaaagaggggcgttaaatgggcgctcattgctcagtgcataatatgcacatcacttagcaccattgcgcttatgttgaccagaacaacacatcaaggcctacgtcaacataagagatcttacaaatttgaattgctagattatgatgtgctttcaaatttcgcggtctggttactttttggatttgtatcatttgctatgttaggatatgttgtccttttgtattccttgtctgattttaccgttagtttaggttatactagtaagcaaggctcatacgtatcgtgcatggtgagtgtcggctctctgctgggacgaccaattgtgggtcacattgctgataaatatggatcactaacagttggcatgatattgcaccttgtcatggccatcctttgttgggccatgtggataccttgtaaaaatttggccactgcgatagcttttggattattggttggttctattatgggaacaatttggccaacaattgcttcaattgttacacgcattgttggtcttcaaaagcttcctggtacctttggtagtacctggatttttatggcggcttttgccttagttgcccccataatcggtctggaacttcgttcaactgatacgaatggaaacgattattatcgtacagcaatattcgtgggttttgcgtactttggtgttagtttatgccaatggctattgagagggtttataatagctcgagatgagattgctgtgcgtgaagcctattcagctgaccaaaatgaattgcatttaaacgttaagttatcacatatgagtaaatgtctttttcgttataaacaattacctaggagagtctaa

SEQ ID NO: 3363 - DNA, 1422 bp, Saccharomyces cerevisiae
atgtttcaaaggtctggcgctgctcatcacatcaaattgatttcatctcgaagatgccgctttaaatcctcctttgcagttgctttaaacgctgccagtaagttggtaactcccaagattctttggaataatcccatatcattagtctcgaaggagatgaacacattggccaaaaatatagttgccctcatcgggtctggccatccggtgctaaacaaggttactagttactattttgaaacagaaggcaaaaaagtacgtcccttgttagtgttgttgttgtcaagagcactttctgaaattcccatgacagaaagaaatcacttgaaaattgacaagtcggatgttcctgaggacccaatttactctaaacctagtcaaaatcaactatttcaacgtcctgcaagtagcatatccccactacatattcttcacggtattaaaccactaaatcccttgacaaaaggtcctgagcctttgccagaagaaacttttgacaaacaaagagggattttacccaaacagagaagattagcagagattgtagagatgatacacactgcgtctttacttcatgatgacgttattgatcattctgatacaagaagaggaaggccaagcggaaatgctgcctttaccaacaagatggccgttttggcgggtgattttctcttagggagagcaacagtgtcaatttcaagattacacaaccccgaagtcgtagaactaatgtctaatagtattgcgaatcttgtcgaaggtgagttcatgcaactgaaaaatacttccattgacgcggatatcgataccatcgaaaatggccataagctacttccggttccttctaaaaagcttgaagttaaagagcacgactttcgtgttccaagccgccaacaggggctgcaattatctcatgatcagattatagaaactgcatttgaatactacatacacaagacctatctgaagactgctgctttgatatcaaaatcttgcagatgtgctgctatattatctggggcatcacctgccgttatcgacgaatgctatgatttcggtagaaatctaggtatatgtttccaactcgtagatgatatgcttgattttactgtgtctggaaaagatttagggaagccatccggcgcggatctaaaattaggtattgctactgctccagtcttgtttgcatggaaagaagacccatctttaggtccactaatttcacgcaatttttcagagaggggtgatgttgaaaaaactattgattctgtgagactccataatggtatagcgaagacgaaaatactagcggaggaatatagggacaaggcattacaaaatctacgggattctcttcctgaatctgatgctcgttctgccctagagtttttaactaatagtatactaacaagaagaaagtaa

SEQ ID NO: 3364 - DNA, 1425 bp, Saccharomyces cerevisiae
atgaaattaaaattgatagtaaatggttgtgaagcacctgatgattataaattgctaagaactactatcaatacagttgcttcgctacgaaagacggctatcttaagatttaatagtgaaagattgacaataatatccactccaaaatcatcactcaacagcagtaacaacggtacaatattacgaggggatactggtcagctttggtgtaccattcctcatgatgtattcagattatatacagttatatcagctcgcgagctcaatacaataacaatggagtgtaattgtgattctttattgagtgtgtttaaaaggtatgatcgagtaatgaaccaaggatcttcctctaatatgactataaaactacagtcaatgccagaatggaatacaaataacggaacactttcaggaggaacagcaggaggcgtagatacaacctcaaaaccgaaccccatttgtgctctaggtataacattcgaagaaattgtacatactagcggcccaaatgacgctatagttatgaatgggggagtggatgagcacaatggtttaccaaccacagtaggcacaggaaatctactcgcaagcaataaggttatcatgcattcgttcaaagtacctgtcaaactattattccgagcacaagatacgcgaatacaagagccaatgattaactatattcaactgatgatgtacaagctgccaccaatatcgggcgagtttggctccgccttccacgggtttattagacgtgttgaacggtacagtaatgtcaaccacattcatttaatgggagtcaaaaaaaaggagcatggaaatgaaggtgatgatgtagaacttaagataattgtgaatgaattagattggcatttggaaatatgctggaatggacccttagactctgtgatacaacgccaagaagggctcactgacaatccttcccaaaaccagcacatcgacacagacggccggcaggaggaaggatctcttccgattatcgaagcggataaaccgatgtcttcactatataccaatactagagatcgagagatggaagaaaatatccgctacgatgaagatttattaagaattgaggatagctcgatcgcagatacgcggggaaacatttacacagctgatactagcggtgatactgaatttaatgacatatccgttatggtggaaaaggctgaacaggaaagttcgtccacacatgaagtaatcatccgttgcaaagattggaaggtgtgttccaagttatacgctgcatttgaagaagttgttttggcgatttctcacgacgaatcctgcgtattccactgttcgttggatcgtggtagcttggaagatagcgaagatgtggaaaaaccaagggaaagaggacaaatcatatattatatagcaagatcgaagggcttgtaa

SEQ ID NO: 3365 - DNA, 1425 bp, Saccharomyces cerevisiae
atgagtatttcaaattggatcaccactgcgtatttaattacatcaacatcttttcaacctctttatgggtcattttctgatgcacttggtcgaagaaactgccttttctttgctaatggggcttttaccattggatgtctagcctgtggtttctcgaaaaacatctacatgcttagttttatgagagcattgacaggcataggaggtggtggcttgatcacactttctacaatcgtaaattcagacgttattccaagttcgaaaagaggaatttttcaagcgtttcagaatttacttttgggatttggtgccatatgtggagcgtctttcggtggcacaatagcgtcgagcattggttggaggtggtgttttctcatccaagtacccatatctgtgattagttccatattaatgaattattatgtacctaatcagaaagaatataatcgtcaaaattctagcatattccaaaatcccggaaaaatactcagggacatagatgttatgggctcaattcttattataactggtctcacactacagcttctttacctgagcctggggtgttctacttctaaattatcatggaccagcccttctgtgctactgctattagttgggagtgtaataatcctcttactgttcatattgcacgaaaggaaaacaagtgctagagcgattattcctatggagctggtcaattcctcctacagtgtcgttgtactttcgataagtatacttgttggttttgccagctacgcgtatctttttactttaccattattctttcagattgtacttggagattccactgcaaaagcaggattacgtcttacgattccttccctatttactccggtaggcagtctcataacaggattttccatgagcaagtacaactgtctaagattattactctacattggtatttctttgatgtttttgggtaactttttattcctgtttattgaaaaaacttctccgaactggttgattggtctatttttgatacctgcaaatctaggacaaggtatcacttttcctacgaccttgtttactttcatatttatgttctctaagagtgaccaagctactgcgacatcaactttatatttattccgtagtattggatctgtatggggtgttgcaatttcagctggcgtcattcaattatctttcgcaggtttattgcgtagtaatttgaaaggtctactggatgaaaacaagataaagaaacttattgttcagcttagtgcaaactcctcatatattggatctttacatggcgaagttaaaaacacagtcataaagagttttgatgaggcaacaaagagggctcatctaatgtctacattactctcttcattggccctgatactctgcatccttaaagacaatctggcgaaacctaaaacaagaagataa

SEQ ID NO: 3366 - DNA, 1425 bp, Saccharomyces cerevisiae
atgtttagagtcaagatcatctctcagaaacgtacaaaaagtgtacagatgctagaaaacgatcaacttgatattttgggacaacaaccttcgctatacaaactatacactcaaatatgctctatctaccgtgtaccagatccttctgctcatgaccatatcgtaaataccttaacaagaggacttgaaacattggctaaaaatttccagtggctagcaggaaatgtcgtaaatgaaggtgctgacgaaggtaacactggtacctacagaattgtcccgtcagacaaaattccacttatcgtccaagatcttcgagaagatctgtctgccccaacaatggattcgcttgaaaaagctgactttcctatctacatgttagacgaaaagacttttgcgccttgcatgactatcaatccacctggaaacactataggtatggccgccaagagtgggcctgtatttgcagttcaagcaaactttatctccggcggcctcgtcttaactattgtcgggcagcacaatattatggatataacaggacaggaaagtatcatcaacttgctcaataaatcttgccaccaaaaacctttctctgatgaagaactgctcattggaaatatagataaaagcaaatctattcctttgtttgatgaaacttgggaacccgacaccacgctagttcatgaaatagtggaaacctctagaaatacaagtggagaggaaaaggaacagtcttgttcttcgaactctacttgggcttatgttgaattttctgctatctcattgcagaatctgaggattttggcaatgcagacatgtacttctggcacaaaatttgtctccactgatgatatcgtcactgctttcatctggaaatcagtttctcgagcccgtttatctcgacttaaaccagaaacgaaatcaaatttagggcgtgctgtggatgttagaaaacggctaggactccccgaaacgtatccagggttattagtcaacatgacctttaatacaggttccctgaaaagcttggatcataaaagtttgggcgttcttgcatcacagattcgcaggaagctagaccctaaagtcttcgatttggcctataatacatgcgcacttgctacgctccttagccgatgcccggacaagactaaggtttctatacctcaaccaattgatactttatctggaattatggtcagttcgtgggcaaaagtcagcctgtatgacgttgatttcaatctagggcttgggaagcccaagagtgtacgacggccgcgcttcatttcccttgagagcctaatatattttatgcctagatcctccagaggtgaaatggtggttgctctttgccttagagataaagattgggagtgcctgaatgcggataaagaatggacaaattatgctacacatataggatga

SEQ ID NO: 3367 - DNA, 1428 bp, Saccharomyces cerevisiae
atgcatgaagtagtaacgatatcggtttcgcagagagcaaaccatttgactactcaattcttcaatatacaagagggctatttacaattgtctaaagaacaacaagtcaatgactccaaaatttttctgaattcggttgtagataaagtttcaaaaacaatttcatatgcaccacgtgccttactttgggatgcccgtacaggtaatggttcactaggaacatatcaatattcagaaagccaagactatcatttcggcaatgaagacaaattcaaggagcaaacagttataaagactcatccaagaatacctaaatccgaatatcagagttctctagatgcaggagcaccgctgccttgtttgaacagagaaaatacgatgtattggtctgactattctaaacttatctatggtccttcaagtttcaatattttgagaaattggtaccatgacactgaaaatccaaaccaacctgactttcaaaacttgggggagcgaaagtttgacaggtattccattggttatgacgaatttaccgaaaattacttgcaagagttttttgatggaaatttgcatagagaattggaaaaatgtgacaccctgcaaggcttcaatcttgtaagtgatatggagagtggatggggcgggttttctagtgctctactggtggaattaaggaatgaattacctaaaaaggcggtcttttcatggggacacaatgaagatgatccattcacagatgacttccctatgaaaagactttcaaagaaatggctcccgatcatttcgaacaaattaagaagcacaataaatatgatgcaagaatccgatctttacttcccattgtatgctgctcctggactaactaattgggaaactgctggaaagagctgtaggatatttgattctataaatgcgacaatttcccaaagcaatcttgaacaaagaaagacaatggattatctaacaactgccattaccttaggatattcgtcgcgaaatatggtcactggcatggttatcggtgacaccgattactcattctgttctcgagtacttcctttcaagaatagccacaaaccaaattctactcacatattttcaaaaagtttcattgatagaggaaatcaaacgcataaacatcattccgaacctgattcacggagtaagatgattgaaatgtatacacacaggtattttccatctgatacgataccgacagaattttccaatgatcgtgaatttgttttggaattagaatcatctgaaaaaaatcgagatatattcaaacattggaatgagtttgtggtaaggtacttcaaaaatgatagtgacagagaagaattgaaaaatgaactttccgattacgcctcagcgtacgaatctgggtggtatgaagacgaagattctggtgatgacgatatgtga

SEQ ID NO: 3368 - DNA, 1428 bp, Saccharomyces cerevisiae
atggcagaccttcaaaaacaagagaatagtagcaggttcaccaatgtttctgttatcgcgcccgaatcacagggacaacatgaacaacaaaaacagcaggagcagctggagcagcaaaagcagccaacgggactgttaaaaggtttaaacgggtttccgagtgcaccacaaccgctgttcatggaagatccgccttctactgtctcgggagaactgaatgataatccagcgtggttcaataatccaaggaaaagagccattccaaattcaataataaagagatcaaatggccaatctttaagccccgtacgttctgatagtgcagatgtacctgcgttttccaattccaatggattcaacaatgtcacttttggctctaaaaaagatccacgcatccttaaaaacgtatctccaaatgataataacagtgccaacaacaatgctcatagttcagatttaggtacggtagtttttgattctaatgaggcaccgcccaagacctccttggcagattggcaaaaagaagatggtatattttcaagtaagactgacaatattgaagatcctaatttgtcttccaacataacctttgatggaaagcctacagccacaccttcgcctttccgtccactagaaaagacctccagaatacttaatttcttcgacaaaaacacgaaaacaacgccgaatactgcgtcaagtgaagctagtgcagggagtaaggaaggggcctcgacgaattgggatgatcatgccattattatctttggatatccagaaacgattgcgaattctattatactccattttgctaatttcggtgaaattttagaggattttagagtgataaaagattttaaaaagttgaattcgaaaaacatgtcaaaaagtccgtcattgactgctcaaaaatatcccatatatacaggagatggatgggtcaagttgacttacaaatccgaactttccaaatctcgtgctttacaagaaaatgggattataatgaatggaacattaattggctgtgtttcgtatagtccggctgctctcaaacaattagcttccttgaagaaatcggaggaaattataaacaataaaacaagttcacaaactagtttaagctcaaaagacctcagcaattatagaaaaacagaaggaatttttgagaaagctaaggcaaaagcagttacttcaaaagtgcgcaatgcagaattcaaggtttccaagaattctacttccttcaaaaatccacgcaggcttgaaataaaggatggtcgttcattatttttgagaaacagagggaagatccacagtggtgtcctgagctcgatcgagtctgacttgaagaaaagggaacaagcgagcaagagtaagaaaagttggttaaatagattgaataattggttatttggatggaatgatttgtaa

SEQ ID NO: 3369 - DNA, 1428 bp, Saccharomyces cerevisiae
atggcttctgcagtgtatttttgcgatcataatgggaaaccactcctatcaagaaggtatagagatgatattccgctttctgcaattgacaaattccctatattactctcggatttagaggaacaatcaaatctgattcctccatgtttgaaccacaatggtctggaatatctatttatacagcataacgatctatacgtggtggcaattgtgacttctcttagtgccaatgcggctgccatttttacttttttgcacaaattagtggaggtattaagtgactacttaaaaaccgttgaagaagaatctattagagataattttgttataatatatgaattactggacgaagtgatggattatggtataccacagatcacagaaactaagatgctgaaacagtacataacacaaaaatccttcaaactagttaaatccgccaagaagaagaggaatgctactagaccacccgtcgcactaacaaattcagtcagttggaggccagaaggcatcactcacaagaaaaatgaagcctttctggatatcgtcgaatctattaatatgctcatgactcaaaaaggtcaagttttgagatcagaaattatcggcgatgttaaggttaactcaaaattgtctggtatgcctgatctgaaattaggtattaatgataaaggcattttctccaaatatttggatgatgatacaaatatcccatcagcgagcgcgacaacatccgataataacacagaaactgataaaaaaccatcaataacatcatcatcggccacaaacaagaagaaagttaatattgaattggaagatttgaaatttcatcaatgtgtccgattaagcaaattcgagaatgaaaaaattataacgtttatacctcctgatggaaagttcgatttaatgaactacagactatctactacgataaaaccgttaatttggtgtgatgtaaacgttcaagttcattcgaattctagaattgaaattcactgtaaggccaaggcccaaattaaaagaaaatctactgcaactaatgtagagatattgataccggtcccggacgacgcggatacaccgacttttaaatattcacacgggtctctaaagtatgtccctgaaaaaagtgcaatcttatggaaaataagaagttttcccggtggtaaagagtactcaatgtctgccgaattgggactgccttcaatatcaaataacgaggatggcaatagaacaatgccaaaaagtaacgcggaaatcttgaagggacctgtccaaatcaaatttcaaataccctactttactacttcaggtattcaagtacgttatcttaaaattaacgaacccaaattgcagtataagagttacccatgggtaagatatatcacgcaaagtggtgatgattatacaataaggctgacgtaa

SEQ ID NO: 3370 - DNA, 1428 bp, Saccharomyces cerevisiae
atgtctgaagcgatattccagccaacggacattgtccttgccaaagttaaaggcttttcagcatggccagcaatgattatccctaatgaactcatcccagataacatcctcaagaccaaacctgtgagtgtccacaaaggcaaatcaggtagtgataaaaaagcaaatgaagatatagatgcagacatggaatcagaggctagagatcgagagcaaagcgaagaagaagaagatatagaggattttggtgagagtgaggctaatcctgaaaaatttataatatacactcccgttctgaagtttcgtaaaaatgatacgttgaaatcgacttactgcgtcaagtttttttgcgatgattcttatatctgggtgaagcccatggatatgaagattctaacaagcgaagattgtcgtaagtggctaagcggcaaacagcggaagaataagaaactcataccggcatatgaaatggctatgagaggcaaaaatggaattgatatttgggaatttgtggaatatgggtcttacggcaagccagatgaagaggaatatgtagaggaagaggaagaagagaacgaacctgaaaaaaaggctataaggccaaccaggtcttccagtagacagcgtcagaagcgcgcctcagaaacggaaaagagtgagggcggtaatagcaataaaaggaaaagagttactagatcgactaggcaacaagcgatagatgcttcagaagaggaagaggaggaagaggaggaaaaagtacaagaggctgttagaaagaggccgcaaaggaccaaaactaagaaagttgtagtatccaagactaaaccaaatccaaaaacaaaggcaaagaaagagaaacctaaaccacctaagccaatcaaatatcattttgaagatgatgaagattggagcattgttgggttgggcccacaagatctatcaatcgaaaaaacgatggatccgattgcgaaaaaactgtcgcagaagaaaaatctagaaaagcatgtggagattaagctagatctggaggataaactagcaggtatcaacaagctcctgtgtgatgtcttatgttcagccattaaccaggctgtttcgataaaggatgatttcgaaataatattagatgaattgcagattgcccttgacaccagggggtccagaaacgaatttataacaattttccaatcaaataattccctactgttaaactttaggatattatttaacttaagaaaaagggaactgaacaaatgggatctgtgggatcgtttccaggatattttcaagcatatttattcctaccagttcatacctgatacggaagattggcaactagagcaaaatatggaaattgaagaaatggatcgggaaaagccgagctttagtgaagacgtaaaggaagaagaaagcaaagtaggagcatga

SEQ ID NO: 3371 - DNA, 1431 bp, Saccharomyces cerevisiae
atgaaattctcaactgccgttactacgttgattagttctggtgccatcgtgtctgctttaccacacgtggatgttcaccaagaagatgcccaccaacataagagggccgttgcgtacaaatacgtttacgaaactgttgttgtcgattctgatggccacactgtaactcctgctgcttcagaagtcgctactgctgctacctctgctatcattacaacatctgtgttggctccaacctcctccgcagccgctgcggatagctccgcttccattgctgtttcatctgctgccttagccaagaatgagaaaatctctgatgccgctgcatctgccactgcctcaacatctcaaggggcatcctcctcctcctcctcctcctcggcaacttctaccctagaaagcagctctgtttcttcatctagtgaagaagctgctccaacatctactgtcgtgtcaacttcttccgcaacccaatctagtgcttcttctgccactaaatctagtacttcttccacttcaccatctacttctacttctacttccacttcttctacttcctcttcctcttcctcctcctcctcctcttcttcttcttcttctggcagtggtagtatctacggtgatttggccgacttttcaggcccaagtgagaaattccaagacggcactattccatgtgacaaattcccatctggtcaaggtgtcatttctattgactggattggcgagggtggatggtccggtgtggaaaacaccgacacttccactggcggttcatgcaaggaggggtcctactgttcctactcctgccaaccaggtatgtctaagacccaatggccatccgatcaaccatctgacggtagatctgtcgggggtttgttgtgtaaaaatggttatttgtaccgttctaacactgacgcggattacttatgtgaatggggtgtcgaggctgcctatgttgtttctaaactaagcaagggtgtcgccatttgcagaaccgactacccgggcactgaaaacatggttatcccaacctatgttgaagggggtagctctttgccattgaccgttgttgaccaagatacttactttacttgggaaggcaaaaagacatctgctcaatactacgttaataacgccggcgtctcagttgaagatgggtgtatctggggtacttctggatctggtattggtaactgggcaccattaaactttggtgctggctccactggtggagtgacatacttatcattgattcctaacccaaacaacagcgacgcattgaactacaacgtcaagatagttgctgctgatgattcatccaatgtcatcggtgaatgtgtttacgaaaatggtgagttctctggcggtgctgacgggtgtaccgtctctgttacttccggtaaagctcatttcgtcttatacaattaa

SEQ ID NO: 3372 - DNA, 1431 bp, Saccharomyces cerevisiae
atgaggcaggtttggttctcttggattgtgggattgttcctatgttttttcaacgtgtcttctgctgcccaatacgagccacctgcgacttgggagaatgttgattataagaggacaatagacgtgtcaaacgcttatatttcagaaacaatcgaaataactatcaaaaacatagcaagcgaacctgcgactgaatacttcacagcctttgagagtggcatcttcagtaaagtttcctttttttcagcctattttaccaacgaggcaacttttttaaatagccaattacttgccaattcgactacagcacctggtgacgatggtgaaagtgaaattagatacgggatcattcaatttccaaatgcaatttcccctcaggaagaagtttctttagtgattaagagcttctataataccgtaggtattccttatcctgagcacgttggaatgtcagaagaacaacacctattgtgggaaacgaacagattgccgctttctgcttacgataccaagaaggcctcttttacgctgattggtagctcatcatttgaggagtaccaccccccaaatgacgagagtttactgggaaaagctaatggaaactcttttgagtttgggccttgggaagatattccgagattttcttcaaacgaaaccttagcaattgtttattcccacaatgccccattgaatcaggtagtgaatttgagaagagatatttggctttctcattgggcttccacaatacaatttgaggaatattatgaattaacaaacaaagccgcaaaactgtctaaaggattttcaagattagaattaatgaaacagattcaaactcagaatatgagacaaactcactttgttactgtcttagacatgctcctgcctgagggagctactgatcattatttcactgatttggttggccttgtttccacgtcgcatgcagaacgtgaccatttctttataagaccaagattcccaatctttggaggttggaactacaattttactgtcggttggactaataaattgtccgatttcttgcatgtatcctctggctcagacgagaaattcgttgcttctatcccaattctaaacggcccaccggacactgtatatgataatgttgaattatcggtatttcttccggaaggggccgaaatattcgatattgattctccagtcccttttacaaatgtttctatagaaacccagaaatcatactttgacctaaataaaggtcacgttaaattaactttcagttacagaaatttgattagtcaagttgccaatggccaagtcttgataaagtacgactacccgaaaagctcttttttcaagaagcctctgtctattgcttgctatattttcaccgcactaatgggagtttttgtcttaaaaactttgaacatgaacgtaactaactga

SEQ ID NO: 3373 - DNA, 1431 bp, Saccharomyces cerevisiae
atgagttttagaaggattaactctagatactttgaaaatagaaaaggaagcagtatggaagaaaaaaaagcaaaggttcctccaaacgtcaacctttcgttatggagaaagaacacggtagaaagcgatgtccatcgattcaattctcttccatcaaaaattagtggggccctaactagggaacaaatatactcctatcaagtcatgtttaggattcaagaaattaccatcaaactgcgtacgaacgattttgtgcccccctccaggaaaaataggtcaccttctccgccaccagtttatgatgcccaaggtaaaagaacgaatacccgtgagcagaggtatagaaagaaactagaggatgaacgtattaaacttgttgagatagccctaaagaccatcccttacttcgttcctccggatgattacaagagacctaccaaatttcaggacaagtattatatcccggtggatcagtatcctgatgtcaattttgttggtttattattaggtcctcgtggacgtacgttaagaaagctgcaagaagattcgaattgtaagattgcaattagaggaagaggttcagtcaaagaaggtaagaatgcaagtgacttacctccaggcgccatgaactttgaggaccccttgcactgtttaattatcgcagactcggaagacaagatccaaaaaggtataaaagtttgtcaaaacattgttatcaaagcggtgacatctccggaaggccagaatgacttgaaacgaggacaactgagagaattggcggaacttaatggtactttaagagaagataacaggccctgtccaatctgtggtttaaaagatcataaaaggtacgattgtccaaacagaaaaatcccaaatatacagggcattgtttgcaaaatatgtggacaaactggacatttcagtagagactgtaactcatcgtctcaaagaatgagccgttttgacagaaacgccacggtaaataattctgcgccaatacagagcaatgacgtacactataatagcaatactcatccaattcaagcaccaaaaagatctcgttatgacaataactcgacggaacctcctttaaaatttccggcttcttcacgttatgcaccatcaccttcacctcctgcgtcacatatttcgaggcaagctcaaaacgtgacgcctacaccccctcccggcctaacatcaagtagctttagttccggagttccaggaatcgcccctcccccattacaaagccctccagagtcggaacaaccgaaattttcgctacctccacctcccggtatgactacggtacaatcctcaattgcacctcctcctggcctaagcggtcctccagggttttctaataacatgggcaatgacattaacaaacctacacctccgggactgcaagggcctcccggattataa

SEQ ID NO: 3374 - DNA, 1431 bp, Saccharomyces cerevisiae
atgatagcttccaaaagctccttattagttactaaatcgcgcataccctctctatgctttcctttgataaagaggtcctatgtgtcaaagactccgacacactctaacacggctgctaatctgatggttgaaactccggccgccaatgccaacggcaatagtgtgatggcacctcctaactcaatcaattttctacagacacttcccaagaaggaactattccaactgggattcatcggtattgcgaccttgaacagcttcttcctgaacacgatcattaagttgttcccttacatccccatcccagtaataaaattcttcgtctcttctttatactgtggcggtgagaactttaaagaggtcatcgaatgcggcaaacgtctgcagaagagaggtatatcgaacatgatgctttcattaactattgaaaattccgaaggtacaaagagtttgtccagtactccagtagaccaaattgtcaaggaaacaatcagctctgtccacaacatcctactgcccaatattattggccagctggaatctaagccaatcaatgacattgctccaggttatatcgctctaaaaccctctgctttggtcgataaccctcacgaggttctgtacaatttcagtaatcccgcctacaaggctcaaagggatcagctgatcgagaactgctctaagattacaaaagagatttttgaactaaatcaatctttgttaaagaagtaccctgaaagaaaggccccatttatggtttccactattgacgctgagaagtatgatttgcaggagaatggtgtttacgaattacagagaatcttatttcaaaaattcaatcccacttcatctaaactgatatcatgtgtcggtacttggcagttgtacctaagggactctggtgaccatattttgcacgaattgaagctggcccaagaaaacggctataagcttgggctgaaactggttcgtggtgcttatattcattctgaaaaaaaccgtaaccaaattatctttggcgataaaacgggcactgacgaaaattacgatcgtatcatcactcaagttgtcaatgatttaatcatcaatggcgaggattcttattttggtcacttggttgtcgcctctcataattaccaatcccaaatgctcgttactaatttgctaaaatctacccaagacaactcttatgccaaatcgaacattgtgttggggcaattactaggtatggcagataatgttacctatgacctaattaccaaccatggcgctaaaaacataatcaagtatgtcccatggggcccaccattggaaactaaagattatcttttgagaagattgcaagaaaacggggatgctgtgagatctgataatggctggccattaatcaaggccatagcaaagtcgattccaaaaagagtaggcctatga

SEQ ID NO: 3375 - DNA, 1431 bp, Saccharomyces cerevisiae
atgctgtccattttaagaaattcggtgagactaaattcaagggctcttagggttgtgccatctgccgccaacaccttaacatcggttcaagcatccagaagacttttaacaagttattcaagttttttacaaaaagaaacaaaagacgacaagcctaaatccattcttacagatgatatgctgttcaaggccggtgttgacgtcgatgagaagggccaaggcaaaaacgaggaaacatcaggagaaggaggagaggacaagaatgaaccttcttccaaaagtgaaaaatctagaagaaaaagacaaacttctacagatattaaaagagaaaagtatgctaactggttttacattttttcgttgtctgcgttgacaggtactgcaatctacatggcaagggattgggagcctcaagagtctgaagaattgaagaaagacatcgataatggctacactttatcacttatgtataaaagattcaaggccaggttcaactcaatgttcacctacttccaagagccacctttccctgatttactacctccaccaccaccaccaccgtaccaaaggccattaactcttgttatcacattggaagattttttggttcattctgagtggtctcaaaagcatggttggagaacggccaaaagacctggtgctgactacttcttgggttacctatcgcagtattacgaaattgttttgttttcatccaactatatgatgtactctgacaaaatcgctgaaaaattagatccaatccatgcattcgtatcttataatttgttcaaggaacactgtgtttacaaagacggtgtgcacattaaggatctgtcaaaattgaatagagatttgagtaaagtaatcattattgacactgaccctaacagttacaaattgcaacctgaaaatgctattccaatggagccatggaatggtgaagctgatgacaaattagtaagattgattccatttttggagtaccttgccactcaacaaaccaaggatgttagaccaatcttgaacagctttgaagacaagaagaacctagcagaagaatttgatcatcgtgtgaaaaaattgaaggataaattttacggagatcataaatctggtggcaactgggcaatgacggcactaggtctcggaaattccctgggcggcagcaccaagttcccgctcgatttgattcatgaagaaggacaaaagaactatttaatgttcatgaagatgattgaggaagaaaaggaaaaaattagaatacagcaggagcaaatgggcgggcaaacatttacgctgaaagactatgttgaaggtaacttgccttcgccagaagaacaaatgaaaatacaattggagaagcagaaggaggtagacgccttatttgaagaggaaaagaaaaagaagaagattgctgaatccaaataa

SEQ ID NO: 3376 - DNA, 1431 bp, Saccharomyces cerevisiae
atggctgacaattctacttccagattttatactaatctattgatagctaattatctcaaacataacggtctggaagatacattagctgcattcataagggagacagcgttacctctttctgccttagaaaagtccgatagttcaaatagtaatgtcggtgagataccgctagaagacttgcagagtgtcgttgaagataggatttactacaaaagacggtctttcaaagataggtttaaaactctttcaataaacgatgatttagccccaattgacaatgctaagtatggaattcaaccttggaaccatagtttgaaatttagtattgatgtaaaattgaacaaatccttacccaaagataccttgttcattagcgcaacttttacagaagatagcaaatatatattactttcgtcagctactggatacctagtaatctacgacattgagaaagcgacgtcgaagtcatttaaaattaatgaaaaagtcaagagcatcgtcaagctgtacggacccattggtagctccggttaccaatatgtatgtccaatgaacggaagtttttacttgctaaataacgattttgaactggtgaacaacgcagtatggaaaattcatgccagaatgattacgcatataaagatctgcaatgttacggaatcatcttggtttgttattactagtggaatggataacttcctgcgattgagtttgttggagataaaaaacgggaacactttcctcacaaaactctccgaaataaagttggcttccaattgtacgtcgttgaatgtaatcgccaacggtgacggcaatggtcagaatagtttctctgtgtttcttaccagagcagaatacactcatatagcatgttactcaattatagatgccaaaaatcttgtccattcatacaatattgccttaaacaatgcggaatttagcacgtacgctttcaacattcgagacgtaatggcagtagattatgttcattccaatactaaggatacgataggattatcacccagtaccatgctagttgtagccacgtcacataaaccatacatgagattgattttagtagaaatacctatgaatacaggccatccaaaggcaatgaaattggataaagttcagacttactacgataaaatcttacgaaattttgcgacagaaatatatcaagatgatttctcattaccaattctcggcaaattagaatcttctaatggtgtattggtaggaaatgatgaaggtatttacagtgttgatttgatgactggtgattcgagaattttaaatattcctggtgaggcaaactccttgcacgacaggataaagtgtatggatatcagtaaggaccaaatgagaatggtcgctggaacgtctactaagtcaatttacatcctaaatgtaatcagaaatgcacagtaa

SEQ ID NO: 3377 - DNA, 1431 bp, Saccharomyces cerevisiae
atgtcatcatcagacatctttgatgtactaaacattaagcaaaaatccagaagtccaactaatggccaggtatcagtgccttcgtcctcggcagccaaccggcccaagcctcaagtgacgggcatgcaaagagaactatttaacctgctaggagagaaccaaccccccgttgttattaagtctggaaataactttaaagaaaaaatgctttcgacgtccaagccatctccttggtcatttgtagagttcaaagctaataactctgtgactctgcgtcattgggtcaagggttccaaagaattaataggagacacaccaaaagaatcgccatattctaagttcaatcagcatttatctattccatcattcaccaaggaggagtacgaggcttttatgaatgaaaacgaaggaactcaaaaaagcgtagaaagtgaaaaaaaccataacgaaaactttactaatgaaaagaaggatgaaagtaaaaatagctggtcttttgaagaaatagaatacctgttcaatctctgcaaaaaatacgatttacgttggttcctgatctttgacagatacagttataataattcaagaacacttgaagatctcaaagaaaaattttattacacctgtaggaattattttaaagcaagtgatcctagcaatccgcttttatcttctttgaatttttcagctgaaaaggagatagagagaaaaaagtatttacagcgtcttctttctcgttctgcagcagaaattgctgaagaagaggcactcgtagtagagtccaaaaaatttgaaatggctgccaagagaacacttgcagaaagagaatcattactccgactgttggactcgccacattcagatcagacaattacacaataccttacctctcagggaatgtctcagttatataacgcgcttctagcagataaaactagaaagcggaagcacgatttgaacatccctgaaaatccttggatgaagcagcaacagcagtttgcccaacataggcaacttcaacaactgaatgtaaaaaagtcagaagtcaaggaaaatctctcccccaagaaaaccaaaagacaaagacaggaaatgcaaacggcgctcaaaagaaagtcagaaagcgcatatgcagaacaattgctgaaagatttcaattcagatgaaaggaaggctttaggtgtgattacgcatggtgagaagctatcgccgggtgtatacttaagatctacaaaattatcgaccttcaaacctgcgctgcagaacaaaattctcgccattcttcaagaattatcgttaccttctcgccctgtgatgccctcatttgatgtaatggaaagacaagaggagcttttgaaaaaaatcaatacgcttatcgatttaaaaaaacacgttgacaaatacgaagctggtatgtcaatcaccaagtga

SEQ ID NO: 3378 - DNA, 1431 bp, Saccharomyces cerevisiae
atgttacaagataataatgggcccgctgttaagagggcgaaaccctcagaaaggttgcaatgtgaatatttcatggaaaaaaagaaacgaagatgtgggatgaccaggagttctcagaacttgtattgttcagagcatctgaatttgatgaaaaaggcggctaattctcaagtgcataataagaatggcagtgaagcagagaaagaaagagaaagagtaccttgtccgctggatcctaaccatacggtttgggcagatcaattaaaaaagcatttgaaaaaatgcaacaagaccaaactaagccatttaaacgatgataagccatactatgaaccgggctataacggagagaatggactgttatcgtcgtctgttaaaatagatattactgcggaacatttggtacaatctattgaattgctgtataaggtgtttgagggagaatccatggacgagctgcctttgagacaactgaacaataagcttatgtctctaaaacgattccctcaattgccttcgaatactaaacatgctgtacaacagtcttcactgatcgaaaacttagtggacgctggcgcatttgagaggccagaaagtttaaacttcattgagtttggatgtggcagggccgaattctcgcgctatgtcagtctgtaccttttaacacaattgacaagccttccagcggagcactcgggttcaaactcgaacgagttcgtgttgattgacagagcaactaataggatgaagttcgataaaaagataaaagacgatttttcagaaataaagtcaaactcaccttccaaacctattagctgccccagcatcaaaaggataaagatcgacattagggacttgaagatggatccgattttaaaatcgacacctggggacgatatacaatacgtgtgcatctcaaaacacctttgtggtgtagctacagatctaactttgaggtgtataggcaacagctcaattttacatggcgacgataacaacggatgcaaccccaaactaaaggcaatttgtattgccatgtgctgcaggcatgtctgtgactacggcgactatgtcaaccgcagttacgttacatcacttgttgaaaagtatagggcccatggctccatcttgacgtacgaaacctttttccgcgttttaactaaactctgttcatggggtacctgcggaaggaaaccaggtacggctattacagatatagtaaacgttgtcgaatcgtttgaaggggctgagccatatacaataaccattaaagagagagaaaatattggattaatggctaggcgtgtaatcgacgagggcaggttggtatatgtgaaagaaaagtttacagagtttaatgcggagctgataaggtacgtagaatccgatgtttctttagagaacgttgctatgttagtttataagaaatag

SEQ ID NO: 3379 - DNA, 1434 bp, Saccharomyces cerevisiae
atgacattgaataggaagtgcgtagtgatacataacggatcgcacagaacggtggctggatttagtaacgttgaattgccacaatgcattataccctctagctatattaaaagaacagatgaggggggggaagctgagtttatattcggaacctacaatatgatagacgctgcggcagaaaaacgcaatggtgacgaggtgtatacattggtagatagccaagggttaccgtacaattgggacgcattggagatgcagtggagatatctgtacgacacccaattgaaagtttcacccgaggaactgccactggtgattacgatgcctgccaccaatggtaaaccggacatggccatattagagcgctactatgagctggcgttcgacaaattaaatgtaccagtattccagattgtaatcgagccattggcaattgccctatccatgggcaagagttctgcattcgtgattgatatcggcgcgtcaggctgtaacgttactcccatcattgacggtattgtggtgaagaatgctgtagtgagatctaaatttggcggtgatttcttggattttcaagtacacgaaaggttggctccactgattaaagaagagaacgacatggaaaacatggccgacgagcaaaaaaggtccaccgacgtttggtacgaagcaagcacgtggattcagcaattcaagtctactatgttgcaagtaagcgaaaaggacttgtttgagttggaaaggtattacaaagagcaagcagatatatacgctaagcaacaggagcagttaaaacaaatggatcagcaacttcagtacacggcgttaacgggaagccccaacaatccgttggttcaaaagaaaaattttctattcaagccattaaacaagactttaaccttggaccttaaggagtgctaccaattcgcagagtatctcttcaaacctcaactgatatcagacaaattctcaccagaggacggactgggaccgctaatggcaaaatcagtcaagaaggccggcgctagtataaattcaatgaaggccaatacctccaccaacccaaacggattgggtacaagccatataaacaccaatgttggcgataataacagtactgccagcagcagcaacatatcaccagaacaagtatactcgctactgttgacgaacgtcatcatcacaggatctacctctctgatcgaaggtatggagcaacgcataataaaggagctgtcaatcaggttcccgcaatacaaattgacaacttttgccaaccaagtcatgatggaccgtaaaatccagggatggctgggcgcccttacaatggccaatctgccatcatggagcttgggaaaatggtactctaaggaagattacgaaacgctgaaaagagacagaaagcagtcgcaggctacgaacgcaacaaactag

SEQ ID NO: 3380 - DNA, 1434 bp, Saccharomyces cerevisiae
atgactgacacaaaacagctattcattgaagccggacaaagtcaacttttccacaattgggaaagcttgtctcgcaaagaccaagaagaattgctttcaaacctggagcaaatatcttccaagaggtcccctgcaaaactactggaagactgtcaaaatgctattaaattctcactagctaactcttctaaggatactggcgtcgaaatttcaccattgccccctacttcgtacgagtcgcttattggcaacagtaagaaagaaaatgaatactggcgtttaggccttgaagctattggcaagggtgaagtcgcagtgattttaatggctggcggacaaggtacgcggttaggatcctctcaaccaaagggctgttacgacattggattgccttctaagaaatctctttttcaaattcaagctgaaaagttgatcaggttgcaagatatggtaaaggacaaaaaggtagaaattccttggtatattatgacatcaggccccactagagcggctactgaggcatactttcaagaacacaattattttggcttgaataaagaacaaattacgttcttcaaccagggaaccctgcctgcctttgatttaaccgggaagcatttcctaatgaaagacccagtaaacctatctcaatcaccagatggaaatggtggactctaccgtgccatcaaggaaaacaagttgaacgaagactttgataggagaggaatcaagcatgtttacatgtactgtgtcgataatgtcctatctaaaatcgcagaccctgtatttattggttttgccatcaagcatggcttcgaactggccaccaaagccgttagaaagagagatgcgcatgaatcagttgggttaattgctactaaaaacgagaaaccatgtgtcatagaatattctgaaatttccaatgaattggctgaagcaaaggataaagatggcttattaaaactacgcgcaggcaacattgtaaatcattattacctagtggatttactaaaacgtgatttggatcagtggtgtgagaatatgccatatcacattgcgaagaagaaaattccagcttatgatagtgttaccggcaagtacactaagcctaccgaaccaaacggtataaaattagagcaattcatatttgatgtctttgacactgtaccactgaacaagtttgggtgcttagaagtagatagatgcaaagaattttcacctttaaaaaacggtcctggttctaagaacgataatcctgagaccagcagactagcatatttgaaactaggaacctcgtggttggaagatgcaggcgctattgtaaaagatggggtactagtcgaagtttccagcaaattgagttatgcaggtgaaaatctatcccagttcaaaggtaaagtctttgacagaagtggtatagtattagaaaaataa

SEQ ID NO: 3381 - DNA, 1434 bp, Saccharomyces cerevisiae
atgtacaacagaaaagacagagatgttcacgagaggaaggaagatggtcaatctgagtttgaagcactgaacgggaccaacgcaattatgtccgataatagtaaagcgtattccataaagtttctgaccttcaatacatgggggttaaaatacgtctccaaacaccgtaaagaaagactcagagcaattgctgataaattggcgggccactcaatgcttacgccaatatctgacgagttgttgcccaatggtggagatagtaatgaaaacgaagattacgacgtgattgccttacaagaaatctggtgtgtggaagactggaagtatctagcttctgcgtgtgcctccaagtatccgtatcagcgtttgttccattctggtattctgacggggcctgggttggccatactgtccaaggtcccgatagagtcgacctttctttaccggttcccgataaacggtagaccgagtgcggtgttccgtggcgactggtacgtagggaaatctatagcaatcaccgtattgaacacaggaacccgccccattgcaataatgaacagtcacatgcacgccccatacgccaagcagggtgatgccgcctacttgtgccacagatcttgtcaggcctgggatttcagcaggctcattaagctttacaggcaggccggttatgcggtgattgtggtgggtgacttaaactccagaccgggctcactgccccacaaatttctcacgcaggaggccggcctggtcgactcctgggagcaattgcatgggaagcaagacttggcggtgatcgctcgtctgtctccattgcaacaattgcttaagggctgtaccacgtgcgattcgctgctcaacacatggagggcccaaagacaacccgatgaggcatgcaggttggattatgctcttatcgaccctgatttcttgcaaacagtagacgcaggtgtcaggttcactgaacggatccctcacctggactgcagtgtctctgaccattttgcatactcatgcacccttaacatcgtcccacagggcacagagtcccgtccatccacctccgttaagcgtgcgaagactcatgatagagagctgatcttgcagagatactccaactacgaaaccatgatagaatgcatccacacgtacttgaagacagcccaaagacagaaatttttccgtggcctacatttctgggcctcaatacttctcctaatagcgtcgttggtcgtgacaacgtttactgcaaacaaggcaggctggtcctccatcttctgggtccttttcgctattgctgtctccatctcgggcaccatcgacggtgccatctccttcttgtttggcaggtctgaaatcagagccctcatcgaagtcgaacaagaggttctggacgcggagcaccacctgcaaactttcttgagcgagaaatga

SEQ ID NO: 3382 - DNA, 1434 bp, Saccharomyces cerevisiae
atgtttcgaaggggagataattcaaattttaacgtacaaaatagcttctttcttcctttggaatacgaatataccgtaaaagataatgtaccttcaaaaaaaaagagtagtataggtttttttccattagatgattctttattcacatcaaaaaacaattcagggcaccataaaagcgaacagctccatcgcggtaatgcagaaactatcagaagccagtttggaactgacgcagttccgataaggatcgatgagaaagaaggaaagtgggatagaattcaagatgataattcttctaatttaaactaccaaattaacaacagtaatgacccagcttcgagtggtaaatatacccagagtattgactgtaaccatatagcggagtcaaaattttcaaaaaaaaatggaaacattgatagtcttcgttcaaactcagcaacttttatgctaaatactgcagatgaagacgtgatagaatttagttttgacgataatgtcccttatgctgagttattatctggtgccacccttgaaaaatgttcgttgactctaaatgaaataaacaaaaaactattcaatacgctctatgactttcgagtaagcaaagataatcccgaagaaaatttggtagaactaatacttccgaactgcgtggtgttattaaacttttttgaagacattgaactcttggccgactcttctgatgaggctttcgaaaaatctactttcattaacacaattgagttcattgtgcacgatatttgggtcgaaacgttgataaagaacataaacttattacaaatgtttgatgcagatttgaaatgctacaatgacaagtacataatttgcaagctaaagggtcagtatccctccacaaatatagtggacataatgtgccgtttgaagcatttttccaattctattttggaaactttcaaattcggaatcgagctaaaagaacaagatcaatgccacaatagaaacactattatcaactacgttcttttcagtagagtattttcaacgattgttttagagattcaaaaatgctttatcttgatcgttaagttcatgtattctgtcaattttttagaaaaattttccgatgaagtatttttgtcatttattgaaattctcataaaaattgtctttgagcaccagattccgcagttatttttgggaattgatgaaattattcaactctggttaaagaacaatgaaggaaaacggcaacaactcttgagcgcttggtgcaacggaactgttcaagatatgaagcaaagccaacaaagagagtcctcaaacgcagaatctgaatcaatcacttcaagtacagaagaggacgaagaaggcctccaattcaataaatgggatgtgattgaaccatttattgataatatcaaggctttgaatcaatcaaaatcccatatgtga

SEQ ID NO: 3383 - DNA, 1437 bp, Saccharomyces cerevisiae
atgaaattctctaccatcttacctatactttgggcaaattgctgtctttgtatgatcatccctgatttcgacgggatagttcgttttattgagaatattgatggtactcgcagtgtaagagcaggagaaggtttgggacagcatgatcctggaaattttcacactgaacatcaacatgtcgctcataaaacagagtttcttccttatcggtatgtcatagtctttaatgaagatatttccctccagcagattcaatcgcatatgcaagtggtacagaaggatcatagtacctcagtaggtaagcttacagaaaatgacgctttttggagggtaatttcttcttcagtatcatctaaatctcaatttggaggtattgataatttttttgacataaatggtctatttcgaggttatactggctatttcactgatgaaatcattaaaataatctcccaggacccaatcataaagttcgtagagcaagaaactacagtaaaaatatctaattcgtcattgcaggaagaagcgccttggggtttacatagagtttcgcacagggagaaaccaaaatatggacaagatttggaatatttatatgaagatgccgccggaaaaggtgtcacatcatatgtactcgacacaggaattgataccgagcacgaggactttgaagggcgtgctgagtggggagccgttataccagcaaacgatgaagcttctgatttgaatggtcatggaactcactgtgcggggattatcggatcgaagcactttggtgtagccaaaaatacaaaaatagtagctgtcaaagttcttcgttctaatggggaagggacggtttcagatgttattaaaggtatagagtatgttactaaggagcatatagaatcgtcgaagaaaaagaataaagaattcaaaggatcgactgccaatctttctttgggaagtagcaaatcgctagctatggaaatggctgtaaatgcagctgtagatagcggtgtccattttgctattgcggcaggaaatgaggatgaagatgcttgtctcagttcaccagcaggagctgaaaaaagtattacggtcggtgcttcgacatttagtgatgatagagcattcttttcgaactggggcacatgtgttgatgtgtttgctcccggtataaatattatgtccacctatattggttcaaggaatgcaactttaagtttatcaggtacttccatggcgtccccgcacgttgctggtattttaagttactttttatcattacagcctgcaccagacagtgaatttttcaacgacgctccctcacctcaagaattgaaagaaaaagtcctaaaatttagtacacagggagtactgggtgatatcggtgatgatactcctaacaaattaatatataatgggggaggtaagaaattggatggtttttggtag

SEQ ID NO: 3384 - DNA, 1437 bp, Saccharomyces cerevisiae
atgaatgctttgacaaccatagattttaatcagcacgttatcgtccggctgccatcaaaaaattacaagatagtggaactaaagcccaacacctctgtatcattaggaaaattcggtgctttcgaggttaatgacataattggttatcctttcgggttgactttcgagatatattatgatggcgaagaggtttcatccgatgaaaatagagattcgaaaccaaagaacaaaattcccatcgggaaagtaaggctattatcgcaggagatcaaagatgtcaataatgataaagacgatggtcaaagcgagcctcctttatctattaaggaaaaatctgtgtctcttgaattgtctagcattgacagcagtgctacgaatcagaatctggttaacatgggcagcaaggcccaagagttaaccgttgaagaaattgaaaaaatgaaacaagaatctttatctagtaaagaaataatcgacaaaattatcaaatctcacaaaagttttcacaacaagaccgtatattctcaagagaaatatgtgaataggaagaaacaaaaattcgccaagtacttcaccgttgagtatttaagtagctctaaccttttacaattcttaatcgacaaaggcgatatccaaagggtattggatatgtctcaggaatcgatggggatgctgttaaatcttgcgaacatccaatcagaaggcaactatctctgtatggatgaaacgggtgggttattggtttactttctgttggaaagaatgtttggcggtgacaatgaaagcaaatccaagggcaaagtcatagttattcacgaaaatgaacatgccaacttggatttgctgaagtttgctaattattctgagaaatttattaaagagcatgtacacaccatttctctattagatttttttgaaccgcctacactacaagagattcagagcagatttacaccattacctaaagaagaagcccgtgcattaaaaggtggtaagaaaaactcgtactaccgaaaactcagatggtacaatacacaatggcaaattttagaactaacaggagaattcctatatgacggtcttgtaatggctactacactacatttaccaacactagtgccaaagttggccgaaaaaatccatggttcaaggccgattgtatgctatggtcaattcaaagaaactttgttggaattagctcatactttatattcagacctcaggtttttagcaccatcaattttggaaactagatgtaggccgtaccaaagtataaggggtaagctacaccctctgatgaccatgaaaggtggtggtggatatctaatgtggtgtcacagagtcatccctgctcctgaacctgtatcggaaaacgcgactgcagctgactccagtgaaaagcttgctgaacatggagctaagaaacaaaaaatataa

SEQ ID NO: 3385 - DNA, 1437 bp, Saccharomyces cerevisiae
atgactggtcctggacctgaaataaataaggaggagcaccccagttctccgggcaagaaacagataacatataatagtatacccaagaatgcaaatctaattgatggatctacgaattcatcgaagaggccaattgaaaagtatgacaagagaatagccgacccaacaaaaagctattttccacatagcatatcaagaacaccaaggagaaaatatacttacattctagtcctcacatcactaaatggaacttttgagagcaaacatgtggtgataccatttaaaccagatggtttgaaattgggaaggcctgttgctaatagtaatagcagctccagttcatcgctcaggggcggtaaaagagtggattcacacactttttcccaagtaaggtccgataatggtaatttcgattcaagagtactctccaggaatcatgcattgttaagttgcgacccgctcacgggtaaggtatatatacgagacttaaaatccagtaatggtacgttcattaacggtcaaagaattggctcaaatgacgtagaaatcaaagttggcgatgtgatagacttgggaacagatatagatacgaaaattgagcatcgaaaaataagtgccacagttgaagaactatttgtacaacctttattagaatcaccgatttttgaaaatgaagatagtgatgattgccatacaattacagaaaaagaggaggctgctgccataacaagtcacatatatggtgattccaacaacctagaattggaagaagttatcctgggctctgatacagaaatactgagtggaatttttattaataattgtattggtacgagcccgactttatctaatatcatcaaaaccctggcaatggaaattccattttccaaatgcgataattttaaattacagtcgatggagaatttcttaattaattatacgacacatctagaatacacgaacaaacttttagtggaaaaaaatgatcagcaactggtaaagctgcaaaatggattaagaaggaaactgtcggggaaatacgaaaagattatcgaacaaaacagaaatcaagtaaaacagttggaaagggaccatatgtttttcaaaaagtcatttgaagtgaagaaaagaagaaataatgaaaagcaaaaaagcatggaaagggaaatagaagacttgaaaactaggttagaagtggaacgatataagaattcacaaatgatgaagaagaacaaacagaaagaacaagaactctcaactgcatctaaaaaaaagactaccgaacatgacactagaggcgtcccgggcatgaatcctaagggtactgacaaatttagcatcaagaacacgctatgtaatcatttcacactattaacatttggaactatttccatcgggattatagctattgtcttcaagatcctttcccccaactag

SEQ ID NO: 3386 - DNA, 1437 bp, Saccharomyces cerevisiae
atgccttctttcaatcctgttagattcttagagttaccaattgacattagaaaagaagtttacttccatttagatggtaatttttgcggagcacatccctacccaatagatatattatacaaatctaatgatgtggagcttccaggaaaaccaagttataaaaggtctaagagatctaagaaattattgagatacatgtatcctgtttttgccacgtatttgaacattttcgaatactctccgcaactcattgaaaaatggcttgagtatgcattttggttgcgctatgattgcctggttttggactgtttcaaagtaaaccatctttatgacggaacgcttatagatgcattagaatggacgtaccttgataatgaacttcgactggcctacttcaataaggccagtatgttagaagtttggtatacttttaaagagtacaagaagtgggtgatagacagtgttgcttttgacgagcttgacttacttaatgtaagtaatattcaattcaacattgataatctaactccacaactagtagacaaatgcttatcaattttagaacagaaagatttattcgcaacaatcggggaggtacaatttggacaagatgaagaagtaggagaagagaaagatgttgatgttagtggagctaattctgacgaaaactcctcacctagctccacaattaaaaacaagaaaaggtcagcatccaaaagatcacattcagataatggcaatgtgggagcaacgcacaaccaactaacaagtatttctgttataagaacaataagaagtatggaatccatgaagagcctgcggaagatcactgtgagaggagagaaattatatgagttgctaataaattttcatgggttcagagacaatcctggtaaaacgattagttacatagtgaaacgtaggataaatgaaatacgcctatcacgcatgaatcaaatttccagaaccggactagctgactttacaagatgggacaacttgcaaaagcttgtattaagtagagtagcttacatcgacctgaatagcattgtctttcccaaaaattttaaatctctgacaatgaaacgtgtaagtaaaatcaagtggtggaacatcgaggaaaatatactaaaggaactaaaagtcgataagagaacttttaaatcgttgtacataaaggaagatgatagtaaattcacaaaattttttaatttacgacacacaagaataaaagagcttgacaaaagtgaaattaatcaaataacataccttcgatgtcaagcaatagtttggctatcttttcggactttgaaccatatcaagctacaaaatgtatctgaagtttttaacaatatcatcgtacctagagcattgttcgatagtaaacgagtagagatttatcgatgtgaaaaaatctctcaggttttggtaatataa

SEQ ID NO: 3387 - DNA, 1437 bp, Saccharomyces cerevisiae
atggattctggtatgttctagcgcttgcaccatcccatttaactgtaagaagaattgcacggtcccaattgctcgagagatttctcttttacctttttttactatttttcactctcccataacctcctatattgactgatctgtaataaccacgatattattggaataaataggggcttgaaatttggaaaaaaaaaaaaaactgaaatattttcgtgataagtgatagtgatattcttcttttatttgctactgttactaagtctcatgtactaacatcgattgcttcattctttttgttgctatattatatgtttagaggttgctgctttggttattgataacggttctggtatgtgtaaagccggttttgccggtgacgacgctcctcgtgctgtcttcccatctatcgtcggtagaccaagacaccaaggtatcatggtcggtatgggtcaaaaagactcctacgttggtgatgaagctcaatccaagagaggtatcttgactttacgttacccaattgaacacggtattgtcaccaactgggacgatatggaaaagatctggcatcataccttctacaacgaattgagagttgccccagaagaacaccctgttcttttgactgaagctccaatgaaccctaaatcaaacagagaaaagatgactcaaattatgtttgaaactttcaacgttccagccttctacgtttccatccaagccgttttgtccttgtactcttccggtagaactactggtattgttttggattccggtgatggtgttactcacgtcgttccaatttacgctggtttctctctacctcacgccattttgagaatcgatttggccggtagagatttgactgactacttgatgaagatcttgagtgaacgtggttactctttctccaccactgctgaaagagaaattgtccgtgacatcaaggaaaaactatgttacgtcgccttggacttcgaacaagaaatgcaaaccgctgctcaatcttcttcaattgaaaaatcctacgaacttccagatggtcaagtcatcactattggtaacgaaagattcagagccccagaagctttgttccatccttctgttttgggtttggaatctgccggtattgaccaaactacttacaactccatcatgaagtgtgatgtcgatgtccgtaaggaattatacggtaacatcgttatgtccggtggtaccaccatgttcccaggtattgccgaaagaatgcaaaaggaaatcaccgctttggctccatcttccatgaaggtcaagatcattgctcctccagaaagaaagtactccgtctggattggtggttctatcttggcttctttgactaccttccaacaaatgtggatctcaaaacaagaatacgacgaaagtggtccatctatcgttcaccacaagtgtttctaa

SEQ ID NO: 3388 - DNA, 1437 bp, Saccharomyces cerevisiae
atggcaaacaaatcacgacccaagaaaatcaaggctccttacaggaagtacgtggcgggagagggtttctcctctacaagaaatgataataaggctaaagaattcactatcactataccggaggatgcagaactcattgagactccacaggggtcttattactatgatgaaaccaatgatactatagtgaaattgacacgactgagtaatgaaaaaaaggataaaaaaggacgtaagcagtcgccatcgtcatcatcgacatcgtcctccaaaggagaaaaaaatggcaaagtcatagagagtgaggaagcgaggatgcattcagtatcagtaaagatggttttgccatgggagatacagcatagaataattcattatcttgatataccagagaaagaagaaaaattaaataaaactgctaatggaaaaaaaactacgactggtataaatatgaactacttactagtttgcagaaactggtacgccatgtgtctaccaaagctttattatgcaccagcgttaacaagtaagaatttcaacgggtttgttgatacaataatcataaataaaaagaagaatttaggacactatgtttttgagttgaacttgtctacaattttacaaagtggtagaaattcatttgtctccaagcttttacgacgatgctgttctaacctaactaaattcatcgcaccacagacaagctttggttacgcgcctttgatttcattgaaatcgtgtcatgatttgaaatttttagacttgggtttagtatcggaaacagttaagctgaaggagttattttctgccattaaaaatttcactaaattaacgcatttatcttttcccagatcgtcgattgactgccaagggttccaagatattcaatggccacagaatctcaggtacttgaaattgagtggaggtataacaaatgaatttgtgattgatacgaaatggccaacaactattacaactttagaattctcttattgtcctcaaataacggaattgtctatttattcgttgttatcacagatcggtgataatttaaagcatttattttttcattatccgatgccatctctggcagaaaattccctagaccatgtcttcacgtactgtgctaatttaatttctttgcagctcatggttgattactgttctaagtggtgcttttctgaattcatgctaagtaaattggtggaatatgataggcctcttaaaacattgtacttagaatgcagcggatccttgggattagcttctaagattcatcccgatgacttgactatagccatactggaatccaggctgccctgcctaaagaatatttgtgtttctcccaagctggggtggaacatgaaaagcgatgaagtcgctgatttggtagtctctttggaagatcaagatggcagtttatatcttaattattaa

SEQ ID NO: 3389 - DNA, 1437 bp, Saccharomyces cerevisiae
atgggcgcaaccaaaattttaatggacagtactcatttcaatgagatccgtagtataatccgttcgaggtcagtggcatgggacgccttagccagatctgaggaattgagcgaaattgatgcgtctactgcaaaagcgttagaatccattctggtgaagaagaacattggtgacggtttatcatcttcgaacaatgcacattccgggttcaaagtgaatggcaagacgttgataccattaattcacttactttccacctcagacaacgaagactgcaaaaaatctgtgcagaacctaatagctgaattgttatcgtctgacaagtatggagacgataccgtgaagtttttccaagaagaccccaagcaattggaacaattatttgatgtgtcactcaagggagacttccagactgtgctaatctctgggttcaacgtggtctcactcttagtgcaaaatgggttgcacaatgtgaaactagtggaaaagctgttgaaaaacaacaacttgatcaatatcttgcaaaacattgagcagatggacacttgttacgtgtgcatcagactattgcaagaactggccgtgataccagagtatcgtgacgtgatatggttgcatgagaagaagttcatgcccaccttattcaagatcctgcaacgtgccacggactctcaattggccacgcggatagttgcaacaaactccaaccacctgggtattcaattgcagtaccactctttactattgatatggttgctgacctttaacccagtttttgcaaacgagctagtccagaaatacttgagtgatttcttggacctcttgaaattggttaagataaccataaaggagaaagtgtccagattgtgcatatccatcatcctgcaatgttgctccacgcgcgtcaagcagcacaagaaggtgattaagcaacttttgttgctcggcaacgcgttgcccaccgtacagagcttgagcgaaagaaagtattccgacgaagaattgcgtcaagacatcagcaacctcaaggaaatcctagaaaacgagtaccaagaattgacctccttcgatgaatacgtcgccgaattggactccaagttgctgtgctggtctccaccacatgtcgacaacggtttctggtccgataacattgacgagttcaagaaggacaactacaagatctttagacaattgatcgaactcttgcaagcaaaggtccgtaacggcgacgtcaacgcgaaacaagaaaagatcattatccaagtcgccttgaacgacatcactcacgtggtcgagcttctaccagagagcatcgacgttctcgacaagactggcggcaaagccgacatcatggagttgctgaaccattcagattctagggtgaaatacgaggccctcaaggccacgcaggcaatcattggatataccttcaaataa

SEQ ID NO: 3390 - DNA, 1437 bp, Saccharomyces cerevisiae
atgtctgaaaataagaactctgaggctgaagacgtatttgaatttttagattctttgccagaagcaaagaatggcgggaaaatggttaatactgacgtaaagggtagccaagaaggcgttaagggaggttctaattctgtggcgggcaagaccgggaatgatggaaagaaaggtgacgatgatatctttgaattcttagaagagttggagaagagtaacttaagcttaactgacaagaaaggggttgaaaagaaggctcccagtgaatcagttaataataaagcacaagacgaaaaagtagaagaatcaaaagaaaacaaaaattccgagcaggacgctcacggaaaggaaaaggaaccacagcagcaggagaaagaagaagaagaggaggaagaagaagaagaagaagaggaggaggaggagaccccattgcatgacccaattgcttctatttcaaactggtggtcctcctctggatccgcaaaggtatcgagtatttggaataaaactgcagaacaagcatcccagatcaaaaaccgacttgcccaagaacagcttgatttgacttcaaagataaacacgagcacgattactgaaatagccagaaacttacagaaaatcgttgttggtgagactgaagaggtgctgcgaattcatctagtccatgatttggttaactatccctcattacaatacaatattgaaagcaagtttgatcaagttctaagctcacaagttgagggaggaatcagaatatttgtagatgaatggggccatcctaacaataatggaattacacctgtggaaaaaaagccttcagttgcagacggtgagttaggcaactctaaaaaaaaattacagtttaatctattcgacggcaaggtaacagacggtgagaaactggcatttgcaaacctggaaaatgcagtcaaactcttcaatactgcacatgaggaataccagaaacaacagaaagaggctgatgccactccagatgacgataggagttctattagcagtaacagcaataaaatcagtgatttattcatatccatcttaccaattgccattccgcaaaaacaaaaagatgccgacggtgactttcaagtgaccgactccaatacgccaggcaatttcaatttcacccttgtattgaaagacataactaacgatattaccaccataacaagatcacaaggattccctgtcaaatgggtcaattggctagaaggatccgtggagaaaacaggatcaacagcaagtgaggagaggaataagtcatacgatcaaaagaaacaaaaagaaagtgaagacgaagacgaagacgatgagatcattgatcctagtgaatgggtaaaggaatggatcgaagatggattaagcttgtcatttggggtcatggcacagaattatgtcattgaccgtatgggtctttga

SEQ ID NO: 3391 - DNA, 1437 bp, Saccharomyces cerevisiae
atgtcttctgaatcaggaaagcctattgctaagcctattaggaagcctggctataccaatccggctttaaaagcccttggtatacccgccttgaggctgccttctcgaaactggatgatcttttggtctgtgttaacagtatccatcggtggcatagcctatgacaaatacaagcaacgtcagattctgagccatgcaacagacttggtgaagcctttggcagaggagtccatggaggtagacaaagtgccacgaaagatcactgtttttattgcacctcctccaaatgattatctggagagttcgttgaaagtttggagacgatatgttaagcctgtactgtattatgcagggttggactatgaattagttcaagaggataggcaagggattattagaactaatgtagccaacagaatcagagaattgagaaaggaaatattggcatcgacggatgggcagccagttaaagagcctaaccaaacggtagcaaaaccaagtggttcttcaaccagtaaaatttcatcactactaccgttcaataaaatcattcaagatcctgctgaagaagatgactcgtttgatccagaaatcggtaaaaagttcaaggagaacttcgactggagaaacgttataggtatcttctatacaatgccaaaaccgaagcatataataagtgaagacgccctgacaaaggaccctatattatctggtggtgttatttgtttaggtagaggcgcctataaggagtacattgccggtattcacgaaggcttgcttggacccatcgagaagaccgaaaaaacaggatccactgagcctaagatgactggggttgtagaagcaaatcaaatagaatcaaaggtaagtgaatccggtgctacggaactggtggatgccgagaaagagactgctttggaagaggccaaagtacaagatgatctaaaggttgatgaagaaaacagctcagaggattcgcaaaaatttttgaagccatttatttcttcagaccaataccctgacctgcaaatcgcttcggaattacaaactccaaatggcgaattcataagaaaccccaatacaaatatcccgcttctgattaatcagccgttattggtcattccaatacctaacttgataggttttactaccattccaaggagaatacatcgtttttaccagaagcgtttctacgtagaggacgtgtgttcaagtgtagttaactgtgttcgacaaacccgtataagaccgtttgatattgcaaaggatattgatttggcgaaggacgaagaaaaagattggccacagaactgggtcaaacagggtaaagaaaagaacagcgaatggacccaagaattagtatgtgatcctagaatcacgaagcatatgtttgtttacgaaaaaccacccaaggaagagccagaatcagatatttaa

SEQ ID NO: 3392 - DNA, 1440 bp, Saccharomyces cerevisiae
atgaatgtgaccactccggaagttgcttttagggaatatcaaaccaactgtctcgcatcgtatatttctgctgatccagacataactccttcaaatttaatcttgcaaggttatagtggaacaggaaaaacctacactttgaagaagtattttaatgcgaatccaaatttgcatgcagtatggctggaacctgttgagttggtttcttggaagcccttactgcaggcgatagcacgtactgtacaatataaattgaaaaccctatatccaaacattcccaccacagattacgatcctttacaggttgaagagccatttcttttggtaaagacgttgcacaatatttttgtccaatatgaatctttgcaagaaaagacttgcttgttcttgatattggatggtttcgatagtttacaagatttagacgccgcactgtttaacaaatatatcaaactaaatgaattacttccaaaagattctaaaattaatataaaattcatttacacgatgttagagacatcatttttgcaaagatattctacacattgcattccaactgttatgtttccgaggtataatgtggacgaagtttctactatattagtgatgtctagatgtggcgaactcatggaagattcttgtctacgtaagcgtatcattgaagagcagataacggactgtacagacgatcaatttcaaaatgtagctgcgaacttcattcacttaattgtgcaggcttttcattcttatactggaaacgacatattcgcattgaatgacttgatagacttcaaatggcccaagtatgtatctcgcattactaaggaaaacatatttgaaccactggctctttacaaaagtgccatcaaactatttttaagcacagatgataatttaagtgaaaatggacaaggtgaaagcgcgataaccacaaatcgtgatgaccttgagaacagtcaaacttacgacttatcaataatttcgaagtatctgctcatagcctcatatatttgttcatatctggaacctagatacgatgcgagtattttctctaggaaaacacgtatcatacaaggtagagctgcttatggacgaagaaagaagaaagaagttaaccctagatatttacagccttctttatttgctattgaaagacttttggctattttccaagctatattccctattcaaggtaaggcggagagtggttccctatctgcacttcgtgaggaatccttaatgaaagcgaatatcgaggtttttcaaaatttatccgaattgcatacattgaaattaatagctacaaccatgaacaagaatatcgactatttgagtcctaaagtcaggtggaaagtaaacgttccctgggaaattattaaagaaatatcagaatctgttcatttcaatatcagcgattacttcagcgatattcacgaatga

SEQ ID NO: 3393 - DNA, 1440 bp, Saccharomyces cerevisiae
atgacgcacccagttatatcactaaagccaagctacaattctgtaatacggggctgccccggtttacctgatacgttaccacgaatcgaatgccagttaagagtgcgctcaaacaactctttgccattcaaattggtaaagatcgaaattgttttaaagacaattgaaatatatttcaacaaaaacctttatagcagcaataacagctctttcaccccatttaatcgtccgtcggacccctctaatggccattctgacaccagtaaccagaacatcagcattcattataagaaaaacatcgtgttatcccaccctacccatgatggcgacgatctcaacaatgatcttattggcatagacatacctttgacgattgggctacctgacgacatcaaagaaacaaactataatccgaaattcggcaaaacgcagactttcctggattgtaccgtgttttatacagaggtcggcggaggaagctcaaataagaaaagaaattttctttacccagtaaacgtcgaaaggtatacatacctaccttcaccgtcatatttcaggccaataaacagatcaaacatcacttctcccgatcaaaagttcttaattagttattccattgagaatccctgtgtttctatgaataatgacacgttgaaactctccatatcaatcaggctgaacccatttccgaacaatgccacaactccctcttcgaatgactttgatgtgtccacgccgacacttttctccacaaagaaaaagtttaagtccaagctcaaattgaaatcaattacaacacagatactagaatacttggaaattctgaagaaccaatcagaattctcatccacgcaaacaacaaatattttgcaaacctctgtaagacaggttgatcaaatcatctccatgaattcaatgatttttcaattcaacctaaaaatattcactaaggacaaaattttacaaagctttagatcttctgagtcgagttgtcccgaaactaaagtattaatcaacaaaatcgacgacattcctctgcaatatcatagttcgataactacgataggtcaacattttaatgtttctcactatctttcaataaggttcaaattcaataaaagtctgaaaaacttcgaaattaatcaccccctaatcatatcgttttggtcagtaagtcaattgccgctaatcgagaacctaatattgcaagaaagacaaactgctaaatttgccaagaagttttataaaaattttggtcgaatcaagaacacgagcaacaacaataacagctcgaactgtctagagtatccctccttgccgccaataatttataattttaacgacccagaaacaaataatagatttaatatattatactcgcaaaaggaccctagtcgtacggatccttctaaattgagaagagtacctgtcatacaatga

SEQ ID NO: 3394 - DNA, 1440 bp, Saccharomyces cerevisiae
atggaaggaaaggttgatgtcttgctaacatggctgaaaaaatcagataagttttatatagcaccaaacatcagcatctgtgaatcgccagaaactggcagagggatcgtcctcagtcacggttcgataagaaaaaacgatatcattgtatcagtaccgagctcgaagcaactaaattttcacactatcctctatcatatttcaaagtttaataaagagctgaatattcctggtatcacaatcgatagaaagccaatcaattatgaggacaatattattgaagcggaaaataaagcctgggccgatcctagatatggattatattccgaattatcgaaagagtttttgttaagtttatcatcatttcaattggtatcattttatatattggttgaaaattttctattgccaaaatggactcacaatgaaatctactcagattggaaaccattctttgatgtatggccctcaatggaggagctgcgatcaatcccagccatttggaactgtgatcccaattcacgttaccattcactgattgaatatctccctgctgcctcacgaaagcatatggcaagaattagtggccttgtcagagaagattgggaaaccatttcagaggtggttttgaaatggaatgaaatttacggctccttaagctgtacgaaaaattctgataaatttactagtgatgagttattctccctttttgtacatgtttattttattataaactcaagatgtctttatgcgaagattccgttgaaaatagaggactccccaagcaatttcactttagtgccgtatgtcgatttcatgaaccacatttgtgagtcggatttgcactgctatcctcagttaagtcctcagttgaggtcagaaggagaaaacatcattggaattggacaatttaccattagatgcggcgatcacctctatgacaacattaacgaggagctctttttgaattatggtgcacactcaaatgattttttactgaacgagtatggatttgtggtagacggaaacaaatggaactacttagacatatctgacgaaattattgaactaatagacgacgacaaaaaggaggtaaaaacgtttctattggaacatgattattggggagattacactatcaatgagactgatatcagttataggatattcgtagcattgaactattatgtgacgagggatgaaaggagggttcgaaaattcattgaaggttacatatcagaagattacttcaagccaaaaatctcttcagttttaaaagaattattggtctccttaactgcaaaatatacaaagacgcttagcgagttgacagaaaaagtatctaatcttgagaataacctctgcttacaaaacttaattaccatatacaaagggtatataaaaatacttacacaacacttacaagacctgcaatcatag

SEQ ID NO: 3395 - DNA, 1440 bp, Saccharomyces cerevisiae
atgggttttgttgatttcttcgaaacatatatggtcggttctagggtccagttcaaacagttagatatttctgattggttgagtctgaccccaaggttgcttattctttttggctatttttaccttcattctttttttactgcaatcaatcaattcctacagttcattaacacgaattccttctgtcttagactgcatttactatatgacagattttggtcgcatgtgcccataataggtgagtacaaaattcggctgctctcgagggcactgacatatagtaaactgaaaataataccaactttagacaaggtgctggaggcgattgaaatttggtttcagctacatttagttgaaatgaccttcgaaaaaaaaaaaaacgtccaaattttcataaccgagggaagtgatgacctaaacttttttaaagatagcaaattccaaaccacattaatgatatgtaatcatcgatcagtgaatgactacacattgattaattacctttttctcaaaagttgtcccaccaagttttatactaaatgggaatttctacaaaagctgaggaagggggaagatctagctgaatggcctcagttaaaatttcttggttggggaaaaatgtttaactttcctcgattggatctactaaagaacatattcttcaaagatgaaacactcgcactctcatcgaatgagttaagagatattttagaaagacaaaacaatcaagctattactatttttcccgaagtcaatatcatgagtttggaactatcaattattcaaagaaaattacaccaagattttccctttgttataaacttctataatttattatacccaagatttaaaaactttaccactttgatggctgctttttcatcaattaaaaacatcaaaagaaagaaaaaccgtaacaatataatcaaagaggcccgatacctgtttcacagagaacttgacaaattagttcacaagagcatgaaaatggagtcttccaaggtatccgataagacgacgccgcccatgatcgtagataattcatacttacttacaaaaaaggaagaaatcagcagcggcaagcccaaggtggtacgaatcaatccatacatatatgatgtcaccataatttattaccgagtcaaatatactgatagtgggcatgatcataccaacggagatttgagacttcataaaggttatcaattagagcaaatatctccgacaatctttgagatgattcaaccagaaatggagtctgaaaacaacataaaggataaggaccccattgttgtgatggtaaatgtaaaaaagcatcaaattcaaccattactcgcatacaatgatgagagtttagaaaagtggcttgaaaataggtggatagaaaaagatagattaatcgagtccttgcaaaaaaatattaaaattgagaccaaataa

SEQ ID NO: 3396 - DNA, 1440 bp, Saccharomyces cerevisiae
atgtcagcgatattatcaacaactagcaaaagtttcttatcaaggggctccacaagacaatgtcaaaatatgcaaaaggctctttttgcactattgaatgctcgccactatagtagcgcctccgaacaaacgttgaaggagagatttgctgaaattatcccagcaaaggcagaagaaattaaaaaattcaagaaagaacacggtaaaaccgttattggtgaagttcttttggagcaagcttatggtggtatgagaggtattaaaggccttgtttgggaaggttccgtgttagaccccgaagaaggtattagatttaggggtcgtactattccagaaattcaaagggaactaccaaaggctgagggtagtacagaacctttgccagaagctttattttggttgcttttgactggtgaaatacctactgacgctcaagttaaagccctttctgctgatttagctgccagatcagaaattccagagcacgttatccaacttttagatagcctcccaaaagatctacatccaatggcgcaattttctattgccgtgactgctttagaaagcgagtctaagtttgccaaagcatatgctcaaggtgtatccaagaaagaatattggagctatacatttgaagattcgttagatctgctgggtaaattacctgttattgcttccaaaatttatcgtaatgtgttcaaggatggtaaaattacttcaaccgatcctaatgctgactatggtaaaaatttggcccaacttttgggctacgaaaacaaggattttattgacttaatgagactatatttaactattcattctgatcatgaaggtggtaacgtttctgcccatactacacatttagtgggttctgccttatcttcgccatacttatctttggccgctggtttgaatggtttagctggcccattacatggtcgtgccaatcaagaagttttagaatggctatttaaattgagagaagaagtgaaaggtgactattcaaaagaaacaattgaaaagtacttgtgggatactttgaacgcagggagagttgttcctggttatggccatgcggttttgagaaaaactgatcctcgttatacggctcaacgtgaattcgcattgaaacatttcccagattacgagttatttaagttggtctccaccatttatgaagttgccccaggggttttaactaagcatggtaaaactaagaacccatggccaaatgttgattcacattccggtgttttattgcaatactatggtctaactgaggcttcgttctacactgtattgtttggtgttgccagagctattggtgtgttaccccaattaatcatcgatagggctgttggtgctccaatcgaaaggccaaaatcattctccaccgaaaaatacaaggagttggtaaagaaaatcgaaagtaagaactaa

SEQ ID NO: 3397 - DNA, 1440 bp, Saccharomyces cerevisiae
atgttcttttcaaaagttatgcttactcggcgtattttggtgaggggtttggcaacagccaaatcttcagctccaaagttaacagatgtattaatcgtaggtgggggtcctgcaggtttgactttagctgcatcgattaagaattctccgcaattaaaagatctaaagacaactttagtcgatatggtggacttaaaagataaattatcggacttttataattcacccccagattattttacgaacaggattgtcagtgttacgcctagatctattcattttcttgagaataacgctggggcaactttgatgcatgacaggattcaaagttatgacggactctatgtcacggacggttgttctaaggctactttggatctggcaagggactccatgctttgtatgattgaaattataaatatacaggcctccttatacaacagaatttctcagtacgattcaaagaaggactccattgatattattgataatacaaaagttgtcaatattaaacacagcgaccctaatgatccattgtcctggcctttagtcactctttccaatggtgaagtatacaagacgagattgctagtgggtgcagacgggttcaattctcctaccagaagattttcccagatcccatctaggggctggatgtataatgcctatggtgttgtggccagcatgaagttagagtatcctccctttaaactaaggggctggcagaggttcttacccactggtccaattgcacacttacccatgcctgaaaataatgctactttagtctggagttcatctgaacgtttatcgaggcttttgttgtcattacctccagaatcattcactgcacttatcaatgctgcttttgtcttggaagacgcagacatgaactactattaccgtacattggaagatggctctatggacaccgataaattgatagaagatattaaattcagaactgaggaaatatacgccacgttgaaggacgagtcggatattgatgaaatttacccaccaagagttgttagtataatagataagacaagagcacgttttcccttaaaattaacacatgcagatcgttattgcactgatagagttgcccttgttggggacgcagcacatacgacacatcctctcgctggacaggggttaaacatggggcaaacagacgttcatggtttagtatacgctttagaaaaggcaatggaaagaggtttagacattggctcttcattgagcttagaacccttttgggcagaaagatatccgtcgaacaacgttctattaggaatggcggataaattatttaaattatatcacactaattttcctcctgtggtagccctaagaacttttggtttgaatctgacgaataagatcggtccagttaagaatatgatcattgacacattaggaggaaatgagaaatga

SEQ ID NO: 3398 - DNA, 1443 bp, Saccharomyces cerevisiae
atgagtgagaaagaaacaaattacgtggaaaatctccttacgcaattagaaaatgaacttaatgaagataacttgcctgaagatatcaacacactattaaggaaatgttctttgaatcttgtgactgttgtctcccttccagatatggatgttaaaccactactggctacgatcaagcgttttctgacgtctaacgtatcctatgattcattgaattacgattaccttttggacgttgtggacaagcttgttcccatggctgattttgacgatgttctagaagtttatagcgcggaggacttagtgaaggcccttaggtcagaaatagatccattaaaagtagcagcatgtagagtcattgagaattcgcagccaaagggtttattcgcgaccagtaatatcatcgatattctattggatattctatttgatgagaaagtggagaatgataagctcattacagcaatcgaaaaagcgttggaaaggttgagtacagatgaattgattaggcgtcgattatttgataataatttgccatacctggtgagcgtaaagggtagaatggaaacggtttcttttgtcagattaattgacttcttgactattgagtttcaattcatcagcggtcctgagttcaaggatatcatattttgctttactaaagaagagatactgaaatccgttgaagatatcctcgttttcatcgaattggttaattattatactaagtttttgctggaaatacgaaatcaagataaatactgggctttaagacatgtaaaaaaaatactgccagtatttgctcaactttttgaagacacggagaactatcctgatgtcagggccttttctacaaattgtcttttacagttattcgcagaggtgtcacgaattgaggaagatgaatattctttattcaagactatggacaaagattctttaaaaattgggtccgaagcaaaattaataaccgagtggttggaattaattaatccgcagtacttggtaaaatatcataaagatgtggtcgaaaactattttcacgtcagtggctacagcattggaatgttgagaaatctttcagcagatgaagaatgtttcaatgctataagaaacaagtttagtgctgagattgtcttaagactaccgtacttagaacaaatgcaagtagtagaaaccttgacgagatacgaatacacttcaaaatttctgctcaatgagatgccaaaggtgatgggcagcttgataggtgatgggagcgcaggtgctattatagatcttgagactgtgcattataggaattctgccttgagaaatttactggacaaaggtgaagaaaagttaagtgtatggtatgaacctttattgcgagaatactccaaagcagttaacggaaaaaattattccacaggcagtgaaactaagattgcagattgcagatga

SEQ ID NO: 3399 - DNA, 1443 bp, Saccharomyces cerevisiae
atgtcccaagaaatttcatatacaccagatgtcgcggaactgctagactttgataaaaaacatatttggcatccttatacgtcattgagttcaccattgaacgtttatccggtaaagagtgctcacggatgcaagctggtgttggataccgactcaccagtggacgtcgaggtgatcgacgccatgtcgtcgtggtggtgtgttattcacgggtacaataatccagaactaaatgaggcccttaccaagcagatgttaaagttttctcacgtccttcttggtggattcacccataaaggagctgtgaatctagtccaaaaacttttaaaagtgattgatgaaccctctttgcagtactgtttcctcgcagattctggctcagtagcagtggaagtagctttgaagatggctttacaatcaaacatgtcaggggaagctactaaaaatagaacaaagtttttgacaatcaagaacgggtatcatggtgatacatttggcgctatgagtgtttgtgatcctgagaattctatgcatcatatctacaacgatcgactcagtgagaacatcttcgcccaagctccctctattgtcgatggccttccaaccagccagaacggtttcgaggaccattggaatgcagaagaagttaccgatctcaagaagcaatttgaattgcatagtgataagatctgtgctgtgattttggagcctatcttacagggtgcaggaggtttgcgaccataccatccacagttcttaatcgaagttcagaaactatgtaaccaatacgacgttttattcatcatggacgagattgctacaggatttggtagaacaggtgagattttcgcattcaagcactgtcaaaaataccaggaccaacatggcatcagtccttccgatcagatcaaagttgttcctgacatattgtgcgttgggaagggcttaaccagtggatatatgactatgagtgcagtggtagtcaacgacaaagttgcttccagaatctcttctccaaatagccctactggtggctgcttcatgcatggccccaccttcatgggcaatgccctggcatgcagtgtggcagaaaagtctatggatatactactgcgtggcgagtggagaaaacaagtgtctgcaattgaaaaccaaatttatagagaactataccagtacatcaagaacccagataatgggctcattggaactgttgttaagcgtgtgtcagttattggagctgtaggtatcgtagagctatacaagaagacagatcccgagtggttccagaaaaagtttatatccaagggagtacatatccgacctttcaactgcctgtgttacattatgccaccatatgtgatcacgacagaggaattgacgaaggttaatcaagtcttgattgaagtattacatgagtggaaatcccacataaaccaatga

SEQ ID NO: 3400 - DNA, 1443 bp, Saccharomyces cerevisiae
atgtcctccaaccgtgttctagacttgtttaagccatttgaatctttcctgccggaagtgattgctccagaaaggaaggttccatacaaccagaaacttatctggacaggcgtttctctactgatctttttgattctgggccagattccgctgtacgggatcgtgtccagtgagacttccgaccctctgtactggctacgtgccatgctggcctccaaccgtggtactttactggaattgggtgtttcgcccatcatcacttcatctatgattttccaatttttgcagggtactcagcttttacaaatcagacctgagagcaagcaggacagagagctgttccaaattgctcaaaaggtgtgcgctattattctgatcttgggccaagcccttgtggtcgtcatgacaggtaactacggtgccccttcggacctcggattgcccatctgtttgttgttaatctttcaattgatgtttgcatcgctgattgtgatgttattagacgaattgctatctaagggttacggcttgggttccggtatttctctgttcacggcaaccaatattgccgaacaaattttctggagagcgtttgctcctactacagtcaattccggtcgtggtaaggagttcgaaggtgctgtgattgcctttttccatcttttggctgtcagaaaggacaagaaaagagcccttgtcgaggccttttaccgtaccaatctacctaatatgttccaagtgttgatgaccgtggccatcttcctctttgttttatatttacaaggcttccgttacgaattgcccatcaggtcaaccaaagtgagaggtcaaattggtatctaccccatcaaactcttttatacttccaacaccccaatcatgttgcagagtgcattgacttctaacattttcttgatctctcaaatccttttccagaaatacccaaccaatccattgattcgtttgatcggtgtttggggtatcaggccgggcacccagggccctcaaatggccttgagcgggttggcctactacatccaaccattaatgtctttatccgaagctcttctggaccctatcaagaccatcgtctacatcacatttgttcttggttcatgcgcagtattttccaagacatggatcgaaatctccggcacttccccacgtgacattgccaaacaattcaaagatcaaggcatggtcattaacggtaagagagaaacctccatttacagagaattgaagaagatcattccaactgctgctgctttcggcggtgctaccatcggtgctctttctgttggctccgacctactaggtactttaggttctggggcatccattttgatggctactaccaccatctacggctactacgaagctgccgccaaggaaggtgggtttactaagaacctcgttccaggattttctgatttgatgtga

SEQ ID NO: 3401 - DNA, 1443 bp, Saccharomyces cerevisiae
atgtctaggaagttgtcccacctgatcgctacaaggaaatcaaaaacaatagtcgtaaccgtacttcttatttattctttgttgacatttcacttgtcaaacaaaaggctgctttctcagttttaccctagcaaagatgatttcaagcaaactcttctccctacgacttctcattcacaagatataaatttgaagaaacaaattacagttaacaagaaaaaaaatcaattgcataatttacgtgatcaattatcgtttgcgtttccctacgactctcaggcccccatcccgcaaagggtgtggcagacctggaaagtcggcgcagatgataagaattttccctcttcgttcagaacctatcaaaaaacatggtctggttcgtattcaccggattaccaatattctctgatttcggatgattctattatcccttttttggagaatctttacgcacccgttccgatagtcatccaagcgtttaaattgatgcctggaaatatcctaaaggcagattttttaaggtacctattattatttgcaagaggtggtatttactcagatatggatactatgcttttgaagccaattgattcatggccttctcagaataagtcatggctaaacaacataatagatttgaataaacctattccttataagaactcaaagccctcacttctctcaagtgatgagatatcacaccagccaggtttggtcatcggcattgaggcagatccggacagagatgattggagtgaatggtatgctcgtaggatccagttttgtcaatggactatccaagccaaaccaggtcacccaattctaagagaattgatcttaaatattactgcaacgactttggcgagcgtacaaaacccaggagttcctgtcagtgaaatgattgatccaagatttgaagaagactacaacgtaaactataggcacaaaagacgtcatgatgagacctacaaacactccgaattgaaaaataacaaaaatgttgatggctcagatataatgaattggacgggtccaggtattttctccgacattattttcgaatacatgaacaatgtgctccgatacaatagcgatatcttgttaatcaacccaaacctaaacaagaacgacgaagaaggtagtgagagtgccaccacaccagcaaaagatgttgataacgatacgctgtccaaatcaacaagaaaattttataagaaaatatcagagtctttgcaatcgtcaaattcaatgccctgggaattcttctcttttttgaaagaaccagttatcgttgatgatgtgatggttctaccaataacaagtttttcaccagatgtggggcagatgggcgcccagtctagtgacgacaaaatggcttttgtaaagcacatgtttagcgggagctggaaagaagatgctgataaaaatgcaggtcataaataa

SEQ ID NO: 3402 - DNA, 1443 bp, Saccharomyces cerevisiae
atgtctgagttaggtgagtattctaaattagaaaacaaagagcttagaacggagtttgaattgacaaattttccttttccaggcacaactgataacgactccgatgacggaagccaagggcagaactctttgaatatcattactcctgacatggatgatactctggttaatgatgtacttcgagaaaacgataaaaagtctagtatgagaatggcttttatgaatctagcaaactctattcttggtgccggaataattactcagccgttcgcgatcaaaaatgctggtatattaggcgggctattatcatacgtagccctcggatttatagttgattggacgttaagacttattgtcattaacttgactcttgctggcaagagaacataccagggtacggtcgaacatgtaatgggtaaaaaagggaaattgctgattctatttacaaacgggttatttgcatttggtggatgtattggttattgcataattattggggatacgataccccacgtactcagagctatattcagccagaacgatggtaatgtacatttttggctcaggcgaaatgtcataattgtaatggtcactactttcatttcctttccgttatcaatgaagagaaacatagaggcactatcaaaggcatctttcttggccgttataagtatgattataattgtactgacagtggtaattagaggacctatgctgccctatgattggaaaggtcattctctgaagttatctgattttttcatgaaagctactatattcagaagtctctctgtcatttcctttgcgttggtttgtcatcataatactagttttattttcttttccatgaggaatagaagtgtggcaaaatttaccaggttaacgcatatcagtatcattatctcagtaatatgctgtgcactaatgggatattcgggatttgcagttttcaaagaaaaaacaaaaggcaatgttttaaacagtttcccaggaacagacactgctatcaacatagccagactctgtttcggatttaacatgctaaccacattccccatggaaatttttgttttgagagatgttgtcggtaacttgttacatgaatgcaaccttattaaaaattatgacgaacacactcaattatcaggtaaacagcacgtcgttataacttcttcactagtcttcatcaccatgggtatatcattaactacatgtaatttaggagcattatttgaactgattggggccactacggcatcgactatggcttacattttgccgccatacacaaatttgttgttaactagtaagaagaagagttggaaggaaaggcttcctttctatctttgtatatgctttggtttcatgattatgataatcagcagcacccaaactattattgatgcagttaatggttctgatggacagcactgccaaatatag

SEQ ID NO: 3403 - DNA, 1446 bp, Saccharomyces cerevisiae
atgggtatttttcaatcaatagaagaagcaaataatacttctgagagattgctgaggtctgagattaaaaatagtcatggagaatttgaaaaattcgattttgatacagaagaatacgaaattaaccctaaaaggaagttaagattagtcagcaggataaacccaaatgctggacatctaaggaaatctaagtcctgctttactgtagatgagcatgttgacgaaacgcgttgtcagaaacctgtgatgaagtcgccgttcatgagtaatgtcgatgatgagatcaagaaaaagagagagacaattacaaagatgacactagaaattgaacatcatgaattgagccagaatattagaaaaccaactgatgatttgcttcctgatagcacgtatcagccttaccacaagaaaatgttgaagcaagaaaatagaatgattcaatcggacatcgtaaatggtgaaaatgaagcagacaggctttcattaatttcagacagactgggtatgttgaattgggaagtaacattacagaaggttactaaaataaatgaccccactgacgagaatgaaatggagactaaacgttaccaaactaaagagctgattgattcaatgttacataaatttgaatctatgaaaaaaaaaagccgcaatttagctagaaggccagcctcaagtgattcattgttgaaattggttagtggcaaagattggcccaagatatatactcgaatcgatcgaacttttattccagattacgcaagctcctctgacgaagaagaagaaaaaataaccgttgaggaaataagggagagacgcctaaagaagagagagcagcaatgcggtggttccattatagtactgctgagcgatcatcaatcacaaaagggaatgacacggtttgctatcgtagctgagccgctccgaaaaccgtatttgattaaaacctccactaaagagagaaattcatggaaaaacaaagttcccacaaatccaaaaaaattcaagaaagctcctcgaatatcaacgcaaattgctgtgaaaagaagaagggaagtcatcccgttaacgatggaggtggaaccagaagtcattcgggatataaggcaagatacacaaaagtctatgaaactgaatgttaaagcggaggaaatatctgtgacagagactgtcaaatcaaaagaaatgaatgccttaaggaacaatgctgcatctataagtccaactctttcagagaaggcacctttaggttcaatttcatcttgcactgcatctcagatttcacaaaggtcttctgagaatgtgggtgctattattaacaatatcaacccaaacttagcaatagtgccctcttgtaacgaaaagacctttgtaaaaacacacaatggaatgaaaactaactcaggtattaatattttgcctgtccgcaagaaaaaaaaggtttag

SEQ ID NO: 3404 - DNA, 1446 bp, Saccharomyces cerevisiae
atgtctcactcacttacttccgttttccaaaagattgattctttaaagcctcagttcttcagcagactgactaaggctattcaaatccccgctgtttcttcggatgaatcactaaggtccaaagtcttcgataaggccaagtttatctccgagcaattatcacaatcggggttccatgacattaaaatggtggatctgggcattcaacctccaccaatttctacgccaaatctgtctctacctcctgtgattctgtctaggttcggcagcgacccttcaaaaaagactgtgttggtttacggtcactatgatgtgcaacctgctcaattggaagatggttgggatactgagccattcaagcttgtcattgatgaggctaaaggtatcatgaaaggaaggggtgtcaccgatgacactggtcccttattatcttggattaacgttgtggacgccttcaaagcctccggacaagaattccccgttaacttagttacttgtttcgaaggaatggaggaaagtggttctttgaaattggatgaattgattaaaaaggaagctaatggttactttaaaggtgtagatgccgtttgtatttccgataattactggctaggcactaagaagcctgttttgacttatggtctaagaggttgcaactactatcaaaccatcattgagggtccaagtgcagatttacactctggtatctttggtggtgttgttgctgaaccaatgatcgatttaatgcaagttctcggttcccttgtggattctaagggtaagatcctgattgacggtattgacgaaatggttgctcctctaaccgaaaaggagaaggctctatacaaggatatcgaatttagcgtcgaagaattgaacgctgcaactggctctaagacaagtttgtacgacaagaaggaagacatcttgatgcacagatggaggtatccttcgttgtccattcatggtgtggaaggcgccttttccgctcaaggtgcaaagactgtcattccagctaaggtcttcggtaagttttccattagaaccgtccccgacatggattctgagaaactgacctctttggtccagaagcattgtgatgccaaattcaagtccttgaactctccaaacaagtgcagaacagaattgatccatgatggtgcttattgggtttctgatccattcaacgcccaatttactgctgctaaaaaggccacaaaactggtctatggtgtcgatcctgattttaccagggaaggtggttccattcctatcactttgactttccaagatgccttgaacactagtgtcttattgctgccaatgggtagaggcgatgatggtgctcattcaatcaatgaaaagttagatatttcaaattttgttggtggtatgaagacgatggctgcttacttgcaatattactctgaatcgccagaaaactaa

SEQ ID NO: 3405 - DNA, 1446 bp, Saccharomyces cerevisiae
atgttgaagtggataaaaggtgggatctcagcagtcactggtatggctgagcctgaatatgggaaagattacattcatagtgttgctgatagggtaaaaaataagcagccttacagagaaaccagtcgtgaagattttttttggcaagctcctgaccatacaaacgttgaatcggttatcttttatttcagtgacttgaaaacaggtatctttggatttgcccaggttattcattcgaacatcattgggttgcacactgcatcccaatttactttcagaatttttgactcgaagaatccagaggatttgaatatctggacttccaccaagttggaaaatttttacatcgaaggtccaaacttctatgccgacaatctttctgtagaattaagtgaagacggtgaaagctatcacattcaatccagtgtttgtgatttatctgtcgttgacttgcatataagaaggttaacccctggagccaagataggcgatgatcctgcgacttattatggtaacaatatcaatgaaccatggggtagcatgagacacgttttctggccaaggaatgcttgtcacggtactatcaaagttaagaaagaagttattccagaatctgatgaagaagaatcctcagctgatgaggatgataatgaagacgaagatgaagagtctggtgattctgaggaggaatctggtagtgaagaagaaagcgacagtgaagaagtcgaaatcacctatgaagatcgtacgattacttttaaagaggaagaccctgcgatttcgacatttataatggccttccaaggcatgaagcctcatcacgcagctaaggcatggaacttcatgtttttccattccgaaaagtattccgcggtgttgatggagttcactacaccaaaatcatatgccaacactaaaatttctgctggtattattaccgatgataaagaagttttagcgatgacaactaacaatcttgttgagcacttaaactcagaaattgattctgttggttggaaagttccaaaagatattaagatcaccttcaaaggtatcaataccaaagtcaaggatgaacaattggaatccgagaatgggactgaacaagctttacaaggagaggatgaaaaggaagatgaaaaggaagatgaagaggaagaagaatacaagaacgtcgcagaagaaaataagatctgtgctgttgtggagggtccgttgaacaacctagttgaaagaattgatgtgatgggcgaaattccaagttttgttaaaaacatcgtctctggtgttgctggtactaagccatttatataccaatatgctgatccaaaaagctcaactttacaaataaatggcggggagaaaattcacggtgtagcttggaccgaagtaacattcatttctgaatcagatgtgattagtgaggagtcttacaatgaagcatga

SEQ ID NO: 3406 - DNA, 1447 bp, Saccharomyces cerevisiae
atgtctgctaacttagataaatccttagacgaaatcattggctctaacaaagcaggaagtaatagagcccgtgtcggtggtactcgtggtaacggtccaagaagagttggtaagcaagttggtagccaacgtaggagccttccaaacagaagaggccctatcagaaaaaatactagggcacctccaaacgcagtcgctagagttgccaagctcttggacaccactagagaggtcaaggtcaacgtcgaaggtttgccaagggacattaagcaggatgctgtaagagtatgttaatacgtgaaatgagagctatttgtttagttactcgcatcgtctcgtgtggatacgagaaatattctttgtaaggaaggatatggcacacgcttttgatcaagaattctctttttagagatgaagaaagagtccgaaatacttcgctagagaaaatacaaaaagagtatcgttttcataagccaaccataccaatttttttcaatacttcaaatcatggcctataaggttggaattaccagctaccactgagaatgggtttgttcttattggctgggttaactcaaatcaatctgactatctgctaatctgtcaatcttacatttttaagctggcgtattgtgtcgcctcgaccgtgatagttagttcctatttttaataagcgtatcatccaatactgaagttgtggaaggatcaattaattttgtatcctttcaagagggagtagctttcagtttcgaatggcaccattttcaaaaaatagctatgggaaacatgtctttcatgaacgttcgaaaagatatgagtgcatcgcttcatttttttattatgatagttacaaaaatatttgatttgagacacctaatgaaaccaaagaggaactcacccatcgtggtacatgtttatttgagggtttatttttcctacgcaatggtatacttttaatactctcaactccttgattgtttgtgtattgtcccttccttctttgattttatatcatagagatatatgactaacttttttttttttattataggaattttttgcatctcaagtaggtggtgttcaaagagttttgttgagttataacgaaaggggccaatctactggtatggctaacatcacattcaaaaacggtgaattggccagaagggctgttgaaagatttaacggctctccaatcgatggaggcagatcaagattgagacttaacctaatcgttgatccaaaccaacgcccagtcaaaagtttagccgacaggatcaaggctatgccacaaaaaggcggaaacgctccaagaccagtaaagaggggtccaaatagaaaagctgctatggcaaaatcccaaaacaaaccaaagagagaaaagcctgctaagaaaagtcttgaagatctggacaaggaaatggcggactatttcgaaaagaaataa

SEQ ID NO: 3407 - DNA, 1449 bp, Saccharomyces cerevisiae
atgagtgatacaaagagagatccggccgatttactagcttctttaaagattgataatgagaaagaggatacaagtgaagtttcaacaaaagagactgttaagtcccaaccagaaaagactgctgattcgatcaagcctgcagaaaaattagttccaaaagttgaggaaaaaaaaacaaaacaggaggatagtaatttaatcagctcagaatatgaagttaaggtcaaacttgctgatatccaggctgacccaaattctccattgtacagtgctaaatcttttgatgaattaggattagcaccagaactactaaaggggatatatgctatgaaatttcaaaaaccatccaaaattcaagaaagggcgctgccattattattacataatccgcctaggaacatgattgctcagtctcaatcaggtacaggtaaaactgccgccttttctttaacgatgctaacaagagtaaacccagaagacgcatctccacaggcaatttgcttagccccctccagagaactggccagacaaacactagaagtcgttcaggaaatgggtaagttcacaaaaataaccagtcagttaattgttcccgattcttttgagaaaaacaagcaaattaatgctcaagtgattgttggtacgccgggcactgttcttgacctaatgcgtagaaaattgatgcagctacagaaaattaaaatttttgttttggatgaagccgataacatgttggatcagcagggtctaggtgaccagtgtattcgtgttaagagatttttacccaaggatactcaacttgttttgtttagtgctacttttgccgatgcagttaggcagtacgcaaagaagatcgttccaaatgctaatactttagaattacaaacaaatgaagttaatgttgatgccatcaaacaactatacatggactgcaaaaacgaagcagataagtttgatgttttaactgagctatatggtttaatgacaattggatcttccattatttttgttgcaaccaaaaaaaccgcaaacgttttatatgggaaattgaaaagtgaaggtcatgaagtttctatcttgcatggtgatttacagacacaagaaagagacagattaatagacgacttcagagagggtagatccaaagttttgattactactaatgtcctggcccgtggtattgatattcctactgtctcaatggttgtcaactatgatcttccaacgcttgctaacggacaagcagatccagctacttacattcacagaatcggtagaaccggtagattcggcagaaaaggtgttgccatttcctttgtacatgacaaaaattctttcaatattttatctgcaattcagaaatacttcggtgatatagaaatgactcgtgttccaacggatgattgggatgaagtcgaaaaaatagttaagaaagtgttaaaggattag

SEQ ID NO: 3408 - DNA, 1449 bp, Saccharomyces cerevisiae
atgagttttaaagggtttaccaaggctgttagtagggctcctcagtccttccgtcaaaagttcaagatgggtgagcagacagaggatcctgtttacgaggatgcagaacgtcgttttcaagaattggagcaggagacaaaaaaattaagtgaggaatcgaagagatactcgactgcggtgaatggaatgctgacacaccaaattggatttgccaaatccatggaggaaattttcaaacctatcagtggtaaaatgagtgaccctaacgctaccataccagaggacaacccacaaggtattgaagcaagtgaacagtatagggcaattgtcgcagaattacaggaaacattgaaaccggatctggctttggtggaagaaaaaattgttacgccatgccaggaactgttgaagattattacttatattcgtaaaatggccaccaagagaaatcacaaaaaattagatttagatagacatctaaacacttataacaagcatgaaaagaagaaggaaccaaccgccaaagacgaagaaagattgtataaagcacaagctcaagtggaagtggctcaacaagaatatgattactataacgacttgctaaagactcaattaccaatactgttcagtttggaagctgaatttgtgaaaccattatttgtctcattttatttcatgcaattgaacattttttacactttgtataatagacttcaagacatgaagattccatattttgatttgaacagtgacattgtagagtcgtacattgccaagaaaggcaatgtggaagaacaaacggacgccttgactattacacactttaaactcggttactctaaggcaaaattggagatgaccagaaggaagtatggtgtagcaaccgccgaaggctcacccgtcagtggcgcatcaagcggtgtcggatatggtgctgggtatgatccagcaactgccacttctccaacccctacaggatacggttatggtgccgcagcaccaagttacgccgctcaacctgctgcccagtatggtactgctgccgccgttggtactgctgctgctgttggtactgctgctggtgctgctgctggcgctgttccgggtacttatccacagtatgctgctgcgcaatctccaccgctcactgggctaggcttccaacaatcaccacagcagcaacagggaccaccaccggcctactctaatcctctaacatcacctgttgcgggcacaccagccgcggccgtagcggcagctcctggcgttgaaactgttaccgcattgtatgactaccaagctcaagctgctggtgatttgtctttccctgccggcgcagttatagaaattgtccagcgtactccggacgtgaacgaatggtggacaggaagatacaatggccagcaaggtgtgtttcctgggaactacgtgcaactcaacaagaactag

SEQ ID NO: 3409 - DNA, 1449 bp, Saccharomyces cerevisiae
atgcctgactatgacaattacactacgccattgtcttctagatatgcctccaaggaaatgtcagcaacgttttctttgagaaacagattttccacatggagaaaactatggttaaatttggctattgctgagaaggaattgggcttaactgttgttacagatgaagcaattgagcaaatgcgcaaacacgtcgaaatcactgatgatgaaatcgcaaaagcttctgctcaagaagccattgtaagacatgatgttatggcacatgttcatacatttggtgaaacttgtccggctgctgcgggtatcattcacttaggtgctacttcctgtttcgttacagacaatgctgatctaatctttattagggacgcctacgatattattattccaaaacttgttaacgtcatcaacagattggctaagtttgctatggaatacaaggatttgcctgtattgggttggactcactttcaaccagcacaattaacgaccttgggtaagagagctactttatggatacaagagctattgtgggatttgagaaactttgaaagagctagaaacgatatcggtctacgtggtgttaagggtactactggtactcaggcatcattcttggccttattccatggtaatcatgataaagttgaagcccttgacgaaagagtaactgaattattaggtttcgataaggtatatccagtcactggtcaaacctactcaagaaaaattgacattgacgtgttggctcctttgtcttcttttgctgctactgcacacaaaatggctactgacataagattattagccaacctgaaggaagttgaggaaccttttgagaaatcacaaatcggatcctctgctatggcttacaagagaaacccaatgcgttgtgagagagtgtgctccttggctagacacttaggttccttgtttagtgacgccgttcaaactgcatccgttcaatggttcgaaagaactctggatgattctgctattagaagaatttctttaccaagtgcatttttaaccgcagatattctattatctactttgttgaacatctcatccggtttagttgtgtatccaaaggttatcgaaaggagaattaagggtgaactaccttttatggctactgaaaatatcatcatggctatggtagaaaagaatgcctccagacaagaagtacatgagcgtattagagtgctctctcatcaagccgcagcagtagtcaaggaagaaggtggggaaaatgatttaattgaacgagtaaagagggatgaatttttcaagcctatctgggaagaattagattctttactggaaccatccacttttgttggtagagctccacaacaagttgagaaatttgttcaaaaagacgttaacaatgctttacaacctttccaaaagtacctaaacgatgaacaagtcaagttaaatgtttag

SEQ ID NO: 3410 - DNA, 1449 bp, Saccharomyces cerevisiae
atgctaaggaacggcgttcagaggttgtactctaacatcgctagaaccgataattttaagctttcgtcactagcgaatggactgaaagtggcgacatcaaatactcctggacactttagtgccttaggcctatacatcgacgcaggatcacggtttgaaggtaggaatttgaagggttgtacacatatcttggatagactagcattcaaatcaaccgaacacgtcgagggccgagcaatggcagagacgttggagttactgggtgggaattaccagtgtacctcgtctagagaaaatttgatgtatcaggcttctgtgttcaaccaggatgtgggtaaaatgcttcaattaatgtcagaaactgtgaggttccctaagattactgagcaagaactgcaagaacagaagctgtcggcagagtatgaaatcgatgaagtttggatgaagccagaattggtattacctgagctgttgcacacagcagcatactccggagaaactttggggtcccctttaatctgccctagagagctcattccttctatttctaaatactacttattggactacagaaataaattctacaccccagaaaatactgttgcggcatttgttggtgttcctcacgaaaaggcattagagcttacagaaaagtatctcggtgactggcaatctacacaccctccgatcaccaaaaaagttgcccaatatacgggcggggaaagttgtattccaccagcaccagtgtttgggaatttaccagaattattccacatccagatcggatttgaaggtctccctatagatcatccagacatttatgctttagcaacattacaaactttacttggaggtggtggttctttcagtgctggtgggccaggaaaggggatgtattctcgtttgtatacccacgttttgaaccagtattactttgttgaaaattgtgttgcgttcaaccattcttattcggattctggtattttcggtatttcattatcttgtataccgcaggcagctcctcaagcggttgaggtaattgcacagcaaatgtataatacatttgctaataaggatttgaggttaactgaagacgaagtctccagggccaagaatcagttgaagtcttcactactaatgaacctagagtctaaactggtagaattggaagatatgggcagacaagttctcatgcatggtcgcaaaatcccagtcaacgaaatgataagtaagatcgaagatttgaagccagatgatatctcacgtgttgccgaaatgatatttacgggaaatgtaaataatgctggcaatggtaagggtagagctactgttgtaatgcaaggagacagaggatcctttggagatgtggaaaatgtactgaaggcatatggattgggtaacagctcctcctccaaaaacgatagtcccaagaagaagggttggttttga

SEQ ID NO: 3411 - DNA, 1449 bp, Saccharomyces cerevisiae
atggatagacctatagatgatattgtgaaaaatcttttaaagttcgtcgttagggggttttatggtggctcctttgtactggtactcgatgctatactatttcactcggtcctagctgaagatgacttgaaacaattgttgagcataaataagacggaactggggccgctaattgctagactaagatcagacaggttaatatccatacacaaacaaagagaataccctccaaactcaaaaagtgtggaaagagtttactactatgtaaaatatcctcatgctattgacgcaatcaaatggaaggtccatcaagtcgtacaaagattgaaggatgacttggacaaaaattcagaacctaatggttacatgtgtccgatttgtttgaccaagtacacacaattggaagctgtacaattattgaattttgataggacagaatttttatgttccctatgtgatgaaccgttggtggaagatgattctggtaaaaaaaacaaagagaagcaagataaattaaataggttaatggaccaaattcagccaatcattgattctttgaaaaagattgatgattcaagaattgaggagaatactttcgaaattgcattggctcgcttgataccacctcaaaatcaatcacatgcagcatacacgtacaatccaaagaaaggcagcaccatgttcagaccgggagattctgctccattgccaaatcttatgggtactgctcttggtaacgacagtagtagacgtgccggtgctaactctcaagccacattacacatcaacattaccacggcaagtgatgaagtggctcaaagggaattgcaagagagacaggctgaagagaaaagaaaacaaaacgctgtccctgaatggcataaacagagtaccatcggtaaaactgctcttggtagactggataatgaagaggagttcgatcctgtagttactgcatctgccatggattctataaatcctgataatgaacctgcacaggaaacatcctatcaaaataacagaactctgaccgagcaagaaatggaagaaagagagaatgaaaagacgttgaatgattactacgctgctttggctaaaaagcaagcaaagctcaataaagaagaagaggaggaggaagaagaagaagaggatgaggaagaagaagaggaagaagagatggaagatgttatggatgataacgatgaaactgctagagaaaatgcattggaagatgaatttgaagacgtaacggatacagctggcaccgcaaagacagaatcaaacacctccaacgacgtaaaacaagaatcgattaatgataagactgaagacgctgtaaatgctactgccactgcttcaggtccgagtgcaaacgctaaaccaaatgatggtgatgatgatgatgatgatgatgatgatgagatggacattgagtttgaggacgtttga

SEQ ID NO: 3412 - DNA, 1449 bp, Saccharomyces cerevisiae
atggatttttatactactgatatcaacaaaaatgttgtgcctttgttcagtaaaggaacagtagcaagaacagcatcaaaagcacagtatccatcatggtgcaacaacgcgttaaagttaactaatattcttcttaaatctcttcgatgtaaatttcaaacgaaccgctgcgaggatgatcgaggttttgaggtatattgtgttattttaaaaagcatcgctttattaatggccgcgaaagaatcattgatattactacaaatacctccttctttaccatcaggatttccatttcgttcaccccaactgtcatttacatatttatcaacccgtcttagtgggagccaacacaaatctacgcattctcatcacatcaatcatcaaactcatcccattcatagtagcagtagcaacagtaatagtaataaccgtattcctacaaaaacagattcctccaaacagcatacacagcatttctcttttgctaatgcgggagcctccaatagagacgaactgctatcaatcgtgcgcaaaattgataaatctaatttgaagtgttgtgactgcggtagcaccgcaacagtagaatgggtgtcaatcaatttattgtgtatattgtgtatcaaatgttcgggcgttcatcgatctctgggttcacatatctccaaaattagatctttaacgctggataatttcacctcgttagagttgatgcatcttttacaaaataatgtttccaatagtaatgttaatgccatttatgaaagcaatctcaggaactttccagttaaaaaaataactgcaaattctgatgactcggaaagatccaaattcattattgataagtatcaatttaaaaagtttgttatcgacagcaaccaaggcagagaggcttctttgaagtctttaattaaagctatccatttagatagtgttttcatgatgcaaagagccatcgcccaaagtaaatattccctaagagaattgacggcaagcgaaaaagagcagaatgatctaaaccattcttccatttttcaatattccctaaagcactatgaaattgttgatggaacgcccattttttttattacagaatttttattgtgcaatggtattcatatagataatttaccgaagattactacgaattggtctccaaaggttttagaatattgggaaactaagttggagatgtacggaacattccaagctgtaaatacttctcgtccaagatcagggccgcatttaaatatgcattcaaatgtagattcagcttcgtcctacaataagaaacacgatttgagagttaacatacctgaaagaagtgcctcagcaagtaaaaggtggagtttgagctccattcctaagtcttctcaaaatttgatgtccccaacaaacttattaacaatgcataagtctttaaaattggccaaaaaggacaaaaaataa

SEQ ID NO: 3413 - DNA, 1449 bp, Saccharomyces cerevisiae
atgggcggctatttggcgatcgtgttcattccccaaactaacacgaagagcatgagagagaaaaaacaaaagtgcttgaaacaggtaagacgtttatcattgatatcaccaaagaaatatataatgccggattctatttttgaacagccctttgtttactgtggtgtttgccacagaagaacatcgcatggagatccattgaggctgacctcatgtgctcatatcctctgttcgcagcattctccattaacatcaaaggtgtgtcctatatgccgttcgagcgatatctccatcattaaccttgtggaatctaaacagctgcctaccgacattaggattttttttgagccactgcccccacttttggagtcgttatataatgtttcccaattccaactgaatgggctttcgaaacagtgtcaatactatcaaaatcattgtttaaagttgagagaaaaatgtgcaagacaacagcagctgctatatcaggccaaaatagagttggattctatggcgattcttaagaaaagaatacaggaattagagtcagttttgaatcataacaatgtttcttcgatgtcagttggtgtgctaccaacaagaaatagccatcaaaatcattaccagccccctccaaccgttgatctgacagttgatgataatagtttagaagaattcgaagccaaatcctttattaaaaagttgaaaaaaaactcttctttgagaaattcttcaaaaaataacaatggaactgtcactccctctacaagtggtcgtgtaaataaaaaccagcctctctttatggagacattgaataatcctaatagaaatagcattcctcctcctggaatgaacccaaacgcaaatagtaatctacctaatatttcgactattgcagaatcaaccaatctgaacagattttcgttctctcctgtgcgtgttgcaaaaggcttcgatggaaagttgccaaatcttgacatcctcacgaataatggctctgtatcttccaaaaatatatcaagattatcttcagcttctctccaaccctcttcgcctctatcttcatcatcaaataggcttattttaccaaatagtaacctcaaagaattgcatcattcaaatacacctttaacaagtacctcgacgcagtttccctcagctttagaaaaattaaaaataacaaggaagagaaataatactatcagcggttcgaatagaataacacacaacttgagctcacacgtaagaagcagtggtcttgccttttcatcttcatcgaactcattgcaacaaagtaaactgccgaaatcaaatatactaaagcggtccaattcaactcagcaactgactaatacacatttgaagagtgataatcatctgccacctcgctcaagtaatactgtgttgggtagtagcaagaaaaacaataagtttagaaggattaggtaa

SEQ ID NO: 3414 - DNA, 1449 bp, Saccharomyces cerevisiae
atggtcaaaagaacagtcgccaccaatggagacgcgtctggcgctcatagagcaaagaaaatgtctaaaactcatgcttctcatatcataaacgctcaagaagactacaagcatatgtacttaagtgtccaaccattggatatattttgctggggtactggttctatgtgtgagcttgggttgggtccactagccaaaaataaggaagttaaaagaccaaggttaaacccatttttacctcgcgatgaggccaagatcatttcttttgcagtcggtggtatgcacaccttagcccttgatgaagaaagcaatgtatggtcctggggttgcaatgacgtgggtgcgttgggcagagatacttccaacgccaaggaacaactcaaggacatggacgccgatgactcaagtgatgacgaagatggtgatttgaacgaattggaatctacgcccgctaaaatcccaagagagtcatttcctcccttagcggagggacacaaggtcgtgcaattggcagctacagacaatatgagttgcgccctgttcagcaatggcgaggtatacgcatggggtactttccgttgcaatgaaggtatcctagggttttaccaagataaaattaaaattcaaaaaactccatggaaagtgcctacattctctaagtacaatattgtccaattagctcccggtaaggatcacatacttttcttagatgaagagggtatggtgttcgcctggggtaacggtcagcaaaaccaattaggaagaaaagttatggaaaggttccgtttaaagactttggatcccagaccatttgggttaagacatgtaaaatacatcgcatctggcgaaaaccattgctttgctttaacaaaagacaacaagttagtaagctgggggttgaatcagtttggtcaatgtggtgtttcagaggatgtggaagacggtgcgcttgttacaaagccaaaaagactagcgctacctgataacgttgttatcagaagcattgctgctggtgaacatcactcattgatcctatcccaagatggcgatttgtattcgtgtggtagactagacatgtttgaagttggtatcccaaaagacaatttacccgaatatacttacaaagatgttcatggaaaagcacgtgccgtgccacttccaactaagttgaataatgttccgaagttcaaaagcgttgcggcggggtctcaccattcagtcgcggtagctcaaaatggcattgcctattcttggggttttggtgaaacctacgccgttggattaggcccttttgaggacgacactgaagttccaaccagaatcaagaatactgctacacaggatcataacatcattttagtcgggtgtggaggccaattttccgtgtctggtggtgttaagctgtctgatgaggacgcagaaaagagagcggatgaaatggatgattaa

SEQ ID NO: 3415 - DNA, 1449 bp, Saccharomyces cerevisiae
atgtctgcctttgtcagggtggttccaagaatatccagaagttcagtactcaccagatcattgagactgcaattgagatgctacgcatcgtacccagagcacaccattattggtatgccggcactgtctcctacgatgacgcaaggtaatcttgctgcttggactaagaaggaaggtgaccaattgtctcccggtgaagttattgccgaaatagaaacagacaaggctcaaatggactttgagttccaagaagatggttacttagccaagattctagttcctgaaggtacaaaggacattcctgtcaacaagcctattgccgtctatgtggaggacaaagctgatgtgccagcttttaaggactttaagctggaggattcaggttctgattcaaagaccagtacgaaggctcagcctgccgaaccacaggcagaaaagaaacaagaagcgccagctgaagagaccaagacttctgcacctgaagctaagaaatctgacgttgctgctcctcaaggtaggatttttgcctctccacttgccaagactatcgccttggaaaagggtatttctttgaaggatgttcacggcactggaccccgcggtagaattaccaaggctgacattgagtcatatctagaaaagtcgtctaagcagtcttctcaaaccagtggtgctgccgccgccactcctgccgccgctacctcaagcactactgctggctctgctccatcgccttcttctacagcatcatatgaggatgttccaatttcaaccatgagaagcatcattggagaacgtttattgcaatctactcaaggcattccatcatacatcgtttcctccaagatatccatctccaaacttttgaaattgagacagtccttgaacgctacagcaaacgacaagtacaaactgtccattaatgacctattagtaaaagccatcactgttgcggctaagagggtgccagatgccaatgcctactggttacctaatgagaacgttatccgtaaattcaagaatgtcgatgtctcagtcgctgttgccacaccaacaggattattgacaccaattgtcaagaattgtgaggccaagggcttgtcgcaaatctctaacgaaatcaaggaactagtcaagcgtgccagaataaacaaattggcaccagaggaattccaaggtgggaccatttgcatatccaatatgggcatgaataatgctgttaacatgtttacttcgattatcaacccaccacagtctacaatcttggccatcgctactgttgaaagggtcgctgtggaagacgccgctgctgagaacggattctcctttgataaccaggttaccataacagggacctttgatcatagaaccattgatggcgccaaaggtgcagaattcatgaaggaattgaaaactgttattgaaaatcctttggaaatgctattgtga

SEQ ID NO: 3416 - DNA, 1452 bp, Saccharomyces cerevisiae
atgagtagctccacaaagtgcaagaaagcatacgaagcggtagtcaaaatggttacgcatagattcaactccaaagcagtccgcaattaccatcaaccacaaggtttaaacaggagtctggcaacccgcaatgcagctagagttaggggtatggtcccttcaagaagagggggcgtgggactgtataagagttcaagtagcaagttgatgaataaactaggaagacaaaagacatggataaatgagtttgaacattttaattctctgcacgaaattgcatatacccctaacattgcgttaagtagtgaaatccaaaaatatttaaaggcattggaaacaaactatcggtccatctatgagaaaagttcagaattactggataagaagctggaagaaattgacaagaaatggatagagaaaaacgggtgtatacctgatgcatctaaagacgatgtggagaaaaatctaagaaagcaatatttagcagatgtacaggacgtaaaaaacgaacatatacctgtgatgaattgtgaacctggtgggtctcagttcaagtatctctgtaaaactattgagttattatcatccaacaagacaatttgttttgccatcgatgtagaggcatttgaatttgatacagacattgttacagagattggcatcgccatatatgatccaagagaaaacatttattccttgatgccgattataagaagttatcatttaattgttgctgaagcgttaccgttaagaaacaagaaattcgtatgcgactttaaagactgctttttacttggagaaagtcttgtattaccattggaacaatgtgtagagttcattcagtcgttgattaatttctatatgaaatgtgagacggaccaagatacaacctgggaaagagcgtttgtgggtcatgctatagcgggggatattaagtggctgaagaaaattggggtccatgtacctgaattggataatgaacttaccaaaccggaggactcaacggagagcaaaggtgttagaaaacatgttaagatgcttgacacagagaaaatttatagcatgtgttatggcaagaagggtagcagtttaggtaaactactaaggctttttcacttgccacatgccttcttacataacgcaggcaatgatgcatattacacgttgctcctgatgctgaagttaggagattataactttagaaagcaaattggggcagatgatttagaaacaatgggatataggataagagaatggtttaagcgtgaggcggacgaacccaaaattttgccaatgtcgtacgtgctaagtgtgatgaatgccaataatagcaaaccgaaagttgatgataagggaagaaagaagccgagggatcttgtacctcagacggaatttagcgggtctcattggtttcaaaatgcacgcgcagccttcaaaagtactcttgtgtga

SEQ ID NO: 3417 - DNA, 1452 bp, Saccharomyces cerevisiae
atgctttctgcaaccaaacaaacatttagaagtctacagataagaactatgtccacgaacaccaagcattacgattacctcgtcatcgggggtggctcagggggtgttgcttccgcaagaagagctgcatcttatggtgcgaagacattactagttgaagctaaggctcttggtggtacctgtgttaacgtgggttgtgttccgaagaaagtcatgtggtatgcttctgacctcgctactagagtatcccatgcaaatgaatatggattatatcagaatcttccattagataaagagcatttgacttttaattggccagaatttaagcagaaaagggatgcttatgtccataggttgaacggtatataccagaagaatttagaaaaagaaaaagtggatgttgtatttggatgggctagattcaataaggacggtaatgttgaagttcagaaaagggataatactactgaagtttactccgctaaccatattttagttgcgaccggtggaaaggctattttccccgaaaacattccaggtttcgaattaggtactgattctgatgggttctttagattggaagaacaacctaagaaagttgttgttgttggcgctggttatattggtattgagctagcaggtgtgttccatgggctgggatccgaaacgcacttggtaattagaggtgaaactgtcttgagaaaatttgatgaatgcatccagaacactattactgaccattacgtaaaggaaggcatcaacgttcataaactatccaaaattgttaaggtggagaaaaatgtagaaactgacaaactgaaaatacatatgaatgactcaaagtccatcgatgacgttgacgaattaatttggacaattggacgtaaatcccatctaggtatgggttcagaaaatgtaggtataaagctgaactctcatgaccaaataattgctgatgaatatcagaacaccaatgttccaaacatttattctctaggtgacgttgttggaaaagttgaattgacacctgtcgctattgcagcgggcagaaagctgtctaatagactgtttggtccagagaaattccgtaatgacaaactagattacgagaacgtccccagcgtaattttctcacatcctgaagccggttccattggtatttctgagaaggaagccattgaaaagtacggtaaggagaatataaaggtctacaattccaaatttaccgccatgtactatgctatgttgagtgagaaatcacccacaagatataaaattgtttgtgcgggaccaaatgaaaaggttgtcggtctgcacattgttggtgattcctctgcagaaatcttgcaagggttcggtgttgctataaagatgggtgccactaaggctgatttcgataattgtgttgctattcatccgactagcgcagaagaattggttactatgagatga

SEQ ID NO: 3418 - DNA, 1452 bp, Saccharomyces cerevisiae
atggccagagcatcctctactaaagccagaaaacagaggcatgatccacttttaaaggatttagatgcagctcaaggtaccttgaaaaaaatcaataaaaagaagctagcgcagaacgatgctgcaaatcacgatgctgcaaatgaggaagatggatacatagactccaaagcatcaagaaaaattttgcagttggccaaggaacaacaggatgaaattgaaggtgaggaacttgctgaatcagaaagaaacaagcaatttgaagccagattcaccaccatgagctatgatgatgaagacgaagacgaagacgaagacgaagaagcttttggagaagacatctccgattttgaacccgaaggtgattataaagaagaggaagagatagttgaaatcgatgaagaagacgcagcgatgtttgagcaatatttcaagaaatcagatgattttaactctttaagtggtagctataatcttgcagacaagattatggcctctatccgagaaaaggaaagtcaagttgaagatatgcaagatgatgaaccacttgctaatgaacagaatacctcaagaggcaatatttcatccggtttgaagagtggagagggtgttgcacttccagagaaggtcatcaaagcatatactacggtaggtagtattttaaaaacttggacgcacggtaagttgccaaagttgttcaaggttatcccatccttaagaaattggcaagatgtcatttatgtgaccaacccggaagaatggtcaccacacgttgtttacgaagcaacgaaattatttgtatccaacctaactgctaaagaatctcaaaaatttattaacctaattttacttgaacgtttccgtgacaatatcgagaccagtgaagaccactctttaaactatcatatataccgtgcggtgaaaaaatcgctttataaaccaagtgccttcttcaaaggtttcctattcccattggttgaaacagggtgtaatgtacgtgaagcgacaattgcaggaagtgtgcttgctaaagtctctgttccggctttacattcttcagctgccttgagttatcttttaaggctacctttctctccacctacaactgtttttatcaaaatattgctcgataaaaaatatgctttaccgtaccagacggtggacgactgcgtgtattactttatgaggtttagaattttggatgacggtagtaatggggaagatgctacaagagtactcccagtgatatggcacaaggctttcttaacatttgcacaacgttacaagaacgatattacccaggatcagagagatttcttgttggaaactgttcgtcaaagaggccataaagatatcggtcctgagattagaagagaactattggcaggagccagcagggagtttgttgatccacaggaagctaatgatgatttaatgattgatgtcaattga

SEQ ID NO: 3419 - DNA, 1452 bp, Saccharomyces cerevisiae
atggtaacacagaccaatccggtccctgttacatatccaacggatgcttatatccccacgtatctgcccgatgataaggtctccaatctggcagatttgaaaaaattgatagaaatggattccagactagatttgtatctgacaagaaggaggctggatacgtccatcaatttacctacaaacaccaagaccaaggaccatccccccaataaagagatgctgaggatttacgtctacaacactacggaaagcagccctcgcagcgattctggcaccccagcggactcaggcaagactacatggacactgagaatagaaggtaagcttctgcacgagtccgcaaacggaaagcacccatttagtgagtttttggaaggtgtcgcggtcgactttaaaagactgaaaccgctgggcatgggcaagaagaggaaacgcgattcgtcattgagccttcctttgaatctgcaacaacccgaatacaatgatcaagatagcaccatgggcgataacgacaacggcgaggatgaggacagtgcagaggcagaatccagggaggaaattgtagacgcactggaatggaactacgatgaaaacaacgttgtggagtttgatggtatcgacatcaagaggcaaggcaaggataatttgcgatgcagtataaccatccagttgaggggtgtcgacggtggaaaagtacagtactcgcccaacttagctaccttgataggtatgcaaacgggctccgttaatgacgcggtttattcgatctacaagtacattttgatcaacaatctgtttgttacggaacaaacagaggctcaagatggttccaacgatgccgaagacagcagtaacgagaataacaataaaaacggtgctggtgacgatgatggcgtcgagggaagtactccaaaggataagcccgaattgggtgaagtgaagctagattcactcttacaaaaggtattggatacaaacgccgcgcacctccccttgatgaatgttgtgcaaaccgtgaacaaactggtatcacccctaccgcccatcatcctagattatacaattgatctttccaaagataccacctatggtgctaccaccttggatgtagatgtgtcgcacattctccaccagcctcaaccccagccaaatttacaaaaagaggaagaaacagatgctgaagacacagcaaaactacgtgaaatcacaaagcttgccttgcagttgaactctagtgctcaaaaataccagtttttccacgaactgtctttgcatccaagagaaacgctgactcactacttatggtcttccaagcaaaacgagcttgtgctgcagggcgaccaatacttcaatgaagatgctgcaagaacgagtgacatatacagtaacaacaacaatgacaggtcactaatgggcaatatctcactactgtactcccaaggaagactataa

SEQ ID NO: 3420 - DNA, 1452 bp, Saccharomyces cerevisiae
atgtatttgtcattctatatcactgatacaaagaacaaacttattttccagtatcttttaggtgcaacagctccctccttcaagcacctgtggacccgcgttcagtccacatgtcctcaattgctcgaagatagcagtagtgatgattatttagaccattcaatggttggaagagatttagaggtctataagtatttctcagttataaataagctcaattattggtgcttagcctccacttcgaagtcaaaaggcccgcttgattgttttacctttttagagactatagatcgtatcctgttagaatattttgacaaggataaattaagtatcaagaaaattgttaataattatgatagaatcagtttgatttttaactgttgcgtcgaagcgggtgaaccaaatgtgagtgatatgctctatgttaataaaattaaagaagctgttcctgaaagatcggatttatcgaagttcataagttctacagcccataatttacagcaggctgtgcaactcccacaacaaaggcaacagcagctacaacaaaatcagatttctcgtggtagtaattcactaatcgaaaatgaagagattgttccctggagaacttcaagggctagcaaacatgagaataatgagctttatgtggatttgttagaaacattccatgttgtatttgaaaagaaaaaatcacatctaaggttgctcactggaagtatccatggaatagtggacgtgagatcttatttgaatgataatcctctagttgcagtaaaattaaacactatgggaaatgatataggtatacccagtttgcatgactgtgttgaaatcaatgatggtgtgttttctccctctaatataacgtttataccaccagatgggaagttcagattgctggagtattccgtcgatttaagttctcaagtaaagcaatccggagtaaggatgaattctattggcttgatgtctttacacttccaaaatggattgggtaaagattctgatgaatttgagttatccttaaatattgaaaatttcaaaaaagtttcacaagttgatgacctaaaaatagatttacagttcaatgttgagaatgctgatccaaatgaaatagcatataagataaaaatattgcgcaatactcatggccgttttgaaaatagcattatcatgggtcaaggacaatggatttttgataaatcaactgccactggaacggtacctgtactacgtggctgtattgagtatgaaaatactgggccaaattttacaaaaaaagttgatttacaaacagtctccttagaatattcttacataggacaatcggccagtggaatctatgtagaagccatcgatattgtatctggattaacaattggcaaaaatacaaagctgtacaagggtgcaaagtataagacccagacaggcaattttcaagtaaggctgtag

SEQ ID NO: 3421 - DNA, 1452 bp, Saccharomyces cerevisiae
atgtcaaaggaggatttcgttattaagcctgaagctgcaggtgcttccactgacactagtgaatggccattacttttgaagaattttgataagttattagtcagaagtggtcattatacccctatcccagctggtagttcaccactaaagagagacctgaaatcatatatcagctctggtgtcattaatctagataaaccttccaacccatcatcgcacgaagttgtagcttggatcaaaagaatcttacgttgtgagaagactggtcactctggtacattggatccaaaagttacaggttgtttgattgtttgtattgacagagctaccaggttggttaagtctcaacaaggtgctggtaaggagtatgtgtgtattgtcagattgcatgatgctttgaaggatgaaaaggatttgggccgctcactagaaaacttgaccggtgcgcttttccaaagacctcctttaatctctgctgttaagagacaattacgtgttcgtactatctatgagtcaaacttgattgagttcgataacaagagaaacttaggtgttttctgggcttcctgtgaagctggtacttatatgcgtactttgtgtgttcatttaggtatgctattaggtgttggtggtcacatgcaagaattgcgtcgtgttagatccggtgctctgtctgaaaatgacaacatggtcactttacatgatgttatggatgcccaatgggtttacgacaatacaagagatgaatcttacttgagatccattattcaacctttagaaactctattggttggttacaagagaattgtagtgaaggattctgctgtcaatgcagtatgttatggtgcaaagttgatgatccctggtttattgcgttacgaagaaggtattgagttatatgacgaaattgtcttgataactaccaagggtgaagccattgccgttgccatcgcacaaatgtcaaccgttgacttagcttcctgtgatcatggtgttgttgctagtgtgaagagatgtatcatggaaagagatttatacccaagaagatggggtttgggtccagtcgcacaaaagaagaagcaaatgaaggcagacggcaaattggataaatacggccgtgttaacgaaaacaccccagaacaatggaaaaaagaatatgttccattagacaatgctgaacagtcaacttctagctctcaggaaactaaggaaactgaagaagagcctaagaaagctaaagaagattctttaatcaaagaagtcgaaactgagaaggaagaagtgaaagaggatgacagcaaaaaggaaaagaaagagaagaaggacaagaaggaaaagaaggaaaagaaagaaaagaaggacaagaaggaaaagaaagagaaaaaggagaagaaaagaaagtctgaagacggtgattctgaggaaaagaaatctaagaaatctaagaaatga

SEQ ID NO: 3422 - DNA, 1455 bp, Saccharomyces cerevisiae
atgacctcatcatctggtgttgataatgagatttccttagacagcccgatgccaattttcaatgagagttctactttaaagccaattagggttgcgggtgtagtaacaacagggacagatcatatcgaccctagcgtactacaggcatacttagatgatactattatgaaatccattactttggggcagctagtgaaaaatgcggatgtgttaaataagagattgtgccaacaccacattgccttgaacgccaaacagtcgtttcacttccaaggcaatacatatatctccgatgaaaaagaaacacatgatgtggtgcctttgatggaagttgtttcacaattagatatattacctcctaaaacgtttacagcgaagacagggacaaattttgggaacgataatgatgcagaggcttacttacaatttgaaaaactaatagataaaaaatacttaaagttacctactagagtcaatctcgaaattttgagaggtacaaaaatacactcctcctttctattcaattcttactcttctctttctccccaatcaattctaaacttgaaagtttttagtcaattttataattggaacacaaataaaggattagatattgggcaaagaggagcaagactatctttgaggtacgagccactgttcttacataaactattacacaatccgcattctaatgaaagtcccacgttatttcatgagtggtttttagagacctgctggagatccactaagatatgttcacaaggcactagtgcgccctatatgtattcaggtacaatgttatctcaagcaggcgatcagttaaggacaattttgggtcatacattcgtgctggacaagagagatcatattatgtgccctactaagggttcgatgttgaagtggagtaatgaactttcgcctggaaagcatttaaagacccaattagaattgaacagtgtaaaaagttggatgaatgacgactttattactttttctactaccattaaaacaggatatctaaagaacttatcctcacaacaatccttgcctgtacatatatgtgataagtttcagagtggtgggcccagcgacattcgggggtttcaaacatttgggttaggccccagagatttatatgatgcagtaggtggtgatgcttttgtttcctatggtcttagcgtattttctcgattgccctggaaaaaagttgaaaagtcaaactttaggttacattggttttttaatgggggtaaattggttaatcatgacaatacgtcgttgggtaattgcataggacagctttcaaaggaacactccacatccacaggtattggtcttgtactaaggcacccaatggcaagattcgagctaaactttactttgcctattaccgctcacgaaaatgatttgataagaaaaggattccagtttggtcttggtctggcatttttataa

SEQ ID NO: 3423 - DNA, 1455 bp, Saccharomyces cerevisiae
atgctacggataagtattgactctatcaagcaattcggttcctttgtgccaggttataacaacactagttaccatgctgccgggagggccataagaacatcaagcctgtacagtacaatgatctcagccaacccgagaaggtgcctgcattcttcgaaactgctaaataaagaaggtcaagaagagggctataatgaacagctcatttcaaaaatgtcttcacagaatggatcgaattccagacagaatgaaagtgaaggaaagaaggaaggcaaggcttcctctgtgaagtcgttgttgcaacatactcatagtcacagccacacacatatgcatgacaatcctttattgtcactgaacgtacagcagatcaagaagaatcctggcgtaagaataacatggataggacttgcatcaaatgtggggatggcagtaggaaaatttgtaggaggaatcacttttcattctcaagcattacttgctgattccgtacatgctcttagcgatttggtatctgattttttaacactgttttctgtccaatatgcgtctcgtaaaccaacttcggagtacccatatggctatggtaaagtggaaactgtgggatctttggcagtatccacaatcttagcaatggctggtatatctatcggttggtcgtcgttatgcgctattgtggggcctgtcattcctcatgccattctagaatcgatggccggtttaattggtgaaacgcattcccattctcagtcgctaacacaacaggcaactaatgtaaatgctgtatggatagcagcgggttctatcttggttaaagaatgggtttttcaggcaacaaagaaagttgcaatccaaacaaattctaatgtactaatggcaaacgcctggcatcatcgtgttgactccttgacatcgttggtagcgttggtcgctatcacatctagttattttttcaacattcaatccttagataatttaggtgggcttgtagtgtcaggtttgatcataaaaacaggtggacaaggtatcttatcctcactgaaggagttagttgaccaatctataccacctactgatccgcgttatctagaaatcgaatctgtcataaaagacagcattggcagtttgaaaacagacttagatctcaaacagtcgttacatgttagagaccttactatattagcttccggtcctaatcttcgtgccaccacaactttggaagtgccagtattacattcaggtcaggaagttgggataagatttttggaaaacgctatttcgactataagagaggatttacgtatgaaggtgccaaacgtggggaaggtggacgtcgagtttgttgatgtaacctctgactctaaaggtgatttggagcactctcatgacactaaatcaacaaatcatactcatactcattctgattctgccgatactcacacccataaacattag

SEQ ID NO: 3424 - DNA, 1455 bp, Saccharomyces cerevisiae
atggatagtgtaattcaaaaaagaatttttgtcggaaatattttccataatgcagatgattgttattcagaactactagatcgatttggaaaatttggtgattgccaagattttcagtttgaaaaacacaaccactttgcatttatcgatataaggtttaatgatgaggcagattttaacaagctaagaaagagctttaataatgttaagtttaaagggaacattttgaaggttgatgaagcaaagccgaattgggaaagcacctgggcggtacaacatgcaaaggaccttaaagaagatattatactaaatgctaaaatgaaaaaaaagaattggcaacattataagaaaatggaaaatgtagcgaaaagttggaaagatcataaggaagttattgctggcagaatgagggaggcgccgagaaaaaggagtcaattgaggaacattacattcaggatcaatgtcaatggttcattgaaagtttacaaatgctataagactaaattatggggttatgaaaggaacaaagaattgaatgaccttgtgtacaagtttacaaataatttctggaaaaacggatacaaccacattgtcgatagattggattacagtcgtgctgttaaaactgttcgattcaaaaatgggctgaaacagttaacagtgtcaaaagatgaaaacgtttgcagtggagagatggacagcgatgagaatatgtcagaagaggagaaggagaaaaataatgttattcttaatgacctattaaaggactttgacttcgataagccaatgacgttgaatgattcggacgaggaacttctgacagagcaacgtaaaggagaggaagaagaagaagaagaagaagaaaaagaagtaaacgctcccgaatacgagaatgttaataagacgaaggaccagagcaccctaccacaagaaaaaccagaggaaaggaaagaacaggacgagggcgacgggcaggaggataatgaatttattccgactttcaccaaggaaattggtcaaggtacaataagcaacactgagacgttaagaaacctattcaaccccaacgaggcagaacctgtatcacaattcaaattgattgaagattctgataatgatattgatcatgcgaaagatgttgatgtgaaccaactggaggaagaagtaagtaaatcatctgacaccctaggtttgacatcggctcccgtaccacatgtatctagagataaagataacaaaaatttcttgtttttccctcatttgcaatcgccatttttagtaggacaaacacagttgagtaaagtaagggctcctggaagagaaacaatgctatcgaactgggatgaggagttctgggctaacagaggtaattggacccgtgatatgaggcgcaaaatgaaagatgcattgaagcaccgtaagaggaaacaatcaaagagcgggcttcttctatag

SEQ ID NO: 3425 - DNA, 1455 bp, Saccharomyces cerevisiae
atggctgataagatagagaggcatactttcaaggtcttcaatcaagatttcagtgtagataagaggtttcaacttatcaaagaaatagggcatggagcatacggcatagtgtgttcagcgcggtttgcagaagctgccgaagataccacagttgccatcaagaaagtgacaaacgttttttcgaagaccttactatgtaaaagatccctacgtgagctaaagcttttgagacatttcagaggccacaaaaatattacatgtctttatgatatggatattgttttttatccagacgggtctatcaatggactatatctttatgaggaacttatggaatgtgatatgcaccaaatcatcaaatccggtcaacctttgacggatgctcactatcaaagtttcacataccaaatattatgtggtttaaagtatattcattctgcagatgtcttgcatcgtgatttgaagcccggcaatttgcttgtcaatgcagattgtcaattgaaaatctgtgattttgggttagctagaggttattcggagaatcctgtcgaaaacagtcaatttttgacggagtacgtggccactagatggtatagagctccggaaataatgttgagttaccaaggatataccaaggcgattgacgtatggtcagctggctgtattttagcggagtttcttggtggaaagccaatcttcaaaggaaaggattacgttaatcaattgaatcaaatattacaagttttagggacacccccagacgaaactttaagaaggattggttctaaaaatgttcaggactacatacatcaattaggtttcattccaaaagtaccttttgtcaatttatacccaaatgccaattcacaagcattagacttattggagcaaatgctcgcgtttgaccctcaaaagagaattaccgtggatgaggccctggagcatccttacttgtctatatggcatgatccagctgacgaacctgtgtgtagtgaaaaattcgaatttagttttgaatcggttaatgatatggaggacttaaaacaaatggttatacaagaagtgcaagatttcaggctgtttgtgagacaaccgctattagaagagcaaaggcaattacaattacagcagcagcaacagcagcagcaacagcaacagcaacagcaacagcagccttcagatgtggataatggcaacgccgcagcgagtgaagaaaattatccaaaacagatggccacgtctaattctgttgcgccacaacaagaatcatttggtattcactcccaaaatttgccaaggcatgatgcagatttcccacctcgacctcaagagagtatgatggagatgagacctgccactggaaataccgcagatattccgcctcagaatgataacggcacgcttctagaccttgaaaaagagctggagtttggattagatagaaaatatttttag

SEQ ID NO: 3426 - DNA, 1455 bp, Saccharomyces cerevisiae
atgggtaaaaataagaagaaaacaggtaagaaggccaagagtcatcctcatgtggaggacgttgatgaaaccgtcaataaacctgaagaaatcatcaattctgtaaacgtcaccgttcctccaaaaatgtccacagatccagaggctgatggtatcgtggcaagcccggacgatgaggggaaagatctctctgaaggagtagacaaacaaaaagtaaatgacggcctgactgtagacaccataaatcctttagaggacaaaaaggctggtgatgagatgaaggaactaagggaagaaattgaacgtttaaaattggaactaagccacaagaaggatcaagaaacgcctaatgaagacttcaaaaatgaactagcaaatgttattaaggaaagagacgaattcaaaacacagtatgacacattattgagcaagatatcttctatgaaatcaatttttaataagatgaaagaagcacaaaaacaattagaggaagtgcaggagcagcttactgaatatgaatcacaaaatctgaaattgaagaagaaacttgaagctaccaagaccgaaaactctgaattacaatccacgattgtgaccctaaatacagagttagaaaacctagaaaaggagcaagaaagtacagaagaggtttttttggaatacgaatcaaggatagaagctttggaagatgaaaaacacgacataattgaaaaacatagtaaggaacttaacacttacaggaaggaaaaagatcaattaaatctccaagttcaggaactcatgataatcttagaaaataataaacaagatatatctgacttgagaacagaaagagatgaattgagacaggctttggaatcccatgaaaaggagaaagcagtattaaagaattctctaaatgatctggaattgaagatagaagaagttgacaacaaaagggaagaagaggctagagagagagaccaggaagtcaaatctttacgatcccaacttgacacggagatagaaacgcacaacaatgacacagaagctttagaaagcatgaaaaaacagctagaagccatgaaggaggacgcctctatgaaggaaaaatatgaggaagaatctaagcagcacatcttacagatcggaaaactacgtcacgaagccattatactaaatgagcatttaacaaaggcactggccatgttgaagaaatcaagcgattctgaatccgttgataaagaactgatatccaatctattgatatctttcgtgtccatacccagagcagacccaagaaagtttgaagttcttgaattactgtccaatttcttaaactgggatgaagataagaaacaacaggccggcttgatctcgaataatgagtctaagaattcaagcgctgtatcgagaacggaaagctttgtatcgctttggaccaactacctcgagaaagagagtgagaaagactaa

SEQ ID NO: 3427 - DNA, 1455 bp, Saccharomyces cerevisiae
atgggttcaaatgatttgataaatgaagcatatgacgactcggaagtagttggtgaggaaagagaatcaaaatctgcatggatgaagaggtggtatcagctacttacttctcctttagacttgcagttggtaataaatgaaaagttagaaatgatcaactgggatgcttatgctaaaagtctagctaagccattagggaattttttaacaatacttttttttatcataagactcttgcaggacaatttgatcaagcccaactattacaaactaaacgtcaagtctggcgctttcgatctttctaaatccaataaattaaaagagtttgattatctatgggagatatcatccagctttcaaaacaataatcaattttatgcatttcaatcttggtattttgttaccttaaggtttttgaataatcttttcaggtttactattttcatactgctgtccctgaacctgtacgtaagctgtaaattcatgtttggatactttaagacttacaatctcttccatttgaaaaaagagttcaactccccaaacctcactaaacacaacttgaaggatctaagcaaagaatactatgaagatatttataagcagtccttgtggtctatgttgaagcattttttcagaggatctcgtgatgacggtcctcatgttaatcaaaatgaagatgagatattttttcagttaagaaaatggatccccactaacttcatgattaatctttttgtgtctttttcaccaacggcaattgtttttttaagcttttctgatgtttcgtttacttcagcaattgctatagtattccatcaatatattctggattatatcataactaagagatttcaaagaagcgtggacgacgacttgattttatcaagtgcagctttgcaagaatatgaggacaagcatataatggcacgaattaaccaatgcagcaatatagatactctatcatctgcaatgggtactagatctaaaacaccgagaatattcaccactcactccctatgtggcgaagaaatcagagaggtttataattatgaaaaaagggaatttgaggcattaccgaaaatgacagaaagtgtgccaggatcccgtgaaaccagaataaaggattatggaggcatttctcaagtatctgaccatcaaagtcatcccattggttttcattattctcctagaatgtccccatattatagggataaagttttggataacaatttggctcaatcatcgtcaaatgaaaatttagagaagggcggagcttacctgccgaatcaagaccaaaatagaccatcgaaatccctgagcccattgagaaaaacgcctttaagcgcacgacagaaaaggtttgaaggctcagagttcaatgtattgaataagaatgatattaattccattcttcgctctccaaagaaaaagaagaactatcacaaaagataa

SEQ ID NO: 3428 - DNA, 1455 bp, Saccharomyces cerevisiae
atgtccttggaagataaatttgattcattgtctgtgtcgcaaggtgcctcggaccatattaataatcagctcttagagaagtatagtcacaaaataaaaactgatgaattatcattcagcagagcgaaaacatcaaaggataaagcaaatagggcgactgtggaaaatgtcttagatccgagaactatgagatttttgaagtctatggtcaccagaggtgtgattgcagatttgaacggttgcttaagtactgggaaagaagctaatgtttaccacgcttttgcaggtaccggtaaggcacccgtaatagatgaggaaacaggccagtatgaagttttagagacagacggatcccgtgcagaatatgccattaagatttataagacctctatcctagtcttcaaagatcgtgaaagatatgttgatggtgaatttagatttagaaattccagatctcaacataatccaaggaaaatgattaaaatttgggctgaaaaggaatttaggaacctgaaaagaatttatcaaagtggcgtcattccagctcctaagccaatagaagttaagaacaacgtcttagttatggaatttttaagccgaggtaatggatttgcctcacctaaattaaaagattatccgtacaagaatcgtgatgaaattttccattattatcacacaatggtggcatatatgagattgctgtaccaagtttgtcgcctggttcatgccgatttgtcagagtataacaccatagttcatgatgataaactatatatgatcgatgtttcccaaagtgtggaacctgaacatccaatgagtttagattttttaaggatggatatcaaaaacgttaacctttatttcgagaagatgggtataagtattttccctgaaagggttatttttcaatttgtcatatcagaaactttggagaaatttaaaggtgattataacaatattagcgccttggttgcatacattgctagtaatctaccaataaaatctacagaacaagatgaggcagaagatgaaatattcagatcgctgcatttagttagatcattgggtggattagaggaaagagattttgataggtatactgatggtaagtttgacttactgaaaagcttgattgcccatgataatgaacgcaattttgctgcttctgagcaatttgaatttgataacgctgaccacgaatgtagttctggcacagaggaattctcagatgatgaagaagacggctcaagcggatctgaagaagatgacgaggaggagggcgagtactatgacgatgatgaaccaaaagttttaaaggggaagaaacatgaggacaaggatttaaaaaaattgcgcaagcaggaagctaaagatgcaaaaagagaaaaaaggaaaacaaaagtcaagaagcacatcaagaaaaaattggtgaaaaaaacgaaatcaaagaaataa

SEQ ID NO: 3429 - DNA, 1455 bp, Saccharomyces cerevisiae
atgtctgtgcacgctgcaacaaacccaatcaataagcatgtggttctaattgacaactacgattcctttacctggaacgtttacgagtacttgtgccaggagggcgccaaagtgagcgtctaccgtaacgatgcaattacagttccagaaattgccgccttgaatcccgacacattgcttatctcgcctggaccaggccacccaaagacagattctggcatttcaagagactgtatccggtactttactgggaaaattcctgtatttggaatctgtatgggccagcaatgcatgtttgacgtatttggtggtgaagttgcctacgctggtgagattgtccacggtaaaacgtccccaatctctcacgacaactgtggaattttcaagaacgtgccgcaaggtattgctgtgacaagataccattcattggccgggacagaatcgtccctaccatcctgcttgaaggttactgcgagtaccgaaaatggaattatcatgggtgtaagacacaagaagtacactgtagaaggtgtgcaatttcatccggaatccatcttgaccgaggaaggtcatctgatgatcaggaacattttaaacgtcagtggaggcacttgggaggaaaacaaatcatctccttcaaattctattttggaccgtatctatgctcggcgtaaaatagacgtcaatgagcagtctaaaatcccaggtttcacctttcaagacttacaatctaactatgatttaggtcttgccccaccgttacaggatttctacacggtgttgtcatcatcccataaaagagccgttgttcttgctgaagtcaagcgtgcctctccatcgaagggacccatttgtttaaaagctgttgctgctgaacaggctctcaaatacgcagaggctggtgcatccgcaatttccgtattgaccgaacctcattggtttcacggttcgttacaggatttagtaaatgtgaggaaaatcctagatttgaaatttcctcccaaggagaggccttgtgttttgagaaaagaatttattttcagcaagtatcaaatactagaagcaagattagctggagctgacactgtccttcttatagtcaagatgctatctcaacccttattgaaggaactgtacagctacagtaaagatttgaacatggaacctctcgttgaggtgaactccaaagaggaattacaaagggctctagaaattggtgctaaagttgtaggtgtcaataatagggacctgcattcattcaacgtagacctaaataccaccagtaacttggtagaatctattccaaaggatgttcttctaattgctctatcgggaattaccaccagggacgatgctgaaaaatacaaaaaagaaggtgtccatggatttttagtgggtgaagccctaatgaaatcaaccgatgtgaagaagttcattcatgaattatgcgaataa

SEQ ID NO: 3430 - DNA, 1455 bp, Saccharomyces cerevisiae
atgtctgttaccagtagggaacaaaaatttagtggtaagtatagttcgtatacagcccaggatcgccaagggcttgttaatgcggtgacatgtgttcttagctcgtcaagcgatcctgtggctgtgtcaagtgactattccaatagcttgagtattgccagagaggtcaacgcttatgctaaaattgccggatgtgattggacgtattatgtacaaaaattagaagttaccattggtaggaacacagacagcttgaacttgaatgctgtgcccggtacagtcgtgaagaagaatatagacattgatcttggtcctgccaaaattgtgtctaggaagcatgctgcaatcagattcaacctggagagcggatcatgggaattacagatattcggtagaaatggtgctaaggtcaattttagaaggattcccacaggtccagactctcctcctacggtgctacagtctggttgtatcatagacataggtggtgtgcaaatgatctttatattgccggaacaagaaactattatatcggattattgcctgaatcacctcatgcccaaattactatctacttatggtacgaatggtaacaacaacccgttgctacgtaacattatcgaaggttctacctatttaagagagcaaaggttacaggaagaggctcgattacaacagctggaccacctacacaccccattatcgtcatcatcagatgttaacccaataggggatccacatggagacacgattatgatggaagaagatgaagaagatgaaaattacaccagaggaggaattagaccgaatacatacacgtccagtagcaacaatgctgtcactaacggtaatgtaccccatatagaaaatccatcagacttgtcgctggatgaaaacagatatatcaaaccaccacagtcgtatgcatcgatgatcacccaagccattctttcaacacccgaaggtagtatttcattagcggatatttacaaatttatctctgacaactacgcattttacaggttttctcaaatggcgtggcagaactccgtgaggcataatctgtccctaaataaagccttcgagaaggtgcccaaaagagctggtcaacaaggtaaagggatgaattggaaaattagcgatgaagtcaggcgtgattttttgaacaagtggaatgctggtaaattgagtaagattagacgaggcgcctctgtgacaagacagctgcaattgcacatgtccaaatttggagaaatacctgctcctgaatcttcatcaattgacccgagggggataaaagcacagaaggtgaaaaagtctttacaagctacgagctcgattttaggtgaaagcgccccgcaattacaaagaactcaactcactggccaaatttctactacgacatccatggacgtaacaacaaacgcaaacgtgaacaattcctctctgagttga

SEQ ID NO: 3431 - DNA, 1455 bp, Saccharomyces cerevisiae
atgttactacgttctcttacaagtgccttcgttttaagtgctggtttggctcaggctgctagcagcagtaacagttccacaccatccattgaaattaaaggcaatgcattttttaattcggaatcaggtgaaaggttttatatccgtggtgttgattaccagcctggtggttcttctaacttgactgatcccttagcagacgcatctgtctgtgacagagacgtccccgttctgaaagatctagggataaatactgtcagagtttatactgtggataactcgcaagatcattcccattgtatgaaactattgcaggagaacggtatatacttgatcctggatgtcaatacccccacgagtgctatttctcgttacgatccagcctgctcctataacgctgactacttacaaaatgtctttgccaccattgatacctttgctgattacgacaatgttctaggttttttcgctggtaacgaggtcatcaatagtgttaatactaccaacactgctacttatgtcaaggcagtggtcagggacatgaagaaatacatcaaggctagaaaatacagacaaattccggtaggttactcggctgctgatatcgtcgctaacagacaattggctgctgaatactttaactgtggtgatgaagctgacgctagaatcgacatgtttggtgttaatgactattcttggtgtggtgaatcttcatttgtggtatcgggttattccaccaagatgaagctatatcaagattactccgttcctgtcttcttaagtgaatttggttgtaaccaagtcaagagctctcgtccattcacagaaattgaagctatctattccactcaaatgtcttctgtattctccggtgggctagtctacgaatattccaatgaaactaacaattacgggctcgttcaaattgatggtgacaaggtcactaaattgacagattttgaaaacttgaaaaatgaatacagcaaagtatccaacccagaaggcaatggtggttacagtacttccaacaactattctacatgtcctgattatgaaaagggtgtctgggaagctaataacactttgcctgctatgccaagtgctgcttctgcttacttcacatctggagcaggttctcctatgggaaccggaatcgccacccaacaaagttgtgatgctaaggacgatgacgacgaagaagacgacgacacctcctcttcatcctcttcttcctcttcatcttcatcttccgcttcttcatcttctgaatcatcatcctcgacttcaaaggcatcttcctcctccccttctgctagcgaaacgagcttgctaaaatctgccgcatctgctacttcgtccagccaatcgtcctcgaaatcaaagggtgctgccggaattattgagattcctttgatattccgtgctttggcagaactttataacttggttttatga

SEQ ID NO: 3432 - DNA, 1458 bp, Saccharomyces cerevisiae
atggttcatttaggtccaaagaaaccacaggctagaaagggttccatggctgatgtgcccaaggaattgatggatgaaattcatcagttggaagatatgtttacagttgacagcgagaccttgagaaaggttgttaagcactttatcgacgaattgaataaaggtttgacaaagaagggaggtaacattccaatgattcccggttgggtcatggaattcccaacaggtaaagaatctggtaactatttggccattgatttgggtggtactaacttaagagtcgtgttggtcaagttgagcggtaaccatacctttgacaccactcaatccaagtataaactaccacatgacatgagaaccactaagcaccaagaggagttatggtcctttattgccgactctttgaaggactttatggtcgagcaagaattgctaaacaccaaggacaccttaccattaggtttcaccttctcgtacccagcttcccaaaacaagattaacgaaggtattttgcaaagatggaccaagggtttcgatattccaaatgtcgaaggccacgatgtcgtcccattgctacaaaacgaaatttccaagagagagttgcctattgaaattgtagcattgattaatgatactgttggtactttaattgcctcatactacactgacccagagactaagatgggtgtgattttcggtactggtgtcaacggtgctttctatgatgttgtttccgatatcgaaaagttggagggcaaattagcagacgatattccaagtaactctccaatggctatcaattgtgaatatggttccttcgataatgaacatttggtcttgccaagaaccaagtacgatgttgctgtcgacgaacaatctccaagacctggtcaacaagcttttgaaaagatgacctccggttactacttgggtgaattgttgcgtctagtgttacttgaattaaacgagaagggcttgatgttgaaggatcaagatctaagcaagttgaaacaaccatacatcatggatacctcctacccagcaagaatcgaggatgatccatttgaaaacttggaagatactgatgacatcttccaaaaggactttggtgtcaagaccactctgccagaacgtaagttgattagaagactttgtgaattgatcggtaccagagctgctagattagctgtttgtggtattgccgctatttgccaaaagagaggttacaagactggtcacattgccgctgacggttctgtctataacaaatacccaggtttcaaggaagccgccgctaagggtttgagagatatctatggatggactggtgacgcaagcaaagatccaattacgattgttccagctgaggatggttcaggtgcaggtgctgctgttattgctgcattgtccgaaaaaagaattgccgaaggtaagtctcttggtatcattggcgcttaa

SEQ ID NO: 3433 - DNA, 1458 bp, Saccharomyces cerevisiae
atgtctggccaaaagggcgagatcgtggtttatacaaaagagttagaaactacccccgagcttttaccaaaccatgaagttttcaagattaggattggccaaaagctatttgagatctcaggtgctacattgaattcggatgcgcccaattttttcacccaattcttcaatacgcacgataaaaatacgattctatttgttgatagatcggaagacgtgttcatcataatatacagacatttacaaggttattttcccgatattaagaacgaagtacaatttacctgtcttttcgcggacgcattatattttcagttacccaagttagttaaactcataaaagaatacgactaccacttcactaatattggaggtgttccctttaaggtaccaaaatcattattccatgaagaagggaaccggttgaactattttgaaacgatttctcgcatatcttatgaggaaattgagaagtgggagtcaaataagaagccgggctttccacctttattaccaccctcatatattgcaaggtccccagaatttttccgagatatattatctttactgggcggttccaaattagaactgtctgaggaaagaaccgcatctctgataaaagagtgtcgttattaccgtctcaacaggttggagcaggaattagtgcgggcaaaaattatatataatcccttaactaattgtcaagaagtttgcatagctcttgatagcgtctccaagaagggtgtaaccattgaaaggttaacatcacttcataccggaaaccaatctttagcggtaagcagttgtctcaatggaactgagggtgaaaaagccgctactggatttcataaaaccgagactgattcaggcaacaatgatgaatatgaacctccaacaaaaaaggtaaaacattgtattgaaagacactggagcatgttaaaataccaaaggccttatatcgatacagtttcgcacgatcttattttccaattacactctaaccagtgcaaaataatattcaacaaaaagaataagactgttcatgtagacctatccagagaggctgcagtgttgtttgaaaacaagttctcggatgttttattggaaaacccagattttaaaattgatctgtccgaatataaggtcaaacttcgtgacagtcaaatgcaagttgaatcccacttaattattcctgcatgtgtctccatttgtgacttgacggtaaatggcgcaaaatgctgtaatattttctcattagttaacgactccaaatgtaaagggagggtcttggattgcaccaatttgaaagttttgaattgcgttcatggtttgaaactacacttatcgaaatccatgtggaagctaggtacaaataatggaagaatcattctcgttgctgtaaaagccgaaaccttctctgggacgaaggaatattgcaaaatgattgattttctgtga

SEQ ID NO: 3434 - DNA, 1459 bp, Saccharomyces cerevisiae
atgggcttcaatatagcgtatgtctagctcacagcatgtgttccaaatacattaaagaagatctcttttgttgttgatactaaccagtaaagttgagagttataacaatgaaaataggatgctgtgcgactttttttatccacagttaggtggagtcgaattccatatatatcatttatcgcagaaactaatcgatttgggccattctgtcgtcattataactcacgcttacaaagatcgagtcggcgtacgacatcttaccaacggtctaaaggtctatcacgtaccattttttgtgattttcagagaaaccactttccccactgttttttcaacatttccaataataaggaatattcttctcagagagcagatccaaattgttcattctcatggtagcgcttccacgttcgctcacgagggaattcttcatgctaatactatgggattgagaactgtgttcacggaccattcactctacggttttaataacttaacgtcgatttgggtgaataagttgctaacatttaccttgacaaacatagatcgggttatatgtgtttctaatacatgcaaagaaaatatgattgttagaacagaattaagtcctgatataatctcagtaattcccaacgcagtggtgagcgaagatttcaaaccaagggatcctactggtggcaccaagagaaaacaaagtagggataagatagtgatcgtggtcatcggaaggctctttccaaacaaagggtccgatttacttactcgcataattccgaaagtttgttcctcacatgaagatgtcgaatttatagtagcgggcgatggtccaaagttcatagattttcaacaaatgattgaaagtcatagactacaaaaacgtgtgcaactcttaggctctgttccacatgagaaagtcagggatgtattatgtcaaggtgacatatatttacacgctagtttaacagaagcatttggtacaattctagttgaggccgcatcttgtaatttgctaattgtaacgacacaagtcggaggaattcccgaagtgttaccaaatgagatgactgtttatgcagaacagacatccgtttctgaccttgttcaagcaacaaataaagctatcaatatcataagaagtaaagctttggacacttcctcttttcatgatagcgtgtctaaaatgtacgactggatggacgtagccaaaaggacagtagagatatatactaatatatcttctacttcttccgctgatgataaagattggatgaaaatggtagcaaatctttacaaaagagatggaatctgggctaaacatctttatctgttatgtggaattgtagagtacatgctttttttcctcttagagtggctataccccagggatgaaatcgatctagctccaaaatggcccaagaaaacagtgtctaacgagacgaaggaagcaagagaaacttaa

SEQ ID NO: 3435 - DNA, 1460 bp, Saccharomyces cerevisiae
atgagagaagttattagtattaatggtatgttcgatttgcccgtccaggctagatcttttttttgttagttcattttggcgtttcatctttcattactaacttcaacgcaaaatttttttttttttgatttctctttacagtcggtcaagctggttgtcagattggtaatgcctgttgggaattatattcccttgagcacggtattaagccggatggacatctagaagatggcctttcaaagccgaagggaggagaagagggtttctccacgtttttccatgaaaccggctacggtaagttcgttccaagggctatttacgtggatttagagcccaacgttattgacgaagtccgtaacggtccttacaaggacttgttccatccagaacagttgatcagtggtaaggaggacgcggctaataattatgcaagaggccattacaccgttggtagagaaattttgggcgatgttctggataggattagaaaactggcagaccaatgtgatgggttacaagggttcttgtttacccattctcttggtggtggtactggttccggtctagggtccttactgttggaagaactatccgctgaatacggtaagaaatccaagctggaatttgccgtataccctgctccacaagtgtctacttctgtggttgagccttacaacacagttttaactacacatactacattggaacatgcagattgtactttcatggtcgataatgaggctatttacgacatgtgcaaaagaaacttggatatcccaagaccaagctttgcaaacttaaacaacctaattgctcaagtggtatcatctgttacagcatcattgagattcgacggttcattaaatgtagatttgaacgaatttcaaaccaatttggttccatatccaagaattcatttccccttagtttcatattctccagtcttatccaaatcaaaggcattccatgagtccaactctgtgtcagaaattacaaacgcttgttttgaacctggtaaccagatggtcaagtgtgatccaagagatggtaaatacatggctacttgtctgttatacaggggtgatgtggtaacaagagatgttcaaagagctgtcgagcaggtgaaaaacaagaagaccgtccaattggttgattggtgtccaactggtttcaagatcggtatttgctacgaacctccaactgccacaccaaactcacaattggccactgtggatagggccgtctgtatgttgtcaaataccacatccattgctgaggcttggaagagaatcgatagaaaattcgatttaatgtatgccaaacgtgctttcgtccactggtatgtcggtgaaggtatggaagaaggtgaattcaccgaagctagagaagatttggctgctttagaaagagattacatcgaagtgggtgccgactcatacgctgaggaagaggaattttaa

SEQ ID NO: 3436 - DNA, 1461 bp, Saccharomyces cerevisiae
atggttcatttaggtccaaaaaaaccacaagccagaaagggttccatggccgatgtgccaaaggaattgatgcaacaaattgagaattttgaaaaaattttcactgttccaactgaaactttacaagccgttaccaagcacttcatttccgaattggaaaagggtttgtccaagaagggtggtaacattccaatgattccaggttgggttatggatttcccaactggtaaggaatccggtgatttcttggccattgatttgggtggtaccaacttgagagttgtcttagtcaagttgggcggtgaccgtacctttgacaccactcaatctaagtacagattaccagatgctatgagaactactcaaaatccagacgaattgtgggaatttattgccgactctttgaaagcttttattgatgagcaattcccacaaggtatctctgagccaattccattgggtttcaccttttctttcccagcttctcaaaacaaaatcaatgaaggtatcttgcaaagatggactaaaggttttgatattccaaacattgaaaaccacgatgttgttccaatgttgcaaaagcaaatcactaagaggaatatcccaattgaagttgttgctttgataaacgacactaccggtactttggttgcttcttactacactgacccagaaactaagatgggtgttatcttcggtactggtgtcaatggtgcttactacgatgtttgttccgatatcgaaaagctacaaggaaaactatctgatgacattccaccatctgctccaatggccatcaactgtgaatacggttccttcgataatgaacatgtcgttttgccaagaactaaatacgatatcaccattgatgaagaatctccaagaccaggccaacaaacctttgaaaaaatgtcttctggttactacttaggtgaaattttgcgtttggccttgatggacatgtacaaacaaggtttcatcttcaagaaccaagacttgtctaagttcgacaagcctttcgtcatggacacttcttacccagccagaatcgaggaagatccattcgagaacctagaagataccgatgacttgttccaaaatgagttcggtatcaacactactgttcaagaacgtaaattgatcagacgtttatctgaattgattggtgctagagctgctagattgtccgtttgtggtattgctgctatctgtcaaaagagaggttacaagaccggtcacatcgctgcagacggttccgtttacaacagatacccaggtttcaaagaaaaggctgccaatgctttgaaggacatttacggctggactcaaacctcactagacgactacccaatcaagattgttcctgctgaagatggttccggtgctggtgccgctgttattgctgctttggcccaaaaaagaattgctgaaggtaagtccgttggtatcatcggtgcttaa

SEQ ID NO: 3437 - DNA, 1461 bp, Saccharomyces cerevisiae
atgaataggattctatctagtgcatcgttgctatccaatgttagcatgccaaggcaaaacaagcataaaattacaaaggcgttatgttatgcaattatagtagcctcaatcggttcaatacaatttggttaccacttgtcggaattaaatgcacctcagcaggtgctttcgtgctcagaatttgacattcccatggagggctatccctatgacagaacatggctgggaaaaagaggatataagcaatgtataccattgaatgatgaacagattggaatcgtgacctccgttttttgcattggaggcattttgggctcttattttgccaccagtctggccaatatttatggaaggaagttctcaagtttaattaactgcacattgaatatcgtcggttcgctgataatcttcaattcgaatagttataggggcttaatcattggtagaattctagtgggtatttcgtgtggctctttgatcgtgattataccccttttcattaaggaagttgctccaagcggttgggaaggtttactgggttcgatgacacaaatctgtatcaggttaggggtcttgttgacacaaggaatagccctcccactgactgattcataccgttggaggtggattttgtttggtagcttccttatcgcggtattgaattttttcatgtggtttatagtcgatgaatctccaaaatggttgttagcacatggaagagtcaccgatgctaagttatctctatgtaagctacgtggcgtgacttttgatgaagccgcacaagagatacaggattggcaactgcaaatagaatctggggatccgttgattgaaccaaccaccacgaactctattagcggttctaattcattatggaaatacttgagggacagaacaaatgtcaagtctcgccatgttatcactgtattgttatttggccaacaattctgcggtataaactccattgtactatatggtaccaagataattagtcaactgtatcctcagcacgcaattaggataaactttttcattagtatggtgaatgtattagtcaccatactagtttctctgctaattcatagtttgccacgtaaaccgcttctgatgacgtccaccgtcttagtttctgttaccgccttcattatgggaatagcaatgaaccataataaaatgaaccttttgattgtgttttcatttatatatatgggcgttttcacgatggggttaaatccgttgccatttataataatgagagaagtatcaaaaccacaggatatggtccttgcgcaaagatatggtaccatttgcaattgggtaggaacttttatcattgcatatactttccctattattcatgatgttttgtcaggttatgttttcatcatttttgctatcatagcatgctcaataagcgcctttatctggaagaaggttccggagaccaagaggagcggctaa

SEQ ID NO: 3438 - DNA, 1461 bp, Saccharomyces cerevisiae
atgagcgaacaaaaggaagatttgtttaaaccagtaggagaagctgctgcagaggtcgaagatgaaagcatagccgaacagaacaaagctaatgacggcgtcaagttaaccggcgcacaggacgccatgggccatccagtgcaagagatagagtctctttgtatgaattgtggaaagaacggtacaaccagacttcttctgacttccatcccttatttcagagaaataattattatgtcattcgactgtcctcactgtgggtttaagaactgtgagatccaacccgcttctcaaattcaagagaagggctctcgttacgttttgaaagtggagtgccgtgaagattttaacaggcaagttattaagtcagaaactgccacttgtaagtttgtcgagctagacattgagattcctgctaagagaggtcaattgacgacagttgaaggtttgttatccgagatgatcgacgatctgtcgcaagaccaggaaatgagaaaatctatagacgaagctctttacaagaagatcgatgacttcatacagaaagttaaatcctacatcaattgtgaacccaacactattccgattacatttattttggatgatcctgcgggaaattcctggatcgaatacaaacccggtgaacctcaacacaaatggtctcatacccagtacgtgagaaccgacgaacaaaacgttcaagttggcattattactagagaccagttggagcaacgtcgccaagaacaattaaaacaattggccaaccgtgaaagaaatccttctgaatctgtcaaagttggctcagcaaacccacagtttttgtcagacgccaccgacatcgaaaactttaacaacgaggtgcaaacattcagagcttcttgtccatcgtgtacccaagagtgtgaaactcatatgaagccagtaaatatcccacactttaaagaagtcattatcatgtcgacggtctgcgatcattgtggttataagtctaatgaggtgaagaccggtggtgccatccctgacaaaggaagaaggattactttatactgtgacgatgcagctgacttgtcccgtgatattttgaaatctgagacctgtagtatggtaattcctgaattacatcttgatattcaagaaggtacattgggtggtagattcaccactttggaaggtttactaagacaagtctacgaagaactagaatcccgtattttcactcaaacttcggattccatggacgaagcaacgaaagcccgctgggtagaattttttgccaagctaaaggaggccatcgctgggaaagtcaagttcacagtcattatggaagatccattggccgggtcgtacatacaaaatgtctacgccccagatccggatccaaacatgactatcgaagattatgaaagaactaaagagcaaaatgaagacctgggattgtccgatatcaaggttgagtaa

SEQ ID NO: 3439 - DNA, 1461 bp, Saccharomyces cerevisiae
atgagtcttaaagaagacgactttggcaaggataattctagaaatatagaatcatatactggtagaatttttgacgtatatatacaaaaagattcgtattcacagtcggccttggatgatatgtttccagaagccgtagtttcaaccgccgcttgtgtgaaaaatgaagcggaggataacatcaatctcatagacacgcatcctcaattcgaactggtaaatactggactgggtgctaaatcggacgatttgaaatctccatcagcaaaggctacgttcactgacaagcagaggaagaatgaagtaccaaatatatctgtgagcaactactttcccggacaaagtagcgaaacgtcgtcaacaacggaatcttggactatcggttgtgataagtggtcagaaaaggtagaagaggcattccttgaggcacttagactgataatgaaaaatgggaccacaaaaataaaaataagaaatgccaattttggaagaaacgagctgatttcattatatatcaagcacaaaaccaacgagttcagaaccaaaaagcaaatttcttcccatattcaagtctggaagaagaccatacaaaacaaaatcaaggactcgctgaccctatcatcaaaggagaaggagcttctacaccttatcgaacatggcgctgaacaaactactgaaaactcaaacctgttttatgacatatttgaagaaattatcgactctctaccttcagtcagtgattctggaagtttaacccctaaaaacctctatgtaagtaataatagcagtggattgtcagtacattcaaaactgcttacgccaatcactgcttccaacgagaaaaaaattgaaaatttcataaaaactaatgctgcatctcaagccaaaacccccctcatttacgctaagcacatttatgaaaacatagacggctacaagtgcgttccgtcaaagaggcctcttgaacaactttcccccacggaactccaccagggagatcgccccaataaggctagcttttccaacaagaaggcaatcctggagagtgcaaaaaaaatcgaaatagagcagagaaagataatcaacaaataccaaagaatttcccgcatacaagaacatgaaagtaatcctgagttcagttccaattccaattccggttcagagtacgaatcggaggaagaagtagtcccaagatcagccacagtcacacaactccaaagcagaccagtgccatactacaagaataatggaatgccctactcactctccaaagtacgaggaaggcccatgtatccaagacctgctgaagatgcttacaatgccaattatattcaaggtctgccccagtaccaaacatcttatttttcgcagctgttattatcatcaccccagcattacgaacattctccacatcaaaggaactttacgccatccaaccaatcgcatgggaacttttattaa

SEQ ID NO: 3440 - DNA, 1461 bp, Saccharomyces cerevisiae
atgatgaacaataacgaaagtgaggctgagaaccaacgtctactggacgaattaatgaaccagacaaaagtcctccaggaaactttagatttttcgttagtgacacccactccacaccacaatgatgattacaagatacacggaagtgcctacccaggtggtgagactcctgcccaacagcatgaaaaactctcatacatcaatacgcacaactctaacgataataataacttaatgggcagtcaagcgaggtccaattcacaaactcctacagcttcgaccatatatgaggaagcagaatcgcaatcgtcttacctggatgatatgtttagaacaagccaaggcggtagacctgtcactcaaaattccatatcttccatagggcagggtcccttgagatcatcttattctatggcttacgactcacctgtggatagagcaatgaatactccattacagcaacaagaaggcttaaaagctgagttaccacatgactttttatttcagcatggcaccgatgacacaatgtataacttaactgatgatttgagctcctctttatcttctagcatcaattctgatatgatgacaccaaacacatattcatcatcattttcttataatccacaaagcttgggcccagcatccgtatcttccacatattccccaaaggtaagatcaccatcatcgtcatttcgtgcaggaagtttcctttcatcttcttttaggcatggtagcataaacacacccagaacaagacacacttcaataagtagcaatatgactgaaaatataggacctggaagtgttccaaagattttaggcgggttaacttctgatgagaaactgaggcgcaaaagagagtttcataatgccgtcgaaaggagaagaagagaattaataaagcaaaagataaaagaactcggccagttggttccaccatctttattgaattacgatgacctaggtaaacaaatcaaaccaaataagggtatcattttggatagaacggtcgaatatttacaatacctggccgaaattttagaaatacaagcacgaaaaaagaaggcgttattggcgaagataaaagaattggaagagaagaaaagttctgtcgcagcattatctccttttaccaataaccaccatgccagttcggggcaaaataatagcgagaatagtgaggaaagaattatagatattagatctgtcccaaatgctttgatgaatgaacaaaatagtaaggctgaattgcacaattgggagccaccgttatatgattcggtcggtaaccacaatcatgctggcactatggagagtcatccacatacaaacattcatgaagaattaaaggagttcttatcaggcgatttgattgaagccgaagataatgcaaaattaatgtttggagatgacaactctaatccagctgactatcttttagaatttggttcggggtag

SEQ ID NO: 3441 - DNA, 1461 bp, Saccharomyces cerevisiae
atgccaagaaaggctaatttgctaaaatctttggcaagaggacgagtacgcacttctttcaataagtataatttgtttaatttgtacaaaaagggtggtgtagacttgaagtctaaatctttgtatcaacagaagtggacggcaaagcaggaaacccgagcttatcatggtgaacatttgacagaaaagagatggcaaaccgttttcaaacccaaattggattcagtagcacaattggatgcttcactgcgtggaggtgaaatcaaggaaacaccatttttattacaaacttttgcagtattagaaaaaaggcttgattttgcccttttcagggctatgtttgcttcgtcagtaagacaagctcgtcagttcatcttgcatggaaatgttcgcgttaatggtgtaaaaattaagcatccaagctatactttaaagcctggagatatgttcagtgtcaaaccggacaaagtgctggaagctctcggtgccaagaaaccaagtttccaagaagcgctaaagatcgataagactcaaatagttttatggaacaagtatgttaaggaagcgaaaacggagccaaaggaagtttgggagaagaagttggaaaattttgaaaagatgtcggattctaacccaaagaaacttcagtttcaagaatttttgaggcaatataataagaatctggagtcacagcaatataacgcattaaagggatgcacacaggaaggtatcttgagaaagcttttaaatgtagagaaggaaataggtaagtcgaataatgagcccttgtcgatagatgaactcaaacagggtctccctgagatccaggactctcagttgttagaaagtctaaataacgcttatcaagagtttttcaaatccggtgaaattagaagagaaatcatttctaaatgtcagcctgacgagttgatttcactggctacagaaatgatgaatcctaacgaaaccacaaaaaaagaattatctgatggagccaaatccgctttaagatctggaaaaagaatcatagcggaaagcgtgaaactatggacgaaaaatataacagaccacttcaaaactaggatgagtgatatttctgatggttcactaacgttcgaccccaaatgggccaaaaatttaaaatatcatgatccgattaaattatctgaattggaaggtgatgaaccaaaagcacgtaaattgataaacttgccgtggcagaaaaattatgtttatggtaggcaagatcctaaaaaaccctttttcacaccatggaagccaagaccatttttatcgcctttcgccattttacctcatcatttggaaatatctttcaagacatgccacgctgtatacctaagggatcccgtcgctcgaccaggccaatccgaagtaatttcaccatttgatgttcctgttcatgaacgtgcatatatgtattacttgagaaatggtaaatga

SEQ ID NO: 3442 - DNA, 1461 bp, Saccharomyces cerevisiae
atgcctctatcaaaggtggagcactacctttcataccatacgcgcttactcttaccccatgttttgtctcttcagtcatcacatcgtgttgcatacatcttttcgctattatctgcggtgtcaactggcttcattactttgatatctctttactctcaaccgtggcagaaacatttaaattattcctcatggcaaatcaacaccatcgctagtatgactaatttggggatgtacttgacgccaccaatcttggggatgatcgctgattctcatggccccattactttaagtcttttagccatcatagggttcatacctagctattcatatctggcttacgtttttaatcatccggagttatctctcggaggaaatggtgactcatcattcaatctatccatcatttgtttcgttttcataggtatatcaacaagcgctttatactttagcgctttactgacatgcactaagctatatcctcatacaaaactactatccattagcttaccaacgacatgttatggtatttcttctgtagtcggttctcaactgctaagaatcaaatggttctggtcctctaacgcaagttcttcctcgtccaatagtgacttaaacctgggaagagtattccaaacatttgccctcgtttatgtcgttattgggctacttgcatggatagccaccagcgtggtatcacttttgcattttaatgaagagcaagacaaccaaaaacggctggatgatcaaactgatgtggaacaatcaccgctgttagaacgaagtaatcatgttcaagaaaagtttacgcagacgatgctaaggatctttagtgatcctgtgacatatatcctagcggtatcaattttgttatcacttgggcccctcgagatgtttattgccaatatgggatcactgactaacctgctagtccaattagatgcgccaaccttatctacaaagttgttatccacatacgcgctatcttccacttttacgagattgctcacaggcatagtggcagacttcttcgccaagaaaaaaatatcaattaaatggatcctgttgactttcctttcattaggggtatgtgcacaactgtttttattgaaaatgacctcttcagcgtcaccctgggggctagtacctacaggatcattggttggaattgtatacggtggacttttcactgtttatccgacgctggtcctgttagtatggggcgaacgctcattcgggactgtttacggtagcttactaattgcacctgctataggttctatgatattttgcatgttgtatgccaaattttacgattctcgctgtatgagtggcggaggagatctgcgaaatccgtcctgtatttcggctgtctacaagtacagcagtatcgcattcgttgtatccgctgttctttcagctgtagtattttggaaattaaaaagtagaaaactcagaatttaa

SEQ ID NO: 3443 - DNA, 1461 bp, Saccharomyces cerevisiae
atgcttttcagaaacatagaagtgggcaggcaggcagctaagctattaacgagaacctcgagtcgtttggcctggcaaagtattggggcctcaaggaatatttctaccatcagacaacaaatcagaaagactcaactatataattttaagaaaactgtgagcatccgtccattttctctctcctcccctgtttttaaaccacatgttgcttcagaatcaaaccctatagaatcacgtttgaagacctcgaagaatgttgcttactggttaataggtacatccggtttggtatttggtattgttgttcttggtgggttgactagactaacagaatcggggctgagtattaccgaatggaaacctgtcacaggtactttgccccctatgaaccagaaggaatgggaagaagaatttatcaagtataaggaatcaccagaatttaaattgttgaattctcacattgatttagacgagttcaagtttatattttttatggagtggattcatagattgtggggtcgtgctatcggcgctgtttttatattacctgcagtttatttcgctgtatctaaaaaaacttcaggccatgtcaataagaggttgtttggtctcgcaggtttattaggattacaaggatttgttggttggtggatggtgaagtctggtcttgatcaagagcaactagacgcaagaaaatcaaagcctaccgtttctcaatatagacttactacgcatttgggtaccgccttctttttatacatgggtatgctctggactggtttggaaatattgagagaatgtaaatggattaagaaccctgttcaagccattagtctcttcaaaaaattagataatcccgcaattggcccaatgagaaagatttctttagctttgttagcggtgtctttccttaccgctatgagtggcggtatggttgccggtttggatgctggttgggtctataacacctggccaaaaatgggtgaacgatggttccctagttctcgtgaattaatggacgaaaacttctgtagaagagaggacaagaaagatctgtggtggaggaatttgctagaaaacccggttacagttcagttggtccataggacatgtgcgtacgttgcgtttacatcagtactagctgctcatatgtacgctatcaaaaagaaggccgtaattccaaggaacgcgatgacctctttgcatgttatgatgggcgtcgttactttacaagcaacacttggtattttaactatattgtacctagtcccaatatcgttagcttctatccatcaagctggtgctttggcgttgctaacaagttctttggtgtttgcctctcaattaaggaagccaagagctccgatgagaaacgtaatcattaccttgccacattcaagcaaagtaactagcggtaaaattttaagtgaagcgtcgaagttagcctcgaaaccattataa

SEQ ID NO: 3444 - DNA, 1461 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 3445 - DNA, 1461 bp, Saccharomyces cerevisiae
atggtacaaaggcttctaccgggcgcacatatatgcagaaggtccttcaattcgtctgcaattataaagtcttctgcattgactctcaaggaagcattagaaaacgtgatacctaagaaaagagatgctgtgaagaaattgaaggcctgttatggcagcacgtttgtcggaccgattaccatttcatcagttctaggtgggatgagaggtaatcagtcaatgttttggcaaggaacatcattagatcccgaacatggcattaaatttcaaggtttaacgattgaagaatgtcaaaatagattacctaatacaggtattgatggcgataatttcctgccagaatcaatgttatggctgttgatgacaggtggtgtgccaactttccagcaagctgcttctttcaggaaagaattggctattcgtggaaggaaattgccacattatacagagaaagttttgtcaagtttacccaaagatatgcaccctatgacccaacttgcaattggtttagcatcaatgaacaaaggatccctctttgctacaaactaccaaaagggcctcataggaaagatggaattttggaaagatactcttgaagattcgctaaatttaattgcttcactcccgctgctgactgggagaatttattcgaacattacaaatgagggacacccattaggtcaatatagtgaggaggtggattggtgtacaaacatatgttccctgctcggcatgacaaatggaacgaactcttctaatacatgcaaccttacttcccagcaatccctggacttcataaacttgatgcggttatataccggtatacatgtagaccatgaaggtggtaatgtttctgctcacaccacccacttggttggaagtgcgttgagtgacccgtatctcagctattcatctggaataatgggattagcgggtcctttgcatgggttagcagcacaagaagtagtaaggtttctcatagagatgaactctaatatttccagcattgcacgagaacaagaaatcaaagattatctttggaaaattttgaattcaaaccgtgtgatccccggttatgggcacgcagttttgcgtaaaccggatcctcgatttacagcaatgcttgaatttgcgcaaaagaggcctattgaatttgagaacgacaagaacgttttgttgatgcaaaaattggcagaaatagcgcctaaggttttgttggaacacggaaagagtaagaatccatttcccaatgttgactctgcatcggggattttgttttatcattatggaatcagggaattattattctttaccgtcatttttgggtgttcaagggccatgggacccttgacacaacttgtttgggatcgcattctaggtttaccaattgaaaggcccaagagtttgaacttggagggtctggaagcacttaccaaagcaagcaatgttaacaagttgtaa

SEQ ID NO: 3446 - DNA, 1461 bp, Saccharomyces cerevisiae
atgtcgcatactttaaaatcgaaaacgctccaagagctggacattgaggagattaaggaaactaacccattgctcaaactagttcaagggcagaggattgttcaagttccggaactagtgcttgagtctggcgtggtcataaataatttccctattgcttataagacgtggggtacactgaatgaagctggtgataatgttctggtaatttgtcatgccttgactgggtccgcagatgttgctgactggtggggccctcttctgggtaacgacttagcattcgacccatcaaggttttttatcatatgtttaaactctatgggctctccatatgggtctttttcgccattaacgataaatgaggagacgggcgttagatatggacccgaattcccattatgtactgtgcgcgatgacgttagagctcacagaattgttctggattctctgggagtaaagtcaatagcctgtgttattggtggctctatgggggggatgctgagtttggaatgggctgccatgtatggtaaggaatatgtgaagaatatggttgctctggcgacatcagcaagacattctgcctggtgcatatcgtggtctgaggctcaaagacaatcgatttactcagatcccaactacttggacgggtactatccggtagaggagcaacctgtggccggactatcggctgcacgtatgtctgcattgttgacgtacaggacaagaaacagtttcgagaacaaattctccagaagatctccttcaatagcacaacaacaaaaagctcaaagggaggagacacgcaaaccatctactgtcagcgaacactccctacaaatccacaatgatgggtataaaacaaaagccagcactgccatcgctggcatttctgggcaaaaaggtcaaagcgtggtgtccaccgcatcttcttcggattcattgaattcttcaacatcgatgacttcggtaagttctgtaacgggtgaagtgaaggacataaagcctgcgcagacgtatttttctgcacaaagttacttgaggtaccagggcacaaagttcatcaataggttcgacgccaattgttacattgccatcacacgtaaactggatacgcacgatttggcaagagacagagtagatgacatcactgaggtcctttctaccatccaacaaccatccctgatcatcggtatccaatctgatggactgttcacatattcagaacaagaatttttggctgagcacataccgaagtcgcaattagaaaaaattgaatctcccgaaggccacgatgccttcctattggagtttaagctgataaacaaactgatagtacaatttttaaaaaccaactgcaaggccattaccgatgccgctccaagagcttggggaggtgacgttggtaacgatgaaacgaagacgtctgtctttggtgaggccgaagaagttaccaactggtag

SEQ ID NO: 3447 - DNA, 1464 bp, Saccharomyces cerevisiae
atgcgattccatcgtcaaggtatctcagccatcataggcgtactactcattgtactgcttggtttctgttggaagttatctggatcttacggcatagtatcaactgccctaccacacaatcaatctgcaattaaaagcacagacttaccttctatacgatgggataattaccatgagttcgtcagagacattgattttgataacagtacggctatctttaattccattcgggctgctttaagacagtctccatcggatatacatcctgtcggagtatcttattttcccgctgtaattcccaaaggaactttaatgtaccatgccggatcaaaagtgccaactaccttcgaatggctagctatggaccatgaattcagctactctttcggcttgaggtcaccatcctatgggagaaaatctttggaaagaaggcatgggaggttcggcaatggcaccaacggtgatcatccaaaagggccaccaccaccaccaccaccaccagacgaaaaaggtcggggttcacaaaaaatgcttacttatagagcagcacgggacctcaacaaatttctctatcttgatggggcttctgctgcgaaaactgactcaggagagatggacacgcagctaatgttgtcaaatgttattaaagagaaattgaaccttacagatgatggtgaaaacgaacgaatggccgaacgactctacgctgctagaatatgcaaatgggggaagccattcgggcttgacggaattatcagggtagaggttggctttgaggtcgttttgtgtgatttttcggctgataacgtcgaacttgtttcaatgttagaaatggtccagcctaaccagtacctaggcttaccagcacctaccgtaatatcgaaggaagaaggttggcctctggatgaaaatggaagcctagttgaagatcagctaacagatgaccaaaaggcgattctggaaagagaagatggttgggagaaggctttttctaatttcaacgcagttaaaagcttcaatcagttgagagcgggtgcagcgcatgacaacggggagcatcgaatccatatcgactataggtacctagtgagcgggataaacaggacgtacattgctcctgatcctaacaacagaagattactcgatgaaggaatgacatgggaaaagcaattggacatggtagatgacttagaaaaggcgctggaagtcggatttgatgccacgcaaagtatggattggcagttagcatttgatgagcttgtccttaaatttgctccattactaaaatctgttagtaacatactgaacagcgatggtgatattaatgagtcaattgccatcaatgcaacagcactcacattgaacttttgtctaccaatatgtgagcccataccaggccttaaaaacggatgcagactttttgatttggtcatctgctgtcagcgttgtcggagaaattgttga

SEQ ID NO: 3448 - DNA, 1464 bp, Saccharomyces cerevisiae
atggaccaccaaataaccactgcaagcgacttcacgactacttcaataccgagcctgtaccaattggatacacttttgagatgtcacatttgtaaagattttctaaaagtccccgtcttaacaccttgtggccatacattttgttccctttgtattagaacacatttgaataaccaaccaaattgtcctctctgccttttcgagttcagagagtccttgctgagaagtgagttcctggtcagtgaaataattcaaagttatacatccctacgatcttccttactagatgcactaaggataccgaagcctacccctgtccctgagaatgaggaagtaccaggtcctgaaaattcttcatggatagaactcatatcagagtctgaaagtgacagtgtaaatgccgctgatgatgacttgcaaattgttgcaacaagtgaaagaaaacttgccaaaagatccatgactgatatattaccactgagttccaaaccatccaaaaggaattttgcaatgttcagaagtgaacgtatcaagaaaaaatcaaagccaaatgaacaaatggcccagtgccccatatgtcaacaattttatcctcttaaagcccttgaaaaaacacatttggatgaatgcctaactttacaatcactaggcaaaaaaccaaaaatttctaccactttccctacagagtcaaatccacataacaaaagttcatccagattcaaggtacgaactccagaagtcgacaaaagctcatgtggtgagacctcacatgtggataagtatttaaactcaatgatgagtgcagaacaccaaagattgccgaagatcaattttacgtctatgactcaatcccaaataaaacaaaaactgtcatcgttgggactgtcaactaatggtactaggcaaaacatgattaaaagatacaatcactacgaaatgctttggaattctaatttttgtgattctctagaacctgttgatgaagctgaactaaaaagacagttgttaagctgggatgtttcacacaataaaaccccccaaaatagtagcaacaagggtggaatttctaaattaatgataatgaagagtaatgggaaatcttcttcatataggaaattacttgaaaatttcaaaaacgataaatttaataggaaaggatggatggttatgtttcggaaggattttgctaggcttatcagggaagcaaaaatgaaaataaaaacaggttcatcggacagttcaggttcagtgggacattctaatgatggagatggtgttgaaaaagttcaaagtgaccagggaaccgaggatcagcaaatggagaaggatcaggacactgttatcaacgaagatagagttgctggtgaaagaaatttgcctaacgaagattcaactgatgctgacttatcaagagaattaatggacttgaatgaatatagtaaagacccacccggtaacaattaa

SEQ ID NO: 3449 - DNA, 1464 bp, Saccharomyces cerevisiae
atggacgcattgttaacaaagttcaacgaggatagaagtctccaagatgaaaacttgtcccaaccacgaacgagagtaagaattgttgacgacaatctttacaacaaatcgaatccattccaactatgctataaaaaacgtgactacggttctcagtactaccacatttatcaataccgtctaaagactttcagagaacgcgtcttaaaagaatgtgacaagagatgggatgcgggctttaccttgaatggccaattagttctaaaaaaggacaaagtgttagatattcagggaaaccaaccatgttggtgcgtaggatccatatattgcgagatgaaatataaaccaaacgtactggacgaagtgatcaatgatacatatggtgcaccagatttaactaaaagttatactgataaagagggtggttctgatgaaattatgctcgaagatgaaagtgggagagtgcttctagtgggagattttattcggtctacacccttcatcacgggtgttgttgtaggtatactgggtatggaagctgaagccgggacatttcaagttttagacatatgctaccccactcctttaccacaaaatcctttccctgcaccaattgctacctgccccaccaggggaaaaattgctcttgtttctgggttaaacctcaataatacatcacctgataggctattgagattggagattttgagagaatttttgatggggagaatcaataacaaaattgacgacatttctctaattggtagattactgatatgcggcaactctgttgacttcgacattaaaagcgtgaacaaagacgaattgatgatttctctaactgagttcagtaaatttctacacaacattttgccatctatatctgttgatattatgcccggaaccaatgatccaagtgacaaatctctaccgcaacagcctttccacaaatcattgtttgataagtccctagaatcatacttcaacggttctaacaaagaaattttgaatttagtgaccaacccatatgagtttagctataatggcgtagacgttctagccgtttcaggcaaaaatatcaatgatatttgtaaatacgtaataccatcaaatgataacggagaaagtgaaaacaaggtcgaggagggcgagagtaatgatttcaaagacgatatagagcatcgcctggaccttatggaatgtacaatgaaatggcaaaacatcgcgcccaccgcacctgataccttatggtgttatccgtacactgataaggatccatttgtattggataagtggccccacgtttacattgtggcaaaccagccatattttggaacaagagtagtggaaataggtggtaagaacataaagataatatctgtccctgaattcagttctactgggatgataatattactggatttggaaacgttagaagcagagacggtcaagattgacatttaa

SEQ ID NO: 3450 - DNA, 1464 bp, Saccharomyces cerevisiae
atggactcacaaccagttgacgttgataatatcatcgatagattattggaagtaagaggatctaaacctggtcaacaagttgatctagaagaaaatgaaatcagatacttatgttcgaaagccagatctatattcataaagcaacccattttactagagttagaagccccaattaaagtatgttaatgttgaacttcgcagtcaagagatagaatgcctagagcttcaggtgttttatgtgttctactcctgttgcggcagtaagatagttacagcagttatttccgtttgactgaaagaatttaccaagcatctgatgttagcctactcatatgtcgagatagccgagataatgtgtgtgtttagctcttcatttttctatcttattaggcatttttttaccaagatttccttatgttttgtatcatcatccggccggcgcctcccatattcagaaaaatcccccttgctcacactaaaaaaagaaggcattttttcgttatgaagaaaacgaatcttttttttttttgagcccgagagaaaggtcggacgaaaaccaagaaatgtggatttgcagaaggcattgggagaaatgaagcgtttttgacagcagtaattgttctcttaaagtcaacggaatgagctagatttagtgacaaattcatttactaacttatttttttctattttttttttttttagatatgtggtgacattcatgggcaatactatgatttactacgtctatttgagtacggtggattcccgccagaatctaattatctatttttgggtgattatgtcgaccgtggtaaacaatccttagagactatttgtctattactggcttacaaaattaagtatccagaaaactttttcattttaagagggaaccatgaatgtgcttccattaatagaatttacgggttttatgatgaatgtaagagacgttataatatcaaactttggaaaactttcacggattgtttcaattgtttaccaattgctgcaattattgatgagaaaatcttctgtatgcatggtggtctctcaccagatttgaatagtatggaacagatcagaagggtgatgaggccaacagatattcccgacgttggcttattatgtgacttattgtggtcagatccagataaagatatcgtaggttggagtgaaaatgatagaggtgtttctttcacttttggtcctgatgtagtgaacagatttttacagaaacaagatatggagttgatttgcagggcccatcaagttgtggaagatggttatgaattctttagtaaaagacaattggtgacacttttcagtgctccgaattattgtggtgaatttgataacgctggtgcaatgatgagtgttgatgaaagtttattatgttcttttcaaattttaaagccagcccaaaaaagtctaccaaggcaagctgggggtagaaagaaaaaataa

SEQ ID NO: 3451 - DNA, 1464 bp, Saccharomyces cerevisiae
atggcttactctaaaatcacattactagccgctcttgctgctattgcttacgctcaaacccaagcacaaatcaacgaattgaacgttgttttagatgatgttaagaccaacattgccgactacatcaccctatcctacactccaaattcaggtttttccttggaccaaatgccagctggtattatggatattgctgcgcaattggttgcaaatccaagtgatgactcctacaccactttgtactctgaagtggacttttctgctgttgagcatatgttgactatggtcccatggtactcttctagactgcttccagaattagaagcaatggatgcttctctaactacctcaagttctgctgccacatcttcaagtgaagttgctagctcttctattgcttcatccactagctcttctgttgcaccatcctcaagtgaagttgtcagctcttccgttgcaccatcctcaagtgaagttgtcagctcttccgttgcaccatcctcaagtgaagttgtcagctcttccgttgcttcatcctcaagtgaagttgccagctcctctgttgcgccatcctcaagtgaagttgtcagctcttccgttgcttcatcctcaagtgaagttgccagctcctctgttgcgccatcctcaagtgaagttgtcagctcttccgttgcaccatcctcaagtgaagttgtcagctcttccgttgcttcatcctcaagtgaagttgccagctcctctgttgcgccatcctcaagtgaagttgtcagctcttccgttgcttcttctacaagcgaagctactagttcttctgctgtcacatcttcctccgctgtttcctcttcgaccgagtctgttagctcttcctctgtcagttcttcctcagccgtttcctcttctgaagctgtcagttcctctccagtttcctcagttgtttcatcttcggccggacctgctagctcaagcgttgctccttacaactcaaccattgctagctcttcttccactgcccagacttctatctcgaccattgctccttacaactccacaaccaccaccaccccagctagttctgcttccagcgttattatctcaaccagaaacggtaccactgttactgaaactgacaacactcttgtcaccaaagaaaccactgtctgtgactactcttcaacatctgccgttccagcttccaccaccggttacaacaattctactaaggtttcaaccgctactatctgcagtacatgcaaagaaggtacctctactgcaactgacttctctacactaaagactacagttaccgtatgtgactccgcctgtcaagctaagaagtctgctaccgttgttagcgttcaatctaaaactaccggtatcgttgaacaaaccgaaaacggtgctgccaaggctgttatcggtatgggtgccggtgctttagctgctgttgccgccatgctactatga

SEQ ID NO: 3452 - DNA, 1467 bp, Saccharomyces cerevisiae
atggctgaaactgaaagactaatgcctaacggtggttcccgcgaaacaaaaccgttaattacgggccatttaatcttgggcacgatagttgcttgtttggggtcgatccagtacggataccacatcgcagagttgaatgcgcctcaagaattcttatcgtgctccagatttgaggcaccagacgaaaacatctcatacgatgacacttgggttgggcaacacggactcaagcaatgcattgcgttaaccgattctcaatacggcgcaattacgtctatattcagcataggcggactgtttgggtcgtactacgccggtaactgggccaaccgatacggaagaaagtacgtgagcatgggcgcctcggccatgtgcatggtttcttctctgctgcttttcttttccaactcctacttgcagttgctatttggcaggttcctggtaggcatgtcctgcggcaccgccattgtgatcacacccttatttatcaacgagattgcccccgtggagtggagaggcgctatgggatctatgaatcaggtttctatcaatctaggtatcctgctgacccaaaccttggcactcaagtacgcagactcctataactggaggtggcttctcttttccggatccgtgattgcggtagcgaatattttagcttggctcaaagtggacgaatctccaaggtggctggtgagccacggattcgtctcggaagctgaaactgctctgttcaagttgcgtccaggaacgtaccaacaagcgaagcaagaaattcaggattggcagcgtagccatgggcacaaccgcgacccggagtcaagcgaagagactcattcaggacccacactatggcaatatgttaccgatccctcatacaagaaaccgcgcacagttatactcgccatcttgtcgtgccagcaattttgcggcatcaactctattatcttctacggtgtaaaagtgatcggcaagattctaccggactactcgattcaggtaaattttgccatttccatcctcaatgtcgttgtcactctagcagcatctgcgatcatcgaccacgtcgggcgccgtccattattgcttgcctcgactacggtgatgaccgccatgtcgctgctgatcagtgtaggtctcaccttgagcgtatcctttttactggtcacggccacttttgtctatattgccgcattcgccatcggtctgggacccatccccttcttgatcattggtgagctatcctacccgcaggatgccgctacagctcaaagttttggtactgtgtgcaactggcttgccaccttcatcgtcggatacctcttcccgataggccacggcctcatgggcggctacgtatttgcgatcttcgccgccatcgctgccatgtttgctacatatgtgtacaagcgtgtacccgagacaaagggcaagactacatacagcgaggtttgggctggctactga

SEQ ID NO: 3453 - DNA, 1467 bp, Saccharomyces cerevisiae
atgtcagctatacaatcgccagcacctaaacctctgcagccaacttatccagctgcttcgccagcttccacgaatgcatatatgaagccgggcctaattggtagtcctgccgtcagtaatcataccgagcctaacaatggtaacaatgaaactgcggagcctcagggaccaaatcagagaattgatttgggtgccatgatcgaagaattaacctcactattgggaaaagaaagctggacgaaatatgctcagatcatcagtcttttcattttagggaagttatccagaaaggaactttctaatgaattagagctggtattttcaccaagcgctgcaagcttagaaaaatcaaatacaaatcatcaccatagtttagtacgacttcataaccaacttttattagggatttttgctaattcattacgtgaaaaccctcttgggagaaacggtaatgagagttcttggggatttggcaatggaagcaacaatccaaacaataaactaaaaagaatcaataagcataactctcaaattgaagtctataaaaaaattgtcatgtcgttacctctaaatgatcgaaatagacttaaaatgatcacgaaagaggccggcaaaagaggcttcattttttgctctgtatttcaagccagattaaataatatacccaaaattcccattgtaaccaatccagaaagtttgaagcgtgtcaagagcaataatttaaaaacgccgctggaatggtcacaagatataatgaatggattcaacgttcctttagcgagcgaaagccattctttaccagacacggattcgttttacttaagaatggttggtatagcaagagaacatgggttagtcggcacagtggacgcacgttgcgtagagcttatatcattggccctagatcaatatctaaaaaatataatagagtttactattgatacagttcgttatagaaggaagaaatattcagattattatgatttgaatgagagtgggctttataaatccgtatcagaaatggctgctgataaacgcgatgccaaaattaagcagttagatgatgataaaaatgaggatgaatgtgccgatgaagccaaaagtattaataacggcaataacagtagcaaggacgatattggcgacatatcaatgagcagcattacaaaggctggcgaagcagttaatgaggagttacatgaaaacagaacgatatcattaacgaatgaagacatatatgattcgttatctatatttccgaatttggttgaaccttcaggttcatactatgcgttaactaatttagggctagttaacgatgatgaactagtagatatgaagagcaatattgacgacttgccggacttcttaaatgaaaagccgactttcacgcctttggatgaaagaaacgttggtacaaggcatgaattaaattggttaattaaaggaatcttaacggaagattga

SEQ ID NO: 3454 - DNA, 1467 bp, Saccharomyces cerevisiae
atgttgagatttaccaattgtagttgcaagactttcgtaaaatcgtcatataagcttaatataagaagaatgaactcctcgttcagaactgaaaccgatgcatttggtgagatacacgtgcctgctgataagtactggggtgcccaaactcaaagatcctttcaaaacttcaagattggtggcgctcgtgaaagaatgccattgcctttggtgcatgcatttggtgttttgaagaaatctgccgcgattgtgaatgagtctctggggggattggatcccaagatctccaaggctattcaacaggccgctgacgaagtggcttctggtaagctagacgaccactttccattggttgttttccaaacgggttccggtacccagtctaacatgaatgctaatgaagttatttccaatcgtgccattgagatcctaggaggcaagattggatctaaacaagtccatccaaacaatcattgcaaccaatctcaatcatccaatgatactttccccactgtcatgcatatcgctgccagtttgcaaattcaaaacgagttgatacctgagttgaccaatttaaagaacgcccttgaagccaaatccaaggaatttgaccatattgtgaagatcggtagaacacacttgcaagatgccacgcctttgacactaggtcaagagttttccggttacgtgcaacaagttgagaacggtatccaaagagtggcacattctttgaaaacattgagtttcctggcacaaggtggtactgccgttggtacagggttgaacaccaagcccggattcgatgtcaagatagccgagcaaatttccaaagaaactggactaaagtttcaaaccgcccctaataagttcgaggctttggctgctcacgacgccattgtcgaatgtagcggtgctctaaacacccttgcttgttctcttttcaaaatagcgcaagatataagatacttagggtccgggccacgttgcggctaccatgaactaatgctgccagagaatgaaccaggttcctcaatcatgcctggtaaagttaacccaacccaaaacgaggcattgactcaagtgtgtgtgcaagtcatgggtaacaatgcagctatcacgtttgccggctctcaaggtcaattcgagttaaatgtcttcaagccagtcatgatcgccaatctattgaattcgatcaggttaattactgatgccgcatattcatttagagtgcactgtgttgaaggtatcaaagccaatgagcctcgtattcatgagttgttgactaaatctttaatgttagtcaccgctttgaaccctaagatcggttatgatgccgcttccaaggtcgccaagaatgctcataagaagggcattaccttgaaggaaagtgcattggaattgggtgtattgactgaaaaggaatttgatgaatgggttgttcctgaacacatgctaggtcctaaataa

SEQ ID NO: 3455 - DNA, 1470 bp, Saccharomyces cerevisiae
atgaagattaagaccattaaaagaagtgctgatgactatgtccctgttaaaagtacgcaggaatctcaaatgcccaggaatttgaaccctgaattgcatccttttgaaagggcacgtgaatatactaaagctttgaatgccaccaaattggaaagaatgtttgctaaaccctttgtgggtcagttaggatacggtcatagagatggtgtttatgctattgccaaaaattatggtagtctgaataaattggctactggttctgcagatggtgtgattaaatactggaacatgtctactagagaagaatttgtttcctttaaggcgcattatggactcgttactggtctttgtgtgacacagcctcgttttcatgacaagaagccagatttgaagagccaaaattttatgttatcttgcagtgatgacaaaactgtcaagctatggtcaataaatgttgatgattactccaataaaaactccagtgataacgactccgttactaacgaggaaggtttgattcgtacttttgacggtgaatctgcatttcaaggtatcgattcgcacagagaaaactccacgtttgccacaggtggggccaagatccatctttgggacgttaacagattgaagccagtttccgatctatcatggggagcagacaacattactagtttaaaattcaatcaaaatgaaacagatatcttggccagtactggtagtgataattctattgttctttacgacttgagaaccaactcccccacacaaaagattgttcaaacaatgaggacgaatgctatttgctggaatccaatggaggccttcaactttgtaactgccaatgaagatcataacgcctactattatgatatgaggaatttatcacgttcattgaatgtattcaaagatcacgtcagcgcagtaatggatgttgacttttctcctacgggggatgagattgttactggttcgtacgataagagtatcagaatatataagacgaatcacggacattcgagagaaatttatcatacgaagagaatgcagcatgttttccaggttaaatattccatggattctaaatatattatcagtggatctgatgatgggaatgttaggctatggagaagtaaagcttgggagaggtctaatgtcaaaactactcgtgaaaagaataaattagaatatgacgaaaaattaaaagaaagatttagacatatgccggagatcaaaagaatcagtagacatagacacgtgccacaagtcatcaaaaaggctcaggaaattaagaacattgagttgagttctattaagagaagagaagctaatgaaaggcgtactagaaaggatatgccatacatttccgaaaggaagaaacaaatcgttggtaccgtgcacaaatatgaagattcaggaagagataggaaaagaagaaaggaagatgacaaacgtgatactcaagaaaagtag

SEQ ID NO: 3456 - DNA, 1470 bp, Saccharomyces cerevisiae
atgacaaaaagtgatttattatttgataaattcaacgacaaacatggaaagtttctagttttttttggtacctttgtagatacccctaaattaggagagctgagaatcagagagaaaacatctgttggagttctcaacggaatcatcaggtttgtgaacagaaattcactcgatcctgtcaaagattgtttagatcacgatagtagcttatcaccagaggatgtcacggtggttgacataattggaaaagacaagactcgaaataacagcttttattttccaggttttgttgacacgcataaccatgtctcgcaatatccaaatgtcggcgtatttgggaattctaccctgctggattggctagagaagtataccttccccatagaagccgcactagcaaacgaaaatattgcgagagaagtttacaataaggtaataagtaagacgctttctcacggtacaacgactgtggcttactataataccattgatctcaagtccactaagctcttggctcaactaagctccttattggggcagcgtgttcttgttggaaaagtgtgcatggataccaatggtcccgagtattatattgaagatactaaaacttcctttgaaagcactgtgaaagttgttaagtacatacgggaaaccatttgtgatcccctcgtaaatcctatagtgacaccaaggttcgcgccctcttgttctagagaactaatgcaacagttgtccaagctagtcaaggatgaaaacatacacgttcaaacccacttgtcggaaaataaggaggagatacagtgggttcaagatttatttcccgaatgtgagagctatactgatgtatacgacaaatatgggctgctcacagaaaaaacagtattggcacattgtattcatctaacagatgccgaagcgcgtgtgattaaacagcgtcgctgtggtatatctcattgtcccatttccaactcctctctgacttctggagagtgtagggttcgatggttgctggaccagggcataaaggttggtctaggcaccgacgtttcagccggtcattcttgtagcatactcaccaccggaaggcaggcctttgcagtttcaaggcatttggcaatgagagaaactgatcatgcaaaactttcagtctccgagtgcctatttcttgctacaatgggcggagcacaagtcttgcgtatggatgagaccttggggacttttgacgtcggtaagcagtttgacgctcaaatgatcgataccaatgctcccggctcaaacgtggatatgtttcattggcagctaaaggagaaggatcaaatgcaagagcaagagcaagagcaagggcaagacccttataagaacccaccgctgcttactaatgaagacataatcgcaaaatggttctttaacggtgatgatcgcaacaccactaaagtttgggtagccggccagcaagtctaccagatttag

SEQ ID NO: 3457 - DNA, 1470 bp, Saccharomyces cerevisiae
atgagctcgcaatttccttcgtccccctacaggacagtggatccgtactctccaccaaattacaaacagcagcctaattgtccctcatccaattatgagaaagctggtaaaactgcgtcagaatcaattggaaatttcgggaaaggagattatccaactccatttccttcttccagtataggaagggtttcgtctcccgttaggtcgaataaggttgacgccatcccttcctctccagcttttcctggccagttggcagaaacgtcacccaagttttcttccaaactttcttctccttcaaggcatactagagtcatcaatgctgaactagatcctagcaagatcagcaccattactgtagggcgcaatagttcgcaatgtgatgttgcgctctgtaagaataagttcatatccagagtacacgctagtataacttatttaccacaaacaaatgaagtgaagattcactgcttcagtatgaacggattaatcgttacctatcgtaagcaatttgattgttatcaattaaaggataccatgaataacaataatagggcatataggcttgttcccagattctctaacgaaaaatgtgttaaagaaattcaagacgagggaggattcattaatttcactctggaagagggagacaccgtttatatgacatattacaagggtatcatgttggattttaggcaggttttacttcgcatttcgttaaaagaaaaaaactcttcttcagagccgttaagattcgagaagaaagctgaatttgaaagtgaaagtgaaacgaaacatatgggtagtataaggaagcatccattgatttttactgacacttcgatggacagacccaaaaaaatacttaaggatagcaacaaaatctcaattggtagtgattctggcgttgcagaaaggatgctaaaccacttcctaaattctaaatcgtccccactttcatccgtctcctctgttgatcacgaggaacaaaccctgagacaagattcactatcatctgataaaaatcctatgactatgaagaaaccaaaacttaacaagagggtcttaccttcaaagccaaaaaaatcggtgaaagagaatttggatgagctatctagaagaaatattgatgttatgcatctacagcatattttaaccaatcacctagcttttgcaaacgtccagcagacgccattattccaattacagcaggtgaactcacaaatttctgagctttcaagagatgaattacgttcgattttgagcgacgcgaaatgtgtcggtgtcatttaccgtcatggtaaggacgccgccggcaaaccattggacgaagagtatttctacgatttagaaaacgatgatgattacgagagaagaaacttggtgagttcattaaaaggtggaaggacaggcttaagatcttgtagaaggacacataaacaatatttttggaaaaagccagcaaaatag

SEQ ID NO: 3458 - DNA, 1470 bp, Saccharomyces cerevisiae
atgcaagaatcaaaagaaccacaaaataaatttgaaggttgtcaaagaatatcttcatcttcatccacactctttggaggaacctccttcgaggaaccgagatgtggaacatcccaaggaaaggaagaagacgctttcgcatgcaataatggagatcactgctcgagcataacgaatgttcaggaagatgactttgtccttccagaactattgccgtcattcgaaatgtatgaaaatttgctcagcaatatacctcaatctagtttcgatacatactttccggagaatccacctttttatgaggttgcttcccgaaatcagagtattccttcggaaggtgagtctgggaatgatatgcggattcttaccggtgatatcgttggcccagataatcatgaagtgactgttgatggccgccggtttgcttccggccctgctgagtctcaaattcgtaattatgatgatactaaaggtatcccagttgagaatatatacgcattgcctaggattaaaacccccatagcgactgaattgtacgtcacaaagacggctccaaaatttggacagcttcctaaacacgagagcatgctaagggaatacacctctggggatataattcacggttatttcactgtagaaaacaaatcaaccaaacctataaaattcgatatgttttatttaactttggaaggtacgacaagttcaaaaacacagtcaccctttggaatccaaaaaacgacagaaagaattttgagaatggtagatatggcagcgagttggtcatataatcatgaagacgtgaacacgggggaagacctttgtggattttttgactccattgataaaacaagctttggattaccgaatagcaggatactaaatccaggtgataaacgtaagaaatttttcacttttaaaattccgaaccagttattagacgtaacctgtaagcacggtcacttctctcactctcttttgccccctacattagggtttgatagaccatcgagttctcatccagagctttctactctaaaattttcggagagtttaggttatggtcgtttgtcagaaagaggttcctcactatggttaaacgacagttctagtggcagcttaataaattactcaataaatgctatgatagtaggcaaagacgtagcttctgggcgtgtttgtttaatgagtgaaaaaaagtatagcataaggatagttccatttggctttcaaaacaatccaattagtagggagaagtgcctcaaagacttagaggatttcgatattgaaattgcaaacaggcttggaatgatcgaaaaagtcttttctaaaatagagcgagcgattcccattcataaggaggacatacaggaggcgaatcgctctgatcaactatcacccctaagaggtaagtatgaatggaacgcggtagctggaaatactgaaaacggaacacttaaaaagaaacactag

SEQ ID NO: 3459 - DNA, 1470 bp, Saccharomyces cerevisiae
atgcaatttcactcagataagcagcatttggacagtaaaaccgacatcgatttcaagccaaactcaccgcgttccttacaaaataggaataccaaaaatttatctttagatatagcagcactccatccattaatggaattctcatcgccaagccaagatgtgccaggttcagtaaaattcccatcgccgacacctttgaatctatttatgaagcccaaacctattgtgttggagaaatgtccaccaaaagtaagtccaaggccaacgccaccatcgctgtcgatgaggcgaagcgaggcctctatatacacactaccaacatctttgaagaaccgaactgtttctccaagcgtgtatacaaaatcatccacagtatcgtctatcagtaagctgtcatcatcatcaccgttatcgtcattttcagaaaaacctcatctgaatagagtccattcattatccgtgaaaactaaagacttgaagttgaagggaattagaggacgttctcaaacgatctcagggttagagacatccacgccaatttctagtactcgtgaaggtactttagatagtacggatgtcaacagattttctaaccaaaagaatatgcaaacaacattgattttcccggaggaggactcggatctgaatattgatatggtgcatgcagagatttatcaacgaacggtttatttagatggaccattgctggtactgccgcctaatttgtatctatattcagaacccaaactagaagatatattatcgtttgatttagtcattaatgttgccaaagaaataccgaacctggagtttttaataccgccggaaatggcacataaaataaaatattaccatattgaatggacacacacatccaagatcgtcaaggacttatcccgattgacacgcattatacataccgctcattcgcaaggcaagaaaatactcgtacactgtcagtgtggagtatcaagatcggcgtcattgattgtggcgtatatcatgcgatattatggcttgagtttaaatgatgcatacaataagctgaaaggtgttgctaaggatataagtccaaacatgggtctcatcttccaacttatggaatggggaaccatgttgtccaagaactcaccgggcgaagaaggagagactgttcacatgcctgaggaagatgacatcggaaacaacgaagtttcctcgactacgaagtcctactcttctgcgtcctttagaagttttcccatggtaacgaatctatcatcgtcgccgaatgacagttctgtcaattcttcggaagtaacgccaagaactcctgctacgttgactggagcaaggaccgcactggccacagaacgcggggaagatgatgagcactgtaaaagtttgtctcaacccgcagattcactggaagcttctgtggacaacgaatcaatatctactgccccggaacagatgatgtttcttccttaa

SEQ ID NO: 3460 - DNA, 1470 bp, Saccharomyces cerevisiae
atgcatttgaaaaaggggaagaggagtattagcacagtatggcgacttttatggaagcgtttttattccgtaaactctaagacgaatatgcatttttctcgaagtaggaagaaaccagtgacaaacttcacaaggacaaacggacttctcctgagctgtaatggtgatacattcccatatctgcgtacactgtggagatacttcaatgcgcctggtaatttgatgtttgtcacaactaatattgtcgcatttatgggcattgttacgtataatacgctggttactatcagcagtgaaagagcattcgaagagcagatgatggcggcacaggtgagcctggcgaaacagagagaagagctcgagactacggccctcagcttgccacgagatattgaattgaggggtgaagaagatgatattaaatgggagcaacctgatgtagcacatgtccgggaagatcccttagtcgaggagcagaacgcaaagttagacacccctataaaacagtatactttaggagatttgattttgaataagagggaaaatgtcactgattatgactcgcagcgtgcgaaggcatctatattccacatgctatatgcttatatgctgtatcgagatgttattcaacccacgaccatgactcaaaataacaacagcgaggaatggcggcgtgaagtcgagcttttgactaagggaaaagaggtacaaggtactcatcgaaggatagacgtgttctacgacctgtggaataaaaatttcgataagatagtgacatcacctgagaaagtgcagaattttcaactgccgaactggtctaaatacccaacgatattgaaattcatctgcacagaacttcacgacaacagtttgaagaccttgggtgagtttaagcaattctatggaaaggtgcgatctaacgaggtaaaaaaactgttgggtctttggctgtacgaccattccttccttttcccccataatatctacgacaacagaaccgaagaagatttttacgatatattaattaatgactccatgcaggataacaggatattccagaaatactcttcaattgtaatgaatccctacaacgaacgtactcaactttttttccctaatgtaaattctccatctgtcaacaagccagtaccgagcatatctctggaaacatacacacgactactcaagggatatatcaacttgcaagaaacaggctgcaaatacgactataatgacaatatattcaaactaatcagcatcctcaaactaaattgtttcctacaacgcaacaagaagaaacacgcagggccaaccgtcagaatcctactgccgagagatgaagaccgctctcaaatacttggtaccatttcgcaggcagagaagagaacctgttatcaaattctaagcaaaaatagggacgtggttgcgctgctgaaacgcatttctgatatccaggcggactcttcttaa

SEQ ID NO: 3461 - DNA, 1470 bp, Saccharomyces cerevisiae
atggactataagcataattttgctacaagtccagattctttcctagatggaaggcagaacccactcttatatacagattttctatcttcaaacaaggagcttatatacaaacaaccatcgggtcctggtcttgtggattctgcctacaattttcatcaccaaaacagtttgcatgaccgtagcgtgcaagaaaacctgggtccaatgtttcaaccctttggcgtcgacatcagccatcttcccattaccaaccctcccatttttcaaagttctttaccagcgtttgatcagcccgtgtacaaaagacgcatatctatctccaatggtcagattagtcaattaggcgaagacttagaaacggttgaaaatctttacaactgtcagcctccgatcctatcgtctaaggcgcaacagaatcccaatcctcaacaggtggcaaatccaagcgcagccatatacccaagctttagctcgaacgaattgcaaaacgtgccacaaccacacgaacaagctacagtcatacccgaagctgcacctcaaacaggtagcaagaatatctacgctgcaatgaccccgtatgatagcaatataaagcttaacatacccgcagtagcagccacttgtgacattccttctgccacgccttctatcccatctggcgattccacaatgaatcaggcttacatcaacatgcaactccgattacaagctcaaatgcaaactaaggcatggaaaaacgctcaattgaatgtgcatccatgtactccagcctctaattcttccgtttcctcttcttcttcctgccaaaacattaatgatcataatatcgaaaatcaatccgtccattcttcaatttcccatggcgttaatcaccacactgttaataattcctgccaaaatgccgagttgaatatttcaagcagccttccatacgaatcgaaatgccctgatgtcaatttaacacatgccaactcaaaaccacaatacaaggatgccacttctgcactgaaaaacaatattaatagtgagaaagacgtacataccgcgcccttctcctctatgcacactacagcaaccttccaaataaagcaggaagctagaccccaaaaaatagagaacaatactgcaggcttgaaagacggtgctaaagcttggaagcgtgcaaggctactagaacgaaacagaattgccgcttccaagtgtcgacagagaaagaaaatgtcacaattacaacttcaaagggaatttgaccaaataagcaaagaaaacacaatgatgaagaaaaaaattgaaaattacgaaaaattggttcaaaaaatgaagaaaatttcgaggttgcacatgcaagaatgcacaattaatggtggtaataatagttatcaaagccttcaaaacaaggatagtgatgttaacgggtttctgaaaatgattgaagaaatgatacgcagctccagtctatatgatgaataa

SEQ ID NO: 3462 - DNA, 1470 bp, Saccharomyces cerevisiae
atggagttgttaaagcttctgtgtttgattttatttcttactctttcctatgtcgcctttgcaatcattgtcccacctctaaactttcccaaaaatatacccaccatcccattttatgtagtatttttaccagtaatatttcccattgatcaaacggagctatacgatctttatattagggaatcaatggaaaaatacggtgctgtaaaatttttctttggttcacggtggaatattctcgtttctcgttctgagtatctagcacaaatattcaaagatgaagatacttttgcgaagagcggtaatcaaaagaaaatcccatacagtgctcttgccgcttacacaggggacaatgtcattagcgcgtatggtgcagtttggagaaactacagaaatgctgtgacaaacgggctccaacattttgacgatgcacctatattcaaaaatgcaaaaattttatgcactttgataaaaaacagactcctagaaggacaaacttcgatccctatgggacctttatcccagagaatggcattggataacatttcacaggttgcccttggatttgattttggtgctctaacacatgaaaaaaatgctttccacgagcatttgattcgtattaaaaagcaaatatttcatccattctttttaacttttccattccttgatgttcttcctattccttcaagaaaaaaagccttcaaggatgttgttagttttagagaacttctcgttaaaagagttcaagatgaattagtcaataattacaaatttgaacaaactacttttgctgccagtgatctaattcgtgctcacaataacgaaataatcgactacaaacagttgaccgataatatcgtcattatccttgtcgctggccatgaaaacccgcagttgctatttaatagttcactctaccttctagccaaatattcaaatgaatggcaagagaaactcaggaaggaagtaaacggcatcactgatccaaaaggcttagcagatttacccttattaaatgcttttctcttcgaagtagtaagaatgtatcctcctttgagcacaattattaatagatgtactaccaaaacgtgcaagttgggggcggaaattgttatacccaagggcgtatatgtcgggtacaacaactttggaacctcacacgatcccaaaacttggggcacaacagcagatgattttaaaccagaaagatggggttcagatatcgaaaccataaggaaaaactggagaatggcgaaaaacagatgtgctgtgactgggttccatggaggccgaagagcatgcctaggggaaaaactagccctaacagaaatgagaatttctttggctgaaatgttgaaacagtttcgatggagtcttgaccctgaatgggaagaaaaattaactcccgctgggcctctttgccctcttaatttaaagttaaaatttaacgagaatataatggaataa

SEQ ID NO: 3463 - DNA, 1470 bp, Saccharomyces cerevisiae
atggctcggggtgacggacatctatggacagagacatatgatagttccacagtcgcttttatgattttaggtgccgccctggttttcttcatggtaccggggctgggctttctttattccggtttagcaagaagaaaatctgctctggctttgatttgggtagtgataatggctaccttagtaggtatactgcaatggtatttttggggctattctttagcattctctaagactgcgacgaacaacaaatttatcggcaacttggattcatttgggtttagaaacgtctatggcaaaatttcggatgattccacgtatcctgaactgatttatgccattttccaaatgatgttcatgtgtgtcgcattgagtattatagctggtgccactgcggaaagaggtaagctttttccacatatggtttttctttttgtttttgcgactttggtttactgtcccatcacttattggatttgggccccaggtggttgggcctaccaatggggggtattagactgggctggcggtgggaatattgaaatcctaagtgctgtggctggtttcgtttattcttattttctaggaagaagaaaagaaaacctcctgatcaactttagaccacataatgtttccatggtgactttgggtacttctatactttggtttggttggttgcttttcaatgctgcaagctcactgtcaccaaatatgaggtccgtatatgcgttcatgaacacttgtctcagcgccaccacgggtggaatgacgtggtgtttattagattatcgatctgaaaaaaaatggtccactgttgggttatgctccggcattatctgtggtttagttgctgccacgcctagctcgggttgtattactctatatggctctttgatccaaggtataatagcgggtgttgtttgtaattttgcaacaaaaataaagtattatttaaaagtggatgattccttagatctattagctgaacacggtatcgccggtgtggtgggattgatttttaacgctctatttgcagctgattgggttattggaatggacggcacaacaaagcataagggtggttggttgacgcataactggaaacaaatgtatattcaaattgcctatatcggtgcctctgccggctattgtgctgtggtcacggccatcatttgcttcgtattaggtaaaattccgggtgtccatctaagagtcactgaggaagccgaagcattggggttggatgaagatcaaataggcgaattcgcttacgattacgtggaggttaggagagattattaccagtggggtgtagatacagatgcacttcatactacatgcaatggcgctaattctgcgtctgagacaaatcctactgaggacagccaaaactcctcattgtcatcagctacagtaagcggccaaaacgaaaaaagtaataatcctaaattgcatcacgcaaaagaagcatga

SEQ ID NO: 3464 - DNA, 1470 bp, Saccharomyces cerevisiae
atgggtaatgttccagggaaaatagaccaggaagatagttttaatgatgtcaggccagattcctcatataatactacatcatcgaattctgtcatcaaacaatatgatgaagaagcctcttcaagggtgagaacgagacgcacgacgtctttggtcaataatattttaaatgggaataatgctcgtacaaaaactggttctcatctatccagcactagtagaagaaagacgtcacgggaaaaagagcttgctaaagaggcacatgctaaacaattggttgtgaggtgtagcgaaactgtagatggggggtttttggccccatttggctgttattcttttgaaaagttggactatgatgctactgtcgttaaaaatttaataatcaaaagaaagttagcgccgttttacactcctttgcaggattttgatgaaagttggactagagatgagttgataaaaattgttgacggattgcccttgcatgacacgttcgatgaaaatttggaagaattcgaagacgtaccgataggcaatttaaggaagtcaacatttaatgaattaatagacaaatctttatccaagaaggaacagagaagaatgcacgcaaagatttttagagcaagattgtataagaaaagaattttatggcaagaaaatgaaaatgagacgtttttggagaggaaattggaaatgaaaagaattggcagcaagtccagcaatgttgaagataataccagtagccagccaaggaaaaattaccatttaccaagtgacgatttgaagtatactctttacaaaaatgggtcggaatgccctatttgttttttatactttccagggcctttcaactattccaaatgttgtcaacagcctatttgtaccgagtgttttgtacagattaagagagctgatcctcacttccctcatgacgaagtagacccaactgaaccacaaactaatgacagtgaaaaggacccaaatcttcttacctctgagccagcaaattgcccctactgtgcaactgctagttttagcatcacttatcaaccacccacaaatcgtgaaactggtatagggggtatgccagccgactcatacgtgtataaggacgccgccatatcaagagctgatggcggtcagccaaacatatcagccattacttcggataccattcgtcctgattgggagattaaattgaacaaagaaagggcaaggttgatgaggagatccgcgaatgccaccgctatacatataagtaataggttgatcgatccaagccatagcagaaggagaaatacaagtcacagtataacccctattcatgatgaaagtacgtcagcttcaagatctcctgaaccgacaataaacgaacttgaagatcaaatggttagagaggctattaggttaagccttgaagatcaggacaaccgaaaaaaatcaaagaatagaaacacctctttgagaccatag

SEQ ID NO: 3465 - DNA, 1470 bp, Saccharomyces cerevisiae
atgtccaatgctgctttgcaagtttatggcggcgacgaagtttccgcagtagtcattgatcctggctcatacacaacaaatattggctattcgggttctgacttccctcaatcaattctgccctctgtttacggtaaatacactgcagatgaaggcaataagaaaatattttctgaacaatcaattggaattccaagaaaagattatgaactgaaacctattatcgagaacggtctagtcatagactgggataccgcacaagaacagtggcaatgggcattgcagaacgaactctatttgaattccaactccggaataccagctctgttaactgagcccgtttggaatagcacagaaaacaggaaaaaatctttagaagtgctcttagaaggcatgcaatttgaagcctgttacttagcacccacatcgacatgcgtttcttttgcagcaggtagacccaattgtttggttgttgatattggacatgatacttgcagcgtcagtccaatagtggatggtatgacattatcaaagagtacaagaagaaattttattgctgggaaatttatcaatcacttgattaaaaaggcattggaacccaaagaaatcataccacttttcgcaatcaagcaaagaaaaccagagtttataaaaaaaacattcgactatgaggttgataaatcgctgtatgattacgccaataaccgagggttctttcaagagtgcaaagaaacactttgtcatatatgcccaacaaaaactttggaagaaacgaaaacagaattaagttctacggctaaaagatctattgaaagtccttggaatgaggagattgtttttgacaacgaaactcgttacggctttgctgaagagcttttccttccaaaagaagatgacatcccagcaaattggcctcgctcgaactctggagttgtgaaaacttggcggaatgattacgtgccgctaaaaagaaccaagccaagcggagtgaacaaatcagacaagaaagttacaccaactgaagaaaaggaacaggaagctgtaagcaaatctacttctccggctgcaaatagtgcagacactccaaatgaaaccggtaagagaccgttagaagaagaaaagcctcctaaagaaaataatgaattgattggtctagcggatcttgtttattcgtctataatgagcagtgatgtggatctaagagcgacactagctcataatgttgtccttacaggcggtacatcctctattcctggattaagtgataggttaatgacagaactaaacaaaatactaccatcccttaaatttagaatattaacaacagggcacactatcgaaaggcaataccagtcatggcttggcggtagtatacttacaagtctgggaacatttcaccaactgtgggttgggaaaaaggaatacgaagaggtgggcgtcgaaagattgcttaacgataggtttagatag

SEQ ID NO: 3466 - DNA, 1470 bp, Saccharomyces cerevisiae
atgtctgctgatttcggtttgattggtttggccgtcatgggtcaaaatttgatcttgaacgctgctgaccacggtttcactgtttgtgcttacaacagaactcaatccaaggtcgaccatttcttggccaatgaagctaagggcaaatctatcatcggtgctacttccattgaagatttcatctccaaattgaagagacctagaaaggtcatgcttttggttaaagctggtgctccagttgacgctttgatcaaccaaatcgtcccacttttggaaaagggtgatattatcatcgatggtggtaactctcacttcccagattctaatagacgttacgaagaattgaagaagaagggtattcttttcgttggttctggtgtctccggtggtgaggaaggtgcccgttacggtccatctttgatgccaggtggttctgaagaagcttggccacatattaagaacatcttccaatccatctctgctaaatccgacggtgaaccatgttgcgaatgggttggcccagccggtgctggtcactacgtcaagatggttcacaacggtattgaatacggtgatatgcaattgatttgtgaagcttatgacatcatgaagagattgggtgggtttaccgataaggaaatcagtgacgtttttgccaaatggaacaatggtgtcttggattccttcttggtcgaaattaccagagatattttgaaattcgacgacgtcgacggtaagccattagttgaaaaaatcatggatactgctggtcaaaagggtactggtaagtggactgccatcaacgccttggatttgggtatgccagttactttgattggtgaagctgtctttgcccgttgtctatctgctttgaagaacgagagaattagagcctccaaggtcttaccaggcccagaagttccaaaagacgccgtcaaggacagagaacaatttgtcgatgatttggaacaagctttgtatgcttccaagattatttcttacgctcaaggtttcatgttgatccgtgaagctgctgctacttatggctggaaactaaacaaccctgccatcgctttgatgtggagaggtggttgtatcattagatctgttttcttgggtcaaatcacaaaggcctacagagaagaaccagatttggaaaacttgttgttcaacaagttcttcgctgatgccgtcaccaaggctcaatctggttggagaaagtcaattgcgttggctaccacctacggtatcccaacaccagccttttccaccgctttgtctttctacgatgggtacagatctgaaagattgccagccaacttactacaagctcaacgtgactactttggtgctcacactttcagagtgttgccagaatgtgcttctgacaacttgccagtagacaaggatatccatatcaactggactggccacggtggtaatgtttcttcctctacataccaagcttaa

SEQ ID NO: 3467 - DNA, 1473 bp, Saccharomyces cerevisiae
atgaatgcggaccatcacctgcaacagcagcagcaacagcgacaacagcatcaacaacaacagcatcaacaacaacagcatcagcatcagcatcaacagcagcagcacacgatattacaaaatgtgtcgaacactaacaatatcggcagcgattcgctggcgtcacagcctttcaacacgactactgtttcctctaacaaggacgacgttatggtgaactctggggcaagagaacttccaatgcccttacatcagcagcagtatatatacccttactatcagtatacaagtaataacagtaacaacaataatgtgacggctggtaacaatatgtctgcgtcgccgattgtccataacaacagcaacaacagcaacaacagcaatatttctgcttctgattacactgtcgcaaacaacagtactagcaataataacaataataataataataacaacaataataacaataatattcacccaaaccagtttactgcggccgcaaatatgaactcaaatgctgcagcggctgcttattactccttccccactgcgaatatgccaataccgcaacaggatcaacaatatatgttcaatcctgcttcatacataagccattactattcagcagttaacagcaataacaatggtaataacgccgctaacaatggcagcaacaactcttctcactcagccccagccccggcccccggtccaccccatcaccatcaccatcatagtaatacacacaacaacctcaacaatggtggtgctgtaaatacaaacaacgctcctcagcaccatccaacgataataacggatcaatttcaattccaactacaacaaaacccttctccaaatttgaatctcaatattaacccggcacaacctctgcatctacctcctggttggaaaataaacactatgccgcaaccacgtcctacgacagcacctaaccatccccctgcgccggtgccttcttcgaaccctgtggcctcgaacttggttcctgccccatcatcagaccataaatatatccatcaatgccaattttgtgagaagtctttcaaaagaaaatcatggttgaaaaggcacctattgtcacactcgcaacaaagacattttctatgcccttggtgcttaagcaggcagaagagaaaagataatcttttacagcatatgaaactcaagcatacaaattatttattagacgaactcaagaaaaacaacatcatctttaactacaacaattcttcctcctctaataataacaacgacaataataataataataacagcaatagcgctagcggcagtggcggtgccggtgccgcggcggcagcagcaacagctcccgaaaatgaagatggaaacggttacgatacaaacatcaagactttaatcaatgatggtgtactgaataaggacgacgttaaacgtgttttgaataaccttattgttagtcacaacaaatag

SEQ ID NO: 3468 - DNA, 1473 bp, Saccharomyces cerevisiae
atgaatttctacagggatgcaacatgggtgctagaagatattgagaaggaggctgcaaaagaaaggatttccggctctatgcagacgctggtactgaaaagctgtaaaagatataagctgaaaagtaatccaaaacatatttatgcagttctcgattcgtgttggaaatataaaccatatttggagaaagtgatgaaaaaggcacacatattggaagatatacccaagaaaaagggcaaaccactcttttcaaggctaactttgttattgctttgccatgatttgctgttgtctaagcagaaaagaattcaaatgggcaaacaccccatcaaagattatgttttgaagtttaagagcccattgcatagcgaaatggtcaaattgaaactcaaattgaaagtaagagagctatctgagttggtattaagcgaggatatttccaatgaccttcctcctgttagatggattagaatcaatccattaaaatgccatccaaatggtgagactgagccggtgttagccgaattgaggaagaagtttactttaaaggtagacaaatggtctgaactagttcctgggtctatctattatgatgagtttattccaaacttgtttggaattcatccgtctgacaaaattacagcacatgagctttataagcatgggaagattatcattcaagatcgtgcttcttgttttccagcccacattttgaatccaggaccaagtgatattgtgatagattcctgctctgctccaggtaataagactacccatacggcctcttatatatatcccgaaccaccgaaggacaataatactcgaatatacgctttcgagaaggatcctgaaagagcaaaagttttacaaaaaatgatcaagatagctggctgttctcccaacatcagtgtcaatgtaggtgattttacaaagctcgctactcctgaaaaatataaggacgttacttgttttattgtagatccgagctgctccggtagcggtatatttggtcgtaagttttttgactcatttaatagaaggaaaattgatgataaagatgacgatggtggcattgtgccggatgagcaagaggagtttatagcaaaggaagaactacagacaaggttagcgaagctgagttcatttcagttccagatggtaaagcatgcaatgagtttcccagcggctaaaaaaatagtatacagcacatgttccattcatgcggaagaaaatgaacgagtcgtcatagaccttcttttagataagtcagttagagaatggggttggaaagtagcgccaaaaagagaagttattccttcttggcctagaagaggcaaggtagaagagttcgaagaggtttttagagatggagtcacctatgaccctcaacagcttgccgagggttgtatcagggcactaccaaaaagtgacggtggtattggtttctttgctgtctgttttgaaagagattaa

SEQ ID NO: 3469 - DNA, 1473 bp, Saccharomyces cerevisiae
atgctggtatcatcatcttttgcatcaagcattgactcagtaatgtcccatgagacgatgtctttacggagaaaccctccctttatagatactccagaaaaaatgccaaacccaacggcttctcccaatggcaccattcaccatttgatagatccatcactgccattgttgtccagtactacgtcgtcttcgcgctctaccctcagttctacactgaattctcctccacctcccccattaactacatcatactcttcttataactcctctgcatgccagtctatcacgagttcgcctacagacaatacagccttggcacataattccaaatgctatttccctcatagcctttctccaacaccgctgtcatccaacagctcaagccatgtcattttgccacccatatcctccttcaccaatttaattacagttgcagaaagagaatttaacggcagatcaaattccttgcatgccaattttacatcaccggtgccaagaacagtgctagatcatcacagacatgagctaacattttgcaaccctaacaacacaacgggtttcaaaaccatcaccccctcaccaccaactcaacaccagagtatattgccaaccgcggtagataacgtaccgagatcaaaatccgtgtccagcctacccgttagtggattcccacctttgatcgtcaaacaacaacagcaacagcaactcaacagtagtagtagtgcctctgcactaccgtctattcattccccattgactaatgaacatacaagcaggtattcatcgtctttaaaggattccgccaagataacgaagcaaagaaagaaaaaggaatgccccatctgccacaacttctacgccaacctatctacgcataaatccactcatttaactccggaggacagaccgcataagtgccctatctgtcaacgcggctttgccaggaacaatgatctgataaggcacaagaagcgccattggaaagatgaatttatgcaaatatacgcaagggagtccgacaacaatagtggtgctgacgatcaagatgacactgcccgcacctccgcaaacaacgacagcgacgactcaaacgataaactcgctgcctcatcctcttccgaagaaacaaaactactgaagaaaaaccaattgaaatcactatacaagattaaaggtgcattcaagtgtccttacaactctactctgatcaatttggatatggaggtgtatccacacaagtctagatcactctatttcgagccaataaactgtcatcaaacgggcgttttttcgcgctgtgatactttcaagaatcacctaaaggctttgcatttcgagtacccgcccaagaccaagaaagaagatagaggtgttgtgccggggaagtgcaagcattgtggactgcaatttccgaacgttgacgtctggctaaataagcacgtggggaaaggatgtggctactcatatcactaa

SEQ ID NO: 3470 - DNA, 1473 bp, Saccharomyces cerevisiae
atggaaagcaaagaaatatcaattaggtcaagaacccctccatcgaagctatattccatccaatcatgtattggcagaggtaactttggtgatgtgtataaagcagtggatagagttacgcaagaaattgtggcaattaaggtggtcaacctggagcattccgacgaagacattgaactgttagcacaggaaattttttttctggcggaattgaaatctcctcttattacaaactatattgcaacaatgttagaagatgtctctatgtggattgtcatggaatattgcggcggtggatcatgttcagatttactgaagcgaagttacgtcaacggtttgcctgaagaaaaagtttccttcattattcatgaagtcaccttgggtttgaaatacctgcatgagcaaaggaaaattcatcgtgatatcaaagcagctaatattttactaaatgaagaaggtatggttaagttgggtgatttcggagtaagtggccacattcgttccactttgaaaagggacacttttgtaggaacgccgtattggatggctccggaagttgtttgctgcgaagttgatgggtataatgagaaagcagatatatggtccttgggtatcaccacctatgagttactcaagggcttacccccattatctaaatatgatcctatgaaagttatgactaacttaccaaaaaggaagcctccaaaattacaaggtcccttttcggatgcagcaaaggatttcgtagctggttgtcttgttaaaacacctgctgatcggccatcggcatataacttgttatcatttgaatttgttaagaatatcaccataacgaacttgaaaagtgatgttgatctaattaaacagaaaaaggttcaggagagatatacaaaagttcccaaataccctcttcaaaatcgcttgtataaaaacagcaacacagtgaggggaaaggaattttggaattttgaatcgacaagactaagcacaacacaaatttccaaagaggaattatctcccattacacaagactctccaacatcatctttaaatatggaaagtccttatttacttcatgggcaaactgtaacgccgataaccaacccaagttcttcatcatttagaaaatgtacgcaaccagttttcgagcttgattcaggaatggatatagattcaggctgcccaaatgctcaagcagagaccgaaatagttcctctctctaatcataataagaagcataaaaagaacgatattcaggcgttgaagatagaaaagtttgactacttgaaaaacattgtatctcatattctcaacagaatgtatgatcgtgcgcgcgacgatgaaacaagaaaatacgtaaatgaaatgttaaagcaattcattaaaactgaggcaaacgttcctggatttaatgaggtttttatagaagagatctcactaagaattgaagcaataaagaaaggattcgtttaa

SEQ ID NO: 3471 - DNA, 1473 bp, Saccharomyces cerevisiae
atggaggctacatcaagtgctctttcgtctacggcgaatctcgttaagacaatagttggcgctggtacacttgccattccgtacagttttaaaagcgatggtgttctggtaggggttattcttacattattggcggcggtaacatccggtctgggtctctttgtgctatcgaaatgttccaagaccttaattaatccaagaaactcttctttcttcacattatgcatgctcacctatcccactttggccccaatttttgatttggcaatgatagttcaatgctttggtgtgggcttaagttacttagttcttattggtgatctctttccaggactgtttggtggtgaaagaaattattggataattgcatcagctgtaatcatcattcccctatgtttagtgaagaaactagatcaattgaagtattctagtattctaggtcttttcgcgctagcatacatatcaattctggtgttcagtcattttgtgtttgagctgggaaagggtgaattaacaaatatattaagaaatgacatatgctggtggaaaattcacgactttaaaggattattatcaacttttagcattataatttttgcttttacgggatcaatgaacctattccccatgataaatgaattaaaagacaacagcatggaaaatatcactttcgttatcaataattcgatatccttatcaacagcactatttttgatcgttggtttatcaggatatttaaccttcggtaatgaaaccttgggtaatttaatgttgaactacgatcctaactcaatttggatagtaattggcaaattctgtcttggctcaatgttaattctttccttcccgcttctctttcatccgctgcgcatagcagttaacaatgtcatcatctggattgagatcacttatggtggggcaaatcccgaagaggacccacaagtttcggaatacactcgtgcttccaacctaagaccaattagcatgactgtggaagatccagcccagcccagtgatgcactagacgcaacttcttataacgagcaagaatgtttactacctaacgggaactttgataatggttcaattgaaagtcaagagaacaataatgatgaaagagggactatggcggtcgccggggataacgagcatcatgcgccatttgttaagtctagattttactggattactgcattattactaataagcatgtataccttggcgttgtctgtccagtcatttgcactggttctttcatttgtaggggctacaggttcaacgtctatttcattcactttacctggattattaggttacaaattaataggcttggattctttggctattgggaagatgattccaccaaaagatagattttacaaaaggtgcagcttattgctagtcttctacggactatctgtgatgtttttgtcattgtatgtaactgtattcaaccgttcagatgaagcctaa

SEQ ID NO: 3472 - DNA, 1473 bp, Saccharomyces cerevisiae
atgtcgactttaaaacagagaaaagaggactttgtgacagggctcaatggcggttctataacagaaattaacgcagtgacatcaattgctttggtaacttacatatcatggaacttattgaaaaattccaaccttatgcctcctggcatttccagcgtgcaatacataattgattttgcattgaactgggttgctttgcttctatctattactatttatgctagtgaaccataccttctaaacacgctaatactgttaccttgtttgctcgcattcatatatggaaaatttactagctcgagtaaaccttctaatccaatatacaataaaaaaaaaatgattacacagcggttccaactagaaaaaaagccgtatattactgcgtatcgtggtgggatgcttattctgactgctattgccatcttggctgtagattttccaattttcccaaggaggtttgccaaggtggaaacttgggggacatccctgatggatcttggtgtaggatcattcgttttcagtaacggtattgtttcttctagggcactgttgaaaaacctaagcttgaagagtaaacccagcttcttaaaaaatgcatttaatgccttaaaatcaggaggaactctattgttcctaggattgctgaggttgttttttgtaaaaaatttggaatatcaagaacatgtcacagaatatggggttcattggaatttttttatcaccctatcattgttgccacttgtattgacctttattgatcccgtcacaagaatggttccacgctgctcaattgcaatattcatttcatgcatttatgaatggctacttttaaaggacgatcgcactttaaactttttaattttggctgatagaaattgtttcttcagtgctaatagagaaggcatcttctcatttctaggttattgctcgatttttctttggggccaaaacacgggattttacttgttgggaaataaaccaactttaaacaatctttataagccttctacgcaagacgtagttgcagcatcaaagaagtcttcgacttgggactattggacttcagtaaccccattaagtggcctctgtatatggagtacaatttttcttgttatcagccagttggtttttcaataccatccttatagtgtttcaagaaggtttgctaacttaccatatactttgtgggtcattacttataatttactatttttgactgggtactgcttgactgacaaaattttcggtaattcttcggaatattataaagttgccgaatgcttggaatcaatcaactccaatgggttgtttttatttttgttggcaaatgtctctactggtttagtcaatatgtctatggtcacgatagattcttcacccttaaaatcattcctggttttgttggcatactgctcattcatagctgtcatatcggttttcttgtatagaaaaagaatattcattaagctataa

SEQ ID NO: 3473 - DNA, 1473 bp, Saccharomyces cerevisiae
atgtctggttttcgtctaattgatatcgttaagcctatcctaccgattttaccggaagttgagttaccttttgaaaaattaccatttgatgacaagattgtctatactatttttgcagggttaatttacctttttgcacaattcccacttgttggtttgcccaaagctaccacacctaatgttaatgaccccatttattttctaagaggtgtatttgggtgtgaaccaagaaccttgctagaatttggcctttttcccaacatttctagtgggttaatcttacaattattagccggtttgaaagtaattaaagttaatttcaagatccaaagtgatagagaattatttcaaagcttaacaaaagtttttgccattgttcagtatgtgattttgaccaacattttcatatttgcaggttattttggtgatgatttatctgtggtacagatcgggttgatcaactttcaattggtcggtgctggcatattcaccactttgttagctgaagtcatcgataaaggatttggattttcttctggagctatgataatcaacactgtggtaatcgccactaacttggtggctgatacttttggtgtttctcaaattaaagttggcgaggacgaccaaaccgaagcccaaggtgccctaatcaatttgattcaaggtttaagatctaagcacaagacatttattggcggcatcatctctgcattcaacagagactatctaccaaacttgacaactactattatagttttggcaattgccattattgtgtgctatttgcaaagtgtccgtgtagaattgccaatcagatcaacaagagcccgtggtacaaacaatgtttacccaattaagctactatacactggctgtttatctgttttgttttcttacaccatcttgttctacatccacatttttgctttcgttttaattcaattggttgccaagaatgaaccaactcacatcatctgcaaaataatgggccactatgagaatgctaataatcttttagcagtcccaaccttcccattatctcttttggctccaccaacatctttcttcaaaggtgtcactcaacaacctttaaccttcatcacctattccgcctttatattggttactggtatttggtttgctgataagtggcaggctatttcaggttcctctgctcgtgatgtagccttggaattcaaagaccaaggtatcactttgatgggacgcagagaacagaatgtcgctaaagaattgaacaaagtcattccaatcgcagctgttacgggtgcatccgtcttaagtttgatcaccgttatcggtgaatctttgggtttgaaaggtaaagctgctggtatagttgttggcattgctggtgggttttctttgctagaagtcattaccattgaataccaacaaagtggcggtcaaagtgctttgaatcaagtcttgggtgttccaggtgctatgtaa

SEQ ID NO: 3474 - DNA, 1473 bp, Saccharomyces cerevisiae
atgttcaggatacaactgagaactatgtccagcaaaacatgcaagagtgattacccaaaggagtttgtcagtttcttaaatagctcacactctccttaccatacagttcataacatcaaaaagcatctggtgtcaaatggcttcaaagagttgagcgaacgtgactcgtgggctggccacgtcgcacaaaaaggaaagtactttgtgacaagaaatggctcttccattattgcgtttgctgttggtggaaagtgggagcctggtaatccaattgccattacgggtgctcacaccgactcccccgcattaaggattaagcctatttctaaaagagtcagtgagaagtatttacaagtgggcgtggaaacttatggtggcgctatttggcattcatggtttgataaggatttgggcgttgccggaagagttttcgtaaaggatgcgaaaactggcaaatccattgctagattggtggatttgaatagacctctgttaaagattcctactttggctattcatctggacagagacgtaaatcaaaaattcgagtttaatagagaaactcaactgttgccgattggtggtctgcaagaagacaaaactgaagcgaaaactgaaaaggaaattaataacggtgagtttacctccataaaaacgatagtacagaggcatcacgcagaacttttggggctaatagccaaagaactcgccattgatacaattgaagacattgaagacttcgaattgatcctttatgatcataatgcatccactctaggtgggttcaacgatgagtttgtcttctctggtcgattggataatttgacatcttgtttcacatcaatgcacggtttaacgttggcggctgacacagaaattgaccgagaatcaggcattagattgatggcatgctttgatcatgaggagattggctcatcctccgcccaaggggcagattctaacttcttgcctaatatattggaaaggttgtccatcctgaagggggacggttctgatcaaactaaacctttgtttcactcggcaatattggaaacttccgctaagtcgtttttcctttcatctgatgttgctcatgcagttcatccaaactatgcaaacaaatacgaaagccaacacaaacccttattgggtggtggtcccgtaatcaagattaacgcgaatcaacgttacatgaccaattcaccagggttggtcttggtgaaaagactagcagaggctgctaaagtccctttgcaattgtttgtcgtagctaacgactcaccatgcggttctaccatcggccccattttggcctcaaagacaggtattagaactctagacttgggtaatcctgtgttgagtatgcattcgattagagagaccggtggctctgcagacctggagttccaaatcaagttatttaaggaattttttgaacgctacacttccatagaatctgaaattgttgtctaa

SEQ ID NO: 3475 - DNA, 1473 bp, Saccharomyces cerevisiae
atgtttcccagagcttctgcattggccaaatgtatggcaactgttcatcgtcgtgggctactcaccagtggtgcacaatcgctagtctccaaaccagtctcggagggagatccagagatgtttgacatcttgcaacaagaacgtcacagacaaaaacactctatcacccttatcccatcagaaaacttcacctcgaaggccgttatggatttgctaggttctgagctccaaaacaagtattctgaaggttatccaggtgaaagatactacggaggtaacgaaatcatcgataagtccgaatccttgtgtcaagcaagagctctggaactgtacggattagaccctgccaagtggggagttaatgttcaaccattaagcggggcacctgccaatttgtatgtttactccgctatcatgaacgttggtgaaagattaatgggattggatttgccagatggtggtcacttgtctcacgggtaccaacttaagtcaggaacgccaatttctttcatttccaaatacttccaaagtatgccataccatgtcgaccacactacggggctaatcgattacgataacttgcaagtattggccaaggcattcagaccaaaggtgatcgtggccggtacttccgcgtactcgagattaatagactacgctagattcaaggaaatttcccaaggatgcggcgcatatttgatgagtgatatggcacacatatccggtttggtggcagccaatgttgtcccatctccatttgaacattccgatatagttaccacaaccactcacaagtccttgagaggcccaagaggtgctatgattttcttcagaaagggtatcaagtctgtcaccaaaaagggcaaggaaatcccatatgagttagaaaagaaaatcaacttctcagttttcccaggacatcaaggtggtcctcacaaccatactatcggtgcaatggcagtggcattaaagcaagcgatgtctccagaattcaaagaataccaacaaaaaattgtcgacaacagcaaatggtttgctcaggaactaaccaagatgggttataagttggtttccggcggtaccgataaccacttgattgttattgacttatccggtactcaggtagacggtgctcgtgtcgagacaattttaagtgccttgaacattgctgctaacaagaacaccatcccaggtgataagagtgctcttttcccctctggtctaagaatcggtactccagcaatgaccacgagaggatttggccgtgaagagttttctcaagtcgcaaagtacattgattctgccgttaagctcgctgaaaatttgaaaactttggaaccaacaacgaaactagatgcaagatcaagactcaatgagttcaagaagttgtgtaatgaatctagtgaagtcgctgctttgtctggcgagatttccaagtgggtcggtcaataccctgtcccaggtgatatctaa

SEQ ID NO: 3476 - DNA, 1474 bp, Saccharomyces cerevisiae
atgggtattaacaatcctattccaaggagtttaaagagtgagacaaagtatgttttatacgggtttggctgggaaacctttaaaaaagttctcccttaatttgttcatcatttactaactagtaataaacaattaataaagaaaagcagcgaagattttggctagttttgtcaaaccaaaccaagtttttggtgcggaccaagtcattcctccagacgttttgaaaagagctaaagggttggctatcataacgatcttaaaagcaggttttctattttcaggtagagctggttctggtgtgattgtcgcaagattaaaggatggtacttggtcagctccatctgccattgccatggcaggtgctggtgccggtgggatggttggtatagaattgactgattttgttttcattttaaatactcaggatgctgttaagtcgttttctgaatttgggaccatcacgttgggtggtaacgtctccgtttctgctgggcctcttggtagaagtgcagaagcagctgcatcagcctccgccggtggtgtggctgcagtttttgcctattctaagagtaaaggtctatttgcaggggtttctgtggaaggttcggctattatagaaagaagagaggctaacagaaaattttatggtgacaattgtaccgcgaaaatgattttgtctggtaggataagaccgcctccagcagttgatccattgtttcgtgttttagagtccagggcgtttaattacagaccctccaacggtggtcgtggcagtttcgatgacgacgaagacgattactatgacgacgacgattactataatgacattcctagttcattcagttctacagatgcttcctccactagacctaacacaagatccacaaggagaagagcccaaagcggttctcgttatacgttcgacgatgatgatgacgatgatgattatggtactggctattcaaggaattcaagactggctcctaccaacagtggcggtagtggtggtaaattggatgacccatctggagcttcaagttattatgccagccacagaagatcaggaactgctcagtcaagggctcgttcttcaagaaatcgttgggctgatgatgaatacgatgattatgatgatgattatgaatccgggtatagacgcgggaatggaagagataggacaaaagaccgtgaagtcgatgacttgtcgaacagattttctaaatctagaatctcgtccgcttcaacaccgcaaactagtcagggcagattcactgctccaacatccccatccacgtcttctccaaaggccgtggcattatatagctttgcaggagaagagtccggagatttaccattcagaaagggtgacgtgatcacaattttgaaaaaatcagattctcaaaatgactggtggaccggaagagtcaacggtagagaaggtatattcccagcaaattacgttgaactagtttaa

SEQ ID NO: 3477 - DNA, 1476 bp, Saccharomyces cerevisiae
atgaaactctcaactaaactttgttggtgtggtattaaaggaagacttaggccgcaaaagcaacaacaattacacaatacaaacttgcaaatgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggctcttgatcaagtttacaagagttattccaagaaggctatttctaaagggttggttagcgatcccgctggttcggatgctttgaacgttttgaaatatttcgactacaacgttttccatgttccaacctgtaaattggtcacaaaatcatacggtagattactatataacgatttcagagccaatcctcaattgttcccagaagttgacgccgaattagctactcgcgattatgacgaatctttaaccgataagaacattgaaaaaacttttgttaatgttgctaagccattccacaaagagagagttgcccaatctttgattgttccaacaaacacaggtaacatgtacaccgcatctgtttatgccgcctttgcatctctattaaactatgttggatctgacgacttacaaggcaagcgtgttggtttattttcttacggttccggtttagctgcatctctatattcttgcaaaattgttggtgacgtccaacatattatcaaggaattagatattactaacaaattagccaagagaatcaccgaaactccaaaggattacgaagctgccatcgaattgagagaaaatgcccatttgaagaagaacttcaaacctcaaggttccattgagcatttgcaaagtggtgtttactacttgaccaacatcgatgacaaatttagaagatcttacgatgttaaaaaataa

SEQ ID NO: 3478 - DNA, 1476 bp, Saccharomyces cerevisiae
atgaagccacagtgcatactcatctctttgctggtcaacctcgcatacgcagaggagtatttggtgaggttcaaaaatcccacagcattccaacaattcacttcgaattccaacaggtcatggagacagttcatcgacaacaaaattgagaagaaattctccatcggatccttccgcggcgtgaccatgaacctgtccaagaacttagtgaacaagctgaagaaaagcccactggtggctgatattgtgcccaacttcaggttcgaagcttttgaaggcgacagtgtaaatagcgccgagtcgagttatacgtttaacgctaccgccaaatactcgtacgaagacgtcgaggaagagcaaaatataacgtatcaaccagacgcaccccgtcacttggcccggatttcccgccactaccaactcccattcgacgttggggacaaggaccgctacaaaagctggttcaattactactatgaacacgactatcaaggtcaagacgtcaacgcctatatcatggatacgggtatcttcgcggaccatccggaattcgaagacagagtcatccaggggattgacttgaccaaagaagggtttggcgaccagaatggccacggaacgcacgtggcgggactcgtaggttccaaaacgtatggagcggcaaagagggtcaatcttgtggaggtcaaagtcttgggcaaagacgggtctggcgaggccagtaacgttcttagtggtctggagttcatcgtggaacattgcacaaaggtcagtcgcccacagggtaaaaaatgcgtggccaatctaagtctagggagtttcaggagccccataatcaacatggcagtggagggggccattgaagaaggtattgtatttgttgccgcggcggggaacttcaatttagacgcctactgggcctcacctgcgtctgcagaaaacgttatcaccgtaggggcctttgatgaccacattgacacgattgccaagttcagcaattgggggccctgtgtaaacatctttgccccaggcgtggaaattgagtcgctatctcatctgaactacaacgacactttaattttgtcaggtacatctatgtcgacgcccattgtcaccggagttgcagcgatcctactctcgaagggaattgagcctgaaatgatagcacaggagattgagtatttgtccacgcgtaatgttttccatagaagaacgttgtttttcaagccttctacgccaaaccagattctttacaacggcgtcgataaactggacgatccatatgacgacgaaacgttccctcgattgaacatagaggcaattgctaaggaactggaggagtacaatgccactttacaaactcctatgtctgagaatcttcaatctggttcaaaactgtggggttggaataacgatgtcacactacctcttggtgagattcgattgaagaggcgtgattttatgaaaaatttgtag

SEQ ID NO: 3479 - DNA, 1476 bp, Saccharomyces cerevisiae
atgaattctccaacaatgaaatcggaacaacttactccaaaactctcaccaatgtccttttgtttggatgaccaaagaaatgcaggctcttttcaaaatctattgaactcacctacgaagctaaaattagacactggcccgattggtaattccttgttatatccaacatcactctctaaattgagcgagttatcaagaggtggacgttctaaacaaagaaggggctctgacactatgaggtctgtatcgcctattaggtttcagtttttgaacaacactccaaagatgttaaaacccgagtacctatctcaaacaaccagtaatctgccattgctatctgccctattgaagaatagcaagaaaactactagtgaaggccagaattcaaaccctgatccattgaacatagagaaaaacatcattaaacaaagcatcaaggacaaactagagcagctgcgcagttcagaatccgttgcgcaagtacaaaagaaagaacgcaatcccccttcatttgaggccaaagtctgtgcggaagaaccgatattacggaaaaacgccgaagggttgctcccctcatacgttcctgttcctgctactcctttggaagatccagaaaatcatggggtgcgaaaggtcgaggacaaaggacttagagtcgtctccggcggctccactcagtgtctaagcaccgaagtgaacgaattgcctaaggatctgaatctagacaatttacctacggataataacgggttcgttcaatatggtctcaaaggcaataacaacaacaacagatatagctttatctcgtctacgtcgacggactatgagcccgaatggtgtgacggacaacaacatatttcaatgcaaatggcctctatggccaatgcagaggaggcaaatagtcgtgaaaaatcgaatttagacataaagatcaagcagctagaacttgaaattacagaattaaagttgcagaatgaaaaattagtgcattccatgacgacgaacagatacattgaagaaagatttatgcttgaggttatgaaggatcctagtatacaggctcaaagatcccaaagagatattgagagaaaagtcaagcaactggagaaaaaattcttcaattgtaaaaaagttcttaagaaattgactgaatcctccgcagtagtggccacctccacttcaaaaactgaaggaaattcagcaagaatcccatgccctaagactagactggcacgcgtttctgttttagacctaaagaaaattgaagaacagccagattcttcttcgggaacttcgtccgaggaagatcatctaacaaacgatgatacggatgctaatactagcgaagatttaaatgttgcttttgaagaggagccaacttctgctatttccacaacagcatctgtgcagagtggggaaagtaaaagaggtttccaacttaaccttcctgtccaagtggagaagaaggaaaaatga

SEQ ID NO: 3480 - DNA, 1476 bp, Saccharomyces cerevisiae
atgaccagtttgtccaaaagcttcatgcagagtggacgaatctgcgcagcatgtttctatctgttattcacactactttcaattccaatctcgtttaaagttggtggtttggaatgcgggctttccttcacggtgacactgttcactttatatttcataactacgactcttaacgtgttggcaagacgacatggaggaagactatacattttttttaccaactgtctgtattactcacaacattttatcattgcatctttgctatacctgtttttgtctggattttctaatgatgagttgggaaacgttctgaaaaataaatataatgagtcggagtcgttcctggaagctttgaaaaatagcttgaattccaatcaaattaactacgtcttatattattactactatcgatttgttgtacaaccgtggcaattcgtgcttaccaagtccacacctttttttactctatcggaaggttttttcactattttagccattcaggccgtcggggaaactaatagatggttatcaaatgacttgaattcaaacacgtggattatttcctcattgttaacctccggaggtgtgattaccgcatcgctgtactatttgtatcggatttatgtcacccccatatggccgttatccatccaaacggcgtccttattaggacttgttttgtctatggtatgtggactggggttgtatggtattgtgagtcaaaaaggatccgtcatagagagctctttattttttgcgtatattgttcgttgtatttatgaaatttcccccaaattagctactaccgcgactgatgaaattttaaatttgttcaaagacgtctggcagaaacatcaaagaaatctgcccacagctgacaatcttttgtgctactttcataatgtcatattgaaaaatgcagaggtgttatgggggtcctttattcctagaggaagaaagaaaaccggtgattttcatgataaactcattagcattctatcattcgaaaaagtatccttgatatctaaaccattttggaaatttttcaagaatttcacctttagtgttccgctatccattaatgaattttgtcaagttacaattaagatggcaagcgaatcagtttccccagctatagtaatcaatttatgctttagagttctgatgttttactcggcaacgaggattattccagcattacaaagaaaaaatgacaaacagttgcgcaagagtcgcaggatcatgaagggattgtattggtacagtccttgcatattaattgctatgtatactcacctgattttacaatattcaggtgagctaaagaaagacctgtgcatatggggttgcagtgaaaagtggtttggcgtagatcaaccagaaattatagtagattcatggggattttggaactggtgcaacattttctgtactattttggtatacgctacagaattaataggttctggtagttga

SEQ ID NO: 3481 - DNA, 1476 bp, Saccharomyces cerevisiae
atgaggttgatatccaaaagaagaatcagatttattgtgtttattttgttcggcgtcctcactgtattcgtagtatcaagacttgttgttcattttcagtataaccaagaaataaagttctataaaaagtattttcaacagaggaaggatgggcttcacgaaatttacaacccattagaaatcaagcaaatacccaaggaaacgatagatgacttatataccgcccgtttagataaagagttgaaaaacggtgaggtcatcgagtggtccaagtttgcatacgtgaattatgtgactaatgctgattatctttgtaatacgctgatcatattcaatgatctgaaacaggagtttgagacaaaggccaagttagttcttctgatatctaaagatctgctagacccaaacacttcctcaaatgtggcttacattagttcactccttaacaagattcaagctatagatgaggaccaggtagttatcaagttgatagataacattgtgaagccaaaggatactacaccttggaatgaaagtttaacaaaattactagtatttaaccaaacagaatttgaccgtgtgatttatcttgacaacgacgcaattttaagatcaagcttggacgaattatttttcctaccaaattatatcaaatttgcagctccattaacatactggtttttatctaacagtgatttggaaaaatcataccatgaaacgcgacaccgtgaaaagcaaccaatcaacctccagtcgtatacaaaagtgctgactaaaagaattgggaaaggtcagatgatttataatcatttgccgagtttgccgcattcattgtacttgaattctaataacatagctcaggacattataagttctacatcatctttatcgccgttatttgatttccaaagtagtaaaaaggttggaaaattaaaatttgcttctaatttaatggttattaatccttcaaaggaggcgtttgatgaaattgtgaacgttatgctgcccaagattttaaacaagaaggaaaagtacgatatggatttgatcaatgaagaaatgtacaatttaaagaagattatttataaacagtttattttcttcagaaaagtccgaaaacttttcaaaccagaagtattggttttgccatttgcaaggtacggcttactgacgggttcattgagaaacccacggcactattctataatctataatgacgttttgggttataagacattggataatgatggcaacgatattccggtaggattaaacgacagtgtcgcatattctaagtacatacatttttcggattatccattggccaagccctggaattatccatcaatgaaggagtttgaatgtatcgttaaagaagaagacgcggaggattcaaagctagagcaccaagcttgtgacctttggaactcggtgtacgcttcttacatacagtccagggaaatctgcctcgtttga

SEQ ID NO: 3482 - DNA, 1476 bp, Saccharomyces cerevisiae
atgagtgctctactgtccgagtctgacctaaacgattttatcagtcccgcccttgcgtgcgtcaaacctacccaggtgagcgggggcaagaaggataacgttaacatgaacggagaatacgaggtgagcacggaaccagaccaactggagaaggtctctattaccctatcagactgcctcgcgtgttctggttgtataacgtctagtgaagaaatcttgttgagtagccaaagtcactcggttttcctgaaaaactgggggaagctttcgcagcagcaagacaaattcctcgttgtgagtgtctcgccacaatgcagactatctcttgcgcagtactacggcttaacattggaggcggccgatttgtgtttgatgaattttttccaaaagcatttccagtgcaagtatatggttggaacggagatgggcagaatcatatcgattagcaaaaccgtagagaagatcattgcgcataagaaacaaaaagaaaataccggtgcggaccgcaagcctctattatctgctgtgtgtccgggatttcttatatacacggaaaagaccaaaccgcagttggtgcctatgctgctcaatgtcaagtcgcctcagcaaattacgggctcgttgatcagagctacgttcgagagtctcgctatcgcgcgtgagtccttttaccatctgtcgctgatgccatgttttgacaagaaactagaagcgtcaaggccagaatcgcttgacgatgggattgactgtgtcattacgccacgtgaaatagtgacaatgttacaagagttgaatttagacttcaagtcgtttcttactgaggacacaagtttatatgggcggctatcaccgccgggatgggacccgcgagtccactgggcgtcgaatctgggaggcacttgtggtggctatgcctaccagtacgtaacggctgtccaacgactacacccaggaagtcagatgatagttctggagggtagaaacagcgacattgtcgagtaccgattgctgcacgatgatcgcataatagccgccgccagcgagctttccgggtttagaaacatccaaaatctggtgcgtaaactgacctcgggctccgggtcagagcgcaagaggaacatcaccgctctgcggaagagacgaacaggtccaaaggcgaactcacgcgagatggcggccgccacggccgccacggccgatccctaccactcggactacatcgaggtaaacgcgtgtccgggtgcatgcatgaacggtggtggcctactcaatggcgagcaaaacagtctcaagcggaagcagttggttcagacactgaataagcgtcacggagaggagctagcaatggtagatcctctaaccctgggacccaagctagaagaggcggcagcccgcccgctttcgctagagtacgtcttcgcgcccgtcaagcaggccgtcgaaaaggatctcgtctctgttgggagcacctggtaa

SEQ ID NO: 3483 - DNA, 1476 bp, Saccharomyces cerevisiae
atgatattagatccattatctccaaatattgaaaatcatactcaagatgaaataattgagttttgggaaaaaactgagtctattgctaacataccaaaggaaaacttggatgaatcccatgttaactcaagcctggttgcctacctgaagtttgctactgattcctataaggtttttattaatactgatcgtgacctctaccggatgtcgctaatactgttagaatcgtccttatttgaatttaaaaaagagttttgcctaagtaagttgcagtcgttactcaacatagacctactggaaatgaatatgaagttcattattgtttacattcttctctgtgaggcgaaaaaaaacgtgtactccttagaaatcatgctcaagttccaaggatttactgtgttttataataccttgtacacacaattcgcctatttgagcaaatacggaaaggaaaggacagttgcttctaaacatcaatacaattctaataattctagcacaggtacatccttggacagtttagaccgaagtttgactgatattgatttgggtattatagacgaaatgaagcaaatttcaactgttttgatggatttgttatttcaaattatgaagtactgtaagtgtgttattgctaatcttcaaattgtggatgacttttttgtttactatatgatggaatcaatgaggtccgacactatggacgatatgttcaataacgcggagtttaaactgctgttggcgttgaacgaacaatatatgatgtttgccaaggagtacgacattgagaacaaggtctataagtatttgatcaatgggtctgtctcaagatgttttacggagctattattactgaaattcaatagggcatcggaccctccgttacaaattatgatgtgcaaaattatttatcttatcttgacaccaagaggagactactctccgatgaatttcttttatacaaacgacttacgtgttcttatcgatgtattaatcagagaactacagaatatcagtgaggatgaagaggtattgagaaacacccttctaagggttctgattccgctattaaagaatacacaattatccaaaacacattatagaaaggatgatttgaataaactattaaactacttgtcgactttagataatatatgcgttgacagtccagcgttgcacgagcatcaagttacagtggccttatctcggaagtgtcttcaacaaattccttggttagagacaccttcaacgccttcagatggaggttcatcggtctctagtaataacactagtagaaactctagcattgttgcattggggacgcccgacaatcaaaatatcttggctcgtaaaggccatctttatagtaatcgtgaattagatgtttctgcagaatctttgactaaaagaaaggctaaagctccgcctccgcctcctcctcctcctccatcaagaaaatgtggaactccaaaataa

SEQ ID NO: 3484 - DNA, 1476 bp, Saccharomyces cerevisiae
atgattagtggtgtgctggtatactcatcgagaggtgaacttgtcttgaacaagttcttcaagaactcgttgaagcggtccatatccgatatcttccgagtacaagtgatcaataatctagatgttagatcgcctgttttgacactgggctcaactactttccatcacatcaggtcgaggcatggtgacaatttgtggttggtaaccattacgagaagcaacgctaatagtgcggcgatctgggagttcttatataagcttgatgcagtgatgaatgcttatcgattggatagagaggaggccttgaaagaggaattcatgattgtgcatgagatgctggatataatgttgggtggaaatgggataccaattgacactgaattgaactctgttatagcgcagatgtctgtgaaacccgttagaaatatgggcggattgttagatagtcccgatggaaatgatgtattatcttcctcttcatctcctacttcttcagcaggagaactacattttcccaaatttttgacaaaaagaagcagtagtttcctgggtcaaggagactccacttctgatttctatgataacaataagatcacttggaggcccaaggggataatacacaagaaggatgaagttttcttgtatgtcaatgagaggataaacattctggtatctagggatggttctatcttgaaatcatacgttgatggcaccatagatatcaccacacacttgagtgggacccctatttgtagatttggattgaatgattctttgggaatgcagtccgaagacgagaagaaatggttagcacagcagcagcgtcactctggcagcgattttggaaacaagaacttcattcccaaagctgctgccggtagtgttttgttggaagattgcaagtttcacgaatgtgtctcacttgacaaatttaacagaaatcatatcattgaattcgtcccaccagacggttcgatggagttgatgaaatatcatgtacgagataacataaacctgccgttcaaggttacacctattgttacacattctacaagagataacgagattgattacaggataacattgaagtctttatttcctggaaaactttccgccaaagatgtggtactacatatacccgttccaccaagcactgtggattgtaagataagtgtctctaatggccactgtaagtttgtgccagaagaaaatgcaatgatttggaggttcaacaagtacaatgggttgacggaaaacactttaagtgcagttactgtgtccacaagtgatactactcaattgaatcttcaacaatggacaagacctccaatatccctggaattcgaggtcatgatgttcagtaattctggcttagtcgtacgatactttaccatttctggaaaagacagtaagcatcgtgctgtaaaatggattaaatatatatcgaaagccggttcttacgaggtgaggtactag

SEQ ID NO: 3485 - DNA, 1476 bp, Saccharomyces cerevisiae
atggcacactatccaccttccaaggatcaattgaatgaattgatccaggaagttaaccaatgggctatcactaatggattatccatgtatcctcctaaattcgaggagaacccatcaaatgcatcggtgtcaccagtaactatctatccaaccccaattcctaggaaatgttttgatgaggccgttcaaatacaaccggtattcaatgaattatacgcccgtattacccaagatatggcccaacctgattcttatttacataaaacaactgaagcgttagctctatcagattccgagtttactggaaaactgtggtctctataccttgctaccttaaaatctgcacagtacaaaaagcagaattttaggctaggtatatttagatcagattatttgattgataagaaaaagggtactgaacagattaagcaagtcgagtttaatacagtgtcagtgtcatttgcaggccttagcgagaaagttgatagattgcactcttatttaaatagggcaaacaagtacgatcctaaaggaccaatttataatgatcaaaatatggtcatttctgattcaggataccttttgtctaaggcattggccaaagctgtggaatcgtataagtcacaacaaagttcttctacaactagtgatcctattgtcgcattcattgtgcaaagaaacgagagaaatgtgtttgatcaaaaggtcttggaattgaatctgttggaaaaattcggtaccaaatctgttaggttgacgtttgatgatgttaacgataaattgttcattgatgataaaacgggaaagcttttcattagggacacagagcaggaaatagcggtggtttattacagaacgggttacacaaccactgattacacgtccgaaaaggactgggaggcaagactattcctcgaaaaaagtttcgcaataaaggccccagatttactcactcaattatctggctccaagaaaattcagcaattgttgacagatgagggcgtattaggtaaatacatctccgatgctgagaaaaagagtagtttgttaaaaacttttgtcaaaatatatcccttggatgatacgaagcttggcagggaaggcaagaggctggcattaagtgagccctctaaatacgtgttaaaaccacagcgggaaggtggcggaaacaatgtttataaagaaaatattcctaattttttgaaaggtatcgaagaacgtcactgggatgcatatattctcatggagttgattgaaccagagttgaatgaaaataatattatattacgtgataacaaatcttacaacgaaccaatcatcagtgaactaggaatttatggttgcgttctatttaacgacgagcaagttttatcgaacgaatttagtggctcattactaagatccaaatttaatacttcaaatgaaggtggagtggcggcaggattcggatgtttggacagtattattctttactag

SEQ ID NO: 3486 - DNA, 1476 bp, Saccharomyces cerevisiae
atggtatatcgtaacaggtcaaagagcgttttatctacacacagcaagaagagcgacgataaggcccactataaatcacgttcgaaaaagaaatcaaaaagcaggagcaagaagaggttaagaatctactggagatacatatctattgtatggatcttatggttaggattaatatcttattatgaatcagtggttgtgaagagagcaatgaagaagtgccaatggtcgacttgggaggattggcctgaaggcgctgaaagtcatagggtgggtttatttgcagacccacaaataatggacgaatattcatatcctgggaggcctcaaatagttaattattttacaagagtgattgttgaccattatcacaggagaaattggaaatatgtccagtattacttggatcctgatagcaattttttcctaggtgatctatttgatggagggagaaactgggatgataagcaatggattaaagagtacacacgattcaaccaaatattccccaagaagccactgagaagaacggtcatgtctttaccaggtaatcacgatattggttttggagacacagttgttgaatcgagtttacagagattttctagttactttggagaaacttcctcctcattagacgctggaaatcatacctttgtacttttagatacaatttcgctttctgataaaacaaatccgaatgtctcgagggttcctagacagtttttggataattttgcaatgggttcacatccgcttcctagaattcttttaactcacgttccattatggagggatccagaacagcaaacgtgcggtcagctacgtgaatccaaagaaccttttcctattcagaaagggcaccagtaccagacagttatagaaaacgatatatcacaagaaattttaacgaaaattcaaccagaaatattattttccggggatgatcatgaccattgtcagatatcacactcatatccgtttcaggggaaaactaaaaatgctcaagaaattacagtaaagtcatgtgcaatgaacatggggatcagtaggcctgctattcaattgctctccttatataatccttcagatttgacaatggtaaatgccggcggagagtatgcatcaaaaacttaccaaacagagctatgctatatgccagatccctataaggcaatcagaatgtacctatggggattattattctctgctgcctttatcgcatacatgcattttttcccaaaatcttttaataatcgcgtagcaaccataatgaacagagtatttacacgacctgatggtaacacctcagatttgccattacctacaagtatttccaaatcgaaatccaaaaaatcattgacacatagtaaatacgctgtgaatgatacgcgttcgatcaaacaatttctagttaatgcaattgtcctttttgtttctgtgatgcccatttttatttatttttatactgtagtctag

SEQ ID NO: 3487 - DNA, 1476 bp, Saccharomyces cerevisiae
atgtccaacccaatagaaaacacagaaaactcacagaatactagttcatcaaggtttttgaggaatgtacaaaggttggccttaaacaatgtaacaaatacgacatttcaaaagagtaatgcgaataatccagccctaacaaatttcaaatctacactaaactcagtaaagaaggagggaagtcggattcctcaatttactagagaaagcgtatcaagatcaacagccgcacaagaggagaaaagaaccctgaaagaaaatggtatccaactccccaaaaacaatcttttagatgataaagaaaaccaagacccaagtagtcagcaatttggtgcgctaacttctataaaggaggggagagctgagctgcctgcaaatataagtttacaagaatcctcctcagcgaaggagataatccagcatgatcccctaaaaggcgttggatcaagcactgaggtagtccataactcggtagaaaacgaaaaacttcatccagctagaagtcaacttcaagttagaaataccgaaagtgaaactgatagtggaaaaaaaagaccaatttctacaattgttgaacaagaactgcccaaaaagtttaaagtgtgcgatgaaaatggcaaagaagaatatgaatgggaagacctagatgcagaagatgtaaatgatccattcatggtcagcgagtacgtcaatgatatattcgaatatctccaccaactagaggtcattactcttccaaagaaggaagatctctatcagcatagaaatattcatcaaaatcgagatatcctagttaattggttggttaaaatccataataaattcggcttattaccggagactttgtatcttgccattaacataatggacaggtttttaggtaaagagctagttcaactggataagttacaattggttggcacatcatgccttttcattgcctctaaatatgaagaggtctattctcctagtataaaacatttcgcatcagagacagacggtgcatgtacggaagatgaaatcaaagaaggggagaaattcattttaaagacattgaaatttaacctaaattatcccaatccgatgaattttctgagaagaatttcgaaagcagatgactacgatatacagtctcgaactcttgccaaattcttattagagatatcattggtagatttcagatttattgggatactaccctcattgtgtgcagcagctgcgatgtttatgtcgagaaaaatgttaggtaaaggtaaatgggatggaaatctaatacactatagcggcgggtatactaaagaagaacttgcgcccgtgtgtcacatgataatggattatctagtgagtccaattgttcatgatgaatttcatagaaaatatcaatctagaagatttatgaaagcttctataatttccgtccaatgggctttaaaggttagaaaaaacggctatgatataatgaccttgcatgaatga

SEQ ID NO: 3488 - DNA, 1476 bp, Saccharomyces cerevisiae
atgtctaagtatcaaattaattgcataagataccggcactttctcaggacatctaatatctcgcagatccctgatttcacgaaatactgcattggtcccgtaaatgaagaattggcaccttacatcatggaaaccatgaaggcatacccttcaaattccgaatatatcaatccgcagcattactatcataatagaacggtattagtagaaaattacttaaaacgaagtccaaatccagtatcattaacgcagttagcgcaatattatgacgattctaccaagctgaccagaaccaagatcatcaattccgggaaatttgtaaaagaagaactggtaattaggatcgcgcataaattaaatcaattgcaacaacttccatttaatgttgtgaacaacttccattttgttcaagtttatgagtcatattacaatatttttgaaagctttagaaaatatccgactataagaactttagaggacgcttctcaatttgcagattttatcaaaaatatgctagaaggcttcaatactctaaacttaccacatttgataatgggggctttagaatgtacaattttggatctttatcctcgtgaaaaaatggaccaactactatctgatctgttaagagctcgaatatcaagaagattgattgtagaggaacacgtcagtatcacagccaactacactagtggtaaggaggaaaataccttggtattgggtgatatttttcaagaatgtagcgctaaaaaatatttattggaagccagtgaggaatctcaaaaatttatccaagatatgtactttaaagacattcccatgccagaatttattatcgaaggtgacactcaactaagcttttactttttgcctacacatttgaagtatttgttaggggagatccttcgaaatacttacgaagcaaccatgaaacactatattcgtaagggattagaaaagccggaaccaatcatagtaactgtagtaagtaacgatgaatcctatttgtttagaatttcagataaagctgggggcgtcctccatgatgatgaaaatctatggtcattcggtaaatcgaaagaaagggctcaagaatccctaaataattttcacaagttacctggtttacaaacagtatctatttatgacgaagtacattcccatactaaatataactccaaactgaagtcattgcagtcaataacattaaaaccgtacatgcacacgtcgctagaaccaatgagttatcctagcatcataaatgggcacatcaaatatgaaactcccctaattgaattgttaaagcggtcttttagatacaagcttgggattgggttagccatgtgtaaagtgtatgctgaatattggaacggcgacctttcattgcattcaatgcctggatatggtaccgatgttgtattaaaattaggcaacttgatgaagcatacgaagaaactacaattagataaagtgtga

SEQ ID NO: 3489 - DNA, 1479 bp, Saccharomyces cerevisiae
atgagcgatgacttgttttctaaggctttggagaatcccgaccaggacttgaacgtggaattgcccaaggatgatgttgatttaggtcttttaggtgatggtgggaacgagaggaagaccgatgaaccggtagcagacgcagaaagatcaacaggcctaggatccggctcttctgaatccgaatcagattccggttctgattctgattctgattctggctcttcaggtagtgaggatgattctgcagatcaggacgttgaaggagaggacgaaggtggtgacgcgattgaaaatgaagacgaagacgaagacccttcaccttccggtcctatactatcgaagaacgaaatactagaggaaactgttcctgaactaccggaagattatgaaatttcagaaaaaacgatcatcactcctattggtgttttgaagtctgcatttgaaaataatataatcattcacgccacgatgtcgggcgaaaagcgtgttttaaaagagggttccattttctgtctcgaggatagaactttgatcgggatgttgacggaggtgtttggacccttgcaaaacccattttatagaattaagttgcccgattcaaaaaaaaacttattcgatgaattaaaagtgcgtttgggtgagaaagcctttatagtcacccctgatgcccactggatagatactttcgagttaaagcgcaacaaaggtactgatgcgtctaatgggtacgatgaagaattacctgaagaggaacaagaattttccgacgacgaaaaagaggcccttttcaagaaaatgaagaaacagcaacggcaacgaaagaaaagggacaaccgcaaactagccaacgatagtgacaatgtcaaggtaaagagagctcggcagcccaaggccaacagtttacctaaactggtaccgccgttgggcatgagcagtaatgctccgatgcaacatgggtacaaatcaagaaacgcacgtgaaaatatcaagcgtgaatccagtgctacctctaatcggaatggctcctccccagtgccaatcacacagcaccaccaacaacagttttctgcaaataattatcccttccctcaacaaccaaacggtatgccttatccaccatactcacctttccctcagccgactaacttccagtatccacctccaccatttgggcaggcgacaccggcccaattctccaacactgttccatatggtagcttacctcccgcatacaacaatatgtcgccgccaacacagcagtcgttcatgccaatgacccaaagtcaaccgccacttccatatggcgtacctcccatgaatcaaatgcaaaacccaatgtacatccaaccgccacctcaagcacctcctcagggaaatggtaatttccaacaagtaatggaattacatcaaatacttttgcagcaacagcaacagcaacaccagtatcagcatcagcatcagcaagatccaagaacctag

SEQ ID NO: 3490 - DNA, 1479 bp, Saccharomyces cerevisiae
atgataatgtcatcaactatgtcgacagaagccgccttggtaccgaacgaaagtgtttttgacacagtttcgtcattcaacgaagacgatgccaattatagcgttcttgatttatacgatgacgacgatgaaggggatgatagttctacagtagaacgaaaagaaatattgacaacacgtgagcttgaaaaagcaaaggcgtttaccagcttaatcatggcagatcctgagaattttgatagatatggatttagcaagaaaggatatttcattagtcaggaagaatacgacaaatggtggacagaatataatagatacaccgaaagaagaaaaaaaaagtgggagaactttcttcttaagaataagattgagctccacaatgataatcctctagtatatcctgcaaggacagatgaattgtcaaaatttgttagaaaaggtataccagcagaatggagagggaatgcctggtggtattttgctggtggacaacgacaattagacgcaaatgttggcgtttatgatagactgaaaagtgactgtcgcgagggtgccgtatctggtaaagatatggaagctatagaacgggatctttatcgaacgtttcccgataatatacatttccataaggagtccttccaaaatggagagccggcgatcatccgatcattgcgtcgagtattaatggccttttctgtttatgacaagactattggatactgccaatcgatgaattttctcgttggattgctattattgttcatggaagaagagaaagcattttggatgctggttattattaccggtaagtatttacctggcgtgtatgaatcagacttagagggtgcgaacgtggatcaaggggtgttggtgttatgtatcaaggaatatttacccgagatatggtcacacattgagtcatcgtatatgaatggcaatggcagcactgaccagatatcagggccagcatcgggggaagaatatctctgcaggctgcctacgctgacgctgtgtacggcaagttggtttatgagctgttttgtgggcgtggtgcccatcgaaacgaccctgagaatatgggactgtttattctatgaagagtctcattttttatttaaagtggctttggggatactgaaattgagcgaaagcgagtttttggagagtaaaagccagaaactgtttagacagtactcttcgtacaccttcggtggtagtaatgactctgattcaactttcaaaagattaaagaacaagattaagacgcaggaagaggcagatatggagattttgcaagtgattcaaaatttcccaaaaagattgctcaatccgaatgatatctttgagaaagtcctgatgaagaagaaggttgcgttgaatggtattacccaggaaaagattgatcgcggtagagagtatgtggcgatggcgagaaatagacaaagggcgagtagccgcccaaaggaaagaagaaaatag

SEQ ID NO: 3491 - DNA, 1479 bp, Saccharomyces cerevisiae
atgcaagatcccaatatttgccagcattgccagttgaaggataatccaggcgcattaatttgggtgaagtgtgatagttgcccgcagtgggtccacgtgaaatgcgtgcctttgaaacgcattcactattcaaatcttacaagttctgaagttctgtcttatccaaattctgcgaagcaaatcaagagctaccgttgtcctaatcataaggaaggagaatatcttaccgcatacgctctcatcacacaaaaaggaaagcggcaaaggaataaagaaaaccctgaagatagtcatataaataagcggtataatttcagaaagaagaaattacttgactatatcgctttgaatgagggtgaatcgaaaagggataaaatgaatcaccctcataaggagagtttcatgaaatcttttgaaaaatggaaaaatggctcaaatattataaacgccgctgactttgctgaaaagtttgataatatagatgtgccgtacaagatcatcgatccactgaatagcggagtatatgtaccgaatgtgggcacagacaatggatgcctcacagttaattatatcaccgaaatgataggcgaggattatcatgttgatgtaatggacgttcaatcacaaatgaatgaaaattggaacttgggatcttggaatgaatattttacaaatactgaaccagacaggagggatcgaataaggaatgttatatcattagaagtctctaatattgagggattagaactagagaggcccactgcagttaggcagaatgatcttgttgataaaatttggagtttcaatggacatttagaaaaagtcaatggggagaaggcggaggagaatgaccccaagccaaaagtgaccaaatatattttgatgtctgtaaaggatgcttatacggattttcatttggattttgccggtacctctgtttattataacgttatctcaggacagaagaagtttttattatttccacctacccaatcaaacatagataagtatattgagtggtctttaaaagaagaccaaaatagtgttttcctcggtgatattcttgaggatggtattgcgatggaattagatgctggtgatttgtttatgattccagctggatatattcatgcagtttatacaccagtagactctttggtatttggaggcaactttttaaccatccgtgatttggagacacaccttaaaattgtggaaattgaaaagttaacaaaggttcctagaagatttaccttcccgaagtttgatcaagtgatgggtaaattatgcgagtatcttgcgcttgataaaaataaaatcactagtgatgtcagtgatggggatttgctttccaggaccactaattgcgcaattcaatcacttcatgcatacgttataaaacctgaagttaagtacaagccgttaaatttcacttcaaagaagcatttagcgaaagctttagccgatcttatttcgtaa

SEQ ID NO: 3492 - DNA, 1479 bp, Saccharomyces cerevisiae
atgcgcccaagaaggagaggattagcgtatcatcataccaagccgaagggacaactttcacaaggacattatcctacgacatccaatgatggccaaagaaggaaggtcggtaattctgaagcattccaatcttttgatatatggaaaaacctagataggataaggtcgactaagaagaatgcagggcaattcataaaaggtagtctgctcatactccccatgagaacggaagataaacaacagttcgacgagtgcatggatgaattgcataagtatatatcgaaggatatattacgatgttatccacagaaagagcagaaagatgaaggcatgcttttctacatagttttgaaggacttcaatatattggactcttgcttcgtattatcagttctgcttgctttccagaagcgattatggatggcaccatccgaaaaatcatactttagagttcctaagaatattaacttgacaggttcgttttatttgcccaagaatatagaaactggtagaggccatataataacaagctatagaagagagcagccctcatccagtattgtagaagttggtttcaatgttgttccagattttcaacagtttcaagttaaggcttgtcatgtaagtaagttcatgaatgagctttctaattttttttcacaagtagaatttggcaagtgtgaagctaacgtgataaactactttaagcgtgaatataaccgcacttattcacagatatcacttgccctctacgaacttccattaattggcgatggcttgtttgatataaagtcgtacattagtaaaaccaggccaattatagaaacatcaaaagctcaaatgattaaacatatttctgaaatgaaggcatataacgaaataagtggccttcaaggagatcaatttccacgacaacaaagacctttatcgaattcgccctcttcaaattcaatttcctcttctcaaactattgaagcaggtgcaacttcatatcaaacacaaccacagagacacgctgttaataagccatcaaatgtattgaattcttccaatcgtcattccgggccaaaaacttttgaggacggaaggtatagtgaaggtaataaaccgggttttatgacgcaggatgaaatcaaacaacattgcattggtaccataaaagcttctatggatgcagtgaaaaagaagtcttcgtatcagattctaaagacatacgttaggtgtccaagacaaaattatattgatattgtttatcaaaatctaaatgatctacgatcaaagacaaattgtaatatcgtcgtattgaatctgaataatcttcacgagtcacaaatgtggcttgaatctttaaatacaacaaattacactatttttgctcaggcgcctcacccaagtaccatccgcgttattagtattggtggagtcggtgaatatatagtcaaagcattagagctgatattgaatatattagaacattga

SEQ ID NO: 3493 - DNA, 1479 bp, Saccharomyces cerevisiae
atgctcgaattacgaagttgtagtaatttggtcaatagtagtaggagacttgtgcctctggtgacttattccggactaagtgcaataacattgcctaaatctcgattttattcacagcctagtgctttagaagtacagggcacatcggattctcgaagcgataatattttagacgaactcaaacaaaggggtctagtgtcccaggtctcacagccagagagtttccttcggacgaagttgaacggtaacgataagatcaaattatactgcggggtggatcccacagctcagtcacttcatttgggaaatctagttccactaatggttttattacacttttacgtaaaaggtcacgacattgtcactgtgataggtggagctacagggaaagttggggacccaagtggtaggaaaacagaaagagacgttatggagaacgatattaggcaaagcaatgtggcatccatctcgcagcaattacaaaggtttttcaaaaatggcctagaatattacagaaaccgatgtgctctcactgaagatgtaccttccggaaaatatacaccaaggaataatttcaactggtggaaagacatcaaaatgttggatttcttagctgattttggtaggcacattcgggtacaatctatgttggcgagggattcaatttcttcgaggcttcaaaccaaaaatggtctgggatttaacgaatttacttaccaagttttacaagcgtacgatttttaccatttgtataaggaagagaatgtgactatacaagtaggtggtaacgaccaatggggaaatataacagccggtatcgatctcatcaataggatacagcctataaagaataagggtttgccatttggtatcactgtgcccttgttgacgacggctacaggagagaaatttgggaaaagtgcaggcaatgctgtttttattgacccctcaatcaatacggcgtatgatgtttaccagttcttttataatactttggatgctgatgtacccaagttcttgaagatctttacgtttttaaactcaagtgaaatcaaaaaaattgtggaaacgcatatcaaatcacccagtctacgttatggccaaactttattggctaaagaagtcacagatatgttatatggagttggctccggatcggattcagaagcgctttctaatattatttttggacgttatgacggaactttatctgctgcgaagttagttgatctatgtaaaaaagccagaattttgcagtatgctgatagagagattgacttaataaagttaatttgtaaactagtaaattgttcagtatcagaagccagaagaaaactttcccagggaagcgtgtatctgcatcattcaaaatctaaagtaaacgaaaatatttctaacttggctcctttcctgatagatgatcgagtactgatcttgaggataggaaagcagaagtgttttataatagaaatgcgttaa

SEQ ID NO: 3494 - DNA, 1479 bp, Saccharomyces cerevisiae
atggagagtcgaactacagggcctttaacgactgaaacctacgatggccccactgtggccttcatgatattaggtgccgccctagtattttttatggtgcccggattgggattcttgtactccggattggcaagaaggaagtctgcactagcactaatctgggttgtattaatggcgactttggtcggtatactgcaatggtatttctggggttactctctagctttttcaaagtccgctccgaataataaattcattgggaatctagattcgtttggctttagaaacgtgtacggaaaaaaattcgatgaagatgcctaccctgagctcgcgtatgcaaccttccaaatgatgttttcgtgcgtcaacttaagtattatcgctggcgccactgccgaaagaggcaggctgctaccgcacatggtttttctctttattctagctaccattggatattgtccagtgacgtattggatttggtcaccaggtggttgggcataccaatggggagtcctcgattgggcaggcggcggcaacattgaaatattaagcgctgtttccgggtttgtttactcttggtttttgggcaaaagaaatgaaaagttactgataaatttcaggcctcataatgtttcattggtcactctaggcacatccatactgtggtttggctggctgctatttaattctgcatcctcattatccccaaatttgaggtcagtttatgcattcatgaatacatgtctcagtgccattactggtgggatgacgtggtgtcttctggattacagatcggagaagaaatggtcgacagttggtctgtgctccggtatcatttctgggctggtggctgcaacgccaagctcaggctgtataaccctttacggttcacttattcaaggcattgtggcgggggtagtgtgtaactttgcgacgaagttgaaatactacgctaaagtagatgatgccatggacattctagctgagcacggggttgcaggcgtaataggactaattttcaatgccctttttggagcagactgggtcattggtatggatggcactacagagcacgagggcggctgggtaactcacaattacaagcaaatgtataagcagatcgcttacattgccgcatccattgggtacactgctgctgtaactgcaataatctgctttgtgctcggctacatacccggtatgaggctaagaatatcagaagaggcagaggaggcgggtatggacgaagatcaaattggcgaatttgcgtacgattatgtggaagtgagaagagattactatctatggggtgtagacgaagattcacaacgctctgatgtaaatcaccgggtgaacaacgctcatttggccgctgaacgtagcagtagcggtactaatagttcctcggatgggaatggagaaatgattcaatccgaaaagatcctaccaattcatcaagaagatcctgccaataggtaa

SEQ ID NO: 3495 - DNA, 1479 bp, Saccharomyces cerevisiae
atggcaaagagcaaaaaaaaaacagatgttgtcgattcaacaaacctgcccattctagaattactatcattaaaagctcccattttccagtctcttttacatcctgaactgcccattataataactggctttggtacaggacatattgtgtgccatcgttatgaccccgctaagttgcaatcgcacctagatcgtagacgtagaattgacactgcaactacaggcaaggatgcaaagaaaggtgtatgcccttggattagattagatatagacctagaaactggagatttgaaatttgttgatattgaagaacaacagcaacaaaagcaaacaggaaaagatgaagacttgggcgtaaaaacactttggaagactaaaagacataaaggtagtgtccgtgccatgtgctttgattctaaaggtgacaatattttttctgttggatcggataatgttttaaaaaaggccaatactatgaccggcaaagtcgtcaaaaaggtaaacttaagctcactgtttaattctgaagagaaaaaaaatgataaatttacgaaattatgcgcctctcaaactcacccattcattttaataggcgatgaatccggtaatatacacgtaataaactcggaaaacttggcattatcaaattccattcgttcgatacattttggcgactctatcaacgatattttccactttgataaaagatctgcatataaattcatttctttgggccagacaacgttagcttattttgacgttcgcgacaaagatgccaaaccgaacgtagctggaaacgaggatggtaaaattttgatcagcgatgatcaggaggacgaagttctttgtggttgtttcgtcgatcccgaagtagcagatacccttttgtgtgggatgggcgagggtattgttaccgtctggaaaccgaataagaatgatttggaagatcaaatgagccgtattaaaattagcaaagatgaaagtatcgattgcattgttcctactttacaagatgataactgtgtatggtgtggttgttccaatggtaacatttataaagtaaatgccaaattgggaaaagtcgtcgagataagaaaccacagtgaattggatgaagtcagttttgttgatctagattttgaataccgtgttgtttctggtggtttggaaaacatcaagatatgggaattatcgagtgatgatgtagaggaaaatgcatcggtagagtccgatagcgacgaacccctctcccactctgatgaggatctaagtgatgacactagttctgatgatgaaacgacgcttgtcgggctctcaaaggaagagctattagacgaattagataaggacctcaaggaagatcatcaagaggaaaaagaatccaactcaaaatctgtcaaaaaaagaaaaataatgaaggagaacaacaaaaaaaaggacctgtatgagcatgggatcaagaagtttgatgatttatag

SEQ ID NO: 3496 - DNA, 1479 bp, Saccharomyces cerevisiae
atggctaatgatcaagatcccaacaagtctctcattaatgacgctttgactcggagtatgtccgaattttatgatgatgatgatgataacgacagtgacatgtgtagggcaaatgatgagggagaagacgtttttgaccttccacttaaggtaggcgtttctcaaagcaggaacttttcagaagtaaatgacgtgttagacccgctttctagtttgcatggtccgtccaagaaggtgagatttgaacagcaaaagcagcaacagcaacatcagcaacttcacaatgacttcaatacagatttcaacctgaaaagcccgtccagtaaaaaaatgggggtagaacagctgatccagtcagccaatgaaatcaacgattacctcgctaacaacattgacaaggtaaatagctttaactcagagctattgagcggcagtggcaagttacctgggagagtaaagagtgacacagcaactcaaggtaccggacgcttagattccatgtccaactttgctcttagcgatacggagttggacaatgatgacgataattatctcctggatccccttgcaaatgctagctctactacacccactgtggaacaccacggttacagcttattagacaaggctttatccacgtctgataaggaaaaaatatatacgaataaagtgaattcgaatagtcagatagatactgataatcactctcacgaaagtggaaacactaccaataacgaaacagatgaaaatgagagttcggagatcctggactacacaaaatttgattctttcccctatcccccgtcttctgcccccaatggggaaccaccagatttgaaagtgctaagcattgaatgtgagcaggaaaatgaaaaagagctacgacgaatatctttattattggatcattacgaatcaataccgaaaataccagaattgtcagacgatgaagcactatctaagttccgtgagaatatcgaattaattttacaactatctaagaaaattaacgataatgcgaacactttagcgatttcctccgaagatcctcaaaaatttgttaattttgtgatgaagaacccaccttccttatcattcagagattttatcgacagaatccagaataaatgcatgtttggtgccgtagtctatcttggagccacctatctacttcaacttgtgtttcttacgagagacgaaatggacggtcccataaagttgaaggctaaattacaggaggaccaagcccataggatcatcatatctacaataagaattgccaccaagctattagaagactttgtccactcacaaaactacatttgcaaagtcttcggtatttcaaaaagactgctgaccaaactggaaatttctttcatggcgagtgttaatttcgatggattaatgattacttgtgaaaaattagaaaaaacattgcatatccttgatgatacaagacaggcattaggaaacacatga

SEQ ID NO: 3497 - DNA, 1479 bp, Saccharomyces cerevisiae
atgtcaaaggcagtaggtgatttaggcttagttggtttagccgtgatgggtcaaaatttgatcttaaacgcagcggatcacggatttaccgtggttgcttataataggacgcaatcaaaggtagataggtttctagctaatgaggcaaaaggaaaatcaataattggtgcaacttcaattgaggacttggttgcgaaactaaagaaacctagaaagattatgcttttaatcaaagccggtgctccggtcgacactttaataaaggaacttgtaccacatcttgataaaggcgacattattatcgacggtggtaactcacatttcccggacactaacagacgctacgaagagctaacaaagcaaggaattctttttgtgggctctggtgtctcaggcggtgaagatggtgcacgttttggtccatctttaatgcctggtgggtcagcagaagcatggccgcacatcaagaacatctttcaatctattgccgccaaatcaaacggtgagccatgctgcgaatgggtggggcctgccggttctggtcactatgtgaagatggtacacaacggtatcgagtacggtgatatgcagttgatttgcgaggcttacgatatcatgaaacgaattggccggtttacggataaagagatcagtgaagtatttgacaagtggaacactggagttttggattctttcttgattgaaatcacgagggacattttaaaattcgatgacgtcgacggtaagccattggtggaaaaaattatggatactgccggtcaaaagggtactggtaaatggactgcaatcaacgccttggatttaggaatgccagtcactttaattggggaggctgttttcgctcgttgtttgtcagccataaaggacgaacgtaaaagagcttcgaaacttctggcaggaccaacagtaccaaaggatgcaatacatgatagagaacaatttgtgtatgatttggaacaagcattatacgcttcaaagattatttcatatgctcaaggtttcatgctgatccgcgaagctgccagatcatacggctggaaattaaacaacccagctattgctctaatgtggagaggtggctgtataatcagatctgtgttcttagctgagattacgaaggcttatagggacgatccagatttggaaaatttattattcaacgagttcttcgcttctgcagttactaaggcccaatccggttggagaagaactattgcccttgctgctacttacggtattccaactccagctttctctactgctttagcgttttacgacggctatagatctgagaggctaccagcaaacttgttacaagcgcaacgtgattattttggcgctcatacatttagaattttacctgaatgtgcttctgcccatttgccagtagacaaggatattcatatcaattggactgggcacggaggtaatatatcttcctcaacctaccaagcttaa

SEQ ID NO: 3498 - DNA, 1479 bp, Saccharomyces cerevisiae
atgtttcatgctttcaccttccttaaaggtggtagattttactcttcactaacagttaaatcattgtacgagcaggtacaccatactagccatgatcccatttcaattaatggatggatcaaatccataagactattaaaacgtatagcgtttttggatttacaagatgggacttctgtgaacccattaagaatagttattccactcacaaatactgatgaagtacagttcctaaaaattctgaaaactggtcaaactttatctatatctaatgctacctggcaaagcacccctaatagaaaacaaccttttgaattgcaaatcaaaaatcctgtcaagtcaattaaacttgtgggtcccgtttcagaaaactatccattacaaaagaaatatcaaaccttacgttatttaaggtccttacctacactaaaatacagaaccgcttacttaagtgcaattttacggttaagatcctttgtagaattccagttcatgctatatttccagaaaaaccacttcaccaaagtttcaccaccaatattaacttcaaacgattgtgaaggtgccggcgagttgtttcaagtctccaccaatacgtcgccaactgcatcctcgtactttgggaagccgacttatttgactgtgtccactcaattgcacttggaaattttagcgttatcactgtcaaggtgttggacgttatctccttgctttagagccgaaaagagtgatactccaagacacctttcggagttttggatgcttgaagtggaaatgtgctttgttaatagcgtcaacgagctaacatcgtttgttgagactacaataaaacacataattaaagcttgtatagataaccaacaagaactcttgccgaagcaatttatctcttcacaagaaaataatgcatcgtcagagctatcaataaatcaagagacacaacaaattaaaacacgatgggaagatttaataaatgaaaaatggcacaatataacgtataccaatgcaatagaaattctcaagaaacgccacaatgaagtttcacactttaagtatgaacctaaatggggacagcctttgcaaactgaacatgaaaaatttttagccggagagtattttaagtccccagttttcgttaccgactatccacgtctttgtaaaccattctacatgaaacaaaattccactcctgacgatactgttggatgctttgatctactggttcctggaatgggtgaaataattggtgggagtttaagggaagatgactatgacaagttatgtagagaaatgaaagcacgcgggatgaatagatctggagaattggactggtatgtttctctgagaaaagaaggaagtgcaccacacggaggctttggtctagggtttgagagatttatctcatacttatatggcaaccataatataaaggatgccatacccttttatagaacatctgcagaatccatcgatttttga

SEQ ID NO: 3499 - DNA, 1482 bp, Saccharomyces cerevisiae
atgaataaagacgtcgactatcaaacttttaaaaaaagtttaagaaaagaatttaaaaaagctgtgaagactatcctaaatttacaagcatataatggtgatttgataagggactttttggctctttatattccgtaccatgtagttttttataatctttcgatcatgaaaaaaggttcaccattaaggattcaaaccaataaccttctgaaagaagcgctggccaaaattttaaactttaatcttgcgatgggtccaaaacatatcatcaagataatgaagaaagataaagccgatccagagacaatgaataaattaaaactggtactatatataaaattatttcaaggagtatttggtcatgtagataaaaattataacctcgcatttcaatcttttcgctggtgcttacaattcattgcgtactcaaaaaggacaagactatttgcaagtatcgcagacgagcaaattggagctttttatgaactttgcgaactatttatatccatgttgtgttgccactgttttctaattgatttgaaagaaaatgaagcattggtaggcaataatctaaaaaattttatcaaaagacaaaaccctaattattcccatggcttcgatttaaatgaggagaccaagtcacttcaatggcactggtcactcgacgaggtagatgttattgaggcgttatactgcgtcgctttcgatgcgatggataagataacgcttaaattttcaaaggtcaatgaaaattttgtttttagtcagttttttcagtattgtgcagaaatcgaagaaatgttagccattctgagaggaaaaatttgggagtgtgaatgtgatgtgttcggtcccagaatcggactattagtagatagtaaccacatgaatgaaacaattcaaaaaaatattctgtcaataactttcaaacttaaaaatgaccctcagattatatgctgcttgaataaaattctggaaggcttattactttcatcaggtgttcaatttaaagttatccagtttttttatgtattaaaactatactatatgcaagataatgaatacacattcgaagcatcatctgaaatggataaattgaccatagaatgcttatgtatcatcgaaaatattattgatgcttgtgacaatcctgatgaagtaactgactaccaactacctaaggtactgttgactgctatggaggggaaattacttgttgctgaaaaaatatccgaagataatgactgttcagaatctctggacgattatcatccccgaacttaccaattcagacatcccagaataataatagacaagatgaaaacaaaattgaagcagaaactgcgctttgactcacctaaagatccagaaacagatgatcattggattgagtattggaaatattgctatcaggataacatagggaacttgccggacattttgtcacgtatatatcaaacctttactgatccctccaattaa

SEQ ID NO: 3500 - DNA, 1482 bp, Saccharomyces cerevisiae
atgacggttttctctggagtaaataaaatagagtttgaaggtactttcgaaggtattggaaaggatgttgttatgtcacaaatgataagggccttgcagaaacattttccttcgatacgtgacaagaattatgagtttagcctatttttgcacatttttcaaagatatgtcttagaaaatacttcaatcacccatgatctagtttgtgacaaaattagattaccgataattgatgaagtggttgaactcgatgatattaaaaattacggtttgttagagggtaaactattatcaaagttagctattttaaaattaaccggaaaggctaatccaatcattggtaaagaaagccctttattcgaagtaaaaaatgggatgtcttcattggatgtaatagttcgacaaacgcaaaatttgaatgtacgatataattcagacgttcctcttatatttatgacctcgcttgaaactgaatctcaagtatcaaacttccttgaagagcattattcttctagcaaagtgagatggaaaaccgtagttcagtcaagctttccacaaattgataaagatagattattacctatcgatttacaaataaattctcatgaaaatgatttttggtatccttgcgggactggtaacctaactgacactttgtatttttcaggagaattggacaaattaattgctcaaggaaaagagattttatttgtttcaaatgttgacaatttgggcgctacaggagatttgaacattttaaatttcatcataaatgaaaaaatcgagtatcttgttgaagtagttgaaaggactgcaaatgtttcaaacactggagtgttggcaacatataaaggtaaactacgatcggtttattacaactgcttatccaatgaaagtgcaagcacgtgtcgaattgtcaacactaataacatttggattgatttgaaaaagctaaaggtgctaatagagtctaatagtttaaatttgccaattcattctagtgaaagtaaaataacacacaaaaatgaagagatagagtgtcttcaatttaagacacagttggtcgattgtattgccttctttccgaacagtcgagtattgaaagtatcaagagacagatttttacccctaagaacatgtaaggacttgtttttgttgaaatcaacattatatgatctcgattcaaatggaacatttaacctctaccctctgaaatttggattattaccttcaatcgacttgggcgatgagtttgcaacttatgagacttttaagataggagtaccagatattcctaatattctggaattagagcatttaactgtgatgggaaatgtgttttttggtcgtaatataactctgaaagggacggtcattataatatgtgatgaaaatgatgtaattactgttcccgatggctctattttggaaaatgtaacgatttggcataaatctcagctggaggatatgaatggatattaa

SEQ ID NO: 3501 - DNA, 1482 bp, Saccharomyces cerevisiae
atgagctttgttcaaataaggcacatttcttcacaaataaaccgtaagactgtatccattgttggatcggggccttccggcttttatacagcgtaccatttactcaagaagtcaccgattccattaaatgttactatatgggaaaagttacctgttccttttggtttaagtagatatggtgtggcacctgatcatccagaagtcaaaaattgtgaagaaacgtttaccacatgtgcagaagagttttcttcccctacaaaccaaaagcataaattttcctttgttggtggtataaccattggaaaagaaatattgttgaaggaattgctggataatcaagatgctgttattttaagttatggttgtacaggggacagaaagctgaatatccctggcgaactcggaacaaaaggggtgtttagcagtagagaatttgtcaattggtacaatggtcatcctgatttcgcaaaggataagcgatttaccgattttgactggagcaaagtttcgaaagttggtattataggaaacggtaacgttgctcttgatattacgcgtgtacttatttctaatcaaattgatgaaatatgggaaaatacggacatctcatctcttgcactaaatttgctaagaagggcacctgtaaaggacgttaagctaattgcacgaagggatttcgttcattccaaattcaccaacaaagaattaagagaactatgggagttagaaaagtatggcatacgtggccgtattgatcctaaatttttccagaaagaaatgtttgacccatctaagtacgatcgtgcattcaatagacgagtagagatgtgtagtgagtatctcaagccatttaatgaacgttcgaagaaaaactataaaaaggctcctcctccaagcagcggatatgacaaattctgggagttagattatttgaagactcccttgaaaattaatagagacgattttggtgcaatcaactctttgagtttatgtaacaatcgattaaatgaagataacagtttgcaacccttgaaggacgtcaataatattatgacatataaagtggatttgctgattacttcattgggatatgcaggcgttcccatgcctgaattctctaagttgtctattggatttgacaaagatcatatagctaataaacagggtcgtgttttaacttccagcggagaaatattcccacatttatatgcatctggttggatccgtaagggcagccagggcgttattgcctcgacaatgcaagatgcttttgaagttggagacagagtaatacaagacttggtggtcagcggagcgctatccttagagaattctatcgacctctctaatatcaagcacaccacatggaaggattgggaaagaatcaacaagaaggaattgcttcggggcaaaaaggaacacaaaactcggtcaaagtttttaacttttgaagagttgtggaacggtgtagaaggcatataa

SEQ ID NO: 3502 - DNA, 1482 bp, Saccharomyces cerevisiae
atgagtaacgatgaaggagaaacatttgccacggaacagactactcaacaagtttttcagaagctaggtagcaacatggaaaatcgagtttgttttgattgtggtaacaagaatcctacttggacttcggtaccttttggtgtgatgctgtgtattcaatgctctgctgtgcatagaaacatgggtgttcatatcacctttgtaaagtcttctacattagataaatggacaattaacaatttaagaaggtttaagttgggtgggaaccataaggctcgtgattttttcttaaagaacaatgggaaacagctactaaatacagcaaatgttgacgcgaaaacaaaatatacgagccctgttgctaagaaatataagatacatctcgacaagaaggttcaaaaggatatggagttatacccatcagaattagtcttgaacggtcaagattcttcggactcaccgttggacaccgattcagacgcttccaggtcgacttccaaagaaaatagtgttgacgattttttctctaattggcaaaaaccaagctccaattccagttctaaactcaatgtaaatacaggctctctcgccccaaaaaacaacaccacaggcagcacacccaagaccactgtcactaaaacgagaagttccatcttaacggctagcagaaagaaaccggtattaaactcgcaagataaaaagaaacattcaattttgtcttcgtcaagaaagcccactagactaaccgcaaagaaagtcgacaaatcacaggcagaagacttgtttgatcaatttaaaaaagaggctcaacaagaaaaggaggacgagttcactaattcgtcttctagcaccaaaattagacaaaatgattacgattcccaatttatgaataacagtaaaggcaacaataataacagtatagatgatattaatacccagcctgatgaattcaatgattttttaaatgacacttcaaacagcttcgacacaactagaaaagaacagcaagatactttaacacccaagtttgccaaattgggatttggtatgaccatgaatgacgccaatgatttggcaaagcaacaaaaagaatctcagaaaatagctcagggaccaagatatacgggcagaatcgcggaaaggtacggcacacaaaaagctatatcatctgatcaattatttggtcgtggctcatttgatgaagcagcaaacagggaagcgcatgacaagttgaaaacatttgacaatgctacatcaatttcctcttcttcatactttggagaagataaagaagtggatgaatttggtaatcccatcaatagtagtggaagtggagcagggaattttgatggccgtaattctaataacggtttcatcgattttaatgcctccgcagatgatgaattgcagatgttgagagacgttgtagaacagggtgctgaaaaactcggtagttatttaagggactacttaagaaaataa

SEQ ID NO: 3503 - DNA, 1482 bp, Saccharomyces cerevisiae
atgctaccctatatggaccaagtactaagggcattttatcagagcacccattggagtacgcaaaatagctacgaggatataacggccacatcgagaacattattagatttccgaattccctcagcaatacacctgcaaatttccaacaaatctactcccaatacattcaattctttagatttttctacgaggtccaggataaatggttctctgagttatttatactccgatgcacagcaattggagaaattcatgcgcaactctactgatatcccattacaagatgccaccgaaacatacagacaattgcaaccaaacctcaatttcagtgttagtagtgcgaatacgttgagtagtgacaacaccacagtcgacaatgacaagaaattactacatgactcgaaatttgttaaaaaatccctttattatggtagaatgtactaccccagctctgatttagaagcaatgataataaaacgactaagtccacaaacccaatttatgcttaagggtgtcagtagtttcaaagaaagcttaaacgttttaacgtgctattttcaaagagattctcaccgcaatttacaggagtggatattttccaccagtgatctattatgtggttatagagtattacacaatttccttaccacgccttccaagtttaacacctcactgtacaataattcttcgttgtcgcttggtgctgaattttggttagggttagtaagtttaagccccggttgttcgacaactttaagatattacacacattctacaaacacaggacgaccactaactttgacattatcttggaatccattattcggccatatatcctccacatattcggccaagacagggacaaattctactttttgcgcgaagtatgattttaatctttattcgattgaatcaaatctttcatttgggtgcgaattttggcaaaaaaagcatcatttgcttgaaaccaataaaaacaataatgataaattagaaccaatctccgacgaattggttgatataaatccaaacagcagagcgactaaactactgcacgaaaatgtaccggatctgaattcagctgttaacgatattccttctacactagatatacctgttcacaaacaaaagctattaaatgatttaacttatgcattctcgtcgtcattaagaaaaatcgatgaagaaagatctaccatcgaaaaatttgataacaaaataaatagttccatttttaccagtgtttggaaattaagcacgtcattacgtgacaagactttaaaactattatgggaaggcaaatggaggggatttttaatatctgccgggacagagctggtattcactagaggctttcaagaaagtttatccgatgatgaaaagaatgataatgcaatatctatatcagcaactgatacagaaaacggcaatataccagttttcccggcaaagtttggcatacaattccagtactccacatga

SEQ ID NO: 3504 - DNA, 1482 bp, Saccharomyces cerevisiae
atgcttcttttcgagcaacctgttgaccttgaaaaaaataatgaagatgatacgaacataaaacctttcgcaatatcacgacattttttattgaaacttttgctttgcggtataatactcattgagttgcttttatattcgaagtgcccaaaacctattgataatgggccccggacaattgcgaatagatcaaatacttacttcaacggcacacatgatttcaagacgttaacgatattgatatctatcgatgggttccatccgagattgatagatgcaaaatacacgccatttctttacaacttgcacaatttgcggtccccgtacgatatgaatatcacgactgcaccgtatatgatcccaagttttcccactcagacatttcccaaccactggagcatggtaacgggaaaatatcccattgagcacggtattgtttccaatatattctgggataatttcacgagtagcgaatttagaccaaataacctcgacgcaagaatttggagcaacacggctgaccctatttggcaactactgcaaactgaatcgcaaggcgaatataaagtggccacgcatatgtggcctggaagtgaggttgtgtatgaggaccacggggatgtacctagggaaagaatgccattttattttgggaaattcaatcaatgggaaaaacttcaagataaattagctcaaattttccgatacatagatatgcctcagcttaaagataggccagaattggtcataagttatatacccaatgttgattcgtacggacacagttttggatacgatttacgagataagcggctacaaaagctgatcggtgaagtcgatggattctttctcgatttgattgaaggcctgcaaaaaagaaacttgttgaaaattagcaatgttatgattgttagtgaccatggcatgagcaatgtcaacgcgaatgacggtgagcatgttgttgtgtgggaaagggtgttcccggccgacgcaatgagcgcatttatttcgcatctttataacgagggccccatgatgatggtatgtttgaaaaaccctcgagacaagcaatggatttgtgacttgattgaagctcagttagagaaagcatatggagatgaaatatcgaggaagtttcacgtgatcctgaaagaagatttcgacccgagctggaaatatttccaatacgataacagaaagcacagatatgacgatagggtcggcgatatctggattctcgcagatgaatactacgccattgtaaaagaaatgggtgatgtgcctatcggcattatgggcacacatggatacaactttaacaactgtagtgatatggcatctatattcattggaatgggtccgatgttcaacaatgaagtcgtacctccatttgaaaacatcgaagtatacaatatgctgatcaaggcaagtgcgcttttgggagaagaaaagacaaagaaggagaagagtttattacaataa

SEQ ID NO: 3505 - DNA, 1482 bp, Saccharomyces cerevisiae
atggagtgccagaggtgccctgcatctgccagaaatccagcgacagttgagtctagaaaggaaaagttttgcgatgaatgtttcatcaagtttgttagtactaaacaaaggaaacaaatgatgaaggatgaatatttcaggaacctatttaaagttatatacccatttgaaaaagaaggatccgtctctaagattctgctccccttatcacattctgattcaggatctctggttatgttagatattgtgcacgacttgctattggaacaaactaagcaacacaataatcgtacaggctttaccgtcgatgtactcacggtattcaccgaggaaaatgtttctgttatcaaagaacgtatggaatccttgattaatgaaaaaatgtcacaactgaataaaatatccaacatatttaatgtccattttattgatgttaacgaatttttcaacaatgcatcggaagtatcgacttttatcattgacaatgaaaattttgagattttcagcaagtcaaagtcagtagatgatagcaatatattaacattaaaagaaatattaggcaaatactgtctcaataattcatccaggtctgatttaatatcgattataaaaactcaattgatcaagcattttgcatacgaaaatggttataatgccataatgtggggacattccatgacaaagctatctgaagtaattatttctcttgtggtaaaaggtaaaggttctcaaatagcgacgtttctagactcggaatcatttgatactttgaataataaaccatgtaagtataaaaacctatatcctatgaaagatctattatccgtcgagattgaaagttttttacaaatcagaaatctggcacagttcctcattaacgttgaagaaactaatgtgaagcctaattgcttgatcgccagaaaatcactgccgtcacttggtcaacaaaaattggtaaaaaatatgacaatcaacgaaattaccaacaaatactttcaggatattcagaacgattattcaaatataatatcgacagttttaagaaccgcagataaattgacgcaacctaaatcaagtatggctaagccgtcacaatgtcaaatatgtcaatctaaaatatacacaaatccatccaattggttaaataggatcacagttacttcgccttatcctgtggagaccactgaagaaaagtatttatttaaacagtggcaagattcaaaattagggcaatctcacacacattatgttgaattgttgaatgaaatcaaacagggtgccagtaatagcctcgatgttgaagacggtgatgtcaaattgtgttatggttgtttaatcttattgaataccagtatcaaggataagaatttggtttggccaaaagtcgataccatggatattacggcaaatgcgaccaataaaaacaaagaattgagccaaatattggatcagttcgagattaattccgatggggaggaataa

SEQ ID NO: 3506 - DNA, 1485 bp, Saccharomyces cerevisiae
atgactaactggcagcaacagcttcctttaacagatacacagaaaaatgaactcgataaaagtgtcctccgatatttgaattggaattacaaacaaactgtacgacatgagcatgctcaagattacgaaagtgttcgacatgcaattgtaactctatcaggttttctgttgcaagaatcagtggaccggcaagaattcatcagtaacaatgacaccagtaacgaaagtatggtagacattgatgaattactgctaccgaagaagtggaactcaattgttagactacaaaaaaaaatcattgaattggagcagaatacagagacccttgtatctcagattaaagatttgaacactcaagtgtcagaactagcacaattcaaacctaccaccagtaacggcaccagcgcacataatgttttgaaatggataccgagaaatctaccaagctgtttaattaatgttgaatcatctgtcacttccgtcaaactacatcccaatttgcctatagtgtttgtggccacagatcatggcaaattatacgcatttgatttatttaactacaccatccctctggcatccttgcaaagtcataccaaggcaattacctccatggatgttttatttaccaattatacgaactccagcaagaagaactatttggtgatcgttaccgcgtctaaagatttgcagattcatgttttcaagtgggtctccgaggaatgcaagttccaacaaattaggtctttattgggccatgagcatattgtctctgcggtaaaaatctggcagaaaaataatgatgtccatatagcgtcctgttccagagatcaaactgttaaaatttgggacttccacaatggttggtcgttgaaaacatttcagcctcattcccaatgggttcgttccatagacgttctaggcgattacatcatctctggttcacatgacactacattaaggttaacacattggccatcaggtaatggtcttagtgttggcacgggtcatgaatttcccatagagaaagttaaatttattcatttcatcgaagactctccggagataaggtttagaacaccatcaacggatcgatataagaattgggggatgcaatattgtgtctcagcgtcaagagatagaacgataaaaatctgggagatacctctacctacgttaatggcccatagagcacccataccgaatcctacagattcaaatttcagatgtgttcttacgttgaaggggcatctttcgtgggttagagatattagtattcgaggccaatacttgttttcttgtgctgatgataaatctgtcagatgttgggatctgaacacggggcagtgcttacacgtttgggaaaagttgcatacaggatttgtcaactgtttagacctggatgtggatttcgattctaacgttaccccaaggcaaatgatggtcactggtggattggattgcaagtctaacgttttcatgagataa

SEQ ID NO: 3507 - DNA, 1485 bp, Saccharomyces cerevisiae
atgagctctgaagaggactatttcgatgagctcgaatatgaccttgccgatgaagttaatgaggaaaaagaagacatacaaactaaaaagctcactacggtaaattgtcaaacagaaaaattcaatccattcgaaattcttccggaaagtatagaattattcaggacgttggcactcatcagtcctgataggttatctctatcagagacagcacagattttaccaaaaattgtcgatttaaaaagaatccttcaacaacaagaaatagatttcattaaactgttaccgttttttaacgaaatcatccccctcatcaagagcaatataaaattaatgcacaattttctaatctcactgtacagtagacgttttccagaactatcttcattgataccatcaccattacaatactcaaaagtgataagcatactggaaaatgaaaattattcaaaaaacgaaagtgatgaactatttttccacttggaaaataaagcaaaattgaccagagagcagatcctcgttttaacaatgtccatgaagacgtctttcaaaaacaaagagccattggacatcaaaacgaggacgcaaattttagaagcaaatagcatattggaaaatttatggaaactacaagaagatataggtcaatacatagcctcaaagatatcaataattgcccctaacgtgtgtttcttggtaggcccggagatagcagcccaattaatagcacatgctggaggggttttggagttcagtcgcattcccagttgcaacattgcgtccattgggaagaataagcacctctcacatgagttacatacattagagagtggagtacgacaagaaggatatctatttgcttctgacatgattcagaaatttcccgtttctgtccataaacaaatgcttaggatgctttgtgcaaaagtatcactagccgcaagagttgatgctggccagaaaaacggtgatagaaatacagttttagctcataaatggaaagccgaactatcgaagaaagctagaaagctatcagaagccccgagcatttctgaaacgaaggctctacctattccggaggaccaacccaaaaagaaaagagctgggagaaaatttaggaagtacaaggaaaaattcagactatcgcatgtcagacaattacaaaataggatggaatttggcaagcaagaacaaactgttcttgattcctatggtgaagaagttggtttgggtatgtctaatacttctttacaacaagcagtaggagctacatcaggttccagaagatctgctggtaatcaagccaagctaacaaaggtaatgaagcacaggatttctgaggctaatcagcaagctgacgaattcctaatctccttgggtcataatacagagcaaccgaatctgtcgccagagatggttcaaatgcacaagaaacagcatactaacccagaagaagagaccaattggttttccggtcatggttag

SEQ ID NO: 3508 - DNA, 1485 bp, Saccharomyces cerevisiae
atgcagaggtggctacaactgtggaaaatggatttggtacaaaaagtgtctcatggcgtttttgaaggctcgtccgaagaaccggctgctcttatgaatcatgattatatagtattaggggaagtatatcctgagcgagacgaagaatctggcgctgaacaatgtgaacaagactgtcgatatcgcggtgaagcggttagtgacgggtttttaagctctctttttggtagggaaatttcttcttacacaaaggaatttcttttggatgtacaatcaagggtcaactttacatatcggacaagatttgttcctatagcaagggcgccagatgggccttcacctttaagtctaaatttattagtacgtacaaatccgatcagtacaatagaggactatatagcaaatcctgattgctttaacactgatattgggtgggggtgtatgataaggacaggacaaagtttgttggggaatgccttacaaatccttcatttgggcagagatttcagggtaaatggtaacgaaagtctggaaagagaatcaaaatttgtaaattggtttaatgacacgcctgaggctccattttcgttacataactttgtttctgcaggtacagaactctctgataaaagaccaggtgaatggtttggtcccgcagctacggcaaggagtatacaatctttaatatatggcttccccgaatgtggcatcgatgattgtatagtatctgtttcatccggcgatatctatgaaaatgaagttgaaaaagtatttgctgagaatccaaatagtagaatattgttcttgttgggcgtgaagctcgggattaatgcggtaaatgagagctatagagaaagtatatgtggtatcttaagttcaacacagtcagtaggcattgccggcggtaggccgtcttcatcgttgtatttttttggttatcaaggaaatgaatttttacatttcgatcctcatattcctcaaccggcagtagaagattcatttgtagagtcgtgccataccagtaaatttggtaaattgcaactatcggaaatggatccctcgatgctcattggtattttgattaagggcgaaaaagactggcaacaatggaagctagaagttgcagaatctgctattatcaatgttcttgctaagagaatggatgactttgatgtgagttgtagtatggatgacgtggaaagtgtaagttctaactcaatgaagaaagatgcaagcaataatgaaaatctcggagtactagagggagactacgtagatattggtgcaatattcccacacacaacaaatacagaagatgtagacgaatatgattgttttcaagatattcattgcaagaaacagaagattgttgttatgggaaacacacacactgttaatgcgaatttaacagattatgaagtagaaggcgtccttgtagagaaggaaacggtaggtattcacagtcctattgatgaaaaatgctag

SEQ ID NO: 3509 - DNA, 1485 bp, Saccharomyces cerevisiae
atgctgctgaaaaattgcgagacggacaagcagcgagatatacggtatgcgtgtttgttcaaggaacttgatgttaagggaaatggtcaagttactctagataatctgataagtgcttttgagaagaacgaccatccgctcaagggaaatgatgaggcaatcaaaatgctgtttactgcaatggatgttaacaaggactctgtagttgatttaagcgatttcaagaagtatgcttccaatgccgaatctcaaatttggaacggcttccagaggatagatttagatcatgacggtaagattggcattaacgaaataaataggtatttgtcagacctcgacaaccagagcatatgtaataatgaacttaatcatgaactttcaaatgaaaagatgaacaaattctcgaggttttttgaatgggcgtttccaaagagaaaagccaacattgcgctacgaggccaggctagccacaaaaagaatactgataatgatcggtcaaagaaaaccaccgactcagatttatacgttacatatgatcaatggagagactttttgctgctggtaccgagaaagcagggttcgagacttcatactgcttattcctatttttacctattcaacgaagatgtcgatctgtcctcagagggagatgttactctcataaacgatttcattcgcgggttcgggttttttattgctggtggtatttcaggtgttatttcaaggacttgtaccgcgccatttgatagactgaaagtgtttctcatcgcaagaacggatctatcctcgatcttgttaaattcaaaaacagatctccttgctaaaaaccccaatgctgacataaacaagatatcatctccattagcaaaggctgtcaaaagcttatataggcaaggcgggataaaggctttttatgttgggaacggtttaaacgtcatcaaagtttttccagaaagttcgataaagtttggttctttcgaggtcaccaagaaaataatgaccaaattagaaggctgccgcgacacaaaagatctttcaaagttctctacttacattgctggtggtttagctggtatggcagctcagttttccgtttatcctatagatactttgaaattcagggtgcagtgcgctcctttggacacaaagttgaaggggaataatttgctctttcagactgcaaaagatatgtttcgagagggggggggtcagattattttacagaggtgtcacagtcggtatagtgggcatatttccctatgctgcattagatttggggactttttctgccttaaaaaaatggtatattgccaaacaggcaaagaccctgaacctaccacaagatcaggtcactctaagcaacctggttgtacttccaatgggtgcattcagtggaactgtaggagcttctgttgtttatccaatcaatcttttaagaacaagactacaagcccaaggaacatatgcacatccttatgtgtataa

SEQ ID NO: 3510 - DNA, 1485 bp, Saccharomyces cerevisiae
atggacttaagagtaggaaggaaatttcgtattggcaggaagattgggagtggttcctttggtgacatttaccacggcacgaacttaattagtggtgaagaagtagccatcaagctggaatcgatcaggtccagacatcctcaattggactatgagtcccgcgtctacagatacttaagcggtggtgtgggaatcccgttcatcagatggtttggcagagagggtgaatataatgctatggtcatcgatcttctaggcccatctttggaagatttattcaactactgtcacagaaggttctcctttaagacggttatcatgctggctttgcaaatgttttgccgtattcagtatatacatggaaggtcgttcattcatagagatatcaaaccagacaactttttaatgggggtaggacgccgtggtagcaccgttcatgttattgatttcggtctatcaaagaaataccgagatttcaacacacatcgtcatattccttacagggagaacaagtccttgacaggtacagctcgttatgcaagtgtcaatacgcatcttggaatagagcaaagtagaagagatgacttagaatcactaggttatgtcttgatctatttttgtaagggttctttgccatggcagggtttgaaagcaaccaccaagaaacaaaagtatgatcgtatcatggaaaagaaattaaacgttagcgtggaaactctatgttcaggtttaccattagagtttcaagaatatatggcttactgtaagaatttgaaattcgatgagaagccagattatttgttcttggcaaggctgtttaaagatctgagtattaaactagagtatcacaacgaccacttgttcgattggacaatgttgcgttacacaaaggcgatggtggagaagcaaagggacctcctcatcgaaaaaggtgatttgaacgcaaatagcaatgcagcaagtgcaagtaacagcacagacaacaagtctgaaactttcaacaagattaaactgttagccatgaagaaattccccacccatttccactattacaagaatgaagacaaacataatccttcaccagaagagatcaaacaacaaactatcttgaataataatgcagcctcttctttaccagaggaattattgaacgcactagataaaggtatggaaaacttgagacaacagcagccgcagcagcaggtccaaagttcgcagccacaaccacagccccaacagctacagcagcaaccaaatggccaaagaccaaattattatcctgaaccgttactacagcagcaacaaagagattctcaggagcaacagcagcaagttccgatggctacaaccagggctactcagtatcccccacaaataaacagcaataattttaatactaatcaagcatctgtacctccacaaatgagatctaatccacaacagccgcctcaagataaaccagctggccagtcaatttggttgtaa

SEQ ID NO: 3511 - DNA, 1485 bp, Saccharomyces cerevisiae
atggataagtacggacatatagctcatcaagaaggcgatgtttgttattatattccaaggctgttcaaatacaacagttattatagtgggacagaggacgttcgaatatttgttggagatttaaagtaccggatgagagtttctttgcaaatttgcgaaaagtattatgataggcggttgtcgatgttgttctggaaaaatcatcctttacagcaaatacaccttattggctgcatcattggactccagttcaaatggattgggaaacaagaatacattttttttcagttggacgattgtacttcagactcttcattggtgggttatactagtgacatgagattcttaacatgtaaagttaagaaggatagcatcctatcatgggggttgaacataaccgatttgataggcttaactcttcatgtctacgggcaagcaagtttgaactatcaagagcttcaagttgaatatttaagattatgctacagtttaacggaagaaatagatcattggaaaatcacaatgaacatgcgtgagcaacttgacacgccttggtccttaagcgattttgtaattggagaattgttcacgcaagagcaagagtggacacctgagacatcacagattgaggtagtaaacccggattttgtaggtatagggtacaaaaccccagaaagtaaaagaaatgaaactactttcatcgagcaactgcaagaagaacgcttgaaggatgaattagaaattattagtccatacaatagcacagatacttcgaatagtgtgcattccttgtcatttcggtttgtatcgtcgctaaaggattttcctgaaactcactttttgaattcaggtgatcaaattgacaacggcaatgacgaacagttaaaaaaactagaatatcaaagcgctaatctacctgtgatgattcccaataggacatcagcaaagtcaaacttgatgttgatcctattaggactacaaatgaaagagatttctaattctgacctttacaaactaaaggaagtacgcagcgtagtaactagcttagcatcgtttttgtttcaacaacaaaatgttggcgtcatgaaatcttttgactctttggaaaaggaagcgtttcgagacctggttaatcgtctagtcagccagggtttgatcggattaaaagataaaacaagtgagacatttgatttgcttcctctaaaaaatctttttgaatatgctgaaaaacgtatatcagttctaatgaagctacaatgttatacaggcactgtgcaattaagtcatgttcaggaaaagctacatttgccgtacataacaacgaacggcatcgttgatgttttcaaagaatgtcttaaaaggacaaagaaacagtatcctgaggtactaaaaaattggtggattgatcttgatccgaagaatggtatggaggaccaaaacagtggaatattattacatttggaatacgcagcagcatattcataa

SEQ ID NO: 3512 - DNA, 1485 bp, Saccharomyces cerevisiae
atggatgatttttcaagagataccgaaaactttgtttgctggttaaaaactaccgctgaaattgaagtatcccctaagatagaaatcaaagatctttgttgtgataatcaaggccgcgcagtagttgccactcaaaagattaagaaggatgaaacattgtttaaaatacctcgtagttctgttttaagcgttacaacatctcaactgataaaggattatccttctctcaaggataagttcctgaacgaaaccggatcgtgggaaggtttaattatctgtatactttatgagatggaagttttgcaagaaagaagccgatgggcgccttactttaaagtttggaacaaaccaagcgatatgaacgcgttaattttttgggatgataatgaactgcaacttttaaaaccatcacttgtccttgaaagaataggaaaaaaggaagccaaagagatgcatgaaagaattattaaatcaatcaaacaaattggtggagaattttcacgtgtagcgacgtccttcgagtttgataattttgcctatattgcaagcattatattgagttactcctttgatttggaaatgcaagatagtagtgtaaatgaaaatgaagaagaagaaaccagtgaagaagaacttgaaaatgagcgctacttgaaatcgatgattccacttgctgatatgttgaatgcagataccagtaaatgcaacgctaatttaacttacgactctaactgtttaaagatggttgctttgagggatattgaaaagaatgaacaagtgtacaacatatacggagaacatccaaattcggaactactaagaagatatgggtatgttgaatgggacggttcgaagtatgattttggagaagtgttacttgaaaatattgtcgaggcgttaaaagagacttttgagacgaatactgaatttttggacaggtgtattgatatcttacgcaataacgccaatattcaagaattcttagaaggtgaagaaatagtactagattcatatgattgttataataatggtgaattgttgcctcaactaatacttttggtccaaatcttgacaattctttgccaaattccaggtttatgcaaactggacataaaagcaatggaaaggcaagtggagagaattgtaaagaagtgtttacaattgatagaaggtgcccgcgccactacaaactgtagtgccacatggaaacgttgtattatgaagcgtctagccgattaccccataaaaaagtgcgtttctatcgaaaaaccttcgaaaggaaactcattaacaagggaagaactaagagatgttatggctcggagagttttgaaaagcgaaatagattcgctgcaagtttgtgaagaaaccatcgacaagaattacaaggttattcctgatgaaaagctgctaactaatattttaaagagaaagttgacagaggaagaaaaaagctctgtcaaacgtccttgcgtgaagaagtga

SEQ ID NO: 3513 - DNA, 1488 bp, Saccharomyces cerevisiae
atgaaaactgatagattactgattaacgcttccccggagacatgtaccaagggagatgctgagatggatactatggatactattgacagaatgacatcagttaaagttttagcggaaggcaaggtattaagcaacttcgaagaaccgggcttaatgaggtgcggttatcatgatgcaaaaaactgggtcagaagattatcgagcgaaacaattgtcggtgaggacacgagtaatttatacccattttatgttgatactgcatacgatgtaaggcgtttgagaaaggatcttataaatgctaaggttgacttgcaggttgaaaacctgataataatctgcaatattaatgatatttccactgtatttctcatgagagaagtggtggaatggatcttacgcaatttccattcaataactgtatatgtacaagatatttttaaaaagtcaactcagtttgctgttggtgacctctgcaaagacagcaattgcagtaaaaacagagtaaagtattggtcaaaagaatttgttaaaaaacacgattcattctttgacttgatgattacactagggggtgatggaactgtcctttttgcttcatctatattcacgaaagatgttccgccgattgttccatttgcccttggatcattaggatttctaacaaattttgaatttcaaaatttcaaagaaacgttgaaacatatcttaacagatgaggttcgtattaatttacgaatgaggttgcaatgcaaactctaccgtagaaataaaccagaaattgatgccgcaactgggagaaaaatatgttacatcgatttcatctccgaacatcacgtattgaacgaagtaaccatagatagaggtccagctccttgtttatccctattagaactctatggaaacgactcactaatgactaaggttcagggagatggattgattgttgccacgcctacgggatccacggcatactcattgagtgcaggaggctctttaatatcgccaagcgtaaatgccatagcggtgacgcctatatgtcctcatactttgagctttaggcctataattttaccagatagcatggaattaaaagttagagtagatatgaactcaagagggacgtcgtgggtgaattttgacggaaaagatagagttgaattgaaacagggtgactatgttgtgataactgcaagcccctattcggtaccgactatcgagtcatctgccagtgaattttttgaaagtatcagtaaaaatcttaattggaatgaccgcgaagagcagaagccatttgcacatattctctcgccaaaaaatcaagaaaaatatagattagactcatcgaaaaatggaaacgacaccataagtaatcccctcgagagttcatgcataagctcagatgcacaagatgaggagaggaaatccgtaacggaaacagaaacagaaatagttgttgaacggactcgtcaggctcattttgcaatctaa

SEQ ID NO: 3514 - DNA, 1488 bp, Saccharomyces cerevisiae
atgactacggataacgctaaggcgcaactgacctcgtcttcagggggtaacattattgtggtgtccaacaggcttcccgtgacaatcactaaaaacagcagtacgggacagtacgagtacgcaatgtcgtccggagggctggtcacggcgttggaagggttgaagaagacgtacactttcaagtggttcggatggcctgggctagagattcctgacgatgagaaggatcaggtgaggaaggacttgctggaaaagtttaatgccgtacccatcttcctgagcgatgaaatcgcagacttacactacaacgggttcagtaattctattctatggccgttattccattaccatcctggtgagatcaatttcgacgagaatgcgtggttggcatacaacgaggcaaaccagacgttcaccaacgagattgctaagactatgaaccataacgatttaatctgggtgcatgattaccatttgatgttggttccggaaatgttgagagtcaagattcacgagaagcaactgcaaaacgttaaggtcgggtggttcctgcacacaccattcccttcgagtgaaatttacagaatcttacctgtcagacaagagattttgaagggtgttttgagttgtgatttagtcgggttccacacatacgattatgcaagacatttcttgtcttccgtgcaaagagtgcttaacgtgaacacattgcctaatggggtggaataccagggcagattcgttaacgtaggggccttccctatcggtatcgacgtggacaagttcaccgatgggttgaaaaaggaatccgtacaaaagagaatccaacaattgaaggaaactttcaagggctgcaagatcatagttggtgtcgacaggctggattacatcaaaggtgtgcctcagaagttgcacgccatggaagtgtttctgaacgagcatccagaatggaggggcaaggttgttctggtacaggttgcagtgccaagtcgtggagatgtggaagagtaccaatatttaagatctgtggtcaatgagttggtcggtagaatcaacggtcagttcggtactgtggaattcgtccccatccatttcatgcacaagtctataccatttgaagagctgatttcgttatatgctgtgagcgatgtttgtttggtctcgtccacccgtgatggtatgaacttggtttcctacgaatatattgcttgccaagaagaaaagaaaggttccttaatcctgagtgagttcacaggtgccgcacaatccttgaatggtgctattattgtaaatccttggaacaccgatgatctttctgatgccatcaacgaggccttgactttgcccgatgtaaagaaagaagttaactgggaaaaactttacaaatacatctctaaatacacttctgccttctggggtgaaaatttcgtccatgaattatacagtacatcatcaagctcaacaagctcctctgccaccaaaaactga

SEQ ID NO: 3515 - DNA, 1488 bp, Saccharomyces cerevisiae
atgtcaaattctccaacagtagcaactttgtcacaagaatatttcgatccgaatattcctcaaatactcccacacgagaaaatgtataagattcaggtggggaaatcattattcaaaatcagcggtgcttctttaagctcggatggtcctagtttcttcaccgaatatttttctaagaagcgctctccttccaataacgatgacagtaataacgataccatggaatctaataaaaatgaggttctattcatagacagatcagccgaagtttttgaatggatctatcaacatttgcaaggatatataattgagattaaggatgaagtacaatataccatgcttttcgcagatgcgatgtactacaatttaccgcgattgcgatctttactgaaagaaacggactattattttaccaacattggtggacaatcattcaagatagcgaaaaatttatttagaagagaaggagattccccaaattatttcgaaatatatgcggctacagtttatatcgatgtggaagagctgataatatctaaaaaactattaaggcctccatctcattctgctccttacattccaagatcttctgagtacttcaaagatttgctgacgttactgggaggagcatccatcgatctagatgataataaaagaaatgccttgataaaagagtgccgttattacaggcttttaaatctcgaacagcggctaatcaaatctcatattagctataacccaataacaaggaaagaagagatttgcctcctattgaaggatttgtcaaaaaaaggcatcacttttccagcttcttctgcattttcaacctcgccctactttgaagacgatttctgtagcataaatgaatgcgactcgctatcaaaaacccgtgaacagccagcaaataaaaagattaaacttgacatgactgaaaaatataacgattcctggaatatgctttgttataagagaccttttttagataagcatccgagagagttgatatttcaaataaattcgactgattgtacgataatcctcaataaggaaagccaaagtatccatgtagacataactggagaatccgcctataagtttgaggccttatttggaagtcatttgccaaatacaccctctggtgcgcctaagttgaaaaattaccagtatcggttcccatccgatagtacgcagacgaaaattgaaactcattatttacttccagcatgcatatatctctgtgatttggacataaacggcattaagatttctcaagttcaaactttgctaactgataaaaataaattcaatgacagggtcattgacgtgtctgatccacttgaccttagattttgttctggtttaaagctttacttaagaaagtctctctggaaactggccgtgaaagatggcaatattatgctgatagctattaaagctatagcatttaacggaactaaggaatactacaagggatatgaatatctgtag

SEQ ID NO: 3516 - DNA, 1490 bp, Saccharomyces cerevisiae
atgattaaatgaacaataattaatatttacttattattaatatttttaattattaaaaataataataataataataattataataatattcttaaatataataaagatatagatttatattctattcaatcaccttatattaaaaatataaatattattaaaagaggttatcatacttctttaaataataaattaattattgttcaaaaagataataaaaataataataagaataatttagaaatagataatttttataaatgattagtaggatttacagatggagatggtagtttttatattaaattaaatgataaaaaatatttaagatttttttatggttttagaatacatattgatgataaagcatgtttagaaaagattagaaatatattaaatataccttctaattttgaagaactacttaaaacaattatattagtaaattcacaaaagaaatggttatattctaatattgtaactatttttgataagtatccttgtttaacaattaaatattatagttattataaatgaaaaatagctataattaataatttaaatggtatatcttataataataaagatttattaaatattaaaaatacaattaataattatgaagttatacctaatttaaaaattccatatgataaaataaatgattattgaattttaggttttattgaagctgaaggttcatttgatctatctccaaaacgtaatatttgtggttttaatgtttcacaacataaacgtagtattaatacattaaaagctattaaatcttatgtattaaataattgaaaaccaattgataatacaccattattaattaaaaataaattattaaaagattgagattcatctattaaattaactaaacctgataaaaatggagttattaaattagaatttaatagaatagattttttatattatgttattttacctaaattatattcattaaaatgatatagtcgtaaagaaattgatttccaattatgaaaaacacttatagaaatctatataaaaggtttacataatacacttaaaggttctaatttattaaaattaattaataataatattaataaaaaaagatattattctaattataatatttctcctttcggggttccggctcccgtggccgggccccggaactaaaaatattattgatgatgtattaaatataaatcttatctataattataaattaccatatcgtataaatagtgatattcaacgtttaaattctataaataataataatactaaatttattaatgttggagtatttgtttatgatttaaataatacattaattataacatttactggttatagaccagcagctctttactttaattgttctccttttcggggtcccgactggggccgggactaaacatgaaattgctaaatatattaaaaatggtaatgtatttataaataaatatattttaaaaaatattttattagattaa

SEQ ID NO: 3517 - DNA, 1490 bp, Saccharomyces cerevisiae
atggctccatttaggcaggacagtattttggtacgtatttagttcatcaatggattttttaagtcttcacgaacagtttttggttaatcttttatactaacaacaattcataacagataatataccccagatctcaaactactctcgttcaatttggtttgaatgaagaaacattcactgtacctgagctggaaataccaacacagatttatcggaccacgagacaagatggttcctacacatatcattcaacgaacaaggataataaagccgaattaatcaaaccaatccaaaatggtgaaataatagacataagcgcctttacacaatttcttagactaatatttgtatctattttgtctgatagagctaataaaaatcaagatgcttttgaagctgaattatctaatattcctcttctactgattacgcaccactcttggtcgcaatcggatctagagattattactcaatatgtcttcgaaagtcttgagataaacaatctaatccaattgccggcttccttagcggccacttattctatgatttcgttgcagaattgttgtattattgatgttggaacacatcatacagatattattcctattgttgactatgcacaattagaccatcttgtctcttcaataccaatgggcggacagtctattaatgattctctaaaaaaactactacctcaatgggacgatgatcagatagaatcattgaaaaaatcaccaatttttgaggtgctcagtgacgacgccaaaaaactatcaagtttcgattttggaaacgaaaatgaggacgaggatgaaggaactttaaacgttgccgagattattacaagtggtcgtgatacacgtgaagttttagaggaaagagaacgtggtcaaaaagtcaaaaatgttaaaaatagcgacttggaattcaatactttttgggatgaaaaaggtaacgaaattaaagttggtaagcaaagattccaaggatgtaataacctgattaagaatatttctaatcgtgtaggattgacgttagataacatagatgatattaacaaagctaaagccgtttgggaaaatattatcatcgtcggtggcactacttcaatttcaggttttaaagaagctttactgggtcaactactgaaagaccatttaattatagagccagaggaagagaagtcaaaaagagaagaggaagcgaaatccgtattaccagctgcaacaaaaaagaaaagcaagtttatgacaaatagcaccgcatttgttccaactatagaatacgtacagtgtcctacagtaatcaaactggctaaatatccagattactttcctgagtggaagaaaagtggatattcagagattatattcttgggtgcccaaattgtttctaagcaaattttcactcatcctaaagatacattttatatcacaagagaaaagtataatatgaaaggaccggctgctctttgggacgtgcaattttaa

SEQ ID NO: 3518 - DNA, 1491 bp, Saccharomyces cerevisiae
atgaaagtattacaattcaatcaagatgcaacgtgctgtgtggtggccgcgtcatcgcatcagatttcgatttttaactgcgacccctttggtaaatgttttgaaattgacactaagaattccaagaagaagacttcaaacaataacggttcagcttcaaactcagaatcacggaataatgaggagagcatattaataactaatggctcccgcgatcgtactgatgcagaagaagaggaagataatgaagataatgccctcgttacaggaaatatactgaaagaaggggagtttgtcattgaaatgttgttttcaactagtcttattgctattgcagatagaggacaaggtctaaacaaaggaaaaaagctgaagattgtcaatacaaagagaaaatgtactatttgtgaaatagttttcccacatgaaattgttgatgtggtcatgaatagaaaaagaatgtgcgtacttcttgaaagtgaccagatattcatttatgatatatcttgtatgaaacccttagaaactatcgatctttgggaagatcattataagaggtcccaagccaattcgttctcaaatgcgtcaaatactggtactttggagggagattctgcaaatttgaacagggtggctaccaatttactagcaaatgccactcaaaaaagtgtgaatggatctaatcctagtgtaagaaccagaagaaactctctaagaagtaaaataaggccaagaatggttttaagtaacgatgatagaagtatactgtgttttactgcgtatagctcgcccaagaagaataagcccaattcagaagcactatatgatgtagtgatttatgacacattaaatgtgacgccagttaattacttgaattccgttcataaggggaatgttgcatgtttagcagtaagtcacgatggtaaactgcttgctactgcctcagataaggggaccataataagggtgtttcatacgggggtagattcggactatatgtcttcaaggtcactgtttaaagaatttagacggggtaccagattgtgcaatttgtatcagctagctttcgataagagtatgactatgattggatgtgtaggtgatacggacactattcatcttttcaaacttgatgacgcctctaatagcctccctggagataattctagcaatggccactggaatgaagaggaatatatactagcatcaaattcaaatcccagtatgggaactccaaaggaaatacctctctcgaaaccaagaattgcgaattacttctcgaaaaaaataaaatcttcaataccaaaccagaacctgagccgtaactttgcttatataacagttaatgaatcgaacaggagttgcttagggtttccagacgaatttcccaaccaagtctatattgcctctgatgatggaaccttcagtatatatagtattccgtcaaaacctggtgaatgtgtgctgactaaaaataataaatttacataa

SEQ ID NO: 3519 - DNA, 1491 bp, Saccharomyces cerevisiae
atgacggccgcacatcctgttgctcagttaactgccgaggcataccctaaagtcaagagaaacccaaatttcaaagttctcgactcggaagatttggcgtactttcgttcgattttgtcaaatgatgaaatcttaaactctcaagctccagaagagcttgcttcgtttaaccaggactggatgaaaaaatatagaggccagtccaatttaattctcttgccaaactccactgataaagtgtccaagattatgaaatactgtaacgataaaaagttggcagtagtaccacaaggtggtaacaccgacttggtcggagcctctgttccggtatttgatgagattgttctttctctaagaaatatgaacaaagtcagagattttgatccagttagcgggactttcaagtgtgacgcgggtgtcgttatgcgtgatgcgcatcaatttttacacgaccatgaccatatcttcccattggatctgccttctagaaacaactgtcaagtgggcggtgtagtttcaacaaatgcaggtggtttgaactttttaagatatgggtctctacacggtaatgttttgggtttggaagtggtgctacccaacggtgagattatcagcaatatcaatgccctaaggaaggacaatactggttatgacttgaaacaattattcatcggtgcagagggtactatcggtgtcgttactggtgtatccatagttgcagcagcaaagccaaaagccttgaatgccgtattttttggtattgagaatttcgataccgttcagaaattatttgtcaaggctaaaagtgaattatctgagattttatctgcttttgaattcatggaccgtggctccattgaatgtacgatagaatacttgaaggacttgcctttccctctggagaaccaacacaacttttatgttcttattgaaacgtcagggtccaataagagacacgacgatgagaagctgactgctttcctcaaagataccacagattctaaattaatttcggagggtatgatggctaaggacaaagccgattttgatagactttggacctggagaaaatctgttccaacagcttgtaattcttacggtggtatgtacaagtatgacatgtcacttcaattgaaagatttatattccgtatctgcggctgtgacggagagattaaacgcagccggtttgattggtgatgcaccaaaaccagttgttaaatcatgtggttatggtcatgtcggtgacggaaacatccatttaaatatcgcggtaagagaatttacaaaacagattgaggacttactagaaccatttgtttatgaatatattgcatcaaagaaaggttccatcagtgctgagcatgggatcggtttccataagaaaggtaagttacactacaccagaagtgatattgaaattagatttatgaaggatatcaaaaatcactacgatccaaatggaatcttaaacccatacaagtacatttga

SEQ ID NO: 3520 - DNA, 1491 bp, Saccharomyces cerevisiae
atgtcaatgagtaatattgttgtttttggaggggactcgcaccccgagttagttactaagatctgtgaaaatttggacattcacccatcgaaagtagaattagggaagttttctaatggggaaacgaacattgctcttcgcgaatctgttcgtgaaaaggatgtatatatcatccagagtggttgtggccaggtgaacgacacgttcatgcagttgctgattttaatcagtgcctgcaagtccgcttctgcctcgagggttacagccgtaatgccatatctctgctactcgagacagccagatattccatatactgccaagggtgctcccataatttccaagcctaaagaaaactatacttttgaatcgcatccaggcacacccgtgtcatcttctttaatgacgcaaagaccaggtgctgagagctcgttgaagagtttggatagtgcaatacgatcaactatcaacttagaaaatcctcaacctatcagaacaccaaacagcagtgctacggcgaataacaatttcgacatcaagaagacgctttctttttcaagaattcctatgattcccggtggtaagttacaaaatacaagcaatagcacggacgctggtgaattgttcaacgctcaaaatgcaggctataagctatgggtagtacaagccggtactttgattgctcatttgttgagtgctgcaggtgctgaccatgtgatcacaatggatttgcacgatccacagttccctgggttttttgacattccagtggataatctctactgtaaacccattgcacaaaactacatccagcatcgcattccagattatcaggatgctgtgatcgtttctccagatgctggtggtgcaaagagagctacggctattgcagacgccttggaattgtccttcgccctaattcataaagaaagaagatctcagttattgaagggccctccagatgcgacgttaacctctggtggttcgttaccagtatctccaaggccattagttactactttggtttcctcccaaaatactacttcttcaggtgccactggggttgcggcccttgaaatgaagaaaacaacttcaacatcttccacctcgtcgcaatcttctaattcgtccaagttcgttcaaactaccatgcttgttggcgatgttagaaacaaggtgtgtattatagtcgacgacttggtggatacttcatacactattacaagagctgcgaaattgttgaaggatcaaggatctaccaaagtttatgccttaataacgcacggtgttttttccggtgatgcgctagaaagaatcggccaaagtagtatagataagttgatcatttctaacacggttcctcaagatagaacactacagtacctaggtaaggacagagtggatgttattgatgtctcctgcataatcggtgaagcaattagaagaatccataacggtgaatccatttctatgttgttcgagcatggatggtag

SEQ ID NO: 3521 - DNA, 1491 bp, Saccharomyces cerevisiae
atgtctgctgttaacgttgcacctgaattgattaatgccgacaacacaattacctacgatgcgattgtcatcggtgctggtgttatcggtccatgtgttgctactggtctagcaagaaagggtaagaaagttcttatcgtagaacgtgactgggctatgcctgatagaattgttggtgaattgatgcaaccaggtggtgttagagcattgagaagtctgggtatgattcaatctatcaacaacatcgaagcatatcctgttaccggttataccgtctttttcaacggcgaacaagttgatattccatacccttacaaggccgatatccctaaagttgaaaaattgaaggacttggtcaaagatggtaatgacaaggtcttggaagacagcactattcacatcaaggattacgaagatgatgaaagagaaaggggtgttgcttttgttcatggtagattcttgaacaacttgagaaacattactgctcaagagccaaatgttactagagtgcaaggtaactgtattgagatattgaaggatgaaaagaatgaggttgttggtgccaaggttgacattgatggccgtggcaaggtggaattcaaagcccacttgacatttatctgtgacggtatcttttcacgtttcagaaaggaattgcacccagaccatgttccaactgtcggttcttcgtttgtcggtatgtctttgttcaatgctaagaatcctgctcctatgcacggtcacgttattcttggtagtgatcatatgccaatcttggtttaccaaatcagtccagaagaaacaagaatcctttgtgcttacaactctccaaaggtcccagctgatatcaagagttggatgattaaggatgtccaacctttcattccaaagagtctacgtccttcatttgatgaagccgtcagccaaggtaaatttagagctatgccaaactcctacttgccagctagacaaaacgacgtcactggtatgtgtgttatcggtgacgctctaaatatgagacatccattgactggtggtggtatgactgtcggtttgcatgatgttgtcttgttgattaagaaaataggtgacctagacttcagcgaccgtgaaaaggttttggatgaattactagactaccatttcgaaagaaagagttacgattccgttattaacgttttgtcagtggctttgtattctttgttcgctgctgacagcgataacttgaaggcattacaaaaaggttgtttcaaatatttccaaagaggtggcgattgtgtcaacaaacccgttgaatttctgtctggtgtcttgccaaagcctttgcaattgaccagggttttcttcgctgtcgctttttacaccatttacttgaacatggaagaacgtggtttcttgggattaccaatggctttattggaaggtattatgattttgatcacagctattagagtattcaccccatttttgtttggtgagttgattggttaa

SEQ ID NO: 3522 - DNA, 1494 bp, Saccharomyces cerevisiae
atgactttgagtaagtattctaaaccaactctaaacgaccctaatttattcagagaatctggttatattgacggaaaatgggttaagggcactgacgaagtttttgaggtggtagaccctgcttccggcgaaatcatagcaagagttcccgaacaaccagtctccgtggttgaggaagcgattgatgttgcctatgaaactttcaagacgtacaagaatacaacaccaagagagagggcaaagtggctcagaaacatgtataacttaatgcttgaaaatttggatgatctggcaaccatcattactttagaaaatggtaaagctctaggggaagctaaaggagaaatcaaatacgcggcttcgtattttgagtggtacgccgaggaagcaccccgtttatatggtgctactattcaacccttgaaccctcacaacagagtattcacaattaggcaacctgttggtgtatgcggtataatttgtccatggaattttccgagcgccatgatcacgagaaaggccgccgctgctttagctgtgggctgcacagtagtcatcaagccagactctcaaacgccgctatctgctttagcaatggcatatttggctgaaaaggcaggctttcccaagggttcgtttaatgttattctttcacatgccaacacaccaaagcttggtaaaacattatgtgaatcaccaaaagtcaagaaagttacttttactggttctacaaacgtcggtaaaatcttgatgaaacaatcttcttctactttgaagaaactgtcttttgagctgggtggtaacgcccctttcatagtctttgaggatgccgatttggatcaagccttggaacaagccatggcttgtaaatttaggggtttgggtcaaacatgtgtgtgcgcaaatagactttacgttcactcatccataattgataaatttgcgaaattactcgcggagagggtcaaaaaattcgtaattggccatggtttggacccaaaaactacacatggttgtgtcattaactccagcgctattgaaaaagttgaaagacataaacaggatgccattgataagggagcaaaagttgtgcttgaaggtggacgtttaactgagttaggtcctaacttttatgctccagtaattttgtcacacgttccctcaacagctattgtttccaaggaggagacttttggtccattatgtccaatcttttcttttgatactatggaagaagttgtcggatatgctaatgatactgagtttggtttagcagcatatgtcttttctaaaaatgtcaacactttatacactgtgtctgaagctttggaaactggtatggtttcatgtaatacaggtgttttttcggattgttctataccatttggtggtgttaaagagtcaggatttggaagagaaggttcgctatatggtattgaagattacactgttttgaagaccatcacaattgggaatttgccaaacagcatttaa

SEQ ID NO: 3523 - DNA, 1494 bp, Saccharomyces cerevisiae
atgagaccgttgtatagctgcaaccttgcaaccaaagatgatattgagatggcaggtggcgtagctcctgctcacctggaagttaatgtaggcggctataatacagagcagacaatacctatagtaaagcatcagctcgtgaaagttgggagaaatgataaggaatgtcaactcgttctaacgaatccctctatctcctctgttcattgcgtgttttggtgtgtcttttttgatgaggatagtattccaatgttctacgttaaagattgttctcttaatggaacgtatttgaacggtttgcttttgaaaagggacaaaacgtatcttttaaaacattgcgacgttattgaattatcgcagggaagtgaagaaaatgacattaaaaaaacacgactagtttttatgattaatgatgatttacaatcttctctggacccaaaacttttagatcaaatgggttttctgagggaagtagaccaatgggaaataacaaatagaatagtgggtaatggcactttcggtcatgttctgatcacgcataactcaaaagaacgtgatgaagatgtctgttatcaccctgaaaattatgctgtgaagatcattaaactaaaaccaaataaattcgataaagaggctcgaatccttttgagactggatcacccaaatattatcaaagtctaccatactttctgtgacaggaacaatcacctttacatattccaggatcttatccctggtggtgatttgttttcttacctagctaaaggcgactgtctaacttccatgtcagaaactgaatcgctattgatcgtctttcaaattttgcaagctttaaactaccttcatgatcaagacattgttcaccgcgatttgaaactagacaatattttgttatgtacgccagaaccgtgcactagaatcgtcttggcagactttggtatagctaaagatttaaattccaacaaagaaagaatgcatactgtcgtaggcactccggaatactgcgctccagaagttggattcagagcaaacagaaaagcatatcaaagcttctcaagagcagctacgttagagcaacgaggttatgacagtaaatgtgatctttggtctttgggtgtcattacacacattatgttaacagggatctcgcctttttatggagatggttctgagaggagtattattcaaaatgcaaaaattgggaagctgaatttcaaactgaagcagtgggatattgtttcagataatgccaagagttttgtcaaagaccttttgcaaactgacgtagttaaacgattaaatagtaagcaaggtctcaaacatatttggattgcaaaacacttaagtcaattagagagattatattacaaaaagatattgtgcaataacgaaggccctaaactagaaagtataaattcagactggaaaaggaagttacccaaaagtgttatcatttctcaggcaataccgaaaaagaagaaggttttggagtaa

SEQ ID NO: 3524 - DNA, 1494 bp, Saccharomyces cerevisiae
atgccattaaggtcattatttcatactaatcagagtagccacgacaaagacgcgttgacaaggggaggttataacgcatatctggaatcactttctcgttgtgacagtggaaaggcagaagaacaaaaaggaaaagttatatcaaagttattagagaaaaaagatgtccgagctttgaggtacataggtttagggcctctggggtttgtaaacaactcattaagaaaagattgttggtatgaattattggcgtcccagttgcttattgatgatgcaacagagtacattacaccagtggaaaaacataaagatgaaggtcaggtgatattggatgcagaaaggtcttttggtggaattgtcgacaaaaacttgaaactgcaattgagaaaactactggtggagttaattactcgggtattgagaaagtacccaacgttgaactattaccaaggttatcatgatattgtgtctgttttcatcatgtgttttagttggaatgtcacaaaagagaacggactggaactagaaaatctctcattgcaagaagaaattgatatggaaaggctgttttattgcatcgaagcatttaccctattatatctgagggatttcatgatgaactcactagatttttcatttgagcaattgagagtaatctcttcattgataaaggaatcaaacatgaaattctataatctattcaaatttgacgaaaatgagccccttttcgctattgggtcaatattgacaatctttgcacataatttgaaacctatagatagcggtgacaacaatcttcataaaattcttttccagatatttgacatgacaatatcgatgcaatctatgcgtttacctttgatcatatacaagaacctgctattgcaaaatgcgtctgaaatttcgaagcaaatagaagctaattctgatttcttcgagaacgattttgacctgcgccatggtgctatacaaacagttttacagaaaaaactgtatgatgaggcgctttgggaagaagtcttgcaaataactagaaaagatgcgactactgccagcaagaaggctttgaaacgggtgagtcttaataaatatagtgcattactcaatacagcatgtggaaagccaggatgcttcgatatgagcaccattatcttctatttgagcgaacaaacaaagatgaacgagcattacaaggaagaaaagtatcatggtgtcgccgccagatccaagacaagggcgttggtccaaagacttggccattttttaccctccaaatataacaggtggagcaaaatttctttacttatcgggattgtagctatcctgtaccaattacggactacaaggtcgttgagtttagtactcaatctacgttacatgatctccacaaagttgaaagacttatcacatataaatataaatttgcaccacgttagtcacatctgggtggatccgattagggacattttgaaactggggcatccaactagatag

SEQ ID NO: 3525 - DNA, 1494 bp, Saccharomyces cerevisiae
atggatgcttcctcggttccaccaaaggtagatgattatggaatgtatacaactgaaatttcacatcataacccaatagagttgaaaaatctgctatcatcatcagactccagaagaaattctcaagatgaagatagtctacctaacaatacaaacttaatcaaagaaattgactggcagggcgagaaagttaaaacatatccactaaactatcaaactgtaccactagtaaagctgcaggtgatagcatgcttgattatgttcgtagtctttggtatgaacgatcaaacagtaggtgcactacttcctacgctaattgaatactatcatatatcgcgggtagatgtctcaaacgtatttatagtccaattatgtggttatgtgatggcgtctttatcaaaagagagattgaataagcactttggtatgagaggtggtatgcttctagcagctggtttgtgtatagtatttcttatcattttagcaactgcaccttctagtttctatgtttgtatgttttgtggccttcctcttggtttagggatcggcatcttagattctaccggtaatgttttaatgggcagtcttttagtccataagaatgaactcatgggtatcatgcatggtctttacggggcagcagctatggttactcctcccttagtttcatattttgttgaatggggtcattggtctctttttttccttattcctctgttcttttctataataggcatgattgtaatcttcccagcttttaaatttgaaactgcaagtaaatacgactacctctgctctgtggaaaacaaagaaagcaacaatgatgtggaagaagcgggtgataactcgctgatggaatctaccaaggcgagcccaggattttttgaacttttaagaaatcctgctattttcttgtactcattgtatttgttcctttacttaggtgctgaaattacaactggttcatggttctttagttatttattggaaactaaatcaagtaataaggttgctatgtcatacatagcggcatcgttttggacaggtttgactgtaggcaggttgtgtctaggatttgttactgaaagattcttcgaaaacgagtataaagcaagcaaagcgtacgcttttttaactctatcttcatacaccttatttgtgcttgttgggttgatcaattcaagctcagttttctatttcgtcgtgttattttttgttgttttttgttgtggtacgtttatcggaccattattcccaaacgcaagtatagttgcattacaagtattgcccaaaagactacatgtgagcggggttggggttgccgtcgccgttggtggttgtggtggtgcagccattccatatttggctggagttattgcacacacagtgggaatccagtatatcccactattgtgttggattatggttgcgttatttacattggaatggacattgtatcctaaattcataaaagggcatgaagaatatttttag

SEQ ID NO: 3526 - DNA, 1494 bp, Saccharomyces cerevisiae
atgttcatcagtagaagatgcagaattaaaggctttacccttaagaatttgctgtggttcaggtcatcatcaactcgatttgtttcaactgaatcaccagatgcgagcgcaattacgaaaccagatggtattttcaattattctctgttggaaaacagaacatacatcaggatacgaggacccgacacagtgaaatttctaaacggattagttacctcgaaactattacctcattttattaagaaaaatctaaccactgtagaagagaatgaagtgcctactgaagaaggaacgacgaaggttgatccaattattcctgtgccagaatttgatgcacgactgggaaattggggactgtataacgaaaaaggtattcaagggccatatatttcaaggtttggtttgtactctgcatttttaaacggtaaggggaagttaataacagatacaattatttaccccactcctgtgaccgtaagcgaacaaatttcaaattatcctgagtatctgttagagcttcacgggaatgtagtggacaaaattttgcacgttttacaaactcacaagttggccaataagattaaattcgaaaaaattgatcattcctccttgaaaacctgggatgttgaggttcaattccctaatttgcccaaagatattgaaaacccgtggtttgataatctactggatcctatggctctaccaaaaaattccatagatgctaataattttgctgttaatgttttaaattctttgtttaactcagatcctagaatattgggtatttacgtagaaagaagaactgagtcaatgtcaaggcattactccacatttccacaatccttcagagttgtcacttccgagcaagtggatgatctctctaagctatttaactttaacgttttcgacttcccttttcaagtaaataaaaaagcttccgttcaagttagagaaatcagatttcaaaaaggtcttatagatagcactgaggattacatatctgagactttgctacctttggaactaaactttgatttttttccaaacactataagcacaaacaaaggatgttatgtaggacaagagctgacagccaggacatatgctacaggcattctacggaaacgtttggtcccagttaagctggataattatcaacttttagatacagacccagaaagaaagtacgcagaattccatatcgacaacgttgtagaaaagagccttgcagagaacgagccaaccctcaatccatttaccaataaaccgcccgaacgaaccaagagaaagcaaaggccggcaggcttattgatttctaatgaagggctgtatggcgtagctttacttagaacagagcatttctctgctgccttctcatctgatgagccagtcgaattttacattactacaacgaagggtgaaaatattaaaataacacctcaaaaaccattctggtttagcgactggaaaaacaataacgggcctcataaatag

SEQ ID NO: 3527 - DNA, 1494 bp, Saccharomyces cerevisiae
atgttgaaatcaactgctacaagatcgataacaagattatctcaagtttacaacgttccagcggccacatatagggcttgtttggtaagcaggagattctattcccctcctgcagcaggcgtgaagttagacgacaacttctctctggaaacgcataccgatattcaggctgctgcaaaggcacaggctagtgcccgtgcgagtgcatccggtaccaccccagatgctgtagtagcttctggtagcactgcaatgagccatgcttatcaagaaaacacaggttttggtactcgtcccatatatcttgacatgcaagccactacaccaacagaccctagggttttggatacgatgttgaagttttatacgggactttatggtaatcctcattccaacactcactcttacggttgggaaacaaatactgctgtggaaaatgctagagctcacgtagcaaagatgatcaatgccgaccccaaggaaataatattcacttcgggagcgaccgaatctaataatatggttcttaagggtgtcccaagattttataagaagactaagaaacacatcatcaccactagaacggaacacaagtgtgtcttggaagccgcacgggccatgatgaaggagggatttgaagtcactttcctaaatgtggacgatcaaggtcttatcgatttgaaggaattggaagatgccattagaccagatacctgtctcgtctctgtgatggctgtcaataatgaaatcggtgtcattcaacctattaaagaaattggtgcaatttgtagaaagaataagatctactttcatactgacgccgcacaagcctatggtaagattcacattgatgtcaatgaaatgaacattgatttactatcaatttcttctcacaagatttacggtccaaagggaataggtgccatctatgtaagaaggagaccaagagttagattagaacctttactatccggtggtggccaagagagaggattgagatctggtactttggcccccccattggtagcgggatttggtgaagctgcgagattgatgaagaaagaatttgacaacgaccaagctcacatcaaaagactatccgataaattagtcaaaggtctattatccgctgaacataccacgttgaacggatctccagatcatcgttatccagggtgtgttaacgtttctttcgcctacgtggaaggagaatctttattgatggcactaagggatatcgcattatcctcgggttcagcctgtacatctgcttccctagaaccttcttatgttttacatgcgctgggtaaggatgatgcattagcccattcttccatcagatttggtattggtagatttagtactgaagaggaggtcgactacgtcgttaaggccgtttctgacagagtaaaattcttgagggaactttcaccattatgggaaatggttcaagaaggtattgacttaaactccatcaaatggtcaggtcattga

SEQ ID NO: 3528 - DNA, 1494 bp, Saccharomyces cerevisiae
atgtttaaccatgattggaagtactccattaattctaagactttcgccgatttaaacattgaattatttcgaaaccacaagttcaaaactgttttaaattacataataggtgtagttgggtggaatggattaaaactcgccctttttgtttctgacatttacacatgtatcaaattgctggcattcaactcctggtcaaacaacatcatcaaaccatacttaccctttaaaatatccaaatggttgtttagcggttgtattttagcatcgattgtgctattgatatgggaggctatagcgggaatgaggatttacaaaacgggaaatatctctttgacttatgtcaacaatttttccagaaacctaaattcagtgctcaattattccaagttttgtgtttataatatgatcgaacgaaagggttttcgacagaaaatgacattttttactttttttcaactgaaagattgtattagattaatcttcacggataccccaaggcaagttattaatggtcttacgctgtggtcagttctcgtaacagtaaataaaaacgaggatctaggcgatctggaatcatttaccggtttgatcaacaaaataaagaacattggccagaccaatcatgaagaagcagtgatattgtcgctgatgctattttcctttataatctgggcattatttgtcttcaagtttctgcttgctgtcatttgctcgatttttgtttattataaaataatcaatgatcaggaatatagcgggttgcgtgagtacatttgtgttaccgtcagcgaaaatgttgatgaacttgttgaaagacaaaggaaaaaggaaaatgatgacacgatttataagacaggtcttctcgaatctcagacttttgacgattttaaagaagttgaaaataaaattgaaacatcttttaatgatacgtcatatgcttctaataatgattctatgattgagctaatagagagaagacccgaatacaaaagtcaggatgtatgtgggcccattcccacaatgaagaaaacggaaacaatggaatcgttcgttgacaatggcaatccacaatataccactagattctctgcgattctagattcaccatatatcaacagctatgaaagtaatgatataaagaaagcaaaaatacaaagcagaagcgtaaatactccaaaatatgaggatttgtcttcttctgacattttcaacaaaatacactctgctggacaattaaaatctacaacttctatggagtttcacgggccattagattctatgccaaatacaacaaacaacatccgtaattttaatagcaacagtagtagacctagaccacctcctttacagacaaaaagttcgattaattcaaaagctgactcgaatgataatggaaggatttatacaccaatgaaagcgtacttcagggagcctgatcttccgaggaagggtttgctggaagatgaagatcgtacatataattatacttaa

SEQ ID NO: 3529 - DNA, 1500 bp, Saccharomyces cerevisiae
atgaaaatcgcactgccagtattccaaaaatttaatagattgatcagttcgtgcaagatgtcaggagtgttcccatacaacccacccgtgaatcgccaaatgcgagaattggataggtcatttttcatcaccaagataccaatgtgtgcagtcaagttccccgaacccaaaaatatcagtgtgttttctaaaaacttcaaaaattgcatcttgagggtgccccgtatcccgcacgttgttaagttaaactcatccaagccaaaggacgaactgacaagtgtacagaacaagaaactaaagactgcagatggcaataataccccagtcacgaaaggtgtgctgctacacgaatccatccacagcgtggaggatgcgtatggaaaattgcctgaggacgccttggcgtttcttaaggaaaacagtgcggaaattgtaccacacgaatacgtgctcgattatgatttctggaaagctgaggagattcttcgagccgtgctgcccgagcaattcctggaagaggttccaacgggttttacaatcacaggccacattgcccacttgaacttgcgcaccgagttcaaaccattcgactcgctcatcggacaagtcatccttgacaagaacaacaaaatcgaatgtgtcgtggacaaagtcagctccattgccacacagttcaggacttttcctatgaaagtcattgctgggaaaagcgatagtctagtggtagagcagaaggaatccaactgcactttcaaattcgactttagcaaggtgtactggaactcccgattgcacacagagcatgaaagactcgtcaaacagtacttccagcctggccaagtagtctgtgatgttttcgccggcgtggggccctttgctgtacctgcgggcaagaaggatgtcatcgttttggctaacgacttgaatcctgagagttacaaatacttgaaggagaacatcgcattgaacaaagtggccaagaccgtcaaatccttcaacatggatggcgctgacttcatccgccagtcgccacagttattacaacagtggattcaagatgaagagggcggcaagatcacgatccctctgcctttgaagaaacgacacagatcccagcaacacaatgaccaacaaccgccacaaccacgcaccaaagagctgatcattccgtcacatattagccactatgtcatgaatctaccagacagcgccatttctttcttaggaaacttccgtggcatctttgcagcacacactaaaggcgccactgataccatccaaatgccatgggtgcacgtgcactgttttgagaagtacccgcctggcgaccaagtcactgaggacgagttgcatgcacgcgttcatgcccgtattattgccgcgctcaaggtcactgcagacgatcttccgttgaatgccgtttcgttgcatttggtgcgcaaagttgcacccaccaaaccgatgtattgcgcgagtttccaacttccagctaacgtatga

SEQ ID NO: 3530 - DNA, 1500 bp, Saccharomyces cerevisiae
atgagcggagaaacgtttgagttcaatattagacattctggtaaagtttacccaataacactttccactgatgctacttcagcagatttgaaaagcaaagcagaggaattgacccaagtcccaagtgcccgccaaaaatacatggttaaaggtggcttgtctggcgaagagtccattaaaatatatcccttaatcaagccaggatcgacagtaatgctattggggactccagatgctaacctgatttctaaaccagccaaaaagaataatttcattgaagaccttgcgcctgagcaacaagtccaacaatttgctcaattgcctgttggtttcaagaatatgggcaacacctgttatctgaatgctaccctacaggctttatacagagtgaacgatttaagggatatgattcttaattataacccttctcaaggtgtgtctaacagtggtgcacaagatgaagagattcacaaacaaatcgttattgaaatgaagcgttgttttgaaaatttacagaataaaagtttcaagagtgttttgccaattgtgttattaaacacgctaagaaagtgttatccacaatttgctgaacgtgattcacaaggtgggttctataaacagcaagacgctgaggagttgtttacacaactattccatagtatgagtattgtttttggtgacaaattttccgaagatttcaggattcaatttaaaactaccatcaaagacacagctaatgataacgatattactgttaaagaaaatgaaagcgattctaaattacaatgtcatatttctggtactacaaatttcatgagaaatgggctcctggaaggtttgaatgagaaaattgaaaaaagatcagacttgactggcgccaattccatctatagcgtcgaaaagaaaatatcaagattaccaaagtttttaactgttcagtacgttagatttttctggaaaaggtcaaccaacaaaaaatctaaaatattgcgtaaggtcgttttcccatttcaattagatgttgcagacatgcttaccccagaatacgcagcagagaaggtaaaagttcgtgacgaactgagaaaagttgaaaaggagaaaaatgaaaaggaaagagagatcaaaaggcgtaaatttgacccatcatccagtgaaaatgtcatgacaccaagagaacaatatgagacacaagtggctcttaacgaaagtgaaaaagatcaatggctcgaagagtataagaaacattttcctccaaacttggaaaaaggtgaaaacccatcttgtgtttataacttgatcggtgtcattacacatcaaggtgccaattctgagtctggacactatcaagctttcataagggacgaactggacgaaaataaatggtacaaatttaatgatgataaagttagcgttgttgaaaaggaaaaaattgaatctttagccggtgggggcgaaagtgatagtgcactgatcttaatgtataaaggatttggtctgtaa

SEQ ID NO: 3531 - DNA, 1500 bp, Saccharomyces cerevisiae
atggagaatagaaacagtagtacctctagtaggccattttctgttaataacccgtttagaaatgccacagttgattcaagtattaatcagtataaaaatgactcccagtttcaggagtgggcgaaaaaccaatctcgtaccaattcatttgatatgccacaattgaacacaagaacttcttcacaattatcattcccaaacattccagaggatgaaccccagcgaaacgcagatcagcagggtgctttttattctggtttggagagctttagtagtggtagtttatcaccaccttcgagacctctttcctcaaagaatcctttcctagacgatgtgagttctgcaaccgattttagaaggtctcccccacctgtttcaaggaataaaaatcatcccactgctaaagaagaaaaagaacaattaaggcaaagatatttggaggaaagtgacgtaagtacagtaggtaacacaagagaaaacactgacctaccaccctcatacgaagagatcacttcaaccaatggatcaaggcgtgcatatccaaaggaaaaggtttctcgtccttcttctcaccgcgaacatagcaacagcggcacatatatttcacgcagatcttcatcccaccatcaccgtgaagcttcctcatcttcaacgccttctaagaagggaaagagaaaaagtaaggttattgttcctaagaacgtcgatactatcgataagttagatgtaactggattgttcggtggctcatttcatcatgacggcccattcgatgcagtaacacctcatagaaataaaaataacaaagctgcgcctgttttagcatttccggtcgatggtccaaacagtaccatcggtggcgcttcaaccaagaagtctgccctggatgaggtttttgggagagatgatacagatgattctgatatataccagtacagttcgcagactctaaggagaggtggtgatacgcaggacgcaataaaagcaaacgtgggtaacgtccaacaaatggatgccaaaaataagacagaattggttcatgggccagttactgcgggattaggttctagtacgtttttagatggggcgccggcctcctcagctgccattagaaacgacataaaagcccattcctatcataatcgtaacggtggtttacaaagaaataagtcactttctcaacgattaggtctcggaggatccggtgatagcaatgcccccatgacaggcgttagaagaaacttgagtttaagtagagacaactatgatgttggtcacagcaatgaaggtgttagaaggtcgaaaaccgttaattctcctaacagaacgcataagtccaattatactactgatttcgacggccaagatgatcacaatgaagatgaggaagacgtttatttgggtgtgcgctacaatgagcccaatatgaaaaagaaatcgacgggcagcaaattactgagcagagtaaaaagtctaaaggtcggcaggaaaagtcagtaa

SEQ ID NO: 3532 - DNA, 1500 bp, Saccharomyces cerevisiae
atgggaggtgaagacgaaatattaagcacgatggaggattttgcggcagtttacgatgtcctggtaattggttgcgggcctggtggctttactgcagcgatgcaggcttcgcaagcaggcctgctcacagcatgtgttgaccagcgtgcctcgctggggggcgcctaccttgtagacggggcagtcccgtccaagaccttgttatatgagtcttatctttatcggctgctacaacagcaagaacttatcgagcaacgtggcacgcggctgtttcctgcaaaattcgatatgcaggcggcccagagtgcactcaaacataatatagaagagttgggcaatgtgtataaacgtgagctatctaaaaataatgttactgtgtataaaggcacggctgctttcaaagatcctcaccacgttgagattgcgcagcgcggcatgaaaccgttcatcgtagaggcgaaatatattgttgtggcgaccggatctgcggttattcagtgtcctggtgttgcaatagataatgacaagataatttcatctgataaggcattgtcactggattatataccttcacgttttactatcatgggaggaggtacaattggactagaaatcgcatgcatattcaataatttgggctctcgggttactatcgttgaatctcaaagcgagatctgtcaaaatatggacaatgagttggcttctgccacgaagaccctcttgcagtgtcagggtatagcttttcttttagacactagagtgcagctcgcggaagccgatgctgccggtcagctgaacatcaccttgcttaacaaggtgtcaaagaaaacatatgtacatcattgcgacgtcttgatggtttctattggtagacgtcccctgctaaaaggtttagatatttccagcattggtctagacgaacgggattttgtagaaaatgttgacgtacaaacccaaagtctgctaaagtaccctcatattaaacccataggagacgttacattgggccccatgctggcgctgaaagcggaagaacaagctataagggccattcaatcaataggctgtacaggctccgacggaacctcgaattgtggcttcccaccaaatgtgctgtactgtcagcctcagattggctgggtcggatacactgaggaggggttggcaaaggctcgcatcccatatcaaaaaggcagggttttgttctcacagaacgttagatataacacgttattaccacgggaagagaatactacagtttctcctttcattaaagttctgatagattctcgtgacatgaaaatactaggcgttcatatgataaacgacgatgcaaatgaattgctgtcgcaagcatcgatggcggtgtcgcttggccttaccgcccatgatgtctgtaaagtaccgttccctcatccgagcttatcggaatcgtttaagcaagccgtccagttggcaatggcaaatggaacatcacctggcgtacatgtccgggaatag

SEQ ID NO: 3533 - DNA, 1500 bp, Saccharomyces cerevisiae
atgtccactaagaagcacaccaaaacacattccacttatgcattcgagagcaacacaaacagcgttgctgcctcacaaatgagaaacgccttaaacaagttggcggactctagtaaacttgacgatgctgctcgcgctaagtttgagaacgaactggattcgtttttcacgcttttcaggagatatttggtagagaagtcttctagaaccaccttggaatgggacaagatcaagtctcccaacccggatgaagtggttaagtatgaaattatttctcagcagcccgagaatgtctcaaacctttccaaattggctgttttgaagttgaacggtgggctgggtacctccatgggctgcgttggccctaaatctgttattgaagtgagagagggaaacacctttttggatttgtctgttcgtcaaattgaatacttgaacagacagtacgatagcgacgtgccattgttattgatgaattctttcaacactgacaaggatacggaacacttgattaagaagtattccgctaacagaatcagaatcagatctttcaatcaatccaggttcccaagagtctacaaggattctttattgcctgtccccaccgaatacgattctccactggatgcttggtatccaccaggtcacggtgatttgtttgaatctttacacgtatctggtgaactggatgccttaattgcccaaggaagagaaatattatttgtttctaacggtgacaacttgggtgctaccgtcgacttaaaaattttaaaccacatgatcgagactggtgccgaatatataatggaattgactgataagaccagagccgatgttaaaggtggtactttgatttcttacgatggtcaagtccgtttattggaagtcgcccaagttccaaaagaacacattgacgaattcaaaaatatcagaaagtttaccaacttcaacacgaataacttatggatcaatctgaaagcagtaaagaggttgatcgaatcgagcaatttggagatggaaatcattccaaaccaaaaaactataacaagagacggtcatgaaattaatgtcttacaattagaaaccgcttgtggtgctgctatcaggcattttgatggtgctcacggtgttgtcgttccaagatcaagattcttgcctgtcaagacctgttccgatttgttgctggttaaatcagatctattccgtctggaacacggttctttgaagttagacccatcccgttttggtccaaacccattaatcaagttgggctcgcatttcaaaaaggtttctggttttaacgcaagaatccctcacatcccaaaaatcgtcgagctagatcatttgaccatcactggtaacgtctttttaggtaaagatgtcactttgaggggtactgtcatcatcgtttgctccgacggtcataaaatcgatattccaaacggctccatattggaaaatgttgtcgttactggtaatttgcaaatcttggaacattga

SEQ ID NO: 3534 - DNA, 1500 bp, Saccharomyces cerevisiae
atgtcttacaattttacaggtacgcctacaggcgaaggaacgggtggtaactcgttgacaacagatttgaatacacaatttgacttggccaacatgggatggatcggtgtggcttcagcaggtgtgtggattatggtcccaggtatcggtttattatattctggtttatccaggaaaaagcatgctttatccttgctttgggcctcgatgatggcttccgccgtgtgtattttccaatggtttttctggggatactcattagctttctcacacaacactagaggtaacggttttattggtaccttggaattctttgggtttcgtaacgttttaggagccccatctagtgtcagttctcttcccgatatactgtttgccgtttaccaaggtatgtttgccgcagtcaccggtgccctaatgctaggtggtgcctgcgagagggcaaggttgtttcctatgatggtgttcttgtttttatggatgactattgtttattgtcctattgcatgctgggtctggaatgccgagggttggttggtcaaattgggtagcttggactatgcaggtggtttatgtgtccatttaacatctggacatggtggtctagtttacgctttgatactgggtaagcgtaatgaccctgttacacgtaaagggatgcccaagtacaaaccacattccgtcacctcggtggttttaggcacagtgttcttatggtttggttggatgttctttaacggaggctctgcaggtaatgcaactatacgagcatggtactctattatgtccacaaacttagctgctgcttgcggtggcttgacatggatggttatcgattatttcagatgcggaagaaagtggactacagttggtttgtgttcaggtatcatcgctggcctagtgggtatcaccccagccgccgggttcgtgccaatctggtcagccgttgtcattggtgtggttactggtgcaggatgtaaccttgctgttgacttaaagagtctattgcgcatcgatgatggtctagattgttactctatccatggtgtgggtggttgtattggttctgtattaactggtatctttgctgcagactatgtaaatgccactgcaggctcttacattagtccaattgatggtggctggatcaatcatcactataaacaagttggttatcaattagcaggtatatgcgctgcactagcctggactgttactgtcacatctatcttgcttctaactatgaatgccattccatttttaaaactaagattaagtgctgatgaggaagaattaggtaccgacgctgctcaaattggtgaatttacatacgaggaatccactgcttacatcccagaaccaatcagatctaaaacatcggcacaaatgccacctcctcatgaaaacattgatgataagattgtgggtaacacagacgcagaaaagaattctacgccttccgacgcttcttctactaagaacactgaccatatagtataa

SEQ ID NO: 3535 - DNA, 1500 bp, Saccharomyces cerevisiae
atgtcttggataaaaaatgtaacagaatctccgacttcactgattaaaaaagtttcatgtggtttgataattgctgcttctctatatgccattgcacccagcctaagtgcgctagtctttggggattctaagcagagtattgggaagtacacgacagtgggcttaattaatcgtgggaatgattgcttcataacatcatctttgcaaggcctggctggaatacctcgatttgtagaatatttgaaacggataagaacggtccttctagaattagaaactaagctgtcaaataatgcaaaaggcgacaatcctacagttgataacactacaaggcatagtcgacttgaaaactcgtctaattcacttgcccccttacacgaaagtcttaccagtttaattttggatttgatatctgtaaaagatcgtaagacgtcaatttctccgaaaatagtgataaacacattagagtccatctttaaatcaaagatctcatccaaacaaaatgatgcacatgaatttacattaatattactacaaacattacaggaagaacgatcaaaattgatcgattacagtaaacagatatgtaatttgaatataccaaagtttccatttgagggcgagacttccaagtttctagtatgccttaaatgcaagggtctatcagaaccatcatacaaacagactttcatccgcgaactgtccgtaccacaacaaacatcagagaatctatccaatattctagcacacgatgaaacagaaatcatagacgactattcatgcctgatctgccaaataagagcaatcttaaaccatgaagaatatagaaatttcaaggactgtaccccggatgaaattttaatgttggacagattgaaaaattatgccactaaagccccaattaacgaaaatttaccattcgaagtagaacagtacgtcaagcgttactcaaagggcaatttgcaggtatctaatataaagggaaaggtcatcaaaaaagatgtagtagtacaactgccagacatattaattgttcacttatcgagatccacattcaatggtattacatattctagaaatccctgcaatgtcaaatttggagaaagaataacactttctgaatatacattggctgagagtgggacaataacagaaaacaggcaagtcaaatataatttgaaaagtgttgtgaaacacaccggttctcattcgagtggacactatatgtgttacagacgcaagactgaaattcgtttcgggaaggaggatgaatcttccttcagaagagcaccagttgtcaacaatgaagttaacaagaatcgcgagcaaaacgttgcacataatgattacaaaaaaagcagatataaaaaagtcaaaaacgccctgcggtatccttattggcaaatatctgataccgccataaaggaatctaccgcttcaactgtcttgaatgaacagaaatatgcttatatgctatactacgaacgtgtaaataaataa

SEQ ID NO: 3536 - DNA, 1500 bp, Saccharomyces cerevisiae
atgttaagaatcagatcactcctaaataataagcgtgccttttcgtccacagtcaggacattgaccattaacaagtcacatgatgtagtcatcatcggtggtggccctgctggttacgtggctgctatcaaagctgctcaattgggatttaacactgcatgtgtagaaaaaagaggcaaattaggcggtacctgtcttaacgttggatgtatcccctccaaagcacttctaaataattctcatttattccaccaaatgcatacggaagcgcaaaagagaggtattgacgtcaacggtgatatcaaaattaacgtagcaaacttccaaaaggctaaggatgacgctgttaagcaattaactggaggtattgagcttctgttcaagaaaaataaggtcacctattataaaggtaatggttcattcgaagacgaaacgaagatcagagtaactcccgttgatgggttggaaggcactgtcaaggaagaccacatactagatgttaagaacatcatagtcgccacgggctctgaagttacacccttccccggtattgaaatagatgaggaaaaaattgtctcttcaacaggtgctctttcgttaaaggaaattcccaaaagattaaccatcattggtggaggaatcatcggattggaaatgggttcagtttactctagattaggctccaaggttactgtagtagaatttcaacctcaaattggtgcatctatggacggcgaggttgccaaagccacccaaaagttcttgaaaaagcaaggtttggacttcaaattaagcaccaaagttatttctgcaaagagaaacgacgacaagaacgtcgtcgaaattgttgtagaagatactaaaacgaataagcaagaaaatttggaagctgaagttttgctggttgctgttggtagaagaccttacattgctggcttaggggctgaaaagattggattagaagtagacaaaaggggacgcctagtcattgatgaccaatttaattccaagttcccacacattaaagtggtaggagatgttacatttggtccaatgctggctcacaaagccgaagaggaaggtattgcagctgtcgaaatgttgaaaactggtcacggtcatgtcaactataacaacattccttcggtcatgtattctcacccagaagtagcatgggttggtaaaaccgaagagcaattgaaagaagccggcattgactataaaattggtaagttcccctttgcggccaattcaagagccaagaccaaccaagacactgaaggtttcgtgaagattttgatcgattccaagaccgagcgtattttgggggctcacattatcggtccaaatgccggtgaaatgattgctgaagctggcttagccttagaatatggcgcttccgcagaagatgttgctagggtctgccatgctcatcctactttgtccgaagcatttaaggaagctaacatggctgcctatgataaagctattcattgttga

SEQ ID NO: 3537 - DNA, 1503 bp, Saccharomyces cerevisiae
atgaagtataataacagaaaactctcgttcaaccctaccacagtaagtatcgctggaacgttgcttacggtgttctttctcacaagactcgtgctttcgttcttctcgatatcgctattccagctggtaactttccaaggaatcttcaagccctatgttccagattttaaaaatactcccagcgtagagttctacgacctacgaaattaccaaggcaacaaagatggttggcaacagggtgaccgcatcttgttttgcgtgccactgagagatgcttctgagcatcttcccatgttttttaaccatctgaataccatgacatatccgcacaacctgattgatctgtcgtttttggtgagtgactcttcggataacaccatgggcgtgttactatccaatctacagatggcgcaatcgcaacaagacaagtccaaaaggtttggtaacatcgaaatctatgagaaggacttcggccaaatcattggtcagtccttttctgatcgtcacgggtttggcgcccagggccccagaagaaagctgatggccagggctcgtaattggcttgggtccgtggccctgaaaccataccactcctgggtttactggagagacgtggatgtcgaaaccatccccactaccatcatggaggatctaatgcatcacgacaaggacgtcattgtccccaacgtctggagacctttaccagactggctgggaaacattcaaccctacgatttaaattcatggaaggaatcagaagggggtcttcaattggcggattccctagacgaagatgctgtcattgtggaagggtacccagagtacgccacttggagacctcacctggcatacatgagagacccaaacggtaatccagaagacgaaatggaattggacggtattggaggggtctcgattctcgcgaaagctaaagtattcagaacaggctcacactttcctgcattctcctttgaaaagcacgcagagacagaagcattcggtaggctctcccgcaggatgaattacaatgtcatcggcttgccccattatgtcatctggcacatctacgaaccttccagcgacgacttaaagcacatggcttggatggctgaagaggagaagcggaaactagaagaagagagaattcgcgaattttacaacaagatctgggagattggatttgaagatgtcagagaccaatggaacgaagaaagagattcaatcttaaaaaacattgactccactttgaacaataaagtcactgtagactggtctgaagagggagatggctcggagctggtggactcaaagggtgactttgtctcaccaaacaaccaacaacaacaacaacagcaacaacaacaacaacagcagcagcagcaacagcaacagcaacaacagctcgacggcaacccgcaggggaaacctcttgatgacaacgacaagaacaagaaaaaacatcctaaagaagttccattagacttcgaccctgatagaaactag

SEQ ID NO: 3538 - DNA, 1503 bp, Saccharomyces cerevisiae
atgactaagctacactttgacactgctgaaccagtcaagatcacacttccaaatggtttgacatacgagcaaccaaccggtctattcattaacaacaagtttatgaaagctcaagacggtaagacctatcccgtcgaagatccttccactgaaaacaccgtttgtgaggtctcttctgccaccactgaagatgttgaatatgctatcgaatgtgccgaccgtgctttccacgacactgaatgggctacccaagacccaagagaaagaggccgtctactaagtaagttggctgacgaattggaaagccaaattgacttggtttcttccattgaagctttggacaatggtaaaactttggccttagcccgtggggatgttaccattgcaatcaactgtctaagagatgctgctgcctatgccgacaaagtcaacggtagaacaatcaacaccggtgacggctacatgaacttcaccaccttagagccaatcggtgtctgtggtcaaattattccatggaactttccaataatgatgttggcttggaagatcgccccagcattggccatgggtaacgtctgtatcttgaaacccgctgctgtcacacctttaaatgccctatactttgcttctttatgtaagaaggttggtattccagctggtgtcgtcaacatcgttccaggtcctggtagaactgttggtgctgctttgaccaacgacccaagaatcagaaagctggcttttaccggttctacagaagtcggtaagagtgttgctgtcgactcttctgaatctaacttgaagaaaatcactttggaactaggtggtaagtccgcccatttggtctttgacgatgctaacattaagaagactttaccaaatctagtaaacggtattttcaagaacgctggtcaaatttgttcctctggttctagaatttacgttcaagaaggtatttacgacgaactattggctgctttcaaggcttacttggaaaccgaaatcaaagttggtaatccatttgacaaggctaacttccaaggtgctatcactaaccgtcaacaattcgacacaattatgaactacatcgatatcggtaagaaagaaggcgccaagatcttaactggtggcgaaaaagttggtgacaagggttacttcatcagaccaaccgttttctacgatgttaatgaagacatgagaattgttaaggaagaaatttttggaccagttgtcactgtcgcaaagttcaagactttagaagaaggtgtcgaaatggctaacagctctgaattcggtctaggttctggtatcgaaacagaatctttgagcacaggtttgaaggtggccaagatgttgaaggccggtaccgtctggatcaacacatacaacgattttgactccagagttccattcggtggtgttaagcaatctggttacggtagagaaatgggtgaagaagtctaccatgcatacactgaagtaaaagctgtcagaattaagttgtaa

SEQ ID NO: 3539 - DNA, 1503 bp, Saccharomyces cerevisiae
atgactttacctgaatcaaaagacttttcttacttgttttcggatgaaaccaatgctcgtaaaccatccccattgaaaacctgcatccatcttttccaagatcctaacattatctttttgggtggtggcctgccattaaaagattatttcccatgggataatctatctgtagattcacccaagcctccttttccccagggtattggagctccaattgacgagcagaattgcataaaatacaccgtcaacaaagattacgctgataaaagtgccaatccttccaacgatattcctttgtcaagagctttgcaatacgggttcagtgctggtcaacctgaactattaaacttcattagagatcataccaagattatccacgatttgaagtataaggactgggacgttttagccactgcaggtaacacaaatgcctgggaatctactttaagagtcttttgtaaccgaggtgatgtcatcttagttgaggcacattctttttcctcttcattggcttctgcagaggctcaaggtgtcattaccttccccgtgccaattgacgctgatggtatcattcctgaaaaattagctaaagtcatggaaaactggacacctggtgctcctaaaccaaagttgttatacactattccaacgggccaaaatccaactggtacttccattgcagaccatagaaaggaggcaatttacaagatcgctcaaaagtacgacttcctaattgtggaagatgaaccttattatttcttacaaatgaatccctacatcaaagacttgaaggaaagagagaaggcacaaagttctccaaagcaggaccatgacgaatttttgaagtccttggcaaacactttcctttccttggatacagaaggccgtgttattagaatggattccttttcaaaagttttggccccagggacaagattgggttggattactggttcatccaaaatcttgaagccttacttgagtttgcatgaaatgacgattcaagccccagcaggttttacacaagttttggtcaacgctacgctatccaggtggggtcaaaagggttacttggactggttgcttggcctgcgtcatgaatacactttgaaacgtgactgtgccatcgatgccctttacaagtatctaccacaatctgatgctttcgtgatcaatcctccaattgcaggtatgtttttcaccgtgaacattgacgcatctgtccaccctgagtttaaaacaaaatacaactcagacccttaccagctagaacagagtctttaccacaaagtggttgaacgtggtgttttagtggttcccggttcttggttcaagagtgagggtgagacggaacctcctcaacccgctgaatctaaagaagtcagtaatccaaacataattttcttcagaggtacctatgcagctgtctctcctgagaaactgactgaaggtctgaagagattaggtgatactttatacgaagaatttggtatttccaaatag

SEQ ID NO: 3540 - DNA, 1503 bp, Saccharomyces cerevisiae
atgctcagaaatacgctaaaatgtgcccaattgtcgtctaaatacggatttaaaactaccacacgtacattcatgactactcaaccccagctaaatgtcaccgacgcaccacctgtgctatttaccgttcaagatacagctagagttatcacgctaaataggcccaaaaagctcaatgctttgaacgccgaaatgtcagaatccatgttcaagactttgaacgagtatgcaaagagcgatactacaaacttagtcattttaaagtcatccaaccgaccacgttcgttctgtgctggtggtgatgtagctactgtggcaatattcaattttaacaaagaatttgccaagtccatcaaattttttactgatgaatattctttgaattttcaaatagcaacttacttgaaaccaattgttaccttcatggacggtatcaccatgggtggcggcgttggtctatccattcacacgccctttagaattgctacagaaaacaccaaatgggccatgcccgagatggacattggtttttttccagatgtaggctcaacttttgctctccctagaatcgtgacattggctaactcaaactcacaaatggccctgtatctatgtcttacaggagaagtagtcacaggagcagacgcttatatgctcggcttagcgtctcattacgtcagtagtgaaaatttagatgctttgcagaaaagattaggtgaaattagccccccttttaataacgatccacaatctgcatacttcttcgggatggttaacgaatccatcgacgaattcgtatcaccattaccaaaagattatgttttcaagtattctaacgagaaattaaacgttattgaagcctgttttaacttgtctaaaaatggtactattgaagacataatgaataacttacgtcaatatgaaggttctgcggaaggtaaggctttcgcacaagaaatcaaaacgaaattgttaaccaagtcaccatcctctcttcaaatcgccttgagattggtgcaagagaattccagagatcacatagaatctgctatcaaaagagacttatacacagcagctaacatgtgcatgaaccaggactctttggtggaattctctgaagccacaaagcataaacttattgataaacaaagggtcccgtatccatggacaaagaaggaacagttatttgtatctcagttgacatctatcacatctcctaaaccatcgctaccaatgtcattactaagaaatacctcgaatgttacttggactcaatatccctaccattctaaataccaattgcctacagaacaggaaatcgctgcgtatattgaaaagagaacgaatgatgacactggcgccaaagttaccgaaagagaagtactaaatcactttgccaatgtgattccttctagaagagggaaactgggtatccaatcgctatgtaaaattgtttgtgaaagaaaatgtgaagaagttaacgatggcttaagatggaaataa

SEQ ID NO: 3541 - DNA, 1503 bp, Saccharomyces cerevisiae
atgtcaattatgccagttaagaacgccttggcgcaagggaggacgctcctcatggggaggatgcctgctgtaaagttttctacaagaatgcaattaagaaatagaactgcggtgctatggaatagaaagttttccacgcgtcttttcgttcagcaacgacgcagttctggagagattgtggatcgtgccaaagctgctgccgcaaatagcggaagaaaacaggtctccatgaaatgggttgttttaactagtttcaccattgttctaggaaccattttactagtgtcaaggaatgatagtacagaggaggatgctacagagggcaaaaaagggagaaggacaagaaaaatcaaaatatttaacaataattggctctttttctgctattctactttaccgctgaatgcgatgtctcgattatggggccaagtaaattctcttacgttacccatttgggttagaccatggggttacaggttatattctttcctttttggagttaacttggacgagatggaagatcctgatttgacacattatgcaaatttatccgaatttttctatcgtaacataaaaccaggcacacgtccagtagcacaaggcgaagacgttatagcttctccaagtgatggaaagattttacaagttggtataatcaactctgaaactggcgaaatcgaacaagtcaagggaatgacatattccatcaaagaattccttggcactcactcccaccccttgatgtctaagagtgcatctagtctagatttgacttctgatgaggaaaagcatagagaattcgccagggtaaatagaatacaattagcgggttccgaagacactgaacagcctcttcttaactttaaaaacgagggcgatcaatctgttcgagagttcaaaccaagtgtgtccaaaaatatacatcttttaagtcaactttctttaaactacttctctaatgggttttcgtgctctgagcctcatgatacggaacttttctttgccgtcatttatttggctcccggtgattaccatcatttccactctccagttgactgggtttgtaaggttcgccgccatttcccaggtgatttattctccgtggcaccttatttccagcgtaacttccctaatcttttcgttctaaatgaaagagttgctttgttgggtagttggaagtacggattttttagcatgactcctgttggtgcaacaaatgttggttcaatcaagttgaattttgatcaagaatttgtgacaaattcaaagagcgacaaacacttggaaccacatacctgctaccaggcagtatatgagaatgcaagtaaaatattgggagggatgcctttggttaagggtgaagaaatgggtggctttgaattgggtagcactgttgtactttgttttgaagctcccactgaatttaagttcgatgttagggttggtgataaggttaagatgggacagaaattaggcataattggaaagaatgatttaaaatga

SEQ ID NO: 3542 - DNA, 1503 bp, Saccharomyces cerevisiae
atgtcagagggaaaagtagacgaatttatggccatcactggcgctgatgacgctgctattgccactcaattcatcgaaatggcagacgggaacttgaacacagccatatcattgtttttcgaaaatggtggggctgctttactgagcagtaacaacacacctactccgtctaattcgactcctatggcgcccacctctgtagattcagatgccgatgcacaattagcggagaggttgcaaagggaagcttaccaacaacaacagcctgaccaagattatgtcaggccacctgatgaggcaagacatgaagtacttactgaaacttcaggattcccaatttcttacggcggcattggcggaagatttgaaccattgcatagggtgaacgacatgtttgacgaaggaagacctgaaagcatttttaatcaacgattggatgacacaaatactaatacatacatcaatgacaactcttcagattccttggactccgaggaagaaaatgacgacgacgaatatgagtatgtggaagagccggtcatcgaacttgatgaagacggcaatatcaaggagtacaccaaattagtgagaaagcctaaaaccatttccaaggagcagaaattagctttgttatttaggcctccattttcaatcatgtccaaactcgacttagacgctgcaaagcaaaaggcaagggcaaagcaaaaatggataatgattaacattcaggattcaggaatcttccaatgccaagccctcaacagggatttgtggtcgtccagaccggtaaaaactataatcaaagagaacttcgttttcctacagtatcaatatgaatcacgtaatgcccaaccctatcttcagttctatcacttgaataataaggatgatttgccccatatcgcgatactggatccaattaccggtgaacgtgtcaagcaatggaatagggttgttcccattccagagcaattcatctcagaaatcaacgagtttttggcctcattttcgctagatccaaaggtccctaatcccacggttaatgaacctcttcctaaagtggatccaacaactttgaccgaagagcaacaaatggaattagccattaaagagtcattaaataataactcgagcaaatcaaaccaagaagaagtgccgagtactggcgaagaacagaaacgagtacaagaaccggatccattcagtaccattgaagccagggtgcatccagaaccgccaaataaaccagggatcactacaagaattcaaattcgtaccggtgatggctccagactagttcgtagattcaatgctctggaagacactgtgcgtactatttacgaggttatcaagacagaaatggatggttttgccgattcaagattcacactaaatgatcaccaaagagaggacttgattgataaattaaacatgaccatagcggacgccggcttaaaaaatagttctttactacttgagaagcttgaccctgaaatagaataa

SEQ ID NO: 3543 - DNA, 1503 bp, Saccharomyces cerevisiae
atgtcattcgacgacttacacaaagccactgagagagcggtcatccaggccgtggaccagatctgcgacgatttcgaggttacccccgagaagctggacgaattaactgcttacttcatcgaacaaatggaaaaaggtctagctccaccaaaggaaggccacacattggcctcggacaaaggtcttcctatgattccggcgttcgtcaccgggtcacccaacgggacggagcgcggtgttttactagccgccgacctgggtggtaccaatttccgtatatgttctgttaacttgcatggagatcatactttctccatggagcaaatgaagtccaagattcccgatgatttgctagacgatgagaacgtcacatctgacgacctgtttgggtttctagcacgtcgtacactggcctttatgaagaagtatcacccggacgagttggccaagggtaaagacgccaagcccatgaaactggggttcactttctcataccctgtagaccagacctctctaaactccgggacattgatccgttggaccaagggtttccgcatcgcggacaccgtcggaaaggatgtcgtgcaattgtaccaggagcaattaagcgctcagggtatgcctatgatcaaggttgttgcattaaccaacgacaccgtcggaacgtacctatcgcattgctacacgtccgataacacggactcaatgacgtccggagaaatctcggagccggtcatcggatgtattttcggtaccggtaccaatgggtgctatatggaggagatcaacaagatcacgaagttgccacaggagttgcgtgacaagttgataaaggagggtaagacacacatgatcatcaatgtcgaatgggggtccttcgataatgagctcaagcacttgcctactactaagtatgacgtcgtaattgaccagaaactgtcaacgaacccgggatttcacttgtttgaaaaacgtgtctcagggatgttcttgggtgaggtgttgcgtaacattttagtggacttgcactcgcaaggcttgcttttgcaacagtacaggtccaaggaacaacttcctcgccacttgactacacctttccagttgtcatccgaagtgctgtcgcatattgaaattgacgactcgacaggtctacgtgaaacagagttgtcattattacagagtctcagactgcccaccactccaacagagcgtgttcaaattcaaaaattggtgcgcgcgatttctaggagatctgcgtatttagccgccgtgccgcttgccgcgatattgatcaagacaaatgctttgaacaagagatatcatggtgaagtcgagatcggttgtgatggttccgttgtggaatactaccccggtttcagatctatgctgagacacgccttagccttgtcacccttgggtgccgagggtgagaggaaggtgcacttgaagattgccaaggatggttccggagtgggtgccgccttgtgtgcgcttgtagcatga

SEQ ID NO: 3544 - DNA, 1503 bp, Saccharomyces cerevisiae
atgtcatttgaaaatttacataaagtcaatgctgaggcattggaagatgcagtggttgagatctgctcctcattgcaggttgatgcagcaaagttggacgaactaacagcgtacttcattgaatgtatggaaaaggggttgaataacacctctgtaggcgaagaaaagacggtggacaagggtctacccatgatccctacatatgtaaccagtttgcccaatgggacggaacgtggtgttttgctggctgcagatttaggtgggactcacttcagagtgtgttctgtgactttgaatggtgacggaacctttgatatgcagcaattgaagtctaagattccggaagaatatctaaatgacaaggatgtcaccagcgaggagctgtttagctacctgggtcgccgtacaagggccttcgttaggaagcatcatcctgagttgttgaagtccacgggggagaacataaaacctttgaaaatgggatttaccttctcatatcccgttgaccaaacctctttgagttccggtactttaatcagatggaccaaaagcttcaagattgaagacacggtcggcaaggatgtcgtgaggttataccaggagcaattagacattcaggggctctctatgattaatgtggtagctttgaccaacgacacggttggcactttcctatcccactgctacacttcaggctctcgtccatcgagtgctggtgagattagcgagcctgtcattggttgtatctttggtactggtactaacggttgctatatggaggatattgaaaacatcaagaagctaccagatgagctcagaacaagactgctgcatgaaggaaaaacccaaatgtgcatcaacatcgaatggggttctttcgacaatgaattgaaacatttgtctgctacaaagtatgacatcgatattgaccaaaaattttctccaaatccaggttaccatctatttgaaaaaagaatttccggcatgtacttgggtgagctgttaaggaacatcctggtggacttgcatgcaaggggcttaatcttgggacagtatcgtaattacgatcaattacctcaccgtttaaagactcctttccaattgtgcagtgaagttctttccaggattgaaatcgatgattcgacaaacttgcgtgaaactgaattgtcgtttttgcagagtttgaggctaccgaccacttttgaagaacgtaaagcaattcaaaatctggtccgttccattacgagaaggtctgcatatctagcagccgttccgattgccgccatcctaatcaagacaaacgctttgaacaaaagatatcacggtgaggtagaaattggttttgacggttatgtcatcgaatactatcctggattcagatccatgctgagacatgctttggcattaagtccaattggcactgagggtgaacgtaagatacatttgcgtctagccaaagatgggtccggtgttggcgcagctttgtgtgctctggtggcataa

SEQ ID NO: 3545 - DNA, 1503 bp, Saccharomyces cerevisiae
atgtctagattagaaagattgacctcattaaacgttgttgctggttctgacttgagaagaacctccatcattggtaccatcggtccaaagaccaacaacccagaaaccttggttgctttgagaaaggctggtttgaacattgtccgtatgaacttctctcacggttcttacgaataccacaagtctgtcattgacaacgccagaaagtccgaagaattgtacccaggtagaccattggccattgctttggacaccaagggtccagaaatcagaactggtaccaccaccaacgatgttgactacccaatcccaccaaaccacgaaatgatcttcaccaccgatgacaagtacgctaaggcttgtgacgacaagatcatgtacgttgactacaagaacatcaccaaggtcatctccgctggtagaatcatctacgttgatgatggtgttttgtctttccaagttttggaagtcgttgacgacaagactttgaaggtcaaggctttgaacgccggtaagatctgttcccacaagggtgtcaacttaccaggtaccgatgtcgatttgccagctttgtctgaaaaggacaaggaagatttgagattcggtgtcaagaacggtgtccacatggtcttcgcttctttcatcagaaccgccaacgatgttttgaccatcagagaagtcttgggtgaacaaggtaaggacgtcaagatcattgtcaagattgaaaaccaacaaggtgttaacaacttcgacgaaatcttgaaggtcactgacggtgttatggttgccagaggtgacttgggtattgaaatcccagccccagaagtcttggctgtccaaaagaaattgattgctaagtctaacttggctggtaagccagttatctgtgctacccaaatgttggaatccatgacttacaacccaagaccaaccagagctgaagtttccgatgtcggtaacgctatcttggatggtgctgactgtgttatgttgtctggtgaaaccgccaagggtaactacccaatcaacgccgttaccactatggctgaaaccgctgtcattgctgaacaagctatcgcttacttgccaaactacgatgacatgagaaactgtactccaaagccaacctccaccaccgaaaccgtcgctgcctccgctgtcgctgctgttttcgaacaaaaggccaaggctatcattgtcttgtccacttccggtaccaccccaagattggtttccaagtacagaccaaactgtccaatcatcttggttaccagatgcccaagagctgctagattctctcacttgtacagaggtgtcttcccattcgttttcgaaaaggaacctgtctctgactggactgatgatgttgaagcccgtatcaacttcggtattgaaaaggctaaggaattcggtatcttgaagaagggtgacacttacgtttccatccaaggtttcaaggccggtgctggtcactccaacactttgcaagtctctaccgtttaa

SEQ ID NO: 3546 - DNA, 1503 bp, Saccharomyces cerevisiae
atgtctgattcatcacctactatcaactttattaatttcaatcaaaccggaacgtgtatttcccttggaacgtcgaaaggtttcaaaatattcaattgtgagcccttcggaaaattttattcagaggacagtgggggctatgctatcgtcgagatgttgttctccacctcgttactagccctcgttgggataggcgatcaacctgcgctttcaccaaggagattgcgtataatcaacacaaaaaaacattctattatctgtgaggtgactttccctacttctattctgagtgtgaaaatgaataagtctcgattggtggtacttttacaagagcagatttatatttatgatatcaacaccatgagactattgcatactatagaaacaaaccctaacccacgtggccttatggctatgtctccttcggtagccaacagctatttagtgtatccatcaccaccaaaagttattaactccgaaattaaagctcatgccaccacaaacaatatcacattgtcagttggtggcaacacagagaccagtttcaagagagatcagcaagatgctggccatagtgacattagcgacttggatcagtattcgagctttactaagagggatgatgcggatccaacaagcagtaacggcggtaacagcagtataataaagaatggtgatgtgatcgtattcaacttggaaacattacagccaaccatggtcatcgaagctcataagggcgagattgctgcaatggcaattagttttgatgggacactaatggctaccgcctctgataaaggtactatcatcagggtctttgacattgaaacgggtgataagatctaccaattcaggagagggacgtacgcgacaagaatttactccatatcattcagtgaagatagccagtacttggcggttaccggctcttccaaaaccgtgcatatcttcaaattggggcattcaatgagcaacaataaactagacagcgatgatagcaacatggaagaagctgcagccgatgattcatcgctcgataccaccagtatcgatgcgctgagtgacgaggaaaacccgacaagactcgcaagagaaccatatgtggatgcatcaagaaagacaatgggtaggatgatacgttactcttctcaaaagctatcccgaagagctgccagaacattgggtcagattttccccatcaaagttacatcgttgttggaatcctcgcgccattttgcgtctttgaaacttcccgttgaaaccaattcccatgtaatgaccatatcaagtataggctctccaatagatatagacacatccgagtatccggaactcttcgaaactggcaattccgcaagtacagagtcctaccatgagcctgttatgaagatggtccccatcagggtcgtttcctcggatggatacctatacaactttgttatggacccggagagaggcggcgattgcttaatattgtcacagtattccatcttgatggattga

SEQ ID NO: 3547 - DNA, 1506 bp, Saccharomyces cerevisiae
atgattagatctgtgagaagggttttcatttacgtctcaatattcgtattgataatagttttgaaaagaacattaagtggcacagatcaaacgtcaatgaaacaaccagtggtggtcattggctctggtttggcaggcttaaccacaagtaatcgtctcattagtaaatacagaattcctgttgtgcttttggataaggcggcttctattggtgggaattctataaaggcttctagtggtattaatggtgctcacacagacactcaacaaaatttaaaggtaatggacactcccgaattgtttttgaaagatactttgcattcggctaaaggcagaggggttccatcactgatggataagttgactaaggaatccaagagtgctatcaggtggttgcaaacagaattcgatttgaaattagacctccttgcgcaattgggcggtcactctgttccaaggacccatagatcttctggcaaattaccaccaggttttgaaatcgtgcaagcgttatcaaaaaaactaaaggatatctcttccaaagattccaatctcgtgcagattatgctaaacagtgaagtagtggatatcgagcttgataatcaaggtcatgttactggtgtagtatatatggacgagaacggaaaccgtaaaatcatgaagtcacaccatgtcgtgttttgctcaggtggatttggttactctaaggaaatgttgaaagagtactcaccaaatttgattcacttgccaactactaatggcaaacagactacaggtgatggtcaaaaaatcctttcaaagttgggtgccgaattgattgatatggatcaagtgcaggtacaccctaccggcttcattgatccaaatgaccgtgaaaataactggaagtttttggctgcagaggcattgaggggtttaggcggcatcttattgcatcccaccactggaagaaggtttacaaatgaattgagcaccagagatacagtaaccatggaaatacagtctaaatgtccgaaaaatgataatagagcacttttggtaatgagcgacaaagtctacgagaactatacgaataacataaacttttatatgtccaaaaacttaatcaaaaaagtgtcaatcaacgatctgatccgacaatatgacctacaaactacagcttctgaactggtaactgaactgaagagctattccgatgttaatactaaggatacgtttgataggccattgattatcaatgcctttgataaagatatttcgactgaatcaactgtttatgttggggaagttacaccagttgttcatttcacaatgggtggtgtgaaaattaatgagaaatctcaggtaattaagaaaaattcggaaagcgttctatctaatgggatatttgctgctggtgaagtttcgggtggtgttcatggagccaacagattgggtggatctagtttgttagagtgtgttgtctttggaaagacagctgcggataacatagcaaaattgtactga

SEQ ID NO: 3548 - DNA, 1506 bp, Saccharomyces cerevisiae
atgattggctcacttagaaacaaatttgagcatttcaaagtttctgaaaagggaggtcaaaatttatctacaacactaccgaaactaccccctgcaaaggaccttgatagatcaactatctacaagtaccgttacaattatggtgtaaacttgggtgcgttatttgtgctcgaaccatggattttttctaaagaaaccatttgtacaatcgatgggaaagaatatgatagcgaatttgatgctatttcccaacaattgaagaagcattcttctgaagacgttgcgaaaatgttaagcgatcactataaaaagtacattgatcgaattgactgggaatggctatctaaagatgcccatattacagcgttacgtattccaattggatattggcatgtcgaagatgggaagcatttagattcgcttccatttgccccattgagaaaagtttatgagttagccaaaccttgggaaaaacttggcgaattaatcaataatgccaagaaaatgagcattggtgtattgatagatttgcatggtctaccaggaggcgctaattgcgactcacacagtggctcgaagagtggtgaagctgcgtttttccacaaggaaaagtacatgaccaaagtctacaaagatattttacctgcaattattaacacaatgactctgggcaacgaaaacatcattggtattcaagtggttaatgaggcatgttttgataataacccaaagggccaaaaattctattattcagaagccattaataccgttgaaaaacttcaaccaggtttacctgtcataatatccgatggttggtggccccaacaatgggcagactgggttaaagaaaaacattttagtgaaatagtggtcattgattctcatgtctaccgctgtttttctgattctgataagtcgaaggatgccaattccattatcaaggatttgccaaatactgtgaattttcctcatgaagatgccgattatactgttggtgaattttctggtgttcttgatggacaaacttggaataaaacttctggcgacagagacgctattgttcaaaaatacgtacaaacccaagcagatgtattttctcatgtagctagttggggttggtttttttggactttgcagtttgaatacggtgatggaggtgaatggggcttagctcccatgatgcagaaaggaaatttaccaaaacgtcctcacggtgatgacttacaagtcgacaagaagaaaatagattcaataatccatgaacacgaggcttattggaacggtaaaggtaaaaattttgaacactggaggtttgaggatggcataaagacagctgttgatgatataattgcctttaggaaatttgacaattcattaattggtagatggcattcatggaagtcgcaaagaagagctgaatacgtttctgccaaaaaagatagcgaatttatgtgggaatgggatcaaggctaccaacgtgggttagatgagtttaataagtattaa

SEQ ID NO: 3549 - DNA, 1506 bp, Saccharomyces cerevisiae
atgcttttacaaggaatgcgtttatcgcaaaggttacataagagacatctatttgcttccaagattttaacgtggactacgaaccctgctcatatacgccacctacatgatataaggccgcctgcatcaaacttcaatacgcaagaatcggcccccataccggagtctccagcaaactcaccaactcgaccacagatggcacctaaacccaatttgaaaaaaaaaaatcgtagtttaatgtattctattattggggtttccatagtaggtttatatttttggtttaaaagtaactccaggaaacaaaaactacctctttcggcgcaaaaagtctggaaggaagccatatggcaagaaagtgataaaatggattttaattacaaagaagcgttaaggcggtatattgaggcgttggatgaatgcgatcgctctcatgtcgatttattgtcagatgattataccagaatagagctgaaaattgctgaaatgtatgaaaagctcaatatgcttgaagaagcccaaaatttgtaccaagaattattaagtcggtttttcgaagcgctgaatgttcctggcaaagttgatgagagtgaaagaggcgaggttttaagaaaagacttgagaatcttgattaaatcgttagaaatcaataaggacatagaaagtggcaagagaaaattgctacaacatttacttttagctcaagaggaaattttaagcaaatcgccagagttgaaggaattttttgaaaacagaaaaaagaagctctcgatggtaaaagacatcaatagagaccctaatgatgattttaaaacatttgttagtgaggaaaatattaagtttgatgagcaaggctatatgattttggatctggaaaagaatagcagcgcttgggaaccctttaaggaagaattttttactgcgagagatttatatacagcttattgtctgtcatcaaaagacatagctgcagctctaagttgcaagataactagtgtggaatggatggttatggcagacatgccaccaggacagatattgctatcacaggcaaatttggggtcattgttctatcttcaagcagaaaagctagaagctgacttaaatcaattagagcaaaagaaaagtaaagagtccaaccaagagttagatatgggaacatacataaaagccgttagattcgtacgcaaaaatcgtgacttatgtctggaaagagcacaaaaatgttacgacagcgttattgcgtttgccaaaagaaacagaaaaattaggtttcatgtgaaggatcaactggatccttcaattgcacagtcaattgctctatctacctatggaatgggggttttaagccttcatgaaggtgttttggctaaagctgaaaaactattcaaagattcgatcactatggccaaggagactgaatttaatgaactccttgcagaagctgaaaaggaactagaaaagacgacagtcttgaaagcggccaaaaaagagggtttaaactaa

SEQ ID NO: 3550 - DNA, 1506 bp, Saccharomyces cerevisiae
atggttacaaatatggtgaaattgaggaatttaaggagattgtattgttcatcccgtctcttaagaactatacagaacgggagaatttcttctgtttcttcaatatcgttgagtaagaaatatactacaaaatctgccaaagaaggtgaagaaaacgtagaaaggaagcatgaggaggaaaaaaaggatacattaaaaagttccagtgtaccaacttcacgaatatcgagattgttccattatggctcactggcagcaggggtgggcatgaatgccgcagcaaaaggcatatcggaagttgcaaagggcaattctcccacttggaaatctttgattctatcagattcgaatattgacagaattaccaataaattttctaaaatgagaggtgttgcccttaaaatagggcaactattgtcttttcaggatgagaaagtgttgccaaaggaattatacgaaattttatcaagggtacagaatagtgcaaatcatatgcctcaaaggcaattggaaaaggttatggccaaggaattaggtgctaattggaagacaaagttttccaaatttgacaagatacctatggcagctgctagtatcggacaggtacatgcggcagagttgcccagtggtcaaagagtggttgtcaaaattcaatatcctggggttaaagaatccattgattcggatttgaatagtttactaatgttacttacagcctcaagtttattaccgaagggattatttttggataagacaattgccaacgctagaactgagttaaaatgggaatgtgattacaacagagaggctagagctctacaaaagtttgaggcgttgctaaaggatgacccagcgtttgaggttcctcatgtgtttcctgaatatacaaccgataatattataactatgacacgtatggagggaactgaaataatgaaattgcccaaggcatcacaagaaaccaaaaattttatttcggagaatatcatgagactatgtctggaagaaattgccactttcaagtatatgcaaacggatcctaattgggcaaatttcctctataacggtaggacaaagaaaattgaattattggatttcggtgcctccagaccttttgcagaagattttattctaaaatatagaaaacttttaacttacgccacattgagagataggaaaggggcgtacgaaatgtctgtacaactgggctatctcacaggcttagaatcgcagtccatgaaagacgcgcacgtcgatagtgtacttacacttggtgaaccttttaggggtgatgtagataaatctttcgatttcaaggatcaaacagtctcagacaggattagaggtaatatcgggttaatgttgaatgaaagactatgtccgccaccagaggaaacatactcgttacatagaaaatttagtggcatttttcttttgtgtgcaagaatgggtgcgtctgttcattgtgcaaagctttttaaagagatttttgcctataaagtttaa

SEQ ID NO: 3551 - DNA, 1506 bp, Saccharomyces cerevisiae
atgtcagaagagagggaagaaaacgggatatctagggctacgctgaatacgcagcgactttcagcaatgatcgattcactgaacaatgagaaagatgacaggctctttccatctcccacaactaccaggacaatgatcacagaggaaaaggcggatcaaagtgatgtctttaaaccaccatcgagattgttgagatcacctgctggtgacgtttcgctgccacctggtgataacagatcaagtatgatttccaactactctggaattattcaagaaggcgttgaagtatcatatgtggtcaaaaaccggcaacagacccaagaacggcgcacaagtaaggattccaatagtttgtactccttgaaagagcccgtgagcaagaacgagttaccgtcgttgcccatgttgccttcagaagcgacattgacaaaacatctaagtgataaccaaagcacaaaatcgaataccaatgcagacgaaattgtcattaaaccagttactaatgccaaacctgtgggaaggtttaactctaacacttcaaaaaaagtagagggtcgtggctcactgaaactgttatctagtcctctacgtcaggaaaaagttatgcgttcctctataggatcaggtaatttggccagcgagagcggatcttccacttataataccaaattccatcaatctattcaagagcagctcgaagaagaagaggaaggaaatgttagcgataagctttcaattgtttccagtgtcatacccgagttgtatacaaccaccaacgaagcacccaaagcgataaacccaatacgttctgaaaccaatgactacaatccaactattccgcccagaagtaaggaccgtcctaggtcaaggttgttcatcgaagaaggtgatggcgagggggatcttttaaccgaagaaatattaccaacgccggtccaacctggtggccactataagaactcatctcagatttccacagttagtgaacaaaaatcggaatcttactattctgcggcaacgagtatgcctccagaggaagagacttacttgacaagaccattgcccagcacacccaatgaggatagcagagttacatcgaatttgaaacgtgacgacacattgaaggctattcatgatagggcaaatcatacctctacttcgacaaacaaacaagatgatgacatgtacgaggacatcattgaggaaacgcccaagaaaactaaactcaagaaggatacgaaaaaaaagctcaataaaaaaaaatctgtgaaggaattgcgatcctttgatatcgacacactaaatcaactgttgagtgtgacaaagggaaccttaatcgggtctgaatttgcgcaactggggatgaaaattgaggagaaacgtgccctggagagactagtagactctttgtccaggttaacagcagacatggttcttgatccggaccgctatgaagaaggactgaaaagattagacaaagctacaaaggctcttgaagggttttga

SEQ ID NO: 3552 - DNA, 1506 bp, Saccharomyces cerevisiae
atgtccaaaattgttaagagaaaggaaaagaaggctaacgatgaattaacttctttagcagaaaagattagagcaaaagctttggaaaatcaaaagaagcttatagaagcagaaaaggaaggtggttcagagtccgattctgaagaagatgctactgctgaaaagaaaaaggttttgaaatcaaaaagcaaatccacagtatcaacccaaaatgaaaatactaatgaagatgaatcttttgaatcctttagcgaactgaatctggtccccgaattaattcaagcttgtaagaacttaaattattccaaacccactcccattcaatctaaggcaattcctcccgcgttagaaggtcacgatataattggacttgcgcaaacaggttctggtaaaactgctgcatttgctattcccattttgaatcggttatggcatgatcaggaaccatactatgcgtgcattctagctccaacaagagaattagcacaacagatcaaagaaacatttgactcattaggatccttaatgggcgtgagatcgacatgtattgtgggtggtatgaatatgatggaccaggccagagacctgatgagaaagccacatattatcattgctacacctggtagattaatggaccatttagagaataccaaagggttttcactgaggaaactgaaattcttggttatggatgaagctgatagattattagacatggaatttggacctgttcttgatagaattttaaagatcatcccaacccaagaaagaaccacttatcttttttccgctactatgacttccaaaattgataaattacaaagagcaagtttgacaaatcctgtgaaatgtgccgtgtcaaacaaataccaaaccgtagatacattagtgcaaacactgatggtcgttccaggtggtcttaagaacacatacctaatttatttattaaatgaatttattggaaagacgatgatcatttttacaagaaccaaggccaacgcggaaaggttgtcaggattatgtaatttgctcgagtttagtgccactgcgctacatggtgatttgaatcaaaaccagagaatgggatctttggatcttttcaaggcaggtaagaggtctattctcgtggctacagatgtcgctgcgagagggttggatattccatcagtggacatagttgtaaactacgatattcctgtggattccaagtcctacattcatcgtgtgggaagaaccgcaagagctggtagatcaggaaaatctatctcactagtatcacaatacgatctggaattgatcttaagaattgaagaagttttaggtaaaaaactaccgaaggaaagtgtggacaagaacattatattgaccctaagagattccgtcgataaggctaatggggaagttgtaatggaaatgaacagaagaaacaaggagaagattgccagaggtaagggaagaagaggaagaatgatgacaagagagaatatggacatgggagaaaggtag

SEQ ID NO: 3553 - DNA, 1506 bp, Saccharomyces cerevisiae
atgtcccatcgtatagcaccttccaaagaacgatcttcatcatttatttcaattttagacgatgaaacaagagacacattgaaagctaatgcagtcatggatggtgaagtagatgtcaaaaaaacaaaaggaaaaagctctcggtatatcccaccatggacaactccatatataataggtataggtggtgcttcaggttcaggcaagacaagcgttgctgctaagattgtgtcgtcaattaatgttccctggacagtattaatatctttggataacttttacaatccattaggcccagaggacagagccagagcctttaaaaatgaatacgatttcgacgagccaaatgccatcaacttagatttggcatataagtgcattttgaacttaaaggagggcaaaaggacaaatatcccagtttatagcttcgtccaccacaatagagttcctgataaaaatatagtcatatacggggccagtgtggtagttatcgaagggatctacgccctttacgatcgccgattgctggatttgatggacttgaaaatttatgttgacgctgatttggatgtctgcttagcaagaagattgtcgagagatatagtttccagagggagagatttggatggttgtattcaacaatgggagaaatttgtgaaaccaaatgcggtaaagtttgtgaaaccaacaatgaagaatgcagatgctatcattccatcgatgagtgataatgctacagcggtaaatttaatcattaaccacatcaagtcaaaactggaactaaaatcaaatgaacacttaagagagctaatcaaattgggctcttctccttcacaagatgtgcttaatcgtaacataattcatgaattgccgcccaccaaccaagttctttcgctgcatactatgcttctaaataaaaatctaaattgcgcggactttgttttctactttgacaggttagcaacaattttgttatcatgggcacttgatgacattcctgtagcacatacgaacataattacacctggtgagcataccatggaaaacgttattgcctgtcaattcgatcaagttacagctgttaatattattcgatctggcgattgttttatgaagtctttgagaaagacgatccccaatatcacaattggtaaattgttgattcagtccgattcacaaactggggaacctcaactgcattgcgaatttttacccccaaatatagaaaagtttggcaaggttttcttaatggaaggtcaaatcataagtggtgcggccatgatcatggccatccaggtgcttttagatcatggtattgatttggaaaagattagcgtggtggtttatttggccactgaagttggtatccgacgtatattaaatgcatttgataacaaagtcaacatttttgctggtatgatcatctccagagaaaagttacaaaatcatcaatacaaatgggcattgaccagattttttgattcaaagtattttggttgtgattga

SEQ ID NO: 3554 - DNA, 1506 bp, Saccharomyces cerevisiae
atgttgaacattcccataattgctaactccaagaggttcctgttctcaaaggatcacgaagcgcaatctacgagagatcacgatgtggagctggagacaagggagggcccaagttcaggatataatccaaacttcaatgcagcggacgcgattttgaaaaagaacagcgatcaagtagatcttgacgttaataagttaacgaacgtcacctcaagagttttaaacaccccagaggcctctttgatttatgatgatgacagagagttcccagatggtgggttaaaagcatggctggtagtatttggtgcgtttatgggactggtcccggtttttggcttaatcaactccttaggggctattgaatcatatatctctaaacatcaattggcaaatatatcttcttcaacaatatcttggattttttccctatacttagctatcagctttttaagctgtatattatccggtggctattttgatagaaatggtagtattggtttgatgtgcacaggtacagtcatatatgctggaggactattcgcattggcaaattgtaagtccgtatggcagttcattttggcattttctgtgtgctctggacttgggacgggaattttaatgactcctctgataggaactgttgcaacctggtttttaaaaagaaggggtatagcaacatctataagtaccatggggggttcaatagggggtatagttttccctattatgctgagaaagttatataaagaagtgggctttcaatgggccattagaatcctatcattcatttgtttaacatgcctcatttgtgcttcagttttggctagagaaagaactaaaccggtcgttcaaccattcaaatccaaggcggaagtagcaaagtggtacatttcctctgtgttcaattggagatattttttggaaggaaaattcttgttcgtcgcaataggcgcttcttttgcagaaagttccctaacttcatgcgctacatatttagcatcttattctatgacaagaggaaacacagaaaatgttgcttataccatgatcactgcttcgaatgctgttggtatacttggaaggtatataccaggctattttgcggataagttcatcgggagattcaatgtagaaattatcaccatttcaatggctgccttatttaattttgtcatgtggctgccatttggcggtaatacaaaggtactttgggcgtacgtttgtttgtgggggttttcgacgggttctatcctatcactgacacccgtttgcatcgggcagatatctaaaactactgattttggtaaacgttatgcaacggtatatctattgcaagcgttggtaacgattccggttttacctatcggcggtaccttaatcggtaaaggtacagttgcaaattataaccattttataatattcaattcagcgttaatggcggcaggtgcggcatgttatataatatcaaggcatatttgcgttggtgcgaagctttgtaagttttaa

SEQ ID NO: 3555 - DNA, 1509 bp, Saccharomyces cerevisiae
atgacaaaatcagacgaaacaacagctaccagcttgaatgccaaaactctaaagagttttgaatccactcttccaataccaacttatccaagagaaggtgttaaacaaggtattgttcatctgggagtcggtgcattccaccgttcccatttagctgttttcatgcaccgtctgatgcaggagcaccacttaaaggattggtccatatgtggtgttggtttaatgaaagcagatgcacttatgcgcgatgccatgaaggcccaagattgcctatacacccttgtggagcgtggtatcaaggacactaacgcttatatcgtcggttctattactgcttacatgtacgctcccgatgatccaagagctgttattgaaaagatggccaatccagacacacacattgtttctttgacggtcacagaaaacggttactaccacagtgaagcaacaaactccttaatgacagatgctcccgagattatcaatgatttgaaccacccagaaaagccagatactctgtatgggtatctatatgaggccctgttgttgcgttacaagagaggtcttaccccattcactattatgtcatgtgacaacatgccccaaaatggtgtcacagtaaagaccatgcttgttgcatttgccaagttaaagaaggatgagaaattcgccgcctggattgaagacaaggttacttctcctaacagcatggtggaccgtgtgaccccacgttgtaccgataaagagcgtaaatacgttgctgacacctggggaatcaaggatcaatgtcccgttgtcgcagaacctttcatccaatgggttcttgaagacaacttctccgatggccgtcctccatgggaacttgttggtgttcaggtcgtcaaggatgtcgattcctacgaattgatgaagttgcgtctacttaacggtggacattctgctatgggatatttgggatacttggcaggctacacctatatacatgaggttgtcaacgacccaactatcaacaagtatatccgtgttttgatgcgtgaggaagttatcccattattgcctaaagtgccaggtgttgatttcgaagagtacactgcatcagtgttggaaagattctccaatccagctattcaggacactgtcgcacgtatttgtttgatgggctctggtaagatgcctaagtatgttttgccatcaatttacgagcaattgcgtaaaccagatggtaagtacaagttattggcagtatgtgttgctggctggttccgttacctgactggtgtagacatgaatgggaagccattcgaaatcgaggatcctatggcaccaaccttgaaggcagccgcagttaagggtggtaaagatcctcacgaactgctcaacattgaggtgcttttcagtcctgagattcgtgacaacaaagaattcgttgcacagttgacccactccctagaaacagtttatgataaagggccaattgccgctattaaggaaattttagaccaagtgtga

SEQ ID NO: 3556 - DNA, 1509 bp, Saccharomyces cerevisiae
atgaaattttctgcgtatttatggtggctgtttttgaatctagcgttggtgaaaggcacttcattgctatccaacgttacattagcggaagattctttctgggagcattttcaggcttacactaatacaaagcatttaaaccaagagtggatcacaagtgaagccgtcaacaatgaaggctctaaaatatatggtgcacaatggcgactatcacagggtcgattgcaaggatccgcatgggataaaggaatcgcagttcgaacaggcaatgccgcagctatgataggacatctcttggagacacctattaatgtttcagaaacggataccttggttgtccagtacgaaattaagttggacaattctttgacgtgcggcggtgcgtttattaagttaatgtctggtttcatgaatgttgaagcattaaaacactatgcacccgatacagagggtgtcgagttagtttttggtccggattattgtgctcctgaaataaatggcgtgcaatttgccatcaataaggttgacaagatcacacatgaatctaaactaagatatttgcaagagatgcccctgtcaaaattaactgatacctcgcaatctcatctgtatacgctcataatagatgaatcagcgcagtcttttcaaattcttatagacggtaagacggttatggtaagagaacatatcgaagacaagaaaaaggtcaattttgagccacccattacaccgcctttaatgattcctgatgtttcagtagcgaaaccgcatgattgggatgatcgcatccgaatcccagatcctgaggcggtgaagctcagtgatcgggatgaacgagacccattgatgattccacatccagatggcactgaaccaccagaatggaacagctccatccccgaatacattcttgacccaaatgctcaaaagccctcgtggtggaaggaacttgagcacggggaatggataccgcccatgattaaaaatcctctttgcactgcagaacgtggttgtggccagcagataccagggctgataaataatgccaagtacaaaggtccaggcgaactcaatgaaatcataaatcccaattacatgggggaatggcatccaccggaaattgaaaacccgctatactacgaagagcagcacccattgcgcatcgaaaacgttatcagtggtgtgatcctcgagttttggagtggatctccaaacatgttgataagcaacatttatgttggtaaaaatgtaacagaggcgcaaattattgggaataagacttggctgatgagagaccgcgcgtttagaggctccgatggccccacagaacgcaaattcatgaatagcagactaggaaatctacaaacaactttccataacgaaagagaatcccctaatccatttgaccgcattatagatcgcatattagagcaacctctgaaatttgtgcttactgcggccgtcgtgctcttgacgacgtcggttctttgttgtgtagtatttacatag

SEQ ID NO: 3557 - DNA, 1509 bp, Saccharomyces cerevisiae
atgaacaacaataatgttacggaagcaacgtcaagggcacagatacggccttattatgatcccgattctttcaatgctgggtatagcgctgttttcaagcccgatgagggtgtagtagatccgcacggatacacaattgcttctaagctaaacgttatcaactcatctccaactacaaagagaatggctaatgcattgtttaaaagctccccaatgaagaaattgtcaaattcagttaacgatggattgtcactggagggaagtaatggcgaaataactggcctgaataattttgaatgggcggaattggttaacatccagaaatggcgaaaaatatttgaacaactgctggatatgtttttcagaaagtattttcaattgctcattcaacagccctttgatgtagcaagactacttatccaagtaggtgagtttaaaatcttcaaaactacagttgacacgaataaacctcaagcaccaataattttgcgggatgaagaaggagatggcgctgcgagagaaggagaagaagatgcttacgatgaggaggagatagatttctttcccatagaaaggaagatcgccgaggcaaactctactgcgcctattatggccgaagaaactgatcattcacatcatgaacctactgatatatccttgactattgcaccacagtccctacatacaattgacgtaatcaacgccctatttgatcaggagggtattcgtggtctatggaaggccaacaacacgacttttatttacaactttctttccctaagcatagatacttggttcacaggattactctcgtcttttttgggtgtccctgacccatattttatggaggtcatcaactctcctgatatttctaagtccttcattttagccttaggcgcgggagtatttaccagtattatattattacctgtggacctgataagaactagattgatagttacatcattcaaaaaaaagaagaatgtcaagacagatggaaagaatatggttactaatactagaagcttgaggcagttaatcagatgctggtcatggcgtaaaaacggagtttccattccattagatatgtggtccctaactattcttcaatctatcaataatagctttttcaacaaattgtttgatttagtcatctacaaccaattccatatcgaaaaatactctcaaaccgtcatgtacaatactatgaagtttttttctaaatcacttgaactatttatcaagttaccattggaaaacctgttacgtcgttgtcaactaaactacttgttgaacgatcagcggttatcatttaaagtagattccactgaattgatagtaaagccaaaaaaatacaatggcatatgggatgtgataagaaacaattctaatacaaatagaggccaactttggaacggttggaaagttggcgttattagtttaatttgcggatatgggttacaaatgatgaataaagttgatatcaacatggaacaagagaagttctga

SEQ ID NO: 3558 - DNA, 1509 bp, Saccharomyces cerevisiae
atgacagaaagtgtaggtggaaataaactagtagattttttggtaaatgttcaatccattttgaatgctgcctctgtgaaatgtcatgtagtagatgaaagttttccagccaagttctttgagaaaaatccggataagatatatgaatcatattgtaaattcattaaaaatagaagtaactctgaaggtttgatacgtaatgaagataaattagttttgacaactatcaataagaggtttgaaaatggagagtacgaacccatacaaggtgggttttataagctgtatcacgacattaagctggtttgtacaatcctcattcacttttatcctcagggtacaagaaactaccaattagtcgacaagttctacaaattttcttcagagcttttattacgagaatgttgtaggataggaattgctctaacgcaaactaataatattaaatcaagaagtggtaagttgttgagcggaaacgagatggatgaatacgacgatgacgatgcaacagaactagacaaaataatctcttatgattttattaagatttctatgaattacacagtgccgatttctcaaacatatcagataagaacgaaggatatggaccttttttcttcgataatttctaaatctaatcttgacaaaagacctcatgaacttcctaatacaaacttcaaaataaacaacgtcttacctcaaactgatatagaaaacgaagctccaagattaggatttgtaggcgctaatactagtaatattccggaccctacgttaccaccaactgaaatgatgactagatttttgcatccaaattggtatgctttacctacaaccgtctggctaaaatatggtaattataattcttgggcaccttcctttaatgaaaacggcaccgttgtggattcgacaacaaggggtcttatttggcttgaaagaattggttatatggacttgtatgaaaaaaatgaaaagaaagtaaaacaagaagaattactgaacacgaatgaagaaggcataaacaggaagcagaacgatgaaaacaacaaaaatgttgacggcaaaagcaatggcgttcaggacgatggtggtgataatgataatgatgcgactatcgcttctgcaaattcagagagtactgagaataaggaacaattcataatcaagcttcaaaacttatataattggacaccatctaattacattggagatgacgaaattgagaactttcgaaatggcacaccagataagttggtttcagactctctcttaaaacttaaaagacttagaaaggagaggattttaaataaagttttgaagcctactacggaggaacgagaattatacttcaaagtgaaaagaatactaaaggaggttatcttagcaaagaaggtttccaaggttcctataaacaatgtaagggcctttccagtattacaaacaaactataatggtagcatacctgtggtaagggcgcaaccaggtcgtaaacggaaacacaagaaataa

SEQ ID NO: 3559 - DNA, 1509 bp, Saccharomyces cerevisiae
atgataccaccacgaatcgttccatggagggattttgctgaactagaggagctgaaactttggttttacccgaaaagcaaaggaaccattgaagataagcgacagcgtgcagtgcaaagagtacagagctaccgactaaagggttcccaatatttacctcacgtggtggactctacagcacaaataacatgtgcggtattgctagacgaaaaggaagcgtgtttaggagtacatcaggattctattcctatccggttatcgtatgtaatggctttgattcggtttgtcaatggcttattggatccaacgcaacaatctcagttcgctattcccttacacacattagctgctaaaattggactgccgtcctggtttgttgatttgagacactggggtacacatgagagagatttacctggattagaaatgcttcgttgggccgccaatgaagcgttatcttggctatatgatcactactggaacgatgaggaattagaagatgacagggatgatgatgacgatgatgatgataccggttacggatacagaagaaatgataaactggagaaatatatggagtcattaactaaaacacttgataaatggaagcgacttagaaacgagtttctggaatacaaatgggtgtgggagaatgcaaacgatagtttaattacaagtagtaacttttctggggataatttggtgaactatgatgccgaaaagaggaaaagttcacacgcaagttcatcagaaactatgatcagggaaaatttgcgtcaatggcaagaactttggaaattatccatttatcacaatgtggttcttgagaaattttttaacaattatgacccacttttactcaaagttttaatgcttaatttgaacaattttgattggaaggtcattgagtgggtagctaggaattacagaacccaacaagatgatagtaatataacgacaattttaaaaaggaaattcaatgcctggaaagaactacaaaaaaggctgttagatgttattataaataaccttaacaataaaaattttaaaaataaatggcaaaattgggagaaacttattgatgaaaatgcgtcatacttgatattgtatttttgccaatctatgctggccaaactagagactgaaaaaattactggtaactcatggagaaacaaaaaacggagaaaacaaattgatagcacagtggaaatcgaggcaaaactgaaggaaaacatagacaatttatcattaaggtttaatgaaggtgaaataaagctgtatgattttattcctgcggaaaaagattccgttccattgaagaaggaagtgagtccggcattaaaggctgataccaatgatatactaggcgatttggcgtctttgaaacagagaatgagcagtttcggaacagtaggtaaaaaaaataaacaagaggagaacagagctacaccagtaaaaaattggtcaagggttcaaaattggaaacccaaaccctttggtgtcctgtaa

SEQ ID NO: 3560 - DNA, 1509 bp, Saccharomyces cerevisiae
atgccaatttggaaaacacaaacattcttcactagtatttctgttattcaaatagtcaataaagaaaccaaagtttctacaaaaaaagaaaaggatagcatgttgaaccagttgaacacaatcttaagatttttattcttgtttctgcagttaattaaatcatccgctgcagttgaacctaatggtggaccgaatattctagatcacaacattatgttggttaacactaatgcaacgatccctaaaaaggaacaaactgattttgaggtgatttctccaacaaaacaaacacaagtagatgaagactgtaaaaaaggcttgtatcatattgagaatgctggaaatttgattgaactgcaagctaaatgttggaaagtggtaggaaacattgaaatatcaagtaactacagcggatctcttattgatctagggttaataagagagatagagggagatcttattatcaagaataacaaacacatttttagaatccagggttataatttagagtctttgggaaagttggaattggatagcctaacttcctttgtatcattagactttcccgctttaaaagaagttgaaaccgttgattggagagttttgcctattctaagtagtgttgtcattaacggaaatattaaaaagatcaaaaatattatcatatctgatactgcattaacctccatcgattacttcaataacgtcaagaaagtggatattttcaatatcaacaataacaggtttttagaaaatttattcgcaagtttagaaagtgttactaaacaactaaccgtccactctaatgccaaagagctggaacttgatttgagcaacttacacacggttgaaaatatgaccattaaggacgtttcagaaattaaactagctaaactttcctctgtgaacagttctctagagttcatcgagaatcaattttcaagcttggaactaccacttttggcaaaagttcaaggaacgttggggttaatagataataaaaatctgaaaaagctaaacttttcgaatgccaccgatattcaagggggtctaatgattgctaacaatacagagcttgccaaaattgatttcttccccaagttgaggcaaattggcggtgcaatatattttgaaggtagctttgataaaattgacctcccagagctaaagttagtaaaaggtagcgcttatatcaaaagttcatctgaggaattaaactgtgaagaatttacatcaccaaaagccggtcgttcgatcataagaggcggtaaaatcgaatgcacatctggtatgaaaagtaaaatgctgaatgttgatgaagaggggaatgtactaggaaagcaggaaactgacaatgataatggaaagaaagaaaaaggaaaaaatggtgcaaaaagtcaaggaagttcaaagaagatggaaaacagtgctccgaagaacatttttattgatgctttcaaaatgtcagtttatgcagttttcacggtattgttctcgataattttttag

SEQ ID NO: 3561 - DNA, 1509 bp, Saccharomyces cerevisiae
atgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctctga

SEQ ID NO: 3562 - DNA, 1509 bp, Saccharomyces cerevisiae
atgctgtcagactgcttgctgaacaatttcagaataacggctcaaatagggtcgggtgcgtatggactagtgttccatgtggtggatatactgacgagccgtgaatatgcagtgaaaacggtcttcaaatcctcctcgatggatgagttttataataagaacggtttgaacaacaactctcaagtggcgcgaaccactcttctgcaaacgcaactgtatcattttttcaaaagtttccaaaaaaaattgttcttaccttccgttgatctagactcgatattacagttgactgagaatgaactaaataggctaccacactacagggagattgccttccaactaagagtgcagtctcacggcaatatcgtgaagattcaccaagttttagaatcttctattgccacttttatagtgatggattattacgacagggaccttttcacctcgatagttgacgataagcattttgtaaatcatggtattttgattaagaaagtttttctgcagctttgctccgcattagatcactgtcatcgtctcggtatatatcattgtgatatcaaacctgaaaatgtcctactggatcgcaatgacaacgcttatctttgcgatttcgggctttccactaaatctaaatatctagctccaaatgtgtgcgttggcagttcatattatatggctccagaaagaatattgtattgtttgaataccaccaccaacggcatacacgtcgacgaatgctgttcgagcctccctacggatacaggagatatatggtctctaggcatcatcctaattaatttaacttgcataagaaacccatggttaaaagctcaccagaaggaggataacacatttcaacattttgctaacgataataatgtcctgaagaaaatccttcctatatcagatgagctgttcacagtgttgacgaaaattctacaactaaatccatacacaagaatagacatgaaaactttgatgtccgaagtttcctctcttacttctttcaccagggaagggcccttgtctcaagttccaatcctatcgagcgaagtttacatgacgcatattataaggaatgaaaacctatttttgagcgatttatcacatttttctgcagaccaagaacaacaacaacaacagcaacaacaacaacagcaagtccaagaacaagaacaggaacaaaaacaagaacaaatacaaaaccaggaacaagcacaacagcagcaagaagaggaagatgctgaaccggagagtgatattccatcaacgtataatagtgacggaagtatggaaaagtatgaatacactaacaaccacaataatagtacctttttaacttcctcaatggacagtacaccttaccaatctgatatcgatgacgttagtgcttccaaagattgcaaattccaacaagatacattaagaaataggctattatgcttacaaatgaatttttctactttaacagacggtccaaacgagaaatggttaccagattattga

SEQ ID NO: 3563 - DNA, 1512 bp, Saccharomyces cerevisiae
atgaacatattgctaatgcaacggatagttagttttattttggtggttagtcaagggcgatactttcatgttggagagctgaccatgacaatgttgaaaagacctcaagaagaagagtcagataataatgctacgaagaagctgaaaacgagattaacgtacccttgtatcctcgggaaggataaggtgacgggcaaattcatctttcctgcaatcactaaagatgatgttatgaatgcaagactgtttttgaaggacaacgatttgaaaacttttttagaatattttttgccagtggaagtcaactcgatctacatttatttcatgataaaattgctgggattcgacgtcaaagataaagaactatttatggcgttaaactctaatatcacttctaataaagaacgttctagtgcggaactatcgtctatacatgcaaaagctgaagatgaggacgagttgaccgatcccttagagaaaaagcatgcagtaaaattaatcaaagatttacaaaaagccataaataaagtccttagtacaaggcttcgattacccaacttcaatacgattgatcatttcaccgccactttgcgtaacgccaaaaaaattttggttctgacgggcgctggagtttccacttctttaggtattcccgattttagatcatctgaggggttttattctaagatccgacaccttggattggaagaccctcaggatgttttcaacttggatatattcttacaggacccttctgttttttacaatattgcccatatggttttaccaccagagaacatgtattctccgttgcacagcttcattaaaatgctacaagacaagggcaaactattaagaaactacacacagaatatagataacttagaatcgtatgcagggatagatcctgataaattagtgcaatgtcacggttcattcgccactgcatcttgtgtgacttgccattggcaaatacctggtgagaaaatattcgaaaatattagaaaccttgaactaccattatgtccctactgttatcaaaaaagaaaacaatattttcctatgagtaatggcaataatacggtgcaaacaaacataaatttcaactcacccattttaaagtcgtatggtgttttgaaaccagacatgacattttttggcgaggccctgccatcgcgatttcataagaccatccgcaaagatatactggaatgcgatctattgatttgtataggaacaagtttgaaagtggctcctgtgtctgaaattgtcaatatggtaccttcacatgttccgcagattttgatcaatagggatatggttacacatgcagagtttgacttaaacctgttgggattctgtgatgacgtggccagtctcgtagctaaaaaatgccattgggatataccgcataaaaaatggcaagatctaaagaagatagattacaactgtacggaaatagataaaggtacgtataagattaagaaacagccacgaaagaaacaacagtaa

SEQ ID NO: 3564 - DNA, 1512 bp, Saccharomyces cerevisiae
atgaggaagctaaatccagctttagaatttagagactttatccaggtcttaaaagatgaagatgacttaatcgaaattaccgaagagattgatccaaatctcgaagtaggtgcaattatgaggaaggcctatgaatcccacttaccagccccgttatttaaaaatctcaaaggtgcttcgaaggatcttttcagcattttaggttgcccagccggtttgagaagtaaggagaaaggagatcatggtagaattgcccatcatctggggctcgacccaaaaacaactatcaaggaaatcatagattatttgctggagtgtaaggagaaggaacctctccccccaatcactgttcctgtgtcatctgcaccttgtaaaacacatatactttctgaagaaaaaatacatctacaaagcctgccaacaccatatctacatgtttcagacggtggcaagtacttacaaacgtacggaatgtggattcttcaaactccagataaaaaatggactaattggtcaattgctagaggtatggttgtagatgacaagcatatcactggtctggtaattaaaccacaacatattagacaaattgctgactcttgggcagcaattggaaaagcaaatgaaattcctttcgcgttatgttttggcgttcccccagcagctattttagttagttccatgccaattcctgaaggtgtttctgaatcggattatgttggcgcaatcttgggtgagtcggttccagtagtaaaatgtgagaccaacgatttaatggttcctgcaacgagtgagatggtatttgagggtactttgtccttaacagatacacatctggaaggcccatttggtgagatgcatggatatgttttcaaaagccaaggtcatccttgtccattgtacactgtcaaggctatgagttacagagacaatgctattctacctgtttcgaaccccggtctttgtacggatgagacacataccttgattggttcactagtggctactgaggccaaggagctggctattgaatctggcttgccaattctggatgcctttatgccttatgaggctcaggctctttggcttatcttaaaggtggatttgaaagggctgcaagcattgaagacaacgcctgaagaattttgtaagaaggtaggtgatatttactttaggacaaaagttggttttatagtccatgaaataattttggtggcagatgatatcgacatatttaacttcaaagaagtcatctgggcctacgttacaagacatacacctgttgcagatcagatggcttttgatgatgtcacttcttttcctttggctccctttgtttcgcagtcatccagaagtaagactatgaaaggtggaaagtgcgttactaattgcatatttagacagcaatatgagcgcagttttgactacataacttgtaattttgaaaagggatatccaaaaggattagttgacaaagtaaatgaaaattggaaaaggtacggatataaataa

SEQ ID NO: 3565 - DNA, 1512 bp, Saccharomyces cerevisiae
atgattgaaaaggataaaagaacgattgcttttattcatccagacctaggtattgggggcgctgaaaggttagtcgtcgatgcagcattaggtctacagcaacaaggacatagtgtaatcatctatactagtcactgtgataaatcacattgtttcgaagaagttaaaaacggccaattaaaagtcgaagtttatggtgattttttaccgacaaactttttgggtcgtttttttattgttttcgcaacaattagacagctttatttagttattcaattgatcctacagaaaaaagtgaatgcgtaccaattaattatcattgatcaactgtctacatgtattccgcttctgcatatctttagttctgccactttgatgttttattgtcatttccccgaccaattattggctcaaagagctgggctattgaagaaaatatacagactaccatttgacttaatagaacagttttccgtgagtgctgccgatactgttgtggtaaattcaaatttcactaagaatacgttccaccaaacgttcaagtatttatccaatgatccagacgtcatttatccatgcgtggatttatcaacaatcgaaattgaagatattgacaagaaatttttcaaaacagtgtttaacgaaggcgatagattttacctaagtataaatcgttttgagaaaaaaaaggatgttgcgctggctataaaggcttttgcgttatctgaagatcaaatcaatgacaacgttaagttagttatttgcggtggttatgacgagagggttgcagaaaatgtggagtacttgaaggaactacagtctctggccgatgaatacgaattatcccatacaaccatatactaccaagaaataaagcgcgtctccgatttagagtcattcaaaaccaataatagtaaaattatatttttaacttccatttcatcatctctgaaagaattactgctcgaaagaaccgaaatgttattgtatacaccagcatatgagcactttggtattgttcctttagaagccatgaaattaggtaagcctgtactagcagtaaacaatggaggtcctttggagactatcaaatcttacgttgctggtgaaaatgaaagttctgccactgggtggctaaaacctgccgtccctattcaatgggctactgcaattgatgaaagcagaaagatcttgcagaacggttctgtgaactttgagaggaatggcccgctaagagtcaagaaatacttttctagggaagcaatgactcagtcatttgaagaaaacgtcgagaaagtcatatggaaagaaaaaaagtattatccttgggaaatattcggtatttcattctctaattttattttgcatatggcatttataaaaattctacccaataatccatggcccttcctatttatggccacttttatggtattatattttaagaactacttatggggaatttactgggcatttgtattcgctctctcctacccttatgaagaaatataa

SEQ ID NO: 3566 - DNA, 1512 bp, Saccharomyces cerevisiae
atgcacctagatctcatacacaagtccttcatcttagtgtggctcatatatatacgagccgcgttggctgaccaattcacatataaagcttgctattcagctagtgatatacgaaaattggggttgacttacaagggtgtttacgagtatcaatcagtttcctactgtcaaaatgaatgccctggtcaggctgtcgttgctcttttcaacggtacaggttgctactgtggtggttccgtagctcagttacagtctttgacgcaggtagattcgagcaaatgtgatgtttcgtgtgctggctggccctaccaaaattgtggtggttcttctgccatgaacgtttatatcaataacgctgcttctaccgcggactcaacttcatctactgctacctcaacatcgacaacatcttcatcaagcacaagtgttagttcaaaaacgtccacgaaattggacacgaaaacttcaactagttcttctgctacgcactcatcctcttcctcgtctacaacctccactaccacttcctcttcagagacaactacttcctcctcttcttcatcctcttcctcttctacgtctactacttctactacttctactacctctagtactacttctacttcttcttctccttccaccacttcctctagcacttctgcctcttccagttcagaaacgtcctctacgcaggcaacttcttcatccaccacatcgacctcatcctcaacttcgacagcaacggtcacttctaccccctcatcgacttcaataggtacttccacgcattacactacccgtgtggtgacgcagtccgtggtttctcaagctaaccaacaagcaagcacgatctttaccaccaggacctctgtttatgcaacagtatcgtctacgtcctcctctactagttctctcttaaacgggaaatcgagctcgtccaagagcaaaggcttgagtggtggcgccatcgcaggtgtcgtagtaggtgtggtttgtggtacagttgccttgttggctctggcgttattctttttcgtatggaaaaaacgtcgccaatcttctcagcatgtggacttggaagagacaaagcagtaccagccgtactcactgggtgatgctgacgctaaccctgttattccaccgtctgcttcgagcactaactggcacataccctctaggaataatacagcattgtccaagaatacagcgtctacttttgccacttatgatctgccgacaagggcgccgggcggcagagattctattattactggtgatgcacataatatcagcaaaagaagtcactttccctcggtagtgtacgaggagcctccttcgatctataacgggaaccaaaggttcagtgctacttcgctgcccgatatgatggaagaaagacaactacacattgtcaaccccgataatgtgagttcaaatattgggagtaatgtctcagatggtgatgatgattacgatgatgcaaaggattccaataatagttctttgcgctga

SEQ ID NO: 3567 - DNA, 1512 bp, Saccharomyces cerevisiae
atgctttgtgctattagtgggaaagttcctagaaggccagttctatcacctaaatccaggactatttttgaaaagtcgctccttgaacagtatgttaaagatacggggaatgatccgataacaaatgagcccttaagcatcgaagaaatagtggaaatcgtacctagtgcgcaacaagcctcactaacagagtctacaaactctgctacgttaaaagcgaattattcgattccgaatctgttgacaagtttacagaatgaatgggatgctataatgctcgaaaactttaagttacgatcaactctagatagtttaacgaaaaaactgtcgactgtaatgtacgaaagagatgctgcaaagttggtcgctgcgcaactattgatggaaaaaaacgaagattcgaaggatttacccaaatcctcacagcaagcggtagctattacgagagaagaatttttacaagggctgttacaatcttctagagactttgtagcgaggggcaagctcaaagcacccaaatggccgattttaaaaaatttggagctattacaggcacaaaattactcccgtaacatcaaaacattcccatataaagagcttaacaaatctatgtactatgataaatgggtgtgcatgtgtcgctgtgaggatggtgctttacattttacccaattaaaagattcgaaaacgattaccacaataactacaccaaatccccgtaccgggggagagcatccagctattatttccagagggccttgtaatcgtttgctactactatatccaggtaaccaaataactatattggactcaaaaacaaacaaagtcctcagagaaatagaggtagattccgccaatgagattatatatatgtatggtcacaacgaggtcaacacagagtacttcatctgggcggataatagaggaaccataggatttcaatcctacgaggatgattcccagtatattgttcattctgctaaatcagatgttgagtacagcagcggtgtcctacataaggattcattattattagccctttactctccggacggtatattagacgtttacaacttgtcatcacctgaccaggcaagctctagattccccgtagatgaagaagccaagataaaagaggttaaatttgcagacaatgggtactggatggtagtagagtgtgaccaaactgtggtttgctttgacctaagaaaggatgtcggcacgctagcgtatccaacttacacaatcccagaattcaagacgggcaccgttacctatgacattgacgactctggaaagaatatgattgcatactcaaacgagagcaattcgctgacgatatacaaatttgacaagaaaacaaaaaattggactaaagacgaggagagcgccctctgtttgcaaagcgacactgccgatttcactgatatggacgtggtatgcggagatggtggtattgccgctattctgaagacaaatgatagtttcaatattgttgcattgacaccctaa

SEQ ID NO: 3568 - DNA, 1512 bp, Saccharomyces cerevisiae
atggaaaaaattcccaggtggttgttgttttctcttatatcgtcggtgctgtgcatacttggggccctgtgtgtgccgttgttatcggttgccttcgatagcaagcgcaatagccaatctaagttggtcaactatggtctttctctaagtgccggatctatgatcactacttcactatacatgctattgcctcggatcgaaaaatcaaaccggttcaaggtttttcctggattgcttttgggtatttgcctcagttttttcttaaactacctagtccacgctttcgccagcgaatcgttggtacactgtgctgatagcggtgaccatgctacaggttcacatatacactccaaatcacattcgcattcgcactcacactcacatgcggattcgcattcgaattttagcaacgatcatgatttagaaaatgctccctctgagcatggttatgcaacatcttcttccagtgtttctgaaaatgacccgttgattacaaaggatagcgatagaccccaaatgaaaaagaaaatgtccctaattgacttattaaccagaaggaaatcagaaggcgagtgttgtgacctaaacaagtgcactccgctcttgcaatcagagcagccagaatatattgcatgtgtcccaccagtgataaagtcttctcaaagtgaaagaaacgtgccacatggatgcgagggatcagaagataatggacaatccgatgacaaggatcatcgtggccttgtatgcgtggaaaataatatcggttacgatcttgaaaacctatcgttgtaccgtaagaattttctttcgagccgccatcatcattcctctgaatcgcccgaaaattatggttccaaccagttgtcgcactctttttcgtcacctttgggaaatgatgtaactgagaatccggccgcattggcagacacacaataccatcccgaaaatggttcattatacccccaccatcatcacttagagacccctttttccaaattactgtctattggtatgcaaacttgtctagtccttgcattacacaaatttcccgaagggtttattattttttacactaacaggtcagattcgtcaaagtccttgggattttccatttttttaagtttgacgatccataattttgtcgaaggatttgcaatgacgttaccattctacactgttttcgaatctaaatgggttgccattttgattactgccgttctcggtggtggatctcaaccattaggtgcattgataggttatttcatctttaaaggtagtactccaagggatcacgaacccaacatggattttttactgagcgttactgcagggttcctattagtaattggtttacaaatgttccaaactggtatcggatttagcgatggacatcatcatcatcaaggagaaggtgatgaagaaatgaaacagtcccatagctcaggcacaacttgcttgaaatggtgctgcactggcgttttgctaattctagcgagtgcccttttcacttga

SEQ ID NO: 3569 - DNA, 1512 bp, Saccharomyces cerevisiae
atgtccgatagattcgttatttgggctccctcgatgcacaatgaacctgccgcaaagtgtgggtattgtcacggtaataaggggggcaacatggatcagttgttcgcattggattcgtgggctcatcgttatatgaacaaaatggacgttgtaaagattgaaaactgcacaattggctctttcgtggaacatatggatgtagccacgtatgatcgcatgtgtaatatgggatttagaaggtctggtaagtttctttataaagtggacccgttgaggaattgttgtaggttatacaccattcgaactgcccctcaagaattgaatatgacaaaggaattgaaaaaatgcatcagccgctttgctactagaataacaagtgaggactactgcccagccgctgttgcaagcagtgattttgtgggcaaaattgttaatgcagagatgaattctaaaacattctatacccgatttgagcctgcactttatagtgaagaaaagtatcacttatttgtcaaatatcaggaaaaagtgcatcaagactacaataattcgccgaagtcctttaagcgattcctatgtgatacgccctttggccctgaagcggtgttggggacacaagaatcatgggagcagttaaacaattggcagcgaatgaagccaggcgagaaactgaagcatatgggtcctgtgcacgaatgctactactatgagggtaaattaattgccatcactgtgtcagatatcttgcccagtggtatatcttcggtatattttatttgggatccagactacagtaaatggtccctagggaagctcagtgctttgcgcgatcttgccatcattcaaaggacaaatctgcaatactattacctggggtactatattgaggactgtccgaagatgaattataaagcaaactatggtgcggaagtactggatgtgtgtcacagtaaatatatcccattgaaacccattcaggatatgatttctaggggcaaactctttgtcataggtgaagaagagacgaaagttactaaggagctctacctcgttgactctgaaaccggaagaggggagggatttcccactgataatgttgtcaagtacaagaatattgctgaggaaatatacggtgtgggagggtgtgcgtttaaatctgcaaatgaatctgcattggaattgaaagaactttacggtataccgtacgaagaggaagatttagataccatctaccatttgaaagaacacaatggccatgctccaaatggtattcctaatgtggtgccgggattactcccgctatgggaattgctggacattatgcaatctggcaagatcactgacctggagggaagactatttctcttcgaaatcgaaacggaggggattcgaccattaattaacttttatagcgaacctccgaatgtcaagaaacgtatttgtgacgtgatacggttatttggcttcgaaacttgtatgaaagccgtcattttatatagtgagcaaatgtga

SEQ ID NO: 3570 - DNA, 1512 bp, Saccharomyces cerevisiae
atgtctgacttccaattagaaattctaaaaaaactagatgaattggatgagatcaagtccacactggcaactttccctcagcacggctctcaagatgttctttccgctttgaactctttgaaagcccacaacaagttagagttttccaaggtcgacacggttacgtatgacttgaccaaagaaggtgctcaaattttgaatgaaggttcgtacgaaattaaactagtcaagctcatccaagagttgggtcaacttcaaatcaaagatgtgatgtccaaactgggtcctcaagttggtaaggtcggtcaggctagagctttcaagaacggctggatcgccaaaaacgcctcaaacgagcttgaactctccgcaaaattgcaaaataccgatttaaatgagcttactgatgaaacgcaatctattctagcgcaaatcaagaacaactcgcatctggatagcattgacgccaagattttgaacgacttgaagaaaagaaagttaattgctcaaggtaaaatcacagatttcaacgttaccaaagggccagagttctcgaccgacctcaccaaattggaaaccgatcttacctccgacatggtctccaccaatgcatacaaggacttgaagttcaagccttacaatttcaattctcaaggtgtgcaaatatcttcaggtgctcttcaccccttaaacaaagtcagagaggaatttagacaaattttcttttccatgggattcacagagatgccctcgaaccaatacgtcgagacaggtttctggaacttcgatgccctttacgtcccacaacagcatcctgctcgtgacctgcaagacactttctacatcaaggacccactaaccgctgacttgcccgatgacaagacatacatggacaatatcaaagccgttcacgaacaggggagattcgggtccatcggttatcgttacaactggaagccagaagaatgtcaaaaattggtcttgagaactcactccacagccatctctgccagaatgctgcacgatttggccaaagatccaaagcccaccagattgttttctatcgaccgtgttttccgtaacgaagcagttgacgccacccatttggccgaattccaccaggtggaaggtgttcttgccgactacaacattactctgggtgacctgatcaagttcatggaagagtttttcgaaagaatgggtgtcaccggtttgagattcaagcctacctacaatccttacaccgagccatcaatggaaatcttttcttggcacgaaggtttgcaaaaatgggtcgaaatcggtaactctggtatgttcagaccagaaatgctcgagtccatgggtctaccaaaggatctaagagtccttggttgggggttatccttggaaagacctaccatgatcaaatataaggttcaaaacatcagagaactgttaggtcataaagtctctttggactttatcgaaaccaatcctgctgctagattggacgaagacttgtacgaataa

SEQ ID NO: 3571 - DNA, 1515 bp, Saccharomyces cerevisiae
atgaataaatttgacgagtttatagagtctaatgagaaggatttggatgtggacaccagtacccgaaatagtataatttcgatgtcacctgtgaggaaaactggacgaaagattcgttctgctagttccaatggatataggctagaacaccatcgtacgtccagtgcgggaagcatgcattcgcaaagactaatgacgcctaccagattaaatgaccaggaccatcccttacaagccaagccagatgctaggagggtggtaactcgtcattcttctgtctcagttccaaatgcaatgagcaagagaagatcacttattcaacccatggttgttcccactacaccagaatctcaaaacaacttaccttcagtaagtcattctgagggatcctatggaatcccattagagtcaaccactgtactttctagtgagcaagcgatggccagcggacttcgacggtctagaaatgggagttcgcagtcggttaatagtatgatagcgaccaccataccaacaaatggggtcgatgtaagtgcgcttctacaatctctcgctacaaaagagttagaacttctggaatgcaaacaaaagattgaagatttgaaaaagcaaacccagcatgaagagcaaaactatactcgtcgggcacgtgaactgcatgaactcaaggagcaagtgagtaaacatttggatccctctctaaatacacctgttaaaaaccgggctttttcaccggtttaccagaatatacctttggaatcacgaactgaaaatgctggtaacagcagccttcctagttctgtcagtaaaccaaagaacatgggtcatcaaagtactaatcagtcaagatctgtgtctccgcaagatattcaagaaaggcgccaaagggacgactcgtcagattcatccaaacagtcactttggagcaaaccattagctctgtttaatcagtttgataaaatcattcagcatgaaattgaaagaactctgaattgggatgactctctttcaggtacgcctgaggtacaggaagggacaccgactagtaatagcgagtcgtccgcgcaacagtacgataatgaagcacctggagctcgccaaaaatctccttcgcaaggatcagtctccaggtcgctttggagctttgttagcgatgtcaaggccggattactcggtatagaagaagaaaacgataatgatgttattactgataacagatgtgatcctgtatataaaagcgatagacagcatgaacagaaaaaaagtacacataaaattacgaaccgggggcaagcagaagatagtggcgacgattctagtttaaacatgaggaaatttaaaacgacaactaagttccagaaagacaatgctgggaataatagtctcacagatgaaagtggacatcgaacacgagaaaaaaaaagtaaaagaagtagtaacaagctaagttttattggagaacccgataatgataattcctccgtcaaaaactcagttgaaatgacagacttctaa

SEQ ID NO: 3572 - DNA, 1515 bp, Saccharomyces cerevisiae
atgaccagtacaagaacgttgagatacgcacaggttgcctgtgcttgtatctggtgtcttttttcagctggtattatctttggatttgctgctttgaaacctattttaatttcagaaggtgtataccatgaattgtgtgatcctaaggatggtgatagattattatgtactgcacaggatctgaaattaaattttatatttgctctcagtgctactgtaacaaacatcatggcccttcctgtcggtaagattttggatatgtatggacctcgtgtctgcggaataataggatcatgtctcttgttcctagcaagcggtaattttatttctgccaagcatctagtgtctctttgggacccatatcttgtcggttacacgcttttggcagttgccggtccgttcgtcttcatttcatgttttcaattggcaaatagcttcccacaaagatcaggaaccgtattggccctactaacaggatcatttgattcgtcatctgcgctgtttctgttatataggttgttatatcaaaactggtttcctaccttgaacgtttccagatttttcaccctatatttgattgttccagtgtttattcttgcctgtcaactcacgataatgcctcattcttcctacaaaactgtcaatcacattgctaagatcgctgtggaaggtttagatgaaaacggaagactcatcgagggtgatacaggctccggtatcatccctgatgaacaggaacgtcaatcgttgattgcaatcgagcgtgaagaagatagtatcccatcaaggccgcagagaaggaaatcggtattggaaacttacgttgaagataagttgcagaaaaagtcaggcggcatattcggagtcttgcatgggaaatccgcttatgaacaaataaagagtccgtggttttatttaatgcttttatttgcgcttgttgccatgctgaggataaactattttattgctaccgtcagaacacaagaagaatacttattaaatgatcctgatttagcactaaaattgaattccatttttgatatgttacttccacttggcggtgctgtttccataccatttattgggctgctcttggaccatacagatactttgtccactctcacaatattgttcaccacttctaccgctataggtgtttttggcttgattccaaattcattcacttggaacttaataggtatagtacttctggtagtgtacagaccattttattacacagttgtttctgattattcttcaaaagtttttggatttgacacatttggtactgtttatgggttattgtcctgcatttgtggtattttcaacatgagtcaaaacttactggacaaatggacacatactactttcaacatgaatccattcccaataaaccttacactggtaatcctcacagtcgttttttcactaactttaacattttacatacgatctcagattttgcccaagcccgtgaatgaaagaggattgtcctccaactaccaaactatctga

SEQ ID NO: 3573 - DNA, 1515 bp, Saccharomyces cerevisiae
atgcaaagcccatatccaatgacacaagtgtctaacgttgatgatgggtcactattgaaggagagtaaaagcaagtccaaagtagctgcgaagtcagaggcgccaagaccacatgcttgtcctatctgtcatagagcttttcacagactggaacatcagacgagacacatgagaattcatacaggtgagaagcctcacgcgtgtgacttccccggatgtgtgaaaaggttcagtagaagcgatgaactgacgagacacagaagaattcatacaaactcccaccctcgaggtaaaagaggcagaaagaagaaggttgtgggctctccaataaatagtgctagttctagtgctaccagtataccagatttaaatacggcaaatttttcaccgccattaccacagcaacacctatcgcctttaattcctattgctattgctccgaaagaaaattcaagtcgatcttctacaagaaaaggtagaaaaaccaaattcgaaatcggcgaaagtggtgggaatgacccatatatggtttcttctcccaaaacgatggctaagattcccgtctcggtgaagcctccaccttctttagcactgaataatatgaactaccaaacttcatccgcttccactgctttgtcttcgttgagcaatagccatagtggcagtagactgaaactgaacgcgttatcgtccctacaaatgatgacgcccattgctagcagtgcgccaaggactgttttcatagacggtcctgaacagaaacaactacaacaacaacaaaattctctttcaccacgttattccaacactgttatattaccaaggccgcgatctttaacggattttcaaggattgaacaatgcaaatccaaacaacaatggaagtctcagagcacaaactcagagttccgtacagttgaagagaccaagttcagttttaagtttgaacgacttgttggttggccaaagaaataccaacgaatctgactctgattttactactggtggtgaggatgaagaagacggactaaaggacccgtctaactctagtatcgataaccttgagcaagactatttgcaagagcaatcaagaaagaaatctaagacttccacgcccacgacaatgctaagtagatccactagtggtacgaatttgcacactttggggtatgtaatgaaccaaaatcacttgcatttctcctcatcatctcctgatttccaaaaggagttgaacaacagattactgaacgttcaacaacagcagcaagagcaacataccctactgcaatcacaaaatacgtcaaaccaaagtcaaaatcaaaatcaaaatcaaatgatggcttccagtagttcgttaagtacaaccccgttattattgtcaccaagggtgaatatgattaatactgctatatccacccaacaaacccccatttctcagtcggattcacaagttcaagaactggaaacattaccacccataagaagtttaccgttgcccttcccacacatggactga

SEQ ID NO: 3574 - DNA, 1515 bp, Saccharomyces cerevisiae
atggctcctattgaatacctactgtttgaagaacctactggttacgcagttttcaaggttaagttgcaacaagatgacattggttcaagattaaaagaagttcaagagcaaatcaatgattttggtgcttttacaaagttaatcgaacttgtatctttcgcgccattcaaaggtgctgctgaagcccttgaaaatgctaacgacatatcagaaggtttagtctctgagagtttgaaagctatcttggatttaaacttaccaaaggcttcctcgaaaaagaagaacattactttggctatttccgataaaaacttaggtccttctattaaggaagaatttccatatgttgattgtatttcaaatgaacttgctcaggatttgattcgtggtgtcagattacatggcgaaaaattattcaaaggtctacaatctggtgacttagaaagagcccaattaggtttaggtcacgcttactccagagctaaagtgaagttctctgttcaaaagaacgacaatcacatcattcaagctattgctttattagatcaattagataaagatatcaacacttttgctatgagagttaaagagtggtatggctggcatttccccgaactggctaaattggtaccagacaactacacttttgccaagttggttctttttatcaaggacaaagcttcattaaacgatgactccttacatgatttggctgctcttttgaatgaggattcgggaattgcacaaagagtcattgacaatgcccgtatctccatgggacaagatatatcagaaaccgatatggaaaatgtttgtgttttcgctcagagagtcgcttccttagctgattacagaagacaattatacgattacttatgcgaaaaaatgcacactgttgcaccaaacttatcagaattgattggtgaagtgattggtgctagattaatttctcacgcaggttccctaactaatttatctaagcaagcagcttcaacggttcaaattcttggtgctgaaaaggctttgttcagagctttaaaaactaaaggtaacactccaaaatacggtttgatttaccacagtggttttatttctaaggcctctgccaagaacaagggtcgtatttctagatacttggctaacaaatgttctatggcctctagaattgacaattactctgaggaaccatctaatgtttttggttccgtactaaagaaacaagttgagcaaagattagaattctacaacactggtaagccaactttgaagaatgaattagccattcaagaagccatggaactttataacaaagataaaccagctgcagaagtggaagaaaccaaggaaaaggaatcctcaaagaagagaaaattagaagatgatgatgaagaaaagaaggaaaagaaagagaaaaaatcgaagaaggaaaagaaagaaaagaaggaaaagaaggacaaaaaggaaaagaaagataaaaaggaaaagaaggataaaaagaagaaaagtaaggattaa

SEQ ID NO: 3575 - DNA, 1515 bp, Saccharomyces cerevisiae
atgtttgaaatgcgctacgtctatttgtttgcaatttgtattaagtttgtttcaagctccgaactaggaaaaatcaacaatctgctgcaaggaagattgatatacacagataattccgttgcgacaaatgtattagaatccaaatttccattcttgaaatcaacatgtgttaaagacgcactaaaattatttttgccacaatgtattgcaaatggacttgaatccattgacgctgaaacaagggtagaaacggccattaaactttcaatatgcgagtttcaggcatctggcttgggcgaaataccagaaaattgcatggttgacgacctaggatcaatgatggattgtatgtttgaactagaatcatcttcacagtggtggacaacttatagtggaaattatcagcgactatcgagtatttgttatgaaaatcttcttccttttgaaaaagaacagatactgaaactttttctaaatatcactgaactttatgattcatttggggatgatgtcgatactaagttaaatcatctgatgtttcaaatggagcaagattctcaaaattttttggacgatctggccaggatgttccgcaactatgacaatgaactgcgaaatgcgaccgaaagcaatcgaataatcttagaaaacgacctctcattttttagaaataaagtgaatgatgtactctatgaaacttccgaacaactagaggtccaaatcatagagaagaacagtcaactaatgaatgaagttgataccgtccatcatattatgagcgatctagccgatgagcttgctaaaaatgacataaaatctaagataaatgacttgaaggacgacagcctgaataatttacaggacctagtggaaatgtccaacgacgtaaaagaatattactctagaaataacaagttagttaataccgagttggaaaacttctcgatgggtttaaaaaaacagttaggaggcatgtcaaaggatctttctgaatcacaaatggaagctatagagctcttgcaagggttcaattccatccttcatgattcattgttaccatccatgacggatgagatagtacctgagatgacgaacttcaaaaataccttactacaagaatggacagctataacatctacactaaatggagattttgctttatggaatgaggagattttttcaacttttaatgatatttcagagaaactgaatggcacaaaaaaaaaattagacgacattgaaatcagagtctcacttgtccataaaaatgtcatgacaatgatgagggtattggattttatgtggaaaactagtaaaatgattataagatgtgggtaccttgcagtcaagaataaatactactggttactgtgctccgttgtgtggatttggtcaaaataccgtacgtctcgagtaaacgtcaaaatgattcctattaaacgctattaccaatgggcagctcttctactttcaatttatctaggagctaagactggctcattgattgatttttaa

SEQ ID NO: 3576 - DNA, 1518 bp, Saccharomyces cerevisiae
atgaagttgggtattataccttaccaggaaggtactgatattgtttacaagaatgctctccagggtcagcaagaagggaagagacctaatttaccacagatggaagcaacgcaccaaatcaagtcatcggttcagggtacaagttatgagtttgtccgcacagaagatattccattgaatcgaagacattttgtgtacagaccgtgttccgcaaatccctttttcactattttggggtatggctgtacagaatacccatttgaccactctggaatgagcgtcatggacagatctgaagggttgtcaattagtcgagatggaaatgatctggtaagtgtcccggatcaatacggttggagaactgcaagaagcgatgtgtgtattaaagaaggaatgacgtattgggaagtggaggtaattcgtggaggaaacaagaaattcgcagacggtgttaataataaggaaaatgctgatgattcagtagacgaagtacaaagtggcatatacgaaaaaatgcacaaacaagtgaatgacaccccgcatctacgatttggagtttgcagaagagaggccagtttagaggctcccgtagggtttgatgtgtacgggtatggtattagagacatttcgttagaatctatccacgaaggaaaattgaattgcgtcctagaaaatggttcgccattgaaagagggtgataaaatcggatttctactgagtcttcctagcattcatacacaaatcaaacaagctaaggagtttaccaaaagaagaatttttgcactgaactcccatatggatacgatgaatgaaccatggagagaagatgctgagaatgggccttcaaggaaaaaattaaaacaagagacaacgaacaaagaatttcaaagggcgctattagaagatattgaatataacgacgtcgtccgcgatcaaatcgccatcaggtataagaaccagttgttctttgaggcaacggactatgtaaagacaacgaaaccggaatattattcttctgataagagggaaaggcaagactattaccagttagaggattcatatcttgctatctttcaaaatggtaagtacctaggcaaagcatttgaaaatttaaagccgttgttaccaccgttcagtgagttacaatacaatgaaaagttctatcttggatattggcaacatggtgaagctcgtgatgagtccaatgataaaaacacaaccagtgccaaaaagaaaaagcagcaacaaaagaaaaagaagggattgatactcagaaacaaatacgtaaataataacaaactgggttactatccaacaatcagctgttttaacggtggaacagcgaggataattagtgaagaagataaattggagtacctcgatcaaatccgatcagcttactgtgttgacgggaattcaaaagttaacacactggatacattgtacaaagaacagatagctgaagacatagtatgggatataatcgatgagttggagcaaattgccctacagcaataa

SEQ ID NO: 3577 - DNA, 1518 bp, Saccharomyces cerevisiae
atgagtgaaggccccgtcaaattcgaaaaaaataccgtcatatctgtctttggtgcgtcaggtgatctggcaaagaagaagacttttcccgccttatttgggcttttcagagaaggttaccttgatccatctaccaagatcttcggttatgcccggtccaaattgtccatggaggaggacctgaagtcccgtgtcctaccccacttgaaaaaacctcacggtgaagccgatgactctaaggtcgaacagttcttcaagatggtcagctacatttcgggaaattacgacacagatgaaggcttcgacgaattaagaacgcagatcgagaaattcgagaaaagtgccaacgtcgatgtcccacaccgtctcttctatctggccttgccgccaagcgtttttttgacggtggccaagcagatcaagagtcgtgtgtacgcagagaatggcatcacccgtgtaatcgtagagaaacctttcggccacgacctggcctctgccagggagctgcaaaaaaacctggggcccctctttaaagaagaagagttgtacagaattgaccattacttgggtaaagagttggtcaagaatcttttagtcttgaggttcggtaaccagtttttgaatgcctcgtggaatagagacaacattcaaagcgttcagatttcgtttaaagagaggttcggcaccgaaggccgtggcggctatttcgactctataggcataatcagagacgtgatgcagaaccatctgttacaaatcatgactctcttgactatggaaagaccggtgtcttttgacccggaatctattcgtgacgaaaaggttaaggttctaaaggccgtggcccccatcgacacggacgacgtcctcttgggccagtacggtaaatctgaggacgggtctaagcccgcctacgtggatgatgacactgtagacaaggactctaaatgtgtcacttttgcagcaatgactttcaacatcgaaaacgagcgttgggagggcgtccccatcatgatgcgtgccggtaaggctttgaatgagtccaaggtggagatcagactgcagtacaaagcggtcgcatcgggtgtcttcaaagacattccaaataacgaactggtcatcagagtgcagcccgatgccgctgtgtacctaaagtttaatgctaagacccctggtctgtcaaatgctacccaagtcacagatctgaatctaacttacgcaagcaggtaccaagacttttggattccagaggcttacgaggtgttgataagagacgccctactgggtgaccattccaactttgtcagagatgacgaattggatatcagttggggcatattcaccccattactgaagcacatagagcgtccggacggtccaacaccggaaatttacccctacggatcaagaggtccaaagggattgaaggaatatatgcaaaaacacaagtatgttatgcccgaaaagcacccttacgcttggcccgtgactaagccagaagatacgaaggataattag

SEQ ID NO: 3578 - DNA, 1518 bp, Saccharomyces cerevisiae
atgattgacgatactgagaactccaaaattcatttggaaggtagccataaaacaggaaagtatacgggctatggtactacacataaaatcagagctcagttaaactttaatgatgaaaagaaatggaagaagttttctagcagaagactagaactcattgactcatttggcttgagccagcacaaagcaagtgaacaagatgataatataagacaaatagccaccatattaaggagtgaatttgagtaccctgatacgttttcggcagaatttgaaaagttggttaccgctgctgttcaatcggtgagaagaaacaggaaacgttccaagaaaaaattattagactctaagaagaaaatagcccgtggtaaagttcaaaaaattcctttgtctccccccagctcaagtaatatggggtcttgttcagcttccaatgcatcaagctctgacgaagaagccagcgtgaaggaagaacctgctgagcacgctcttccttctcttaatactataacatcacaaaaattgttaccttatccgaatggccgcactcttccacctgtaccaactcaagttcgctctttacttaagaagaacgcatctcttcttcgtgatccatcggcaccgtatgcgcacggcggcgatgaaaaattacaaaagtttgatatagaagatcagcctctagaaagtgaacaagaatacgactttattgccaaatcaataattgttgaaattgtaaataatgctattccactacctgaacaaattcaaagagataagttcattagaccaaatttaacgaaaaaaaaagggtgccaaagcaaagttgtaatatccaacaacttgagaaaactcatcctgtcaaagatacataactcaaggacgtgcttggagatgtctaaggatgaaagaaatttggattcttttgctaatctagaaacgctgggcaaaaattcactaatggcttccatttcccttgtggtagaaaacagcttttcacatttaccgtcttctactaagcaatatcttactgaacggctgtcatcaatcgaatttttgactattctatcgcaaaggctatttatgcccgctacacgtcaactattcgctgacctatcacaagaaaaaattcaggtgagagtgctgaatctcatactgggatctcttgtcaaagattatgggtttgatgcatctttggcaccaatcaacgaaattatctatcacatgacactccatcaatatcccttggtttgtagtaataaacagtccaatccaatgaggccacactccacatctgaggtcttgagtgcacattcttcaacgaaagatgcaagcactcccggtaaagaagagcctcgagtgacgaggtcaagcacatcggcagatagcactatcattacattgccttcaattgaagtcccaaatacgtacgatgatgacaggttaaagatgttgagcgcgatatcgttgcagattgaaaattccaccttttccaaaccattcagtactatttcaaaataa

SEQ ID NO: 3579 - DNA, 1518 bp, Saccharomyces cerevisiae
atggatagccaagtagaaggcaaaatatccccctcacagaaggagtcctcctccacctcaggcctcgtttcacctagtgaagatggcccagcacatcaaaaaatacacagagaccaattaagtgtggatcaaatcaagaaaatcagagaagaacgtgctcagaagagacaggtacgtaggaactctctaatatcccaagggaaggaccctgacttcccaacgcctgacttacaattcattgaaagaccattcctccctatcaaccatgataattcgaaaggtcttacgccagcgaccatacaagtcacccaagattcattggacgttaaaataatgacctataatactctagcacaaaccttgattaggagagattttttcccagaaagtggaccagcgttaaagtggcataagagatcaaaagttttggtccacgaattgaaaaagtacaggcctgatgtagtatcgttgcaggaggtcgattacaatgaactcaacttctggcaggagaatttccataagttagggtttgatgtgattttcaaaaggcatgaagggaaaactcatggactactagttgcatggaacaataaaaaattccagttagataatgattggatgctggactacgataatatattggcgggaaatgtcatttcagcaagaacaagaactaaaaatattgcccttattatatcgctatatttcaagggtataacagattcatcatcaagaggaattatcgtcgcaaatacacacctattttggcatccctttggggtatttgaaagattaaggcaatcttacttggttttacaaaagatccaggaaattaaagcatgttccaaatataatggctggcatagcctactgatgggtgatttcaataccgaacctgaagagccaccgtacttggccataacgaaaagaccactgatattaaaaggcccaataagagctatggtggaatgctcactagcgtatcggtattcaaaaaaaaggaatggagaagaaagtgaccaggatgatgaagagtgtgatgaaaagtctaggggcgaaggccattcagatcaaccacaaaacccaaaaccagagagctttacagccacaaaggaagaaaaggctctggtaaatcaattagttgcgttgcataattcactacatgtgaaaggcgtatctttgtatgggattggctacggtaaagtgcatcctgaaaatgctaacggaagccacggcgaaccgggactctcaaactgggccaatacatggtgtggattattagactacatattttatatcgagggtgatcataatcaggacacgcgtcagaaagagcctctgaatgcttttgaaggaaataacaacgtaaaaataatcggatatctgaggatgccgtgcgcacaagaaatgcccaaacactcccaacctttcgagggagaatatgctagtgatcacatttccctaatgtgccaaatacgcttgttttttgggggggagaaagtgcatagcttaaaataa

SEQ ID NO: 3580 - DNA, 1518 bp, Saccharomyces cerevisiae
atggatctattcaaaagaaaagttaaagaatgggtatactccctcagcactgacgaccattatgcagagtataaccccgatgaaacgcctacttttaacatgggtaaacgtttaaacagcaacaatggtcaggtaaatccctctcaaatgcatttgaatagtgtagatgaggaaatgagcatgggatttcaaaatggcgtgccatctaatgaagacataaatattgatgaatttacgtccacggagtcaaacgatggtgtctctgaaaccctcttagcttggagacacatcgatttttggaccagtgaacataatccagatttaaatgcaactttgagtgatccttgcacccaaaacgatatcactcacgcagaggaagacttggaagttagctttcccaacccagtaaaagcgtctttcaaaattcatgatggccaagaagatttagaatcgatgaccggtacttctggcttgttttatggcttccaactaatgacactagatcaggttgtagctatgactcaggcctggagaaacgtcgcaaagaacctaaacaaaagatctcaacaaggtttatcccatgttacatctactggctcttcttcatctatggaaagactaaatggtaacaagttcaaactgccaaatatcccagatcaaaaatctattcctccaaatgcagtgcaaccggtatatgcacatcctgcttggattcctttaataacggacaatgccggtaaccatatcggtgttgacttggcgcctggtccaaatggtaaatatgctcaaattataacatttgggagggacttcgatacgaaatttgtcattgctgaaaattggggtgaatttctgttatcgtttgccaacgatttggaagctggtaattggtatttagtagatgacaatgacgactactttagcggtgatggtgaattggtcttcagggataagaaatctaatggtcctatacaagattatttcgaagttttaaaaagaagaacgtggatcaagtatcaagaaaacttgagatcacaacagcaaaaatctcaacctgacacatccttgcaggagcagaaatacgtgcctgcctcgcaaaagaaagtggcagctgaacagccttctaccctcaacgcagaatccataaagggcgaagatagtggtagtgcagatgtacaatctgttcaagatcacgaatctgtcaaaattgtgaaaacagaacctagcgaagcggagactacaactgtaaatacagaaagccttggacaagcagagcatgaaatcaaagctgataatgtagacattaaacaagaaagcgagaggaaagaagacgaaaagcaaccaaaggttgaagaaaaagaacacgttgaaaacgaacatgtcacagaatcagcaaaaaaagacgatgatgtaaataagcaaacagaagaaatgaacaaaaaggaagaaaatgaaataagaagtgatgatgctaaagtggaagaagcgagagaagaatttgaaaatatagctttatga

SEQ ID NO: 3581 - DNA, 1518 bp, Saccharomyces cerevisiae
atggctaccccgtcaaataaacgttctagagattctgaatctacagaagaacctgtagtagatgaaaagagcacttcaaaacaaaacaatgccgcacctgagggagaacaaactacttgtgtggaaaagttcgaagaactaaagttatcacagccaactttaaaggccattgaaaagatgggatttaccactatgacttctgttcaggcaaggactatcccacctcttttggccggtagggatgttcttggtgctgccaagacaggttctggtaaaactctagcgtttctcatccctgctattgaactattgcattctttgaaattcaaaccaagaaatggtaccggtataattgtcattacgcctacaagagagttggctttacagatttttggagtggcaagagagttaatggaattccattcacagacatttggtattgtcattggtggtgcaaatagaagacaggaagccgaaaaattgatgaaaggtgttaacatgttgattgctacccctggaagattattggatcacttacaaaatacaaaaggatttgtattcaagaacttgaaggctttgattatcgatgaagcggacagaatcttagaaattgggtttgaagatgaaatgaggcagataattaagatcttgccaaacgaagataggcaatccatgttattttcagctacacaaacgaccaaagttgaggatttggctagaatctcgctgagaccgggccctcttttcattaatgtcgttcctgaaaccgacaactccaccgcagatggattagaacaaggctatgtggtatgtgacagtgataagagatttttgttgttattttctttcttgaaaagaaatcaaaaaaagaaaattattgtatttttatcatcttgtaactctgtgaaatattacgctgaattattgaactatattgatttgccagtcctcgaattacacggtaagcaaaaacaacaaaagagaacaaatacatttttcgaattctgtaatgcggaaagaggtatcttgatttgtacagatgtcgcagctagagggctagatatccctgctgtggactggatcattcaattcgaccctcctgatgatccaagagattatattcatagagtcggaagaaccgcaagaggcactaaaggtaagggtaaatctttaatgtttttaacacctaatgaattagggtttttaagatatctaaaggcttccaaggtcccattaaatgagtacgaattcccggaaaacaaaattgcaaacgttcaatcacaattagaaaaattaattaaatccaactattatctacatcaaacagccaaggatggttatagatcttatttacaagcgtacgcttcccactctttgaaaactgtctatcaaatcgataagctggatttagccaaagtagcaaagtcttacggttttccagtccctccaaaggttaacattacaattggtgccagtggaaaaacgccaaataccaaaagacgtaaaactcataagtaa

SEQ ID NO: 3582 - DNA, 1521 bp, Saccharomyces cerevisiae
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggaaagccttaccattcaaatgccaaaggtgatttggcacaaattttacagcttaccagatattttgctgggtccgctgataagtttgacaaaggtgcaaccataccattgacttttaacaagtttgcatatactctaaaagttccttttggcgttgttgctcaaatcgttccatggaattatcctctagctatggcttgttggaaattgcaaggtgccttagcagccggtaacacggttatcatcaaacctgctgagaatacctctctatctctactttattttgctactttaattaaaaaagcaggttttccacctggtgttgtcaatatcgttcctggttatggatcacttgtaggccaagccctagcatctcacatggatatcgacaaaatatcttttacgggaagcaccaaggtcggtggatttgtgttggaagcttccggccaatcgaaccttaaagacgttacactagaatgcggtggtaagtctcctgctctcgtatttgaagatgcagaccttgataaggctatcgattggatagcagctggcattttctacaattcaggacagaattgtaccgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaagggaggaaaagttggacatgttccagacctctgaatttcctattggtggagctaaaggctacttcattcccccaaccatcttcactgatgtcccgcaaacatcgaaactgttacaggatgagatatttggcccggttgtggttgttagcaagttcacaaattatgatgacgctctgaagctggctaatgatacttgctacgggctcgcctctgcggtcttcacaaaagatgtcaagaaagcgcacatgtttgctcgcgatattaaagcaggaactgtttggatcaactcatctaacgatgaagatgttaccgttccttttggcgggtttaaaatgagtggtattggtagagaactggggcaaagtggtgttgatacctatcttcaaacaaaagcagttcacataaatctctctttggacaactaa

SEQ ID NO: 3583 - DNA, 1521 bp, Saccharomyces cerevisiae
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggtaagcctttccattccaatgctaaacaagacttagcccagattatagaacttacaagatactatgcgggggcggtcgacaagttcaatatgggtgaaaccattccattgacttttaacaagtttgcatatactctaaaagttccttttggcgttgttgctcaaatcgttccatggaattatcctctagctatggcttgtagaaaaatgcaaggtgccttagcggccggtaacacggttatcatcaaacctgctgaaaatacctctctatctctactttattttgctactttaattaaaaaagcaggttttccacctggtgttgtcaatgtcattcctggttatggttccgttgtggggaaagctttaggaacccacatggatatcgacaaaatatcttttacgggaagtactaaggttggcggctcagtattggaagcttccggccaatcgaaccttaaggatatcacactagaatgcggtggtaagtctcctgctcttgtatttgaagatgcagaccttgataaggctatagaatgggtagcaaatggtattttttttaattcgggacagatctgcactgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaaaggaggaaaagttggacatgttccagacctctgaatttcctattggtggagctaaaggctacttcattcccccaaccatcttcactgatgtaccagaaacatctaagttgctgcgtgatgaaatatttggcccggttgtggttgttagcaagttcacaaattatgatgacgctctgaagctggctaatgatacttgctacgggctcgcctctgcggtcttcaccaaagatgtcaagaaagcgcacatgtttgctcgcgatattaaagcaggaactgtttggatcaatcaaaccaatcaagaagaagctaaagttccttttggcggatttaagatgagtggtattggtagagaatcaggcgacaccggcgttgataactatttacaaataaaatcagtccatgtggatctttcattggataaataa

SEQ ID NO: 3584 - DNA, 1521 bp, Saccharomyces cerevisiae
atgccagagtccagattgcagagactagctaatttgaaaataggaactccgcagcagctcagacgcacctccataataggtaccattgggcccaagacaaatagctgcgaggccattactgctctgagaaaagctggtttgaacatcattcgattgaacttttcccatggctcctacgaattccatcaatcagtaatcgaaaatgctgtgaaatcggaacagcaattccctggcaggccgctcgccattgccctggataccaagggtcccgagatcagaacaggtcgcacgttaaatgaccaagatctttatatccccgtagaccaccaaatgatctttaccactgacgcaagttttgcaaacacctccaatgataaaatcatgtatatagactatgctaacctgacaaaagttatcgttccggggagatttatatacgtggacgacgggattctctcttttaaagtgctccaaatcattgacgaatctaatttaagggtgcaagcggtaaactcgggttatatcgcatctcataaaggtgttaatctgcctaataccgacgttgatttgccccccttgtccgccaaagacatgaaggacttgcaattcggagtccgcaatggcattcacatcgtatttgcctctttcataagaacttcagaagatgtgttgtctatcagaaaagcgttgggttctgaagggcaagatatcaagattatatccaagatagaaaaccagcaagggttggataattttgacgaaatcctggaagtcacggatggtgttatgatagcgagaggcgatttaggaattgaaatcctggcacctgaagtattagccattcaaaaaaagctgattgcaaaatgtaatttggcgggcaaacctgtcatttgcgcgactcagatgctggattcaatgacacacaatccgagaccgacaagggctgaagtatcggatgtgggtaacgctgtgttggatggtgctgattgtgttatgctttctggagaaacggcgaagggtgattatccggtgaatgcagttaatattatggcggcgaccgctctgattgctgaaagtactatcgctcatttggctctttatgacgatctcagagacgccactcccaaacctacttccactacggaaactgtagcagctgcagctaccgcagcaatcttggagcaagatggtaaggccatcgttgtattatctactacagggaacacggcaaggctactgtcgaagtatagaccaagctgccctatcatattagtaacaagacacgcaagaacggcaagaattgcgcatttgtatagaggtgttttcccatttctgtatgaaccgaaacgcctagacgactggggtgaggatgttcataggcgcctaaagtttggtgttgaaatggcgaggtctttcggaatggtggacaacggtgatactgttgtttccattcaaggattcaaaggaggagtcggccattccaataccttacgcatttctactgttggtcaagaattctag

SEQ ID NO: 3585 - DNA, 1521 bp, Saccharomyces cerevisiae
atggaatcgacagcaatagtgcctaaaggccctgttgtgggtagtgaagatatggagaaagcggaagtcattgctagtgggtccacagacattatatcaacaacatcaacagcgacaacaacggcggcgattggaagtgtacaggaagaaagtgtaaaacaagaagatgttcctatggaaggtggagagggggaagtcgaggaagaggaaggcgaaactcgctgtatctgtggagagctcgatactccagatgactccggatttttcattcaatgtgagcagtgcagttcctggcagcacggttattgtgtgagtattactcaagacaacgcacctgataaatattggtgcgagcaatgcagaccggagttacatcagctctttaccacagatactggcgaagcaaggtcaatctataaacctgtgcaagagaaaaggaggcaatcaagaaggaaggcacgaagtgcagctgcaagtaaatctcatgccgccaatgaagcagagaaaagtcccagaaataccagcaataccgatgataacgtcgacgatatcggcgacgaagaagatgaagtagaagatgaagcttcggctgtagcattagccaaggacggcaacacgaggtcaagtagaaggaggaggaggaattcaatggatgatgcttctaccgatcagtattcactggatcctggagatagtgataagaagctactggatagaaaaagggcaactttcatggcaagagaagaaaagcaatatcaaagaatgcttgaaaaagccttgaaagaaagcaggaggacatcacatcaagaagatcctgaaagttatgaaaatgatgctgatatataccaaggtgataccgacaatcacaacggcaccactcgattacaaacggatgttatgctaacggaaggcaaaccggactcggtaacaaatgatgatatgaaagaaagcctacgaccatcgaaagagcaatcaatggaaaaaacaaatgatgtggaaaaagaagctagtcaagaaaaggaatcttctacgggttcggcgcaagacactgagaaaactgatgaacccatcctacccctaacctcaatatcttcttctgaggatgattcaaggaaagctagttcgaggggttctaaaagagtttccaaaccagcaagaaagggcaacagaactcgtcgaagcaatacaagttcagacaccaaccaaaatagaaggagtgctgatataggtaccgacaaaccagtaaagcccagattaccccctcaaaggacctcattaaacgaaatgagaagaagggtatccgctattttggagttcatttctagaactcaatgggaattgagtgaagatcagtctgatcgagaggaatttgtacgattcgtggaaaaccagcatttcgtagaaaaagttgatacgatttacaacggttataatgaaagtctatcaatgatggacgacctgactagagagttactactatgggagaaaaaatattcaaataacactaatgccattcaataa

SEQ ID NO: 3586 - DNA, 1521 bp, Saccharomyces cerevisiae
atggatccatttttagagttcagagtaggcaatatctcattaaatgaattttatagaagaactattcaaagcgaatttgagaggatccttgaagatcccctatcaaatatgaaaaactacagatttagtaaacaatcaaactatagtacaaaagaaaaaacaccgttaagtataggtgttaactgtcttgatattgatgatactggtcaagtgttattaggaggtggagatgatgggtcactttccatttggggtttagatgaatcattgcaccgcaatgatgaaggtgaacaggaattgatcaataaaaggctaaactatatcaagcgacagcctcaccaatcagatgatgagcctgctcaaataatgggttataaaaataaaagaacacgaataaacgacaacaacactatgagactggtgcacagttttcaaacacagagaaacaaatatcgaatgtatagacagtctagtgctgcagttccagttcaaagatcacacatatcaaataaaacggattctcctatcgggtttagtgagacactatctgaaacagattcagaagcttccatatctcaccataaatatggtataacaactttgaagtggtataaggctgataatgggatgttttttactggctcaaatgataaaactgtaaaaatatgggacacaaacaggtttgaagcggttcaagatataaacctggggtataaaataaatcaaattgataataacgttgtcgacgacagttctttgcttgtagtggcaagtgaagactactatccaagattaattgacctgagaaccatgaattcaggggtaactgcgcttggaatgggaaatcaaacacgaatgcaatcagaaattttatgctgcaaatttaaccccgtcagggaacagattattgcttgtggtgacatggagggtggggtaaaattatgggatctaagaatgaggaacagactgtattcagaattgaaaagaaataaaaataggttcaagactataaataacgatgataatgacgatcaaagcgatgtctatttcagctctaaccaatcaaaagcccatctgagatgttgcagtgacattgtttggaatagtgagggttcagagctatgttcagtcggcatggatggaaaactgaatgtttggaggccatttacggaaattctgcaaccagaaggtctagctagttattcccagttgggaacacaagacctgagccgtatcaaatacaaaaaaagagtatctcgaaggttgctttggtttgacaagtttttactgtgtattactgacaatggtgaagtagaaatatacaatacggaggaaaaaaaactttggaacaagctcgaatacccaatggttaatcaggtaaaaaaaaatcaggcttcgcattgtcagtttagttccatgattgtgcaaacaaatataatgaattcagttggcctcaaattgttctttggaactaacaacaacaccgttagcgacggcggatccatctttgaatgttcataa

SEQ ID NO: 3587 - DNA, 1521 bp, Saccharomyces cerevisiae
atggccattgattactctaagtgggataaaattgaactatcagatgattctgatgtcgaggtgcatcctaatgtggacaagaaatcgttcattaaatggaaacaacagagtatccatgaacagcgattcaaaaggaaccaagatatcaaaaatttggagacacaagtggatatgtattctcatttgaacaaacgagtggacagaattttgagtaatttacctgaaagttctcttactgatttgccagccgttaccaaattcttgaatgcaaattttgataagatggagaaaagtaaaggggaaaatgttgatcctgagattgcaacatacaatgaaatggttgaagatctttttgaacaattagcaaaagatttagacaaagagggcaaagactcgaagagcccatctctcataagggatgctattttgaaacatagggctaagatcgattcagtaactgtagaggctaagaagaaattagatgaattatacaaggagaaaaatgcacacatttcatctgaagacattcatacaggctttgatagtagctttatgaacaagcaaaaggggggggctaagccactggaagcaactccttcagaagctctttcgagcgctgcagagtctaatattcttaataaactagcaaaatcatcagttccgcaaactttcatcgattttaaagatgatcctatgaaactggccaaggaaactgaagaattcggtaaaatatccattaatgagtactcaaaatctcagaaattcttactggagcacttacctattatttcagaacaacaaaaggacgccttaatgatgaaggcctttgagtatcagttacatggtgacgataagatgactttgcaagtcattcatcaatccgaattgatggcctacattaaggaaatctacgacatgaagaaaattccatatttaaatccaatggaactatcaaatgtcattaatatgtttttcgagaaggttatcttcaacaaggacaagccaatgggtaaagagtcttttttgagatcagttcaagaaaaatttttgcacattcaaaaacgttccaaaattttacaacaagaggaaatggatgaatcgaatgctgaaggagtagagacgattcaattgaaatctctagatgattctacagaattagaagtaaacttgccagacttcaattctaaagatccagaagagatgaaaaaggttaaagttttcaaaactttaataccggaaaaaatgcaagaagccataatgaccaaaaatttggataatattaataaagtctttgaagatataccaattgaagaggctgagaaacttttggaagtgtttaatgacattgacattattggaataaaagcgatcttagaaaacgagaaagactttcaaagtttgaaagatcaatacgaacaggaccatgaagacgccactatggagaatctgtccttaaacgaccgtgatggtggcggagataaccatgaagaggtcaaacatactgccgacactgttgactag

SEQ ID NO: 3588 - DNA, 1521 bp, Saccharomyces cerevisiae
atggcttcaatgttcagaccaccagaatccaataggagtcaccaaaagactccaaaattaacgcttccagtaaatttagttcaaaatgcgaaatccactaatgatgggcaacatctcaaccggtcaccgtactcgtcagtgaacgaaagcccatactccaacaatagcacttcagctacttccactacgtcatccatggcttcaaattccactttgttgtacaatagatcatctactacaactattaaaaatagaccggtaccacctccattacctcccctagtactaacgcaaaaaaaagacggtatagaatatagagttgccggcgatagtcagctttctgaaagattttctaatttgcatgttgatataacttacaaggaactactatctagtgctccaatttccactaagttatccaacatagataccacttttatcaagaaagatctcgacacaccagaaggcgaggattcatacccctcgacacttctttctgcgtacgacttcagcagtagcgggagcaactccgcccctttaagtgcaaataacataatttcttgttccaacttaatacaaggaaaagacgtagaccagttagaggaagaagcatggaggtttgggcatctcaaggatgagattactacactaggaattctaggagaaggcgcgggtggttctgtagccaagtgccgattaaaaaatggaaaaaaggtttttgcgttgaagacaatcaacactatgaatactgacccagaatatcaaaagcaaatattcagagagctacaatttaataagagttttaagtccgattatattgtgcagtactatggtatgtttaccgacgaacagagttcttcaatatacattgccatggaatatatgggaggaaaatcactggaggcaacgtataaaaatttgttgaaacgtggcggtagaataagtgagagggtgataggaaagatagcagaatctgtcttaagaggtttatcatacttacacgaaaggaaagtcatccacagggacattaaaccccaaaacattcttcttaatgaaaaaggggaaatcaaattatgcgatttcggtgtcagtggggaggctgttaactctttagcgatgacatttactggaacgtcattttatatggccccagaacgaatacaaggccaaccatacagcgtaacctgtgatgtatggtccttaggattaactcttctggaggttgctggagggagatttccatttgaatctgacaaaataacgcaaaacgtggctcctatagaattattgacgatgatcctgacgttttctccccagttgaaagatgagccagaactagacatatcctggagcaagacatttagatcttttatcgactattgtttaaaaaaagatgccagagagaggccttctcccaggcaaatgttaaagcatccctggattgtagggcaaatgaaaaaaaaagtcaacatggaacggtttgtaaagaaatgctgggaaaaggaaaaggatgggatataa

SEQ ID NO: 3589 - DNA, 1521 bp, Saccharomyces cerevisiae
atgggttccatcaataataacttcaacactaataataacagtaatacggatctcgatcgggactggaaaactgcattgaatattcccaagaaggataccagaccacagacagatgatgtcttaaatacaaagggtaatacttttgaagatttttatttgaaaagagagctgttaatgggtatttttgaagccggttttgaaaaaccatcccctattcaagaagaggctattccggtagcaataactggtagagacatattggccagagcaaagaatggtacaggtaagacagccgcatttgttattcctacgttagagaaagtcaaaccaaagttgaataaaattcaggctttgatcatggttcccacaagagagttagctctgcaaacttcccaagtcgtccgtacattgggaaaacactgtggtatttcatgtatggtgaccactggtggtaccaatttgagagacgatattctaagattaaatgaaacagtccatattttggttggtactcctggtagagtgttggatttagcttcgagaaaagtagcagatctgtctgattgttcattattcatcatggacgaagccgataaaatgttatctcgtgacttcaagacaataattgaacaaatcttatccttcttacctccaactcaccaatctttattatttagcgctactttcccactaacggttaaggaattcatggttaaacatctgcataagccttatgaaattaatttgatggaagaattgactctaaagggtattactcaatactacgcctttgttgaagaaagacaaaagctacattgtttaaatactttattctctaagcttcaaattaatcaagccattattttttgtaattctactaaccgtgtcgaattactagccaagaaaatcactgatttaggctattcctgttattactctcatgcaagaatgaagcaacaagaaagaaataaagttttccacgaatttcgtcaaggtaaggttcgtacattggtctgctccgatttattgacccgtggtatcgatattcaagccgttaatgtcgttatcaatttcgatttccccaaaacggcagaaacatatttacatcgtattggtagatccggtaggtttggccacttgggtttagcaatcaatttgattaactggaatgatcggtttaacctttataaaatcgaacaagaactgggcactgaaattgcggctattccggccactatcgataagtcattgtatgtggctgaaaatgacgaaacggtacctgtcccattcccgatagagcaacagagctatcatcaacaagcgatacctcagcaacaattaccatctcagcaacaatttgctattcctccgcagcaacatcatccacaattcatggttcctccttcgcatcagcaacaacaggcgtatcctccaccgcaaatgccatcgcagcaggggtatcctccacagcaggaacatttcatggcgatgccacctggtcagtcacaaccccagtattaa

SEQ ID NO: 3590 - DNA, 1524 bp, Saccharomyces cerevisiae
atgaaagtgcttgacctactaacggtactcagtgcctcttcattattatctacattcgcggctgccgaaagtactgctactgcagacagtacaactgcagcttctagcactgcttcgtgtaacccgttaaaaactacaggttgtacgccggatacagctttggcaactagttttagcgaagatttctcatcttcatccaaatggtttaccgacttgaagcacgcaggtgaaatcaagtacggttcagacggtttgtcaatgacactggcgaaaagatacgataatccaagtttgaagtctaacttttatatcatgtatggtaaattggaagttatcttaaaagctgccaatggtaccggtattgtttcatcattctatttacaaagtgatgatttggatgaaattgatattgaatgggtgggtggtgacaacactcagttccaatctaacttcttttctaaaggtgataccacaacatacgacagaggcgaatttcacggtgtcgacactcctaccgacaaatttcataactacactttagattgggcgatggacaagacgacttggtacctcgatggagagtctgtcagagtattatcaaacacatcaagtgagggttacccacaatctcctatgtacctaatgatgggtatctgggccggtggtgacccagacaatgctgctggtaccattgaatgggctggtggtgaaaccaactacaatgacgctccattcactatgtacattgaaaaggtcattgtaactgattattctaccggtaaaaagtacacatatggtgaccaatctggttcttgggaatctattgaagctgacggtggttctatttacggcaggtatgaccaagcccaagaagatttcgcagttttagccaacggtggtagtatttccagcagctctacatcctcttctactgtatcttcctcggcgtcttccactgtatcttcctcggtttcttccactgtgtcctcctcggcttcttccactgtgtcttcctcggtttcttccactgtatcttcttcgtcttctgtatcttcctcttcatccacatctccatcttcttcgaccgctacttcatctaaaacacttgcttcctcatcagtcaccacatctagttccattagttcattcgaaaagcaatcctcctcttcatccaagaaaacagtggcttcctcttctacaagtgagtccattatttcctccactaagaccccagccactgtttcctctaccactaggtctacagttgccccaactactcaacaatcttccgtatcatcggacagtcctgtacaagataagggtggtgtcgcaacatcaagtaatgacgtgaccagttctactacccagatatcaagcaaatacacatctacaatccaaagttcttcctccgaagccagctcgacaaactctgttcaaatttctaacggtgctgatttagctcagagtttaccaagagagggaaaacttttttccgtactcgtagctttactagccttgctataa

SEQ ID NO: 3591 - DNA, 1524 bp, Saccharomyces cerevisiae
atgacaaatgcaaagattttagtagctcatataagtgaaagcgatgccgatgaggctatcagaaagatcaagaaagtgaatgaaaaatcagggccctttgatctaataattatattcagtaactcgtatgatgaaaattttgagctgaatactgatgggttacctcaactaatactactatcgtgtgataaggctaacaattcgaaatccaaaaagataaatgaaaatgtaacattgctgcataatatgggtacttataaattagcaaatggaatcactctttcatattttatttatccggatgatactcttcaaggggagaaaaaaagcatactggacgaatttggcaaaagtgaggatcaggtagacattctccttacaaaagaatggggcctttcgatctctgagagatgtggaaggttgtctggaagtgaagttgttgatgaattggcgaaaaagttacaagcaaggtaccattttgccttttcagatgaaataaacttttacgaattagagcctttccagtgggaaagagagcgcttatcgaggttcctcaatattccaaaatatggatctggaaagaaatgggcctatgcattcaatatgccaataggggacaacgaactaaaggatgaacctgaaccgcccaacttgatagctaacccgtataatagcgtggttacaaacagcaataaaaggccactagaaacagaaacagagaattcgttcgatggagacaaacaggtacttgctaatagagaaaagaatgaaaataaaaaaattcgaacgattttgccgtcaagttgtcatttctgcttttcaaatccaaacctcgaggatcatatgataatatcaatcggcaaactagtgtatttaaccacagcgaagggacctttaagtgttcctaagggtgatatggatatctcaggccattgcctcattattcccattgaacatattccgaaattagatccaagcaagaacgcagagttgacacagagtattttggcttatgaagctagtcttgtgaagatgaactacataaaatttgatatgtgcacgattgtcttcgaaatacagtctgaacgttctattcatttccacaaacaagttattcccgttccaaaatacctcgttctaaagttctgcagtgccttagatagacaggttcatttcaataacgaaaaattcacaagaaatgctaagctagagttccaatgttacgattcacactcttccaaacaatatgtggatgtaattaacaaccaatccaataattatttacaatttaccgtctacgagactcctgaagcggacccaaagatatatttggccacatttaatgccagtgagacaatagatctgcagtttggacgacgtgtactagcctttttacttaacttgccacgcagggtgaaatggaattcttcaacctgtttacaaactaagcaacaagagactatagaggctgaaaagtttcaaaaggcctacaggacctatgacatttctctcacagaaaactaa

SEQ ID NO: 3592 - DNA, 1524 bp, Saccharomyces cerevisiae
atgacaagcaaaacgaagaatatcgatgatatacctccagaaatcaaagaagagatgatacagctctatcatgatctaccgggtatagaaaatgaatataaactcatagacaagatcggtgagggaacattttcgtcagtgtataaagccaaagatatcactgggaaaataacaaaaaaatttgcatcacatttttggaattatggttcgaactatgttgctttgaagaaaatatacgttacctcgtcaccgcaaagaatttataatgagctcaacctgctgtacataatgacgggatcttcgagagtagcccctctatgtgatgcaaaaagggtgcgagatcaagtcattgctgttttaccgtactatccccacgaggagttccgaactttctacagggatctaccaatcaagggaatcaagaagtacatttgggagctactaagagcattgaagtttgttcattcgaagggaattattcatagagacatcaaaccgacaaattttttatttaatttggaattggggcgtggagtgcttgttgattttggtctagccgaggctcaaatggattataaaagcatgatatctagtcaaaacgattacgacaattatgcaaatacaaaccatgatggtggatattcaatgaggaatcacgaacaattttgtccatgcattatgcgtaatcaatattctcctaactcacataaccaaacacctcctatggtcaccatacaaaatggcaaggtcgtccacttaaacaatgtaaatggggtggatctgacaaagggttatcctaaaaatgaaacgcgtagaattaaaagggctaatagagcagggactcgtggatttcgggcaccagaagtgttaatgaagtgtggggctcaaagcacaaagattgatatatggtccgtaggtgttattcttttaagtcttttgggcagaagatttccaatgttccaaagtttagatgatgcggattctttgctagagttatgtactatttttggttggaaagaattaagaaaatgcgcagcgttgcatggattgggtttcgaagctagtgggctcatttgggataaaccaaacggatattctaatggattgaaggaatttgtttatgatttgcttaataaagaatgtaccataggtacgttccctgagtacagtgttgcttttgaaacattcggatttctacaacaagaattacatgacaggatgtccattgaacctcaattacctgaccccaagacaaatatggatgctgttgatgcctatgagttgaaaaagtatcaagaagaaatttggtccgatcattattggtgcttccaggttttggaacaatgcttcgaaatggatcctcaaaagcgtagttcagcagaagatttactgaaaaccccgtttttcaatgaattgaatgaaaacacatatttactggatggcgagagtactgacgaagatgacgttgtcagctcaagcgaggcagatttgctcgataaggatgttctcctaatatctgaatag

SEQ ID NO: 3593 - DNA, 1524 bp, Saccharomyces cerevisiae
atgacaatgacacaccaacaggatttgaaaggtgtgttcaccgcaaaggatttggattttaagcccgctggcaagattactaaaaaagatttgaatacaggtgtcactaaggcagaatatgctgtaagaggagctattccaaccagagctgacgagctaaaagaggaattgaaaaaaaacccagaagttttgcctttcgatgatattatcaatgcgaacattggtaatccgcagcaactggatcagaagcctttgacctttaccaggcaagtactggccatcctggagtacccggaaattttacgagtaggccataatgaactggcttctttgaacttgttttccagggacgccttggaaagagctgagcgcctcttgaatgatattggcggttctataggggcatattcgcattctcaaggtgtgccaggaataaggcaaacagttgctgacttcattactagaagagacggcggtgagcccgctacaccggaagatatttatttaaccactggcgcttcgtccgcggcaacttctttgttatctttattgtgtaaagattctcaaacaggcctgctgattccaattccgcagtatccgctttatactgcatccgcatctcttttcaatgcacaagtgctgccatactacttagatgaggagtcaaattggtctacaaacagcgacgaaattgaaaaagtagtgcaagatgctttgaaaaaacagatcagaccatctgtgctgatagttattaatccaggtaacccaaccggtgcagttctttctgaagaaaccattgccaggatctgtttgatcgctgcgaaatacggcattacaatcatttctgatgaggtctatcaagaaaacattttcaacgatgttaaatttcattcgatgaagaaagtcctaagaaaattgcagcatctttatccaggaaaattcgataacgttcagctcgcctctttacactccatttctaaaggattcatggatgagtgcggccaaagaggcggttacatggaaattattgggttttctcaagaaataagagatgctcttttcaaactcatgtctatatccatatgttctgttgtcacaggacaagctgtggttgatttaatggtcaaaccaccccagcctggagacgagtcctatgaacaagatcatgacgaaaggctgaaaatttttcatgaaatgcgtacgagagcaaacttattgtacgagacgtttaaggaactagagggtatcgaatgccaaaaacctcagggtgcaatgtatcttttccctaggcttgttttacctaagaaagctctttgtgaaagcgaacgccttggcatcgaacctgatgagttctattgcacatctttgctagaatctacaggtatttgtactgtcccagggtctgggttcggacaaagacccgggacttatcatgtgcgaacaacgtttttggctccagggactaaatggattcaagactggaaagaatttcatcaagatttcttcagcaagtatcgtaattga

SEQ ID NO: 3594 - DNA, 1524 bp, Saccharomyces cerevisiae
atgaccgcttccatcaaaattcaaccggatattgactctctaaagcaattacagcagcaaaatgacgatagttccataaatatgtatcccgtgtatgcgtatttgccatcattggatctgactcctcacgtggcatatctaaaattggcacaattgaacaaccctgatagaaaggaatcatttctgttggaaagtgctaagacaaataatgaattagatcgttattcattcataggtatctcgccacgcaagaccatcaaaaccggtcctactgaaggcattgaaacagatcctttggaaattttggaaaaggagatgtctacctttaaagtagccgaaaatgttcctggtttaccgaaattaagtggtggtgctattggttatatttcttatgactgtgttcgttatttcgagccaaaaacaagaaggcctttgaaagatgtcctaagacttccagaggcatatttaatgctttgtgataccattattgcctttgataatgtttttcagagatttcaaatcattcataacattaataccaatgaaacttcgttggaggaaggttaccaagctgcagcacaaataatcactgatatcgtatcaaagctaaccgacgattcctcgccaataccatatccagaacaacctcctattaaattgaatcaaacttttgaatcgaatgtgggcaaggaaggttacgaaaatcacgtctccactttgaagaagcatattaagaaaggtgatattattcaaggtgtgccatcgcaaagagtggcaaggccaacttcgttacatcctttcaatatttacagacatttacgtacagtgaacccatctccttacctgttttatattgattgtttggatttccaaatcattggtgcatctccagaattgttgtgcaaatcggattccaaaaatagagtcattacccatccaattgctggtactgtcaaacgtggggctactactgaagaggatgatgctttagcggaccaattacgtggctcgttaaaagaccgtgcagaacatgttatgctggtagatttagcaagaaacgatattaacagaatttgtgacccattaacaacaagtgtcgataaactgttaactattcaaaaattttctcatgtccaacatctggtttctcaagtcagcggtgttctccgcccagaaaagacaagatttgatgcattcagatcgattttccctgcaggtactgtcagtggtgctccaaaggttagagccatggaattgattgccgaactagaaggagaaaggcgtggggtttatgcaggcgccgtaggtcattggtcatacgacggtaaaacaatggacaattgtatcgctttaaggactatggtctataaagatggcattgcttacttgcaagctggcggtggtattgtttacgattcagatgagtacgatgaatatgtcgaaaccatgaataaaatgatggccaatcacagtactattgtgcaagcagaagaattgtgggccgatatcgtaggatcagcttaa

SEQ ID NO: 3595 - DNA, 1524 bp, Saccharomyces cerevisiae
atgactaaatctgagcagcaagccgattcaagacataacgttatcgacttagttggtaacaccccattgatcgcactgaaaaaattgcctaaggctttgggtatcaaaccacaaatttatgctaagctggaactatacaatccaggtggttccatcaaagacagaattgccaagtctatggtggaagaagctgaagcttccggtagaattcatccttccagatctactctgatcgaacctacttctggtaacaccggtatcggtctagctttaatcggcgccatcaaaggttacagaactatcatcaccttgccggaaaaaatgtctaacgagaaagtttctgtcctaaaggctctgggtgctgaaatcatcagaactccaactgctgctgcctgggattctccagaatcacatattggtgttgctaagaagttggaaaaagagattcctggtgctgttatacttgaccaatataacaatatgatgaacccagaagctcattactttggtactggtcgcgaaatccaaagacagctagaagacttgaatttatttgataatctacgcgctgttgttgctggtgctggtactggtgggactattagcggtatttccaagtacttgaaagaacagaatgataagatccaaatcgttggtgctgacccattcggttcaattttagcccaacctgaaaacttgaataagactgatatcactgactacaaagttgagggtattggttatgattttgttcctcaggttttggacagaaaattaattgatgtttggtataagacagacgacaagccttctttcaaatacgccagacaattgatttctaacgaaggtgtcttggtgggtggttcttccggttctgccttcactgcggttgtgaaatactgtgaagaccaccctgaactgactgaagatgatgtcattgttgccatattcccagattccatcaggtcgtacctaaccaaattcgtcgatgacgaatggttgaaaaagaacaatttgtgggatgatgacgtgttggcccgttttgactcttcaaagctggaggcttcgacgacaaaatacgctgatgtgtttggtaacgctactgtaaaggatcttcacttgaaaccggttgtttccgttaaggaaaccgctaaggtcactgatgttatcaagatattaaaagacaatggctttgaccaattgcctgtgttgactgaagacggcaagttgtctggtttagttactctctctgagcttctaagaaaactatcaatcaataattcaaacaacgacaacactataaagggtaaatacttggacttcaagaaattaaacaatttcaatgatgtttcctcttacaacgaaaataaatccggtaagaagaagtttattaaattcgatgaaaactcaaagctatctgacttgaatcgtttctttgaaaaaaactcatctgccgttatcactgatggcttgaaaccaatccatatcgttactaagatggatttactgagctacttagcataa

SEQ ID NO: 3596 - DNA, 1524 bp, Saccharomyces cerevisiae
atgataacaccaagattctctataacacaggatgaggaatttatatttctcaaaatattcataagtaatattaggttcagtgcagtgggtttagagataatcatccaagaaaatatgatcatttttcacttatccccttactatttaagattaagatttcctcacgaattaatcgatgatgagaggtctaccgctcaatacgattccaaagatgaatgcatcaatgtaaaagtagccaaactgaataaaaatgaatatttcgaagatttggacctaccgacaaagttgttggctaggcaaggcgatcttgcaggtgccgatgcattaacagaaaatactgatgcgaaaaaaacccaaaagccccttattcaagaggtcgaaactgatggcgtgtcgaataatattaaagatgatgtgaagactattggtcaaatgggagaggggtttaattgggagatagagcaaaagatggattccagcaccaataatggaatattgaagacaaaatatgggtttgataacttatatgatacagttatatcagtgtcgacaagcaacgggaacgatatcaatgaattagacgatcctgaacacactgacgcgaacgatagagttattgaaaggttaagaaaagaaaatttgaagtttgatcctgagtactatgtttccgagtatatgacacataaatacggtaacgaggaagacttggaaattaacggcattaaagaactactgaagtttacaccttcgatcgtaaagcaatacctgcaatggtacaaagacagtacgaacccaaatctggtcatgccaattgagtttactgacgaggaacaaaaacagatgcaggacaatttacccaagaagtcttatctcgtggaagatataaaaccactttatgtcactatactcagcgttcttttcagttatgtgtttgaacagatcgaaaacgaaggtactcataccacagagagtgcttggaccatgggaaaattgtgccctcaaatatcattcttagaccaacaattaaaacaggtgaacgaactgcaagacggtatgaaagaaatatcaaaggttaataaagacagctctctcatcaagattgcaatcattacaggtatcaggagagccctgagttatccactacatagaaactatgacctagcaatgaaagcgtggacattcgtatattatattctacgaggtggtaagagactagtcataagggcgcttttggacattcatgaaacatttcgtttccatgatgtttactacgtctacgacaaagttctcttggatgatctgactgcgtggttcatttctcagggtagtgagaacgtcataagaagtctggccttggaaatgagaaaagagcaagagtcactttccaagcaggatattgaatttgaatgtattgcatcgttcaacgaacaaactggcgaacctgagtgggagacactaaatataagagagatggaaattttggcagagtctgaataccgagagcagcagcagaacccacaatga

SEQ ID NO: 3597 - DNA, 1524 bp, Saccharomyces cerevisiae
atgtttgaagtccctataactttaactaataggaagtttgctcaaagaagaaagttaaagtatcaatacataaattacatttctagaagatttgacagaatttccaagaaatctactaccacagatagtttgccaacgcccgaaaattctgcagctgaaaataatgacgaagaagaaggtcaaaacagtgaagccggcacatataggaggtcagtactacagcagaagaaaagaagaagagaaaggcattggaggagtgtggtcggtgaaatttactctactacggaaagcgaaacagactctcaagaggaggaaactgaggaaggtggcgaacatgacaccgggatagacaaggaagatagtgatgaggagagaaaattttggaaaaaatacgaaaaacctgagaagagtttcgaaatttggcgaacagtgtcctcacaaaataaacagcccattaacaaacaaaaaatgacgtatcataattttaaaaaaattgaaaagattcctttaaggaaaatggaaattccacttttgcattgtacaaaggaaaataaactttacttccaatctatatctagagggttagagccattaaaaacatcaacatcagaagtcagaaactaccgcacaagacatatagtaacattaaccgaccttttgcatttgaatgtgtcaagacataactggtcgcttgcatataaaatattcgccacattaataaggatcccaggggttcaaatcaagtctctttggggcattggcgttgaaatactggataatttatcaaattcatcaagtggtcttgacttcttacaatggatgtgtcaaatctattcgtcaaagtcaagatttgttcagaacatcaattaccgttccattgtccctccttttcaaaccggttctagaacacatactgcgaaatttgctatcacgtacctttggtcttctttaattaattgccaaaaatctatggaaccatcatcaaacatcattgacaaaccttttgatacggaaaacgatttactacaagaattgattgataagatatcagaatgggtattgacccctccgtttatggaagacgctgaagtttggttcatttatgcatcttgtcatttattgaaggccgatacattgtcgaggcaatttgtcaatgacaacaaaaataatgacctaattggtttggatagagacataaagatcaaccaggttataaaacatattcactacgtgagaacgtttttaaaaatttgcttagataaaggtgggtttgccgtccctagcaggttaattgaaaatcaactgaaaagcttcgagtcaagactgtacggcgaagcacaagacattcaagagagggatgtagccaacgtatatgatagcattgataacagttcagtggaaaactcttttggagacgtgtatgaaacaaatgcagaatttctagatacgcagctgatggatttatcgccggaggacaacgggttggacgaaatgcattacagtgatgaagactcaagtgagtga

SEQ ID NO: 3598 - DNA, 1527 bp, Saccharomyces cerevisiae
atgaaacttcaattggcggcagtggctacattagcagtcttaactagtccggcattcggtagagtacttcccgatgggaaatacgtcaagattcccttcacaaaaaaaaagaacggcgacaatggtgaactcagcaagagatcgaacggccatgaaaaatttgtactagctaacgagcaaagcttttattctgttgagctagccattggtacaccttcacaaaacctcactgtgctgttagacacaggctcagctgacttatgggttcctggcaagggaaacccctactgcggttctgtgatggactgtgaccagtatggcgtgttcgacaagaccaagtcgtccacgttcaaagccaacaagtcctcgcctttttatgccgcttacggtgacggaacctatgcagaaggtgcatttggtcaagataaattaaagtacaacgaattagacctcagtggtctatcgtttgccgtggccaacgaatctaactcaacctttggtgtgctcgggatcggcctttccacgcttgaagtcacctattctggaaaagtcgctattatggacaagagaagctacgagtatgataactttcccctgttcctaaaacattctggagccatcgatgcaaccgcatactctcttttcctaaatgacgagtcacagtcctccggcagcatcctcttcggcgctgtagatcacagcaagtacgagggccaactgtacactatcccgttggttaatctttataagtcgcagggttatcagcacccggtggcgttcgatgtcactttacagggcttaggactgcaaaccgacaagcgcaacatcacattgaccaccaccaagctcccagccctactcgattcaggcacaacgctaacatatctgccctcccaggcagtggctttgctagcaaagagcttgaatgcctcgtattccaagacattgggttattatgagtacacgtgtccctcgagcgacaacaaaaccagcgtggccttcgacttcggtggcttccgtatcaacgctcctctatccgactttactatgcagaccagtgtggggacctgtgtcttggcaataattccacaagcgggcaacgccaccgctatccttggtgattccttcttgagaaacgcctacgtggtctacgatttggataactacgagatttccctagctcaagccaagtatggcacggggaaagagaacgtcgaagtcatcaaatctaccgttcccagtgcaataagggcccccagttacaacaacacttggtctaactacgcctccgccacgtccggtggtaatatttttaccaccgtgcgcactttcaatggcaccagtactgccaccactacgaggtcaaccaccaccaagaagacaaactctaccactactgcaaagtcgactcataaaagcaagagggcactccagagggctgctaccaactccgcttccagtatacgctctaccttgggtttactgctagtcccctccttactcatcctttccgttttcttttcgtaa

SEQ ID NO: 3599 - DNA, 1527 bp, Saccharomyces cerevisiae
atgaagtatctaaacttagttttcgtgcttcagcttcttattagcatcaaatacgcctcattcggccgagccttttctctttttgaagatgataccacctttgccaatttggataaacagctaaagcttccacagaatacacagcaaacccttaaattggaccgtttgaatcacgatgatccgctgtttacaacttttatttcttctgtggacacagattacagtttgagacttagaacagtagatccttctaaactaggaattgacaccgtaaaacaatggtcgggttacatggactataaggattccaaacactttttttactggttttttgaaagtaggaacgatcctgctaacgacccaattattctttggttaaatggtggacctggttgttcctcgtttactgggttgctatttgaactaggcccctcatcaattggcgccgatatgaaaccaatccacaatccctattcttggaataataacgcttcaatgatcttcttagaacagccactcggagtcggcttttcctatggtgatgaaaaagtctcctctacaaaattagcaggcaaagatgcgtacattttcctggaattgttttttgaagcttttcctcatttacgctccaacgatttccacattgcaggcgaatcctatgcaggacattatatccctcaaattgcacatgagatcgttgtcaagaaccctgaaagaacgttcaatttaacttcagttatgattggtaatggtatcacagaccctttgattcaagcagattattatgaaccaatggcatgcgggaaagggggctatcaccctgttctctcatcagaagaatgtgagaaaatgagtaaagctgcaggtcgttgtcgtaggttgaacaagttatgttatgcttctaaatcaagtttaccatgcatagtcgccactgcttactgtgactctgcacttttggaaccgtacattaacacaggactcaacgtctatgacattagagggccctgtgaagataatagtactgatggtatgtgttatacaggtctccgctatgtcgaccagtatatgaattttcctgaagttcaagaaacgctagggtccgacgtgcataattattctggctgtgataatgacgtgttcaccggatttttgtttacgggcgatggaagtaaaccatttcaacaatatattgctgaattattaaatcacaacattccggtattaatatatgcgggtgataaggattatatttgtaattggctgggaaaccatgcttggtccaatgagttggaatggatcaataaacgtaggtatcagagaaggatgttaagaccatgggtcagtaaagaaacaggtgaagagttgggacaagtcaagaactatggccctttcacctttttgagaatatacgatgccggtcatatggtgccctatgatcaaccggaggcaagtttggaaatggtcaacagttggatttccggtaatcgtgctttttcggatctttccaccttggaaaatgctagttag

SEQ ID NO: 3600 - DNA, 1527 bp, Saccharomyces cerevisiae
atgaatacagtttcaccagccaaaaaaaaggttattataattggtgccggtattgctgggcttaaagctgcatctacgctacaccaaaacggtattcaagattgtcttgttcttgaggccagagatcgggtcggtggtaggttgcaaactgtcacaggctatcaaggtcggaaatatgatataggtgctagctggcaccatgatacgttgacaaaccctttatttttggaagaggctcaactgagtttgaatgatgggagaacgaggtttgtttttgatgacgataattttatttatatcgacgaagaacgtggaagggtagaccatgacaaggaactgcttcttgaaattgtggacaatgaaatgagcaaattcgcagagttagaattccatcaacacttaggagtttcagattgctccttttttcaattagtaatgaaatacttactacaaagacgccaatttctcacaaatgaccaaataagatatttgccacaactctgtcgatatctggaattgtggcacggcttagattggaagcttttgagtgccaaggatacatacttcggtcaccaaggaaggaacgcctttgctttgaactatgattctgtggttcaaagaattgctcaaagctttcctcaaaattggttaaagctaagttgtgaagtgaaatcaattacacgagaaccttcaaaaaatgtgacagtgaactgtgaagatggtactgtgtacaatgctgattatgttattattacagtacctcaaagtgtattgaatttgtctgtacaacctgaaaaaaatttacggggaagaatagaatttcaaccacccttgaaaccagtgattcaagatgcttttgacaagatccattttggagcgctaggtaaagtaatttttgagtttgaagaatgttgttggtcgaacgaaagttcaaaaattgtaactttggctaactctaccaatgaatttgtcgaaatagtacgtaatgcggaaaatttagatgaattagactctatgctagaaagggaagattctcaaaagcatacgagtgttacttgttggagccagcctttatttttcgtaaatttgtcaaaaagcacaggagtagcaagctttatgatgttgatgcaggcaccgcttacaaatcacatagaatccattagagaagataaagagcgtctttttagttttttccaacctgtgctgaacaagattatgaagtgtctagattctgaggatgtcatcgacggaatgaggccgatagaaaacattgcaaacgctaataaaccagtcttaagaaacatcatcgttagcaactggacacgcgatccttactcacgcggtgcttattcggcctgttttccaggagatgatccagttgatatggttgttgcaatgtctaatggtcaagactcccgcataagatttgcaggcgaacatactatcatggacggcgccggctgtgcctatggtgcttgggaaagcggaagacgggaggcgactcgaatctctgacttactgaaatag

SEQ ID NO: 3601 - DNA, 1527 bp, Saccharomyces cerevisiae
atggcttcactgttcagacccccagaatctgcgaaatgcaacccaaactctcctagacttaaactgcccctcttacgaaataatcaggtagatgaaaataatatatacttgacgtcgaatgggagttccaccacagcttacagtagccacaccccagaaccactgacctcttccacatcgacacttttctcccaaactcgacttcatcctagcgactcttcaatgactttaaatacaatgaagaagaggcctgcaccgccatctttaccttcgctcagcataaattcacagtctaagtgcaaaacactacccgaactcgtacccatcgccgatgtgtctgatggtaaacatgatttaggattgaaacagcgtgtgatagccgaaaatgagttgtctggtaatagtgacttaaccccttcatcgatggcaagccccttttcacatacaaacacctcttctccctacctcagaaatgatctgagcaattcagtgggatctgacttttcaaatttgatatcggcatatgaacaaagttcaagtcccatcaagtcatcgtcccagcctaaatcatcttctgaatcgtacatagacttaaacagtgtacgagatgttgatcaattggatgaaaatggttggaaatatgcaaatttaaaagataggatcgagacattaggcattctaggagaaggagccggtggctctgtttccaagtgtaaattgaaaaatggatcaaaaatattcgctttaaaagtgataaacacattaaatacagatcccgagtatcagaagcaaatattcagagaattacagtttaataggagtttccaatccgaatatatcgtacgatattatggaatgtttacggatgacgaaaactcttcaatttatattgctatggagtacatgggtgggcgatcgttggatgctatttataaaaatttgttagagcgtggtggtaggatcagtgaaaaagtcctggggaagattgcagaagcggtactaagaggactatcatatttgcatgaaaaaaaagttattcatagagatattaagccccagaatattttactgaatgaaaatggtcaggtgaaactttgtgattttggggtcagtggagaagccgttaactcgctagccacaacattcacggggacgtcattctatatggctccagaaaggattcaaggtcaaccatacagtgtcacatctgatgtatggtcacttggattaacgattttggaagtggcgaacgggaaatttccatgctcttccgagaagatggcagccaatatagctccctttgaattgttaatgtggattttaacatttactcctgaattaaaggatgaacccgaatctaatatcatatggagtccatcattcaaatcctttatcgactactgtctgaaaaaagatagtcgtgaacggccatctccaagacaaatgatcaatcatccttggataaagggtcaaatgaaaaaaaatgtcaatatggaaaaattcgtgaggaagtgctggaaagattaa

SEQ ID NO: 3602 - DNA, 1530 bp, Saccharomyces cerevisiae
atgatcgctttgaagcccaatgctgttcgaaccttccgacaagtgcagcattgcagctttcgcatttgtcggtatcaatctacgaagtcaaataagtgtctgacgcccttgcaagagtacgacagactggtgaagttggggaagctacgggatgatacatatcagcgtggtatcatctcttccttaggggatttgtatgattcactggttaaatatgtacctccggttgtcaagacacccaatgctgtcgaccaagttggcggttggttgaatggtcttaaatccgtatttagccgtggcaaacctaagaacattggggcgtatgtggatgtatccaaaattggtaactcgatacctcgaggagtttacctatatggagatgttggctgcggaaagacaatgttgatggaccttttttatactacaattcccaatcatttaacaaaaaagagaatacattttcaccagtttatgcaatatgttcacaaaaggtcgcatgaaattgttagagagcaaaatttgaaagaactaggtgatgcaaaaggaaaagagatcgatacggttccatttttggccgcagagattgcaaataattcgcatgttctttgttttgacgagtttcaagtcactgacgtggcagatgcaatgatattgagaaggctgatgactgccttactatccgatgattatggtgtcgtacttttcgcaacctcgaatagacatccagatgagttgtatatcaacggtgttcaaagacaatcatttattccttgtattgaactgataaagcatagaactaaggttatcttcttgaattcgccaacagattaccgtaagattccaagacctgtgtcctcagtttactatttcccatccgatacgagcataaaatacgcatcaaaggaatgtaaaacccgtcgagaaactcatattaaggaatggtataactatttcgcacaggcttcccacaccgatgattccactgattcacacacggtgcataagacattttatgattatccattaactatttgggggagagagttcaaagtccctaagtgtaccccacctcgagtcgcgcagtttactttcaagcagttgtgtggtgagcctttggccgcaggagattacttgacgttggcaaaaaattttgaagcctttatagtgaccgatattccatatttgtccatttacgttcgtgatgaagtgagaagatttattacatttttagatgctgtatatgacagtggcgggaaactggccactacgggtgcagcggatttttcttccttgtttgtggaacctgaacagatacttaatgattttgagttacgcccaacaaccaaagaacctgatagcgtcgatactggtatggtagatgagatggttgagaaacacggtttttcgaaagagattgccaagaaatcgcagatgtttgctcttgatgaagaaagatttgcctttgcccgtgccttaagcaggctgtcacagatgagctccaccgattgggttactaagcctacatactaa

SEQ ID NO: 3603 - DNA, 1530 bp, Saccharomyces cerevisiae
atgccaaatgtgctttctgatgatgaagagctccttaatggactaggaagtgagattatgaaaccctctagacaaggtaaccatatggcaaggaccgtcaaaaggtgggtaaataaagaacgtgctaccacagccgatctgaaaaatgttaatattgatggagttcatggaccggtaaataccgaaagttatatatcaccaggacagctttactccactgactcgggcaatttatttcatgctggaagaatccttgtcgttctagtcggtcttccagcaacatcaaagacactattgtcagtagcgattacaagatatacaagatggttaggagttaggacgaaatcgttccatttttcagaatataaagaatcagctaaaaatataccctcagactatttttgcgtagtgccaacgtcaaaagaaggtgtagcgtttgttgaaaagcttcgcatgcagatgttgaatgatatactggcatttttcaacgacttgtcaggtcagctggccatttatgatgccctaaacatccgtaaaattgacagaaagaatttggagacaacgttttctgaaattggagttaaagtactcttcatagaatcaatcgtgtctgatcaagaaatcatgaatagaaacatagctcttgcactggagtcgaacgattacaagggactttcaactgatgaagccattgacgaatatatgagacgtttatcagtgaacgaaccatactatgaaatgatgacacatgacgaagaattatcgtacattaaatatataaatttgggaaagcagataattgtgaaagataacatacatggttatttggtcaacaaaatagtatttttcttaatgaatttgaggcagaaaaaggggtgtgtatattttgctcgctgtggcaccagcgataaagacaactacatacatgatgaggaactaaacgaggagggaatccattactctcaagttctcaaggattttgtcctccaacgaattaaacagaagagacaggccaaaaaaaattcggattccttagtcgaagtaatagatggaagtcatgatgaagatttgaagacttccttgatagtttggacaggtcccaggaaaagaacccacgatactgcactctttttttcaaaagaaggtattaaagttcagcaacggtcagagttgagacagttgaacccaggaagtattgctgatcttactgatcaacagataatggacaaatttccatcagaatataaagaatcattaaaagacccatatcattttcgattccctagggcggaatcttaccatgacttagccgttcgtatggaacctttactattagaaatggagcatacgagcaaggacattctcatcattgcacatgagtcaacattaagagtattatatggctatttaatggcttgcacctgcgtagagttaccaaatctaaatttcacaagagacaaattagttgaaatttcattcagccctttctgtaatactgtagagttactgaacattcctttaactagctaa

SEQ ID NO: 3604 - DNA, 1533 bp, Saccharomyces cerevisiae
atgaaggccgttttcaaagtaacgactgctttgctggcttgcgtgtttattgcaaggtatctggtctgtcagcaaaatggtctgggaagctttgccacagatttacagcccatttgccggcatactgaattttcagttggctcactattcgattctaaattggttgaaggttcagcggtttctgactatttagttggaaagtactcacaatcgataaaaccactgattgaaagataccccaactcatccttgaagagaattatgggatatttttaccgcttttggtacaatattttctcttttctaaggctaaatgagctctgctgttcgctacattccaagttgggacctttattaaatcatctaaggattgcctggtactatttaaagccatatacagacaatgtgaagaatgtactagagaatccatttaactcctctacggattggatgaaatacggctcctttagcgctgatggcacgctcaccaaacccatttttgagacagactcggaaacagaggattatgaggatgatgagaatgaaaatgaggatgaggatgaagatgaggatgaggatgatgtcggaattgaggatgaaaataaagaatacgagttcgatggagtacaggatggccacgggaactcacaactcgtcactgctgctattttgcaggatttgtcaaagattatcattggttccaatagccatgcagaattggaaacttacgaggcagaatcattaaaaatggaatatgaagcatggattaaggctatagattcgaaaatacacagtgcgatggcacttttggattcagagatacagtctgtgttcgaggccgaggtgcaaaataaatctatagaaatcactaggaatcttgatgaccttaacactaccgttaatgagcaattagtgtttctagattcaaaaatcaaagatattaattgtacctctaaattcgatcctgtgcaaaataaaataaagtattttgatgaatcgggtcaagttgaactggaagcttacattaccaaatcatctatcacatcgatactgaagaattataaaatacatttgttagactttgaaaaatcactgtttcattcattagattcttttcttaccgaaatggctaaactggcagaatcgattcgtcttgaaaacgtcgaagtgtacgaagagtggggcgatgtaatgataagtcaatggtcgcaaagaatggcatatatggacgtcagaggtctccatttggaagatcaatacgatcctgcctatatagaagagaatcattccaactggctccgtttcatggaattgaaaaagaaagttatttctgagaggaaccgtctggtaaaacatgatctggatatgactttgatactggaatggattactaaactaaaagctgatttccagaacacaaaaaataatattcaagatacctttctgcaacgaatgaatactgcggatactttattcaaaaaccgtgaactaaaggaacaactagaggaagaatttgtacggcaagaacattga

SEQ ID NO: 3605 - DNA, 1533 bp, Saccharomyces cerevisiae
atgacttcatctctagatgatatagaaccaacagcatataataatatggaagcggacgaggaatattgcagacgcaacgatatacatgacctttccagcgtggtcggtgatgctgtctcacaaggtgtgccagacatggatggtcaaacaacggattcttcgaaggaccctgagccaaattccgaggataagaaagcgtttcctccttcgagtggctcatttttttctcctaatctacagggtcaaaggaagaaagttcttttaaagtttgttttcacaaattgcttactggccataatttgctttacaatgtttgtgttgttctggggggctctttacgacaccagcaagtatctacacaaagttaagcttctggttgttatccaggaaccccctgtggtaattttggataataacagttccatggtagtgccctccatatcgtatgctttgcctacttttatcaataaaataccatgtgattgggatatttataacagtcctaccttccaggccaagttcgacgtaaatacgccacagcaagtcaatgacaaggttgtcgatttggtttacgacgaaaaatactggtttgccattaatatcaagccaaacgccacggagactctatttgaatcactaatcaacgataccgcaccactattcaattctacgctgtttaatcaggtggtatatgaaactggtagagacccgacaaacctaaaatcaacgattttaccggttgctcagaccattgaagagtactaccatacattctacacactaaattatctgccgccgttattgacaaacataacccaggtatatcgttatgcactaactaacaatgcaaggtatatcgctgcagcaggtaaatataactacgaatactatgaccacagaccattcacagaccgtattctactggcacccacacaaatcggtgttgtttactgtttactgctaacttttttccaatttctattgtacggcccattacacgtagaaatggcaaaagtgctaagaccagccaacggtttaatttaccgtatcgctatgtcatggttcacctttttctttgcgtctttgttcttctgcacaacaaccgccatctttcaagtcgattttaccaagtcctttggtagaggtggcttcgtcgtatattggatgtctacgtggctcttcatgcttgctgcgggaggagctaacgaaaatgcggttatgcttgttattacgttaggaccccagtatctcgggttctggatcctatcatttgtcattctcaatattgcaccttctttcttcccattagcgctaaacaataatgtttatagatatgggtacatgatgcccgttcacaacgtcatcgatatctacagggttattttttttgacgtgacaagacgcaagatgggtcggaattatggtattttagtcgcactcattgccttgaatacggcactgttaccatttgttggcaagtatgctagtagaaaactaaaacagaaggctttagtggcagcaaagcagagttaa

SEQ ID NO: 3606 - DNA, 1533 bp, Saccharomyces cerevisiae
atgacttccaaaacgtcagaaagtggtaccggtacccaaagtaccatagttcagctgaggaacctaccggatttgacggaaattagtcacttggaaatagatgctcccgtagttgaaattctaaagaaaacagtacttttccagttgaattcgttgaacatctgcatttcaaactttgcattggatgagctggtcaacctcgtgaccgtccaaatggacggcatgtttcggaacctgcacaatttaacacttttacaaagaaggtcgcaagcttctcaagcagatttgaaattgttgcttcgagagtttaacctggatgcgccctccctttatcagcagtttcaggcctcagaattcatcaaatcgaagcattccacggaatatgaaaaattgatgagctggtcgtctcttgctgctttaccgcataacgaagaagatgaagaggacgaattgaataatatcgaggagcaacagaacgagatcaacgttttgctgcctccctctaacccactggaaaaacagataccgagttggctgcccaactttccgcctgaccatacctataagtttacacctgagttcaaccatccaattactgatctaaaaaccatcaagaaagaaatagtaaaagaaagccaagagtctgaaaaggcactattgaacttgaacaaaagtctctcccacatatcatcagcgtcaaataccccgcaaccgccgggtttagacgatgaggacgctatcgagcaacaattggagatttggggcaacgcgctggaagaaaggaaaccaaccataactgaaaagtccttcaatgaaaacaatatcgagcagtatgcgaagtatagagtggaattggcgagagaacgtgtcacgaaatttgaagtgaatcagttgaaaagaacaaaaaatccattcttgaaaatttctgaaactctctaccttccagagagtcctcaccagtctcacaaaaccatacaaaaaaccatagaattgcaatttcgtaagtctatgacactattcatgcacaatttacctaaggtccagaagttgaagaaggaaaaaatacgaatggccaaggaagaaagagcaaaatcgctaaaacgtcggcaagaagagcttatttcacaacgaacaaagagggaacaagatgaaggccatgatcttgagcttctactaaataacgagcacgcaagggacgctgcagacgacacgaccacccctaatgcattaaacaactctaccatagttatcaacacaaacgccgaggatgaggacgatgacataaacttatttggcatcttagggagcagtgaagatgagaatgaaatgtcgagtatgcctgcggagaacctggtcgcggaatcggaaccgccaacaatgacagcgcaagatactacaaatactacacctgtagcacataacacaaccaatatcgatgctactacaagtcactctcctcattcgacgcctaatgaaaacgccccgacatctcctcctgcagatatagccacagatcacgatataactatgtaa

SEQ ID NO: 3607 - DNA, 1533 bp, Saccharomyces cerevisiae
atgcacgttttctttcctttgcttttccgcccttcccctgttctgttcatcgcatgtgcatatatatatatagatatatatatacattgtacacggtgcacggtagtgaacataactatgagcacgaacagagtcccgaacctcgacccggacttgaatttaaacaaagaaatctgggacctgtactcgagcgcccagaaaatattgcccgattctaaccgtattttgaacctttcttggcgtttgcataaccgcacgtctttccatcgaattaaccgcataatgcaacattctaactctattatggacttctccgcctcgccctttgccagcggcgtgaacgccgctggcccaggcaacaacgacctcgatgacaccgatactgataaccagcaattcttcctttcagacatgaacctcaacggatcttctgtttttgaaaatgtgtttgacgacgatgacgatgatgatgacgtggagacgcactccattgtgcactcagacctgctcaacgacatggacagcgcttcccagcgtgcttcacataatgcttctggtttccctaattttctggacacttcctgctcgtcctccttcgatgaccactttattttcaccaataacttaccatttttaaataataatagcattaataataatcatagtcataatagtagtcataataataacagtcccagcatcgccaataatacaaacgcaaacacaaacacaaacacaagtgcaagtacaaacaccaatagtcctttactgagaagaaacccctccccatctatagtgaagcctggctcgcgaagaaattcctccgtgaggaagaagaaacctgctttgaagaagatcaagtcttccacttctgtgcaatcttcggctactccgccttcgaacacctcatccaatccggatataaaatgctccaactgcacaacctccaccactccgctgtggaggaaggaccccaagggtcttcccctgtgcaatgcttgcggcctcttcctcaagctccacggcgtcacaaggcctctgtcgttgaagactgacatcattaagaagagacagaggtcgtctaccaagataaacaacaatataacgccccctccatcgtcgtctctcaatccgggagcagcagggaaaaagaaaaactatacagcaagtgtggcagcgtccaagaggaagaactcactgaacattgtcgcacctttgaagtctcaggacatacccattccgaagattgcctcaccttccatcccacaatacctccgctctaacactcgccaccacctttcgagttccgtacccatcgaggcggaaacgttctccagctttcggcctgatatgaatatgactatgaacatgaaccttcacaacgcctcaacctcctccttcaacaatgaagccttctggaagcctttggactccgcaatagatcatcattctggagacacaaatccaaactcaaacatgaacaccactccaaatggcaatctgagcctggattggttgaatctgaatttatag

SEQ ID NO: 3608 - DNA, 1533 bp, Saccharomyces cerevisiae
atgccaacttctggaactactattgaattgattgacgaccaatttccaaaggatgactctgccagcagtggcattgtcgacgaagtcgacttaacggaagctaatattttggctactggtttgaataagaaagcaccaagaattgtcaacggttttggttctttaatgggctccaaggaaatggtttccgtggaattcgacaagaagggaaacgaaaagaagtccaatttggatcgtctgctagaaaaggacaaccaagaaaaagaagaagctaaaactaaaattcacatctccgaacaaccatggactttgaataactggcaccaacatttgaactggttgaacatggttcttgtttgtggtatgccaatgattggttggtactttgctctctctggtaaagtgcctttgcatttaaacgttttccttttctccgttttctactacgctgtcggtggtgtttctattactgccggttaccatagattatggtctcacagatcttactccgctcactggccattgagattattctacgctatcttcggttgtgcttccgttgaagggtccgctaaatggtggggccactctcacagaattcaccatcgttacactgataccttgagagatccttatgacgctcgtagaggtctatggtactcccacatgggatggatgcttttgaagccaaatccaaaatacaaggctagagctgatattaccgatatgactgatgattggaccattagattccaacacagacactacatcttgttgatgttgttaaccgctttcgtcattccaactcttatctgtggttactttttcaacgactatatgggtggtttgatctatgccggttttattcgtgtctttgtcattcaacaagctaccttttgcattaactccttggctcattacatcggtacccaaccattcgatgacagaagaacccctcgtgacaactggattactgccattgttactttcggtgaaggttaccataacttccaccacgaattcccaactgattacagaaacgctattaagtggtaccaatacgacccaactaaggttatcatctatttgacttctttagttggtctagcatacgacttgaagaaattctctcaaaatgctattgaagaagccttgattcaacaagaacaaaagaagatcaataaaaagaaggctaagattaactggggtccagttttgactgatttgccaatgtgggacaaacaaaccttcttggctaagtctaaggaaaacaagggtttggttatcatttctggtattgttcacgacgtatctggttatatctctgaacatccaggtggtgaaactttaattaaaactgcattaggtaaggacgctaccaaggctttcagtggtggtgtctaccgtcactcaaatgccgctcaaaatgtcttggctgatatgagagtggctgttatcaaggaaagtaagaactctgctattagaatggctagtaagagaggtgaaatctacgaaactggtaagttcttttaa

SEQ ID NO: 3609 - DNA, 1533 bp, Saccharomyces cerevisiae
atgtgtggtattttaggtattgtattagcaaaccaaaccactccagtagctccggagttatgtgatggatgcatttttctacaacatcgtggacaagatgcagctggtatagctacctgtggttctcgtggtagaatctaccaatgtaaaggtaatggtatggctcgtgacgtatttacccaacaacgtgtttccggtcttgctggttccatgggtattgcccacttgagatatcctacagccgggtcttcggctaattcagaagcgcaaccattttacgtcaatagtccttacggtattaacttggcacataacggtaacttggtgaatactgcatcattgaagagatatatggatgaagacgttcatagacatattaacacggacagtgattcggagttactattgaatatttttgctgctgaactggaaaaacataacaagtacagagttaacaatgaagatgttttccacgcgttagaaggtgtttaccgtttatgccgtggcggttatgcttgcgttggtttacttgccggttttgcattatttggtttcagagatccaaatggtattaggccattattgttcggtgaaagagaaaatccggacggcactaaggactatatgttagcttcagaaagtgttgttttcaaagctcacaactttactaaatatcgtgacttaaagcctggcgaggcagttatcatccctaagaactgtagcaaaggtgaacctgagttcaaacaagtggttcctattaactcttatagacctgatttatttgaatacgtatatttcgccagaccggacagtgtcttggatggaatatcagtttatcacacaagattggctatgggttctaaattagcggaaaatattctaaagcaactgaagccagaagatattgatgttgttattcccgtcccagatactgcaagaacatgtgcactagaatgtgctaatgtgttagggaagccttatagagagggctttgttaaaaacagatacgtgggcaggacatttatcatgccaaaccagagggaaagggtttcttcagtaaggaggaagcttaaccctatggagtctgaatttaagggtaagaaggttctgatagtggatgattctattgtcagaggtactacttcaaaagagattgttaacatggccaaggaatccggtgcaacaaaggtttacttcgcttcagctgccccagccattcgttacaaccatatttatggtattgacttaacagacacaaagaacttgattgcttataacagaaccgatgaagaagtggcggaagtaatcggttgtgaaagagtcatttaccaatcattggaagatttgattgattgttgtaaaactgataaaataaccaaattcgaagatggtgtatttaccggaaattatgtcactggtgttgaagacggttatattcaagaattggaagaaaaacgtgaatcgatcgcaaataattcatcagatatgaaggctgaagtcgatatcggattatataattgtgcagattattga

SEQ ID NO: 3610 - DNA, 1533 bp, Saccharomyces cerevisiae
atgttaagaatctgcgtaaaaaggccctgtataaagatcgttctttcacaagtacgtccagcattactagtaaggaaggagaatctccacataagtactggagtaaaagttgaaaagagcagtataataaaccaaaaggaccctaataaagtacgcgttgagataaacgagttaaagagacaagctgaaattgaaaaggctgcaataaaggaattggagaaaaatcctcaataccaaaaattagctgaagcattcaacagtcatgatcatgttcatttacgtgaatcagagaccgagcaaaacgacataatttcattgggcacgatacgagactacaaaagcagtaaatgtgagcaagctgataagccttcgtcgttgaatctgcattcgcatacacattctcatggacatacgcattctcatgctgctcacaatccattattagtacttagtactgagcaaattaggaaaaatgcaggcgtaagaatcacatgggtcggcttaggtgtaaacgttggtattgctataggtaaattttttggaggtatcgtatttcattcacaagcgttgtttgcggatgctatccacgcaataagtgacatggtttctgacttgttgactttgctttcggtagggctagcagccaacaagccaaccgctgattatccatatgggtatggcaaaattgaaactgttggttccttggcagtttcaacaatattagccatggctggtatatcaataggttggagttccctttgtgcactcgtagggcctgttatcccacatacaatcattgacaccataggaaacttaggtcatgctcatacttattctgaagacattattgaagacgttactgatatcaacgcagcctggattgccgccgcttccattgcagctaaagaatggatatttagagccacaagaaagattgctatcaacactaattcaaatgtactaatggcaaatgcttggcatcaccgtgttgattcattaacttctcttgttgctctggttgcaatcagtactggttatttggttaatatacaatcattagacacgattggtggtttaattgtttctggtttaattatcaaggctggtggcgagggtatgtgcatcgcaataaaggagttaatcgatcagtcagtttctcgtgatgatccacgctacctagagatagaaactttggttaaagatacgttgaacaaactgatctctaataataattctcagaaaccctatggattgaaagaactgacgttactgtcctcaggaccgaatttacgcggacatttaaccttggaagttcctttacaaaaatggggcaatattttaggtgttaacgagtttgaaattgtgacacatcatttacgtaatgtgttaaccaatgaagtatcgaatttgagaagactggatattgaatacgtggaagaaaaaaatggtgaggaaaatgagcatatcaagggacaacaaaactacaaagaagatgttcttattaagcacgaccatacgaatactcatatttga

SEQ ID NO: 3611 - DNA, 1536 bp, Saccharomyces cerevisiae
atgcctgctcctcacggtggtattctacaagacttgattgctagagatgcgttaaagaagaatgaattgttatctgaagcgcaatcttcggacattttagtatggaacttgactcctagacaactatgtgatattgaattgattctaaatggtgggttttctcctctgactgggtttttgaacgaaaacgattactcctctgttgttacagattcgagattagcagacggcacattgtggaccatccctattacattagatgttgatgaagcatttgctaaccaaattaaaccagacacaagaattgcccttttccaagatgatgaaattcctattgctatacttactgtccaggatgtttacaagccaaacaaaactatcgaagccgaaaaagtcttcagaggtgacccagaacatccagccattagctatttatttaacgttgccggtgattattacgtcggcggttctttagaagcgattcaattacctcaacattatgactatccaggtttgcgtaagacacctgcccaactaagacttgaattccaatcaagacaatgggaccgtgtcgtagctttccaaactcgtaatccaatgcatagagcccacagggagttgactgtgagagccgccagagaagctaatgctaaggtgctgatccatccagttgttggactaaccaaaccaggtgatatagaccatcacactcgtgttcgtgtctaccaggaaattattaagcgttatcctaatggtattgctttcttatccctgttgccattagcaatgagaatgagtggtgatagagaagccgtatggcatgctattattagaaagaattatggtgcctcccacttcattgttggtagagaccatgcgggcccaggtaagaactccaagggtgttgatttctacggtccatacgatgctcaagaattggtcgaatcctacaagcatgaactggacattgaagttgttccattcagaatggtcacttatttgccagacgaagaccgttatgctccaattgatcaaattgacaccacaaagacgagaaccttgaacatttcaggtacagagttgagacgccgtttaagagttggtggtgagattcctgaatggttctcatatcctgaagtggttaaaatcctaagagaatccaacccaccaagaccaaaacaaggtttttcaattgttttaggtaattcattaaccgtttctcgtgagcaattatccattgctttgttgtcaacattcttgcaattcggtggtggcaggtattacaagatctttgaacacaataataagacagagttactatctttgattcaagatttcattggttctggtagtggactaattattccaaatcaatgggaagatgacaaggactctgttgttggcaagcaaaacgtttacttattagatacctcaagctcagccgatattcagctagagtcagcggatgaacctatttcacatattgtacaaaaagttgtcctattcttggaagacaatggcttttttgtattttaa

SEQ ID NO: 3612 - DNA, 1536 bp, Saccharomyces cerevisiae
atggacaattacgaaggcagtgatccttggaataccagttctaatgcatggactaaggatgatgatcacgtcgtttctaccaccaatagtgaacccagcctcaacggaatctctggtgagtttaacaccttgaacttttcaacacctctggacacaaatgaggaggatactggttttttaccgaccaacgatgtgcttgaagaaagtatctgggatgatagtagaaatcctcttggtgcaactggcatgagccaaactcccaatatagcggccaatgagacagttatagataagaatgatgctagagatcagaatatagaagaatctgaagccgacttacttgattggactaacaacgttagaaaaacatacagacctctagatgccgacatcatcatcattgaagagatacctgaaagagagggtttacttttcaagcacgcaaactatttagtgaaacatctcattgctcttccaagtacctcgccttctgaagaacgtactgtcgtaagaagatactctgatttcttatggttaagagaaattctgctgaaaagatacccttttagaatgatccctgagctacctcccaaaagaattggatcccaaaacgcagaccagctttttttgaagaaaagaagaatagggttatctagattcattaatttggtaatgaaacaccctaaattaagtaatgatgatttagtgttaacatttttaaccgtacgcactgacttaacaagttggagaaagcaagcaacctatgacacttcaaacgaattcgctgataaaaagatatcacaagaatttatgaaaatgtggaaaaaagagtttgcagaacaatggaaccaggctgcatcttgtatcgatacctcgatggaattatggtatagaatcacgcttctcttggaaaggcatgaaaaaagaattatgcaaatggtacacgaaagaaatttttttgagacactagtggataactttagcgaagtgactccaaaactatatccggtacaacaaaatgataccatattggacattaataacaatttgagtataattaaaaaacacctagaaactacgagtagtatctgcaaacaagaaacagaagaaatatcgggaacgttatcgccaaaattcaaaattttcacggacatcttactttctttgagaagtttatttgagagatacaaaattatggctgcaaataacgtagttgaattgcaaagacatgtcgaattgaacaaagagaaattggaatcgatgaaaggaaaaccagatgtcagtggagcagagtacgacaggataaaaaaaatcatacagaaggatagaagaagcataatagagcaatcaaacagagcttggttgataagacaatgtattttggaagagtttacaatctttcaggaaacccaatttttaataacacgtgccttccaggattgggcaaaattgaactccaaccatgccggtctcaaactgaatgagtgggaaaagctcgtcacaagcatcatggatatgccgatttctcgtgaataa

SEQ ID NO: 3613 - DNA, 1536 bp, Saccharomyces cerevisiae
atggcttacgttttaactgaaacttcagctggttatgctcttttaaaagcttccgataagaaaatctacaaatcttcaagcttaattcaagacttggatagctctgacaaagtcttgaaggaattcaagatcgccgccttttccaagttcaactctgcagctaacgctttagaggaagccaactccattattgaaggtaaagtttcttcccaattagaaaaacttctggaagaaattaaaaaggacaagaagtcgaccttgattgttagtgaaactaaactggcaaacgctattaataagttgggattgaacttcaatgttgtttccgatgctgtaaccttagatatctatagagctatcaaagaatatttgccagaattgctgccaggtatgtctgataatgatctaagcaagatgtctttgggtttagctcattccatcggtcgtcacaaattaaaattttctgctgacaaagttgatgttatgattattcaagcaattgctttattggatgatttagataaagaattaaacacatatgccatgagatgtaaagaatggtacgggtggcactttcctgagttagctaagattgttactgattccgtcgcttatgcgagaattattctaacaatgggtatcagatccaaggcttctgaaacagatttgagtgaaatcttaccagaagagattgaagaacgtgtcaaaaccgctgctgaagtgtctatgggtactgaaatcactcaaaccgatctagacaacattaatgctttagctgaacaaatagtcgaatttgccgcttacagagaacagttgtccaattacttgtctgcaagaatgaaggctattgctccaaacttgactcagttggttggtgaattagttggtgctagacttatcgctcattcaggttccttaatttccttggccaaatcaccagcttctaccatccaaatattaggtgccgaaaaggctttattcagagctttaaagaccaagcatgatacaccaaagtatggtttgctatatcatgcctctcttgttggtcaagctactggtaagaacaaaggtaagattgcaagagttctggctgctaaggccgctgtctcattgcgttatgatgctttagctgaagatagagacgattcaggtgacattggtctagaatcaagagccaaagtagaaaatagattatcccaattagaaggtagagatttaagaactactccaaaggttgttcgtgaggctaagaaggtggaaatgactgaagctagggcctacaatgcagatgctgataccgcaaaggctgcttctgattctgaatccgattctgatgatgaagaggaagaaaagaaagaaaagaaagaaaagaagagaaagagagacgatgatgaagattccaaggattctaaaaaagctaagaaggaaaagaaggacaagaaggaaaagaaggaaaagaaggaaaagaaggagaagaaagagaagaaagagaagaaggaaaagaagtccaagaaagagaagaaagagaagaaataa

SEQ ID NO: 3614 - DNA, 1536 bp, Saccharomyces cerevisiae
atggctttccaacaaggtgtattgtcaaggtgttccggtgtctttagacaccatgtgggacattctcgccatatcaataatattctttatagacatgccatcgcgtttgcatccatcgctccacgaataccaaaatctagcttccatacttctgcaatcagaaacaacgaagcattcaaggacccgtacgatactttaggcttgaagaaatctgctacaggtgcggaaatcaaaaaagcatactacaaactggcaaagaagtaccacccggatatcaacaaggaaccggatgctgagaagaaattccacgatttacagaacgcttatgaaattctgtcagacgaaacgaagaggcagcagtacgatcaatttgggcccgctgccttcggcggcggcggtgccgctggaggtgccggtggtggtagtggctctccctttggttcccaatttcatgatttctcaggattcaccagtgcaggcggctcgccatttggcggtatcaattttgaagacctgtttggtgctgcatttggtggtggtggccgcggtagcggtggcgcaagcaggtcgtcatctatgttcagacaatataggggcgacccaatcgagattgtccataaagtgtctttcaaggacgcagtgtttgggtccaagaacgttcagttaagattctctgcgctggacccttgtagtacctgttcagggacgggaatgaaaccaaacacgcataaggtcagttgtagcacttgtcacggaacaggaaccactgttcacattaggggcggatttcagatgatgtcgacttgtcctacttgcaacggtgaaggtaccatgaaacggcctcaggacaattgtaccaagtgccatggtgagggtgttcaggtcaacagggcaaagacaattacggtggacttgccacatggattacaggacggcgacgtggtcaggatccctggccaaggctcataccctgacatcgctgtagaggcggacttgaaagattcagtcaagttatcaagaggtgatattttggtgagaattcgtgtcgacaaggatcccaacttttcgataaagaacaagtacgatatttggtacgacaaggagattcctataaccacagctgcacttggtggtactgtcactatccccactgtggagggacaaaagatcaggataaaggtcgctccagggactcaatacaatcaagtgatatccattcctaacatgggtgttcctaaaacatcaaccattcgcggtgatatgaaagtccagtacaagatcgttgttaagaaaccgcaatcgctggcagaaaaatgcttgtgggaggcactggcagatgtcaccaacgatgacatggccaagaaaaccatgcaaccgggcacagccgcgggtacagccattaatgaagagatactgaagaaacaaaaacaagaagaggaaaaacacgcaaaaaaggatgacgacaacactttgaagagactagaaaatttcattaccaacacattcaggaagatcaaaggtgacaaaaaaaattaa

SEQ ID NO: 3615 - DNA, 1536 bp, Saccharomyces cerevisiae
atggtaggacactcagctcagcacagatcaaaaagcagcttagtgtctcacctactaatactacttatctttataacgattattattgaaatgtgtttatataataaaatttttaagaaccaaaggtcggatgatattagagacaactttaacaatggcggacatcgagttcccagtaatgtccaaaatcatggaacccatataagagacgaagcctttatatcaggggtctattattccaattggtccccatacaaaccgaggtttcatttccctcacgacataaacttgaagcaagtgtctcacatttactatgcatttttcaaaataaactctagaactggtggtatagaaaacacggatagttggtctgatctagaaatgaatttgtataaatcgctggcaattaaaaattcagaactaattaaagaaagctcgaacaatagtgtccaaaacatcctacccttaggttgcattggtgaactattttatttgaagaatacctgttctgataagaaatttaaagttatcatgtcaattgggggctggtctgatagtgaaaatttcaaaatcataattaaagatgataaactcttacaaaattttgttgattcgtcggtggaaacaatgttcagattaggatttgatggcattgatctagactgggagttccctggtaacaatgaatcagaacctcgcggatatctgaaactggtcagaatgctgcgattaaaactaaacagcctcgaatcccaaatatttgggaaacgtactgaagatcattttcaattatctattgcggcacctgcattcaaggataaattattttacttgccaatcacagaaattgatcaatatgttgactactggaatatgatgacgtacgattattatggctcgtggtcagaaacaacaggatatcacagcaatctattcagtgagacggaattgaatggaaactttgccatgcattatatgatcgatagatttggcgtcaattctagaaaattagtactgggaatggccgcctacggaagaagtttccatatcaaagataacaaattcgaaccattcaatcaaaatactgtattaattaacaaaattttcaaaggagtgggcaagcccactaaagaaatagataaagctgatggcaaggagggcatctggccttacaaaaatttaccaaagattggtacaatagaacaatacgatccaaaatatgtttcagcatattgctttgatgaaaaaaattcaatatttatcagttatgataacactaaatcagtcaaaactaaggctgaatatgtgacacataacaatttaggcggaggcttttggtgggagtcatgtggtgaagcttatgcaaatgagtcaaggtcgttgataaacgcatttaatgaaggcttgcactttaatgtgtcatcaaaaccatcaatatttcaagatgtgagagttaaaaaatattacttgaataaatatggcgatggcggatttttatctccatatttaaagcatttggattcaagaaagcaatga

SEQ ID NO: 3616 - DNA, 1536 bp, Saccharomyces cerevisiae
atggttttgccaagactatatactgctacatcccgtgctgcttttaaagcagccaaacaatccgctccgcttctatccacttcgtggaaaagatgtatggcctcagctgctcaatctactccaatcaccggtaaagttaccgctgtcattggtgccattgttgacgttcattttgaacaatcagagttgcccgctattttgaacgctttagaaattaaaacacctcaaggtaagttggttttggaagttgctcaacatttgggtgaaaacactgtcagaaccattgctatggatggtaccgaaggtttggtccgtggtgaaaaggttcttgacactggtggccctatctccgtcccagttgggagagaaactttagggagaatcatcaacgttatcggtgaacctattgatgaaagaggtccaattaagtccaaactaagaaagccaattcacgcagaccctcctagttttgcagaacaatctacttcggctgaaattttggaaacaggtatcaaagtcgtcgatctattagctccttatgccagaggtggtaagattggtcttttcggtggtgcaggtgtcggtaagactgtgttcattcaagaattgattaacaatatcgccaaggcccatggtggtttttccgttttcaccggtgttggtgaaagaacaagagaaggtaatgacttgtaccgtgaaatgaaggaaactggtgtcattaacttggaaggtgaatccaaggtcgccttagtgttcggtcaaatgaacgaacctccaggagccagagccagagtcgctttaactggtttgacgatcgctgaatatttcagagatgaagaaggtcaagatgtcttgttgtttatcgacaatatctttagatttactcaagctggttcagaagtctctgcccttttgggtcgtattccatctgccgtcggttatcaaccaactttggccactgatatgggtctcttacaagaaagaattaccaccacaaagaagggttctgtcacttctgtgcaagccgtttatgttccagccgatgatttaacagatcctgctcctgccactacttttgcccatttggacgctactaccgtcttgtcaagaggtatttcagaattaggtatttaccctgcagtggatccattggattctaaatcaaggttattggatgccgccgttgtcggtcaagaacattatgacgtcgcctccaaggttcaagaaactttacagacctataaatctttacaagatatcattgctattttgggtatggatgaattgtccgaacaagataaactaactgtcgaaagggcaagaaagattcaaagattcttatctcaaccatttgctgtcgccgaagtctttactggtatcccaggtaaattagtgagattaaaggacaccgttgcctcgttcaaagccgttttggaaggtaaatacgataatataccagaacatgctttctatatggttggtggtattgaagatgttgttgctaaagctgaaaagttagccgctgaagccaactag

SEQ ID NO: 3617 - DNA, 1536 bp, Saccharomyces cerevisiae
atgtcgaaaaggtctatcgaggtcaacgaggaacaagatagagtggtctctgctaaaacagaatctcactctgttcctgctattcccgcctctgaagagcaagatgctcccaagaatgacctagaagaacaattgagtgatgaatttgatagtgatggtgaaattattgaaattgatggcgatgatgagattaatgacgaagatgaccttaggaaaaagcaagaagaagctgaaactttagtacaaaaggaccaatccgaaggcaacaaagaaaagatccaggagctttacttaccccatatgtctcgtccattagggccagatgaagtccttgaggctgatcccactgtttatgaaatgctacataatgtcaatatgccatggccatgcttgacattagatgtcattccagatacactaggttctgaacgtagaaactatccacagtctattttgttgaccacggctactcaatcttccaggaaaaaggagaatgaactaatggttctagcactttctaatttagcgaaaacacttttgaaagacgataatgaaggtgaagatgatgaagaggatgatgaagatgatgtggatccagtcattgagaatgaaaatataccattgagagatacaaccaatagattaaaggtttctccttttgccatttctaatcaagaggtgttaaccgctacaatgagcgaaaatggtgatgtttatatatacaatctagctccacaaagcaaagctttttccacaccaggttatcagattccgaagtctgctaagcgtcctattcacactgtaaaaaatcatgggaatgttgaaggctacgggttggattggtcaccattgatcaagactggtgcgttactatcaggtgattgctcaggacaaatatattttacccaaaggcacacatcgagatgggtgactgataaacaaccatttactgtttcaaacaataaatccatagaagatatccagtggtctcgcactgaatccaccgtttttgcaaccgcaggatgtgatggatatataaggatttgggacacaagatcaaaaaaacataaacctgctatctctgttaaagcttctaatactgacgtaaatgtcataagttggagtgataaaattggttacttgctagcaagcggtgacgataacggtacatggggagtatgggatttaagacagtttacgccaagtaatgctgacgccgtccaaccggttgctcaatatgacttccataagggagccattacttccattgcattcaacccattagatgagtctatcgttgcggtaggctcagaagataatactgtgactttgtgggatttgtctgtagaagctgacgatgaggaaattaaacaacaggccgccgaaacaaaagagctacaagaaattccaccacaattattgtttgttcactggcaaaaggaagttaaagatgtcaaatggcataagcaaatcccaggttgtttagtaagtaccggtactgacggtttgaacgtctggaaaacaatcagtgtctaa

SEQ ID NO: 3618 - DNA, 1536 bp, Saccharomyces cerevisiae
atgttacataggataaacccagtacggttttctatgcaatcttgccaaagatacttctcgaagttggtatcgccattggaacagcataaaagtaatacttttactaatagagtcagaatccccattgaggcaggccaaccactgcatgagacaaggccgttccttataaagtcgggcgagttgacaccaggcatttcagccttggaatactatgaaagaagaattaggttggcggaaacattgcctcccaaaagttgtgtgattttagctggtaacgatatccaatttgcatctggagcagtattttatccgttccaacaggaaaatgacctgttttatcttagtggttggaatgaacctaattcggtcatgattttagaaaagccaacggatagtttaagtgatacaattttccacatgctggttccgccaaaggatgcgtttgctgaaaagtgggaaggatttaggtctggggtttatggtgttcaagaaattttcaatgccgatgaatctgcttccattaacgatttgtctaaatatttgcccaaaataattaacaggaatgatttcatctattttgatatgctatcaacttctaatcccagttcgtccaattttaaacacatcaagagcctgttagatggcagtgggaatagcaatcgatcattgaattccattgcgaataagaccatcaaacccatcagtaaaagaattgcagagttccgtaagatcaagtcccctcaagagttgagaattatgaggagagctggccaaatatcaggaagatcgttcaatcaagcctttgctaaaagatttaggaatgagagaactttagattcctttcttcattacaagtttatatccggtggttgcgataaggacgcatatatccccgtggtcgctactggttcgaattctttgtgtatccattacacaagaaacgatgatgtgatgtttgacgacgaaatggttcttgtagacgctgctggctccttgggtggttattgtgctgatatttcgagaacgtggcccaatagtgggaaattcactgatgcacaaagagatctctacgaagctgtattaaatgttcagcgtgattgcattaagttatgtaaagctagcaataactattccctccacgacatccatgaaaagagtatcacactcatgaaacaggaattgaaaaacttgggcatagataaagtctccggttggaatgttgaaaaattgtatccgcactatattggacacaatttaggtctagatgttcacgatgtgcctaaagtttccaggtacgaaccattaaaggttggacaagttattactattgaaccgggtttatatattcctaacgaggaatcatttccatcttactttagaaacgtcggaataagaattgaagatgacatagccattggtgaagatacttacactaatttaactgttgaagcagtgaaagaaattgacgatttagaaaatgtcatgcaaaatggcttatctacaaaattcgaggaggaccaagtggcaccactgtaa

SEQ ID NO: 3619 - DNA, 1539 bp, Saccharomyces cerevisiae
atgaagtcaaaagggagtcggttgtcaacagactgtcctgtcgaatttcccaagatagtctctggattcgctgaggaagtgaaaatacgtagacaaagttcccaaggacagtacgccgtcgattcacatcctccgaaaagccctgaactgaaacacagaagacagaggtcatcctcttttgttaacggtaaatgcaggaacagggaccttccattgttagataacaagaaagcacaagaaataaacaccaattcacacggccaagacatcggtatcaaaaacttaccacgtcaacgtgagttgttgaatgccaaaaatggaattgattttacgctgatggtggcgggtcaaagtggattgggtaaaaccacgtttatcaattccttattttctacttctttaattgatgatgacatcaaagaaaacaaacctattattcgttataaaagcattgtagaaggagatggaacacaccttaatttcaacgtcatcgatacacctggttttggtaacaatatggataatgcatttacgtggaggacaatggttaactatattgatgaagaaataagatcgtacattttccaagaagaacaacctgataggacaaaaatggttgataatagagtccattgttgtttgtactttctgagaccttcaaataagggaattgatactttagacgtcgtaacaatgaaaaaattagcgaagagagtgaatttaatcccggttattgctaaatcagatttgctaacgaaagaggaattgaaaaacttcaaaacacaagttagagaaataataagagtacaagatatccctgtatgtttctttttcggcgatgaagttttgaatgcaacacaagatatttttcaaaaatatccattcagtataattgcatctaatgagtacatttttaatgaaaagggcgaaaaagttaaaggaagacaatacaaatggggcgctgttgacattgaaaatgaaaagtactgtgacttcaaaatcttgcaaaagacgatttttgattggaatttaattgatcttgtagaaagtaccgaggattattatgaaaaatgcagatctgaaatgctaagaactaggctattaaaggccagagattgcttaacaacgaaaagtgttgacataacggaagaacaaaggaaatttttggaggaagaaatgaacttcgatgaaatcgaggaaaacaaactcaaaaattacaagtgctatgaaataattaataaaacggtcatggataaggtggctacagaatgggatcctgaatttataactagacaattagaagctaagaaaaaattcaacgagctgtccaacagagaaatttcaaaatttcgagactggaaaaagagcctattcatggaacaagagaattttaaccaagagattgaacaattgaatcacaagttggaaaacttacaactggaatgtcaggacttggaatacaagctgttaatcggaaaaagttccaacagccattccacagatagtgctactttagtaaacgttcacatcaaaaggtag

SEQ ID NO: 3620 - DNA, 1539 bp, Saccharomyces cerevisiae
atgatgaaggaatcgaaatctatcactcaacatgaggttgagagagaatctgtttcttccaagcgtgccattaaaaagagattacttctgtttaaaatagacttgtttgtgctatcatttgtttgcttgcaatactggattaattatgtcgaccgtgtcggtttcaccaatgcatatatatccggtatgaaggaagatcttaagatggtcggaaacgatttgaccgtgtctaacacagttttcatgattggttacattgtaggtatggtccccaataatttaatgttattgtgtgttccgcccaggatatggctaagtttttgtacgtttgcttggggtttattgaccttgggaatgtacaaagttacatcgttcaaacatatttgcgcaattagattctttcaagccttatttgagagttgcacattttcaggaacacattttgttttgggttcgtggtataaagaagacgaattgcccattagaagtgctatttttacaggtagcggtttggtgggatctatgttcagtggatttatgcaaacaagtatctttactcatttgaatgggcggaatggcttggcgggttggagatggttattcattattgatttttgtatcacattacccattgcaatttatgggtttattttcttccccggccttcctgatcaaacaagtgctgttagcaaattttctatgacgagatacatttttaatgaacaagagctacattatgctaggagaaggctccccgctagggacgaaagcacccggttagactggtcgactattcctagagtcttaaaaaggtggcactggtggatgttctctcttgtttgggttctgggaggtgagaacttgggtttcgcatctaattctacatttgcattatggttacaaaaccaaaaatatacgttggcgcaaagaaataattatccttcggggatatttgccgtaggtatagtttctacgctttgttctgctgtatatatgagtaagatcccaagagctaggcattggcatgtttctgttttcatatcattggtaatggttattgttgcggtactaatacgtgcagacccactaaatccaaaagtcgtcttttctgcacagtatcttggaggcgtagcatacgctggacaagcggtttttttttcgtgggcaaacattatttgtcatgcagatcttcaagaacgtgctatcgttcttgcttccatgaatatgttttcaggggccgttaacgcatggtggtctatattattctttgcttcagatatggtgcccaagtttgagagaggttgctacgccctcttggctacggcaatatcaagcggaattgtctcggtcgtcatacgctcactacagataaaagagaatttgtctaagaaacaggttccttatatagatgctaatgacatgcccggagaagatgacgatgacgacaaccaggataatgaaaatgatggcgacgacgagagtatggaagttgaacttcataatgaggaaatggccgaaatttcaaatcctttccgatag

SEQ ID NO: 3621 - DNA, 1539 bp, Saccharomyces cerevisiae
atggtagcaacaataatgcagacgacaacaactgtgctgacgacagtcgccgcaatgtctactaccttagcatcaaattacatatcttcgcaagctagttcctcgacgagtgtaacaacagtaacgacaatagcgacatcaatacgctctacaccgtctaatctactcttttctaatgtggcggctcagccaaaatcatcttcagcaagcacaattgggctttcaatcggacttcccatcggaatattctgtttcggattacttatccttttgtgttatttctaccttaaaaggaattcggtgtccatttcaaatccacccatgtcagctacgattccaagggaagaggaatattgtcgccgcactaattggttctcacggttattttggcagagtaagtgtgaggatcagaattcatattctaatcgtgatattgagaagtataacgacacccagtggacctcgggtgataacatgtcttcaaaaatacagtacaaaatttccaaacccataataccgcagcatatactgacacctaagaaaacggtgaagaacccatatgcttggtctggtaaaaacatttcgttagaccccaaagtgaacgaaatggaggaagagaaagttgtggatgcattcctgtatactaaaccaccgaatattgtccatattgaatccagcatgccctcgtataatgatttaccttctcaaaaaacggtgtcctcaaagaaaactgcgttaaaaacgagtgagaaatggagttacgaatctccactatctcgatggttcttgaggggttctacatactttaaggattatggcttatcaaagacctctttaaagaccccaactggggctccacaactgaagcaaatgaaaatgctctcccggataagtaagggttacttcaatgagtcagatataatgcctgacgaacgatcgcccatcttggagtataataacacgcctctggatgcaaatgacagtgtgaataacttgggtaataccacgccagattcacaaatcacatcttatcgcaacaataacatcgatctaatcacggcaagaccccattcagtgatatacggtactactgcacaacaaactttggaaaccaacttcaatgatcatcatgactgcaataaaagcactgagaaacacgagttgataatacccaccccatcaaaaccactaaagaaaaggaaaaaaagaagacaaagtaaaatgtatcagcatttacaacatttgtcacgttctaaaccattgccgcttactccaaactccaaatataatggggaggctagcgtccaattagggaagacatatacagttattcaggattacgagcctagattgacagacgaaataagaatctcgctgggtgaaaaagttaaaattctggccactcataccgatggatggtgtctggtagaaaagtgtaatacacaaaagggttctattcacgtcagtgttgacgataaaagatacctcaatgaagatagaggcattgtgcctggtgactgtctccaagaatacgactga

SEQ ID NO: 3622 - DNA, 1539 bp, Saccharomyces cerevisiae
atgtcagtaaacccagaatttatagccgatggcatcgatttttatccaacaacgcccgatgccgcgtatttcaatgccgctgatggtaaaaataaagttaacaggataaatggtaactcagaaaatttacaccactcctttgcatcgggttgccgtagatcatctctttcagtcgactttaatgttacctcgtccgattcagaaaaaagtgaacagagctgcttggaaaacaactctcaagaagacgaatatttttgtgacattttttccactgaattaaaattagatgaaacttctaacaagtcaaccgattattccagttcaaatcaccagtatcctgaacaactggagttgcacaattataaactgctcaataaaattggtgaaggggcattttccagagtatttaaagcagtaggcatcaacacggatgaccaagctcctgttgccatcaaagcaatcataaagaaaggcatttcgagcgatgccatcttaaaagggaatgatagaatccaaggttccagcagaaagaaagtcttaaacgaagttgccatccacaaactggtttcgaaaaataatccgcattgtacaaaatttatcgcattccaggaatcggcgaactactattacttagtgacggagttagtcacaggtggggaaatatttgataggatcgtccaactaacatgctttagtgaagacttagctcgtcatgtcattactcaggtagcaattgcaattaaacatatgcactacatgggtattgtgcatcgtgatgtcaaaccagaaaacctactatttgaacctatcccattttatggccttgatggggacatgcaaaaagaagacgagtttacattaggtgtcggcggaggcggtattggtttagtgaagctaatggacttcggactagccaagaaacttcggaacaataccgcaaaaactccctgcggaacgatagaatacgtcgcatcagaagtattcacctccaaacgatattccatgaaagttgatatgtggagtattggctgcgtactattcacgttattgtgtggatatcctccgttttacgaaaagaacgaaaaaacattattgaagaaaatatcgagaggagattacgaattcttggcgccatggtgggacaacataagttctggcgctaagaacgcagttacccatcttttggaggttgacccaaacaagagatacgatatcgatgacttcctaaatgatccttggttaaattcgtacgattgtttgaaggattcaaactcaaattcttatgccagcgtgcaaagcatactaaatgattcattcgatgagagagcagagaccctacattgtgcattaagctgccaatctgaaaaacaagatgacaccgagttttccagaagtgaaagctcggaatacatatttatgacggaagaagacagaaacctacggggcagttggatcggtgagccaaaagagtgttttaccttagaccttgcaacatcttctatataccgaagaaggaagaacaagatattcttctggtaa

SEQ ID NO: 3623 - DNA, 1539 bp, Saccharomyces cerevisiae
atgtccatgactatttgctcaaatactcctggtgcataccctgaaattggagcttataatgaggttgataaacagttggaatcaagcggattctcctctgattcctctctgatattgaataaaccagaagttcgtcaatactggtcatccgtttcatctcatatttcacgctcaggtgatgtgtttacaaatgataaagaaaaaatttcatcctctattggtgaggatgcgatggatatcgacgcttcgccctcattgattgaaaaatataactcttttcccacaagaaagattcttcctgagcaggacgagtttgagaacgacgttgaggacgatgcttcttcctcactgaaggaaaaatcacaaggttcttgtgaaattgaaattgcttctgaaatttcatccgaaattttaaatggcacatcggcagacggtaattccgagtttcacgacttcgctgagccccctccctctcagaatgaatctgtcgctctgtcttttagtcaatcgaatgatttggactttttgaataatccaagcggatcaggctcttcaaacgatatcaatagaagtacaagttccatttcacttcctagacatgtgtcactagattttaacgtttacaatagtctttgcctcacaaatgaggtgactgcatcagaatcacataatgtggccaaatttcaccttggcaagaaaaacaagaagagcttgctaccaagatggaaaaccattgaaatgtacggggaggtagttaagaaaactcaagacatatattctaattttcagtatgcacaatacattttaagggtagggttggataccgaaaaactacacgaacttgttaaggaactggaggatgaaagcaatagcttctctgtagattctttaaaggaatatttagtgaacgatgccaaagttattttgaagaaactaagtgccgttggataccctgatgcacagtaccttctaggtgacgcctactcctctggagttttcggtaaaataaagaatagaagagcatttcttttattctccgctgcagccaaaagaatgcacatcgaaagtgtttacagaactgccatttgctatgagtgcggcttgggtgtaaccagaaatgcaccgaaggcggttaactttttgacttttgctgcaactaagaaccatcctgcagcaatgtacaaattaggagtatattcgtatcatggtttgatgggtcttccagatgatattctaaccaaaatggatggttatagatggttgcgaagggctacatctatggctagcagctttgtttgtggtgctccttttgaattagccaatatttatatgacgggatataaagatcttatcatttcggatccagattatgctatggcattgtatgagaaggcggcggctttagggcatactgaatcggcaagaatactagaagacgctcgcagaagtggagggtttgtttcgcgaggacatcctccttcggcacagaaatatcataaaacctcccatgaagctgtggcagccaaaaagttgatttaa

SEQ ID NO: 3624 - DNA, 1542 bp, Saccharomyces cerevisiae
atgaagcaattcaagttggttaatgcggtttccgcatcatttgtgcttattggcttagtgttggccaattcagattcagtgttcgacaagtggacgcaggaagacctggccgattatttacgtgataataagaagagcttggaaaagtacgctacagactccattgaggacttgaaaacggaggcatcgcaggtatgggacaaacacgcgcagcccaaaccatggtggcaggtgtggtctagtgacagcagtagcgtgagcaacagtaaccccggatggtttggttatactggttcttcggatcacccagtttctgactggctctttgacacctggtccacagacagtctacgtaacttcttgaagaaaaacggcgtggatgttgacgacgctaaggcttccaaggactcgctggtgaagactgctaaggagaacttcaacaagatttccaaatctttgaagtcgtcgggatactatccttctagctcttactttgatagctggtcaaccaaagatttgcaaaactggttgaatgacaatggtatcgactacgacaaggcagttcaaagcaaggacgagctagttcagaaagtcaaggaaaacatctaccgaacttcagaaaaggcagaacagcagcgtctgggtttgctagaaagcttggatttggctcaccaacaaatattagacacatcgggacaaataaaagacactgtatttgacaagtggtctagtgatcagttaaccaattggttggagagccacaaggtcaatattgacaagaacatggccaagaaacacgactatttggttagaatggccaaagaaaattctgccaatttgaaagatgatatctactggtacctggactatatgaaaagagagtcttctccatttttgaccaagaccccagaatacgttggttccgtttgggactcttctaaaaatttcctcacaaatttgtactccaagttcagaggtaagactgacaatgtgatcaatgatacttttttggttggcctagactcttggccaaaggacaaattgaaaatgtttttagatgctcgtggtattaagtactcaatgctgtctactgaacatcaattgagagaattagtcaaaaaatccagaaacgaaaaactcaagatcctgccaaaagactaccaaaaatactttgacaacagtaactggtctttggatgacataaagggttggtttgctgacaaaaaggacgacttccaagattctcagacttactccacaattatgcaggattttgacaaggtttccaaaaacacaaatgatgctaaggaccaaatcgctaagacctggtcaaatacctttcagagctggtctcaagaagacctattgcagtacctaaaatcattcggtgttccggttaaacagacttctacgaaggacgacttaatcaacttggccaagcagaatacgcaatggttgttcggcactgttaaggagcctgcttacaagaggtacctacataacgttaaaaactggtcgaaaagcatattagggttcaactaa

SEQ ID NO: 3625 - DNA, 1542 bp, Saccharomyces cerevisiae
atgactgctggttctgccccccctgttgattacacttccttaaagaagaacttccaaccgtttctctccagaagagtagaaaatagatctctgaaaagcttttgggatgcttctgatatctcagatgacgtcattgagctagctggtggaatgccaaacgagagattttttcctatcgaatctatggatttgaaaatatcaaaagttccttttaatgataacccaaaatggcataattcgtttaccacggcgcatttggacttgggatcccccagtgagctacccattgcacgttctttccaatatgcagaaaccaagggtttaccccctctcttacattttgttaaagattttgtgtccagaattaatcgcccagccttttccgatgagacggagtctaactgggatgtcatcctttctggcgggtccaacgattcaatgtttaaggtttttgaaacaatttgcgacgaatcgaccactgtgatgattgaagagtttactttcaccccggctatgtccaatgtggaggctacaggagcaaaagtcatccccatcaagatgaacctgaccttcgacagagagtcccagggtattgatgtcgaatatctaacgcagttgctcgataattggtcaactggaccatacaaagacttaaacaagccaagggtcctatataccattgcaacgggccaaaatcctaccgggatgtctgtcccccagtggaaaagagagaaaatttaccagttggcccaaagacacgatttcctcattgttgaagatgatccctacggttatctgtactttccttcctataatccgcaagagccattagaaaacccttaccattctagcgacctgactactgaacggtatttgaatgattttttaatgaaatcattcttgactttggatacagatgcccgtgtcatccgtttggagactttttctaaaatttttgctcctggattaaggttatccttcatcgttgctaataaattccttttgcaaaaaatcttggatttggccgacattactacaagggcccccagtggtacctcacaagctattgtttattctacaataaaggcaatggctgagtccaacttatcgtcctctctttctatgaaagaagcaatgtttgagggttggataagatggataatgcagattgcttctaaatacaatcataggaaaaatcttactttgaaagccttatacgaaacagaatcttaccaagctggtcagtttaccgttatggaaccctccgcgggtatgttcatcattattaaaatcaattgggggaatttcgatagacctgacgatttgccgcaacagatggatattttagataagttcttgctgaagaatggtgttaaagtagtgcttggttataaaatggctgtttgcccaaattattcaaagcagaattcagattttctaagactcaccatcgcctatgcaagggatgatgatcagttgattgaagcttccaaaagaatcggtagtggcataaaagaattttttgacaactataaaagttga

SEQ ID NO: 3626 - DNA, 1542 bp, Saccharomyces cerevisiae
atgagtgactattccctgaagcattcggtcactcagtatttggaagaaattcctcaacaagttcaaaataggctttatacctcaccagctacatgtctggctatctatagaattttaccaccactagctaaattttttatcatggcaatggttttcaacgaaaatgaagtacctttgttggatttagataaatgggttaactctaatggtaaattgcagtttcagaatgcaatcaaatcgatgaagtctttgcatcttcttataccaaataaatcatctggtactttgatgatcaacctaaacccaacattcaaaatcagcctgaggaacgcattaacgggtggggaagttcaaaactcattcggtgtggttgtagaggaaaacgtagttagcctggacttgttggatgaatattcagctaataaatgggaaacaatattacatttcatggttggcactcccctcgctaaaatcccatctgaaaaagtactgaaccttttaaaacacagtaaactaatggaagaggtaaactctactggagagttcaaaatcactaatgaaggcttccaatttcttttacaagaaatcaactcccaattatggacattattattgcaatatttaaaaatgatcgaaacgtccaaaatggatttagtcgatgttttacattttattttcatgttaggcgcattggaagttggcaaagcctataaaatcgatgcattaagcgaaacacaaagaattatgttacaagatatgcgagactatggtttggtattccagaagcattcaaatgatagcattttttatccaacaaaattagctttgatgctgacttccgataccaagacaatcagatctgcctccaatgcgatggatagtgtactgagacagaatagagaagagccgtcagtaaatgaagacggcgccaacgggaaatccacaacagatatcactacatcagatgatttgaacaaagcaggtctaaaaaatcaagatatacccgatggctcattgattgtagaaacaaatttcaaaatctattcatattctaattcacctctgcaaattgctgttttgtctctttttgttcatttaaaggcaagatttgtgaatatggtattgggtcaaataacaagggaatccataagaagagcattgaccaatggtatcactgccgaccaaatcattgcctatctggagacacatgcacatcctcaaatgagaaggttggcagaagagaaactagaaaaaaaattagagctggaccccaactgtaaggagcctttacaagttttgcctcctaccgtcgtagatcaaatcagattatggcaattagagttagatagagtcattacatatgaaggttccttatattctgattttgagactagtcaagaatacaacttactaagtaagtacgctcaagatatcggtgttttgttgtggaaagacgacaaaaagaagaaatttttcatctcaaaggaaggtaattctcaagtacttgatttcgctaaaagaaagttgaaaaagaaacaataa

SEQ ID NO: 3627 - DNA, 1542 bp, Saccharomyces cerevisiae
atgagtttgtccacgaaaagagagcactctggtgatgtaactgactcttcattcaaaagacagcaacgaagtaataagcccagctcagaatacacttgtctgggccatctggtgaacttaatacccggaaaggagcaaaaagtggaaataacaaatagaaacgttactacaatcggtagaagtaggtcgtgcgacgttatattgagtgagcctgacatctcgactttccatgctgagtttcatctactgcaaatggatgtggataatttccaaagaaatttgattaatgttatcgataagagcagaaacggaacttttattaatggtaatcgtttggtgaagaaagactacatccttaagaatggtgacagaattgtctttggcaaaagttgctcctttttgttcaagtacgcatcttcatcttctactgacatcgaaaatgacgatgaaaaggtaagttcagaaagtcgttcatataagaacgacgacgaagttttcaagaaaccgcaaataagtgctacaagtagccaaaatgctacaacgagtgccgcaattagaaaactgaataagacaaggcctgtgtcgttctttgataaatatttattaggtaaagaattaggtgcagggcactacgccctggtgaaagaagccaaaaacaaaaaaactggtcagcaagtagctgtgaaaatattccacgctcagcaaaatgacgaccaaaaaaagaataaacaatttagggaggaaactaacatcctaatgagagtgcaacatccaaacattgtcaacttactagatagttttgtagagccaatcagcaaatctcagattcaaaaatatttggtactggaaaagatcgacgatggcgaactatttgaaagaatcgtcagaaaaacatgtttgagacaggatgaatccaaagctctattcaaacagttacttaccggattgaagtatctgcatgagcaaaacatcattcacagagacatcaagccagaaaatatcttattaaatataacaaggcgcgaaaatccaagtcaagtccaacttggcccatgggatgaagatgaaattgatattcaagttaaaatagcggattttggcctagcaaaatttacaggagaaatgcaattcacaaacacactttgtggtacgccttcttatgtagcgcccgaagtcctcacaaagaaaggatacacatcaaaagtagatctttggagtgctggtgtcatattatatgtctgtttatgtggttttcctccattcagtgatcaattggggccaccttcattgaaggaacagatcttacaagctaagtatgcgttttactctccgtactgggataaaatcgatgactcagtactacatttaatatccaatcttttggtcctaaatcctgatgaaaggtacaatatagatgaagctttgaaccacccttggttcaatgacatacagcaacaaagctcggtctcattagaattgcagcgtttacaaattactgacaataaaatacccaaaacatactcagaattatcttgcctctaa

SEQ ID NO: 3628 - DNA, 1542 bp, Saccharomyces cerevisiae
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 3629 - DNA, 1542 bp, Saccharomyces cerevisiae
atggcagataaattaatggacaaaaattttgaagaactgtgctattcatgccgcactggtgatatggacaatgttgatagattgatttccacgggagtaaatgtgaatagtgttgacaagtttgacaattcgccactttttctggctagcctttgcgggcatgaagcagtcgtgaaacttcttctacagagaggagccgtctgtgatagagacagatatgaaggagctcgatgtatttatggagcattgaccgatactatcagagatacccttttaagttatgatatatccaaggctgtagatgtcaagcaaccctttgctactcatatctcatcgatgtataatgacgaaggcttccttaaaagagatatcacattcagagtttcgaatggaaaactgttcacagcgcataagttcttattatgtgcaaggagcgaaattctagcagaaaaaatggtgaatgagtgggcaaagcatgaaattgtttctcttgaagtgcgcccagatatatttgacatatttttgaaatttctttacttaattccgatcctgcaccaaattgaaccgggacaatatgaagaacttatagagctatctagtaaatttgatattgagttattgcccgaatttttagacaaagcaaggcataccgccgatcctacggaaaagtcgaggttaatgtcagattaccaatataagtttaccgaggttgcaagaagtcaacttttaatatttgtgaacaattgtatctttagatctactgttgatcttgctaatagtgaacgacgagttttttccttgatgaactgtccagcttatccggatgttcaacttatggtaaaaaaccgaaatggagccattcgaatatacccttgtcacctggctgttttgagccgcgcagaatatttcaaggtgatgttcacaaacaacttcaaggagaaagttacatatatcaaagccaagcacgttacaggaaagtataatagtatcattccacagctgacattacccaattgtgagtttgaggttgccgaaattattctccgctacttatatgcagataatacagacattccttggatgtatgccgtcgatgttttgttacttgccgatatacttttagaagaccgcttaaaaactatcgcttctacaattataacacaatcaaaagagtttattcagcaatacaatgtttttgacgtactctatttatcatgggaaataggagtggaacgcttagaacaatttgcagctaaatttatagctatacatttgcaagagttatataaagatccagagattaaaagggcaattatgttgagttcacaacgaatttctctccgccaggaaactgatactattgaactagtggatgacattaggtactatttgctccgaaaatattcttttgaaccggatgatgtggagctgttcgaaaaccaagacgatttagaatacctaaaacaagtagggtatttggagtacagaaaagatatgggtatgttagataatatcctagctgatctggaacttgatgtataa

SEQ ID NO: 3630 - DNA, 1542 bp, Saccharomyces cerevisiae
atggtatcgaggctatcaaagagatatagatccagagtacagtttagtatatccgtgatggatgaaaatatttatctttcgctatctcagataaataaagacatcagaaaggaaaacaagtccgtaaggaatcgacttcagagtattcttttagacaataaatttttgcaagatcgagttatccctatatttccccattatccactgatacccaatgaaagatgtgggctatggtactgtaatccatcaagtttcaaacagaccagttactttaagagcacagacgggcatgtcaaccaatgggactttagcacccgaagattgaactttcatttgttagagaccattcgagataataaaggtattataattgtcgatagtactagaagaggtaaaaaaatcccagatgctttgagtaagactgtccccatatggtgtgctgtattaaatacgttaatgcttcaggaaacagaaaaaaatgttgccatcgataaggtactgtatcttccacctgagacagttcccaaatcagaatatgacatgattaagcgaaaaatacccgaactagttgctaaactacaaaaattgaatattatagattctaagaaattgaacgaactgtttatgggtaagttattgcggcccatatgggttcaccctggttcttcacttctagaccattctgttgattacttcacgggtgaagtacaggagtatgaagcctgggaaacacctgaagaccaaaacataatacccattattttgtgcacggtaagctatcaagcacaagatggtatggataaaagatacggcttcacttatgtgcagggtgcagccgacgatcacgagctctggtcttttggtttggattcaaatatgttttgggcccatatagaatacctaggcgacgcaagttattcagacgaccagttacatgattacatcatggatttggctgctgcaaagctgagaaatcagtgttatatacaagataaaggaagcttggatgaagtctttggaaacattgataaaattacgaatgagatatctctaggaaaagtgagttcaggcttaaccatcaataagaatttgaaacagaaattgaagtcagaatatggtaaagttataattttcagtaattcggtgactgttgctgaagatacagacgatgaagaagaaagtgggacagatccgtttatttcaatatacaagttgcaaagcggagacaagaaaagttcaaaagctttacgatccacattccctagaatccatggagaaattcaatcgttgtttacaaatcgagatgaaaaaataaagccaatgctaatatgctgcaatacaggtactgatatgtcaatcggtgtcatcttaagtatcctttgtaccaaatatactgaagaatggatgcttacgtcggagttaccggacatcagtaagcttattgtaagaaaacacttgacaaaattgatttcccacttgaaaggacgcaacgttaacccttcaagagcaacactgaacagcgtcaatagctttttaatgtag

SEQ ID NO: 3631 - DNA, 1542 bp, Saccharomyces cerevisiae
atgtcaacacccacagcagcagatcgcgcgaaggcacttgaaagaaagaacgaaggaaatgtttttgtgaaggaaaaacattttttaaaggccattgaaaaatatacagaggcgatcgatttagattctacacagtctatctatttttcgaacagagcatttgctcactttaaggtagataactttcaaagcgctttaaatgactgtgatgaagccattaaactggatcccaaaaatatcaaagcttatcatagacgtgcattatcctgcatggctctgctagaatttaaaaaggctaggaaagatttgaatgtgcttctaaaggcgaagcccaatgatccggctgctactaaggcgttacttacatgtgataggttcattagagaagaaagatttaggaaagctatcggaggcgcagaaaatgaagccaagatcagtttgtgtcagactttgaacttgagttcatttgatgctaatgcagatttagccaattatgaaggtccaaagttagaatttgaacagctgtatgacgataagaatgcctttaaaggtgcaaagatcaagaacatgtctcaagagtttatttccaaaatggttaacgatcttttcctaaagggaaaatatttaccaaaaaagtacgttgcagctattatctctcatgctgataccttatttcgtcaagagccatctatggtagaactagaaaataactctactcctgatgttaagatatcagtatgtggtgatacgcatggccaattttatgatgttttgaatttatttcgcaagtttggtaaagtaggtcctaagcacacttatctattcaatggtgattttgtcgaccgtggttcttggtcgtgtgaagttgcactattattctactgtttgaaaatattacatccaaataatttctttttgaacagaggtaatcatgagagtgataatatgaacaaaatctatgggtttgaagatgagtgtaaatacaaatattcacaaaggatatttaacatgtttgcacaaagttttgagagccttccattggctaccttaattaataatgattaccttgtaatgcatggtggtttaccaagtgatccttcagcaactttgtctgatttcaagaatattgatagatttgcccaaccacctagagatggcgcctttatggaacttctatgggcggacccacaagaagccaacgggatgggtccttctcagcgtggtttaggacatgcttttggacccgacattacagatagatttctaagaaacaacaaattgcgcaagatttttagatctcacgagttaagaatgggtggtgtgcaattcgagcagaagggtaaattaatgacagttttcagtgctccaaactattgtgatagccaaggtaatcttgggggtgttattcatgttgtaccaggccatggtattttacaggctggcaggaatgacgaccaaaatctaataattgagacattcgaagctgttgagcacccagatataaaaccaatggcctattctaatggtggttttggtttatag

SEQ ID NO: 3632 - DNA, 1542 bp, Saccharomyces cerevisiae
atgtcagaaaaccaaaaggaggtatcgcctcctcaagccatatcggtcaaatccgaggcaagctctagtatattttccaaacctatctccacatcatcacccgctgggttagcagccgctcaaagagttacgcccgggaaactgtccactttattactagaaatgggaccattggccattagacacattacacagaccttatgcctagatattccctgttttaaagatttatcatcttccaagcaaagacgacttataatgagtgctatggaaagtggtgataaagaaaaatcagtggtatttgaaaaaattggatggggtcaatggtccgcgaaaagagtagaccctgccaactttgataaggagctggaagcgaccaattttgcaaatgcaaaggtgaaagacttgatttctcaagagagtcaaagaaggaaaagcaacaattcaaattctaattcaggcggcaaagttgaaatgcctatgaaagttgagcataatatcacgaatatcgatggagccaccaccccgcctaccgctgttgcttccaccaccattcctgttaatatcaaacgcagcaaatctccacttgcagcagcaaacgtagtatatatagatgaaaatgcgctagcatcggaagatgaggatgaggagtttgatgaagatgaccatcatttacattaccaaaacaaatcgaggaacagcagtaataattttggaaaatcttcaaatggtgatccctatagtttcggcaggagaaggtctcaagttgtgttcgccgattcaactcccgagaatattgagcatgaaataatagcacaaaagattagaccgctattaagaaatagacgccgttcgagcataaaaccacatacacctttcatttccaaactaaacacacaccaagattcatcctacctttcccccaatacaacctcaacgacaaccccatcaaataacaacagtaactcaaaccaggcgaagatagatttagagaaacttactgcgacaagtgagccaacttcaagaagagcttctcgtctgtctgtatcgaaagaatcaagtattagatcgacacttttcccaaacaaaaactatttgatcgtcactacaaaccctaactctaaagctacgtcggtttccacctcccctaagctagaagaacagatgaatgtaagttcaaatccgatagtattatcggacaaggagaaacatagagtagcttcacaacacctgaatggggaatcgtcgccacaacttgttccccattctcatcatcaacctcactcagatacagacgaagaagactgggaatcaattggtgcagcttctctgagaaataacagtttagcacctaacatagacagcgtagcaagttctactaatggcgtagttagccctaaacctacaaatccaagttttactaactctcagaatggagatattgagcctcccctacaacacgaccaacagaaacatgaacagcagccaagaaatggggaagacaatagtgctgcgtttttattaatgagcttaaaatcttaa

SEQ ID NO: 3633 - DNA, 1542 bp, Saccharomyces cerevisiae
atgtcagctataccaataactccaactaagcgtatcagaagaaatctatttgacgatgctccagcaacgcctccacgacctttgaaaagaaaaaagttgcagttcacagatgttacaccagaatcatccccagaaaaactgcagtttggctcacagtctatttttttgaggacaaaggcacttttgcagaagtcatctgagctagtcaacttgaatagcagcgatggtgcattgccagcaagaacagcagagtacgaacaagttatgaattttttggcgaaggcaatttctgaacacaggtccgattcactgtacatcacgggtccgcctggcactggcaagactgcccagcttgatatgattataagacagaagttccagtccctcccattgtcgctctccacgccacgctcgaaggacgtgctgagacatacgaatccgaacttgcagaatttgtcctggtttgaattgcccgatggaaggctagaatccgtggcggtaaccagtattaattgtatatcgttgggagagccgtcctccattttccagaagattttcgattccttccaagatctgaatggcccaacattgcaaataaaaaacatgcagcatctacagaagttcttagagccttatcataagaaaactacgtttgtggttgtgttggacgagatggacaggctattgcatgctaacacgagcgagacacaatcagttagaactattcttgaattattccttttggcgaaattgcctactgtgagttttgtgttaatcggtatggctaatagtctagatatgaaagataggtttctttccaggttaaatttggacagagggttgttaccgcaaactatagtttttcagccatacactgctgagcaaatgtatgaaatcgtcattcaaaaaatgagtagtctgcccactattatcttccaaccgatggccatcaaattcgcagcaaagaagtgtgctggaaatacgggtgaccttcgaaaactttttgatgtcttaaggggaagtatcgaaatctatgagttagaaaagcggtttctgctttcaccaacaagaggatcattgaactctgcgcaagttcctttgacgccaactacttctccggtaaagaaatcgtatccagaaccacaaggtaaaataggcttgaactacatagccaaggtcttctcaaaattcgtgaacaataattctacgagaacgaggatagccaaactaaacatccagcaaaaattaattctttgcaccataattcaatcactgaagctaaattccgatgctacaatcgacgaatcgtttgatcattatatcaaagcgataacaaaaactgatactttagcaccattgcagagaaatgaatttttggaaatctgtacaattttagaaacttgtgggctggtttcaatcaaaaagacaaagtgtaaagggaaaaccaagagatttgttgataagattgatgttgatctcgacatgcgagaattttatgatgagatgaccaaaatttcaattttgaaacctttccttcactag

SEQ ID NO: 3634 - DNA, 1542 bp, Saccharomyces cerevisiae
atgtcgactgctaggcctagaataatcacttcgaaggctccattattgcctcaacagactaccccggagcagcgttactggcgtcaatacacttccgcacaactggttaaagaacataatagcgttactcacatatcattcaatcctcaacatcctcatgattttgcagtaacttcctcaaccagagttcaaatattttcttcaagaactaggcaagtgatcaagaccttttcaagatttaaagatgttgtctattctgcatcctttaggagtgatggtaaattgctttgtgccggtgatgctaccggtttagtgtctgtatacgacagttataatcccaggactatccttttatctataaacgcttccacacatcccacacatgttacgaaattccatacgcaagataacaaaattctggctacggcgagtgacgatagagtgacaagactttgggatatatccaacgcatatgagccacaattagagctcaccggagctactgactatgttcgtaccttatcatttatcccagcagccccacatttggttgcaacaggctcatacgacggtttgatcagattatatgacacaagatctagcggatccacgccaatttattctctgaatcatgaccaacctgttgaaaatgttattgcagtatctccaacccaaattgtttcttgcggtggcaataatttcaaagtgtgggacttgaccagtaacaagaaattatacgaacgtggcaatttcaataaggctgtgacatgcttggactatgttgaaaattttgattctccaatgcaatcggcgttgatcgcttcttccttagatggtcatgtcaaagtctttgatcctttagacaatttccaagtcaaatttggctggaaattttcgggtcccgtactaagttgtgctgtctcccctagtaccgcacaagggaataggcatttagtagcaggtttatcatcaggactactagccattagaactaaaaagaaagagaaacgttcttccgataaagaaaacgcacccgccagttttaataagaatgcgaaaagtaataacttccagagaatgatgcgaggctcggaataccaaggtgatcaagagcatataatccacaatgataaggtaagatctcaacgtcgtatgcgtgcattcgaaaggaacataaatcagtttaaatggagcgaagcactcgacaatgcctttgtaccaggtatggccaaagagttgacacttactgttcttcaagaactacgcaaacgtggcaaagttcgtgtagcgctatatggtagagatgaatctacattagagccgctactgaattggtgcttaaaaggtattgaagatgtgagatcagcatctattgtagcggattgggtcgccgtggttttagaattatatgggaatacgttagaaagctctccagttcttcaagaattgatgatagatttgaaaactaaagttagacatgaaattcataagtctaaagaagctcaaagaattgaaggtatgcttcaacttttaacgagttaa

SEQ ID NO: 3635 - DNA, 1545 bp, Saccharomyces cerevisiae
atgaacgaagttacttgttccataactggtgacaacccaattcataagatcaacaatggattaggcttgaaatggaataatctgggtaaattctctgattttcagactaacgatagcgccgcgcgagatgctagaacaatagattacatctttaccaattgtcaaaccggcagcagtattggtaagatagattttcgggccgcactaccggcagataaatctcaacatagtggtgtcagcgaaaaagaattttcaagacttgagaaccagtggtcaaaggaattctcttgtttccccaagaataaaaatgctgatgtgaccaagcccagtagaaacaaacatgagaaacgctccgctaatttgcacaataggtactttgcacaatattatagtacggcatatcagcaaaatcgtatatatccttgtcgaatatcttacaatgaacactcatctgtttctaatggctgggaatttcagttcaaatcaatcgaaaatcagttactaaatgagctaaagatagaaaacaatgtagaagaaaaaactgttggttatgaatatgtggcagaatacgaagaaacaattgatttcatgcatatgctgtcatccgtaccacaaacatatcaattcctaaaatcaaacatctacataacggaacgggacccatataaaataggatgtgtactaatggacaacggttccaatttgaacgaagtagtaatggcctttgaagcagccatttcacaagatccaagccatataaatgcatggttgaagttaggtatagttaattttgaaaatgaaagcgaaagcaatggagagcttgctttgcgaaattgcttaaatttggatccaaataatacaattgcattggaaaacttagcaattcaccatataaatcaacaaaatgaatcagagtcattgaaactttttcacaaatggattctttcaaaattttcgaaggttttccaaccttctgcgggggaaaacaaagatagcattaataaaattccgaaaaaggcccatttggcgcatattctagaatccctgttgaatatgggtatagaaaaaaaagatcagtatgatatatattcagtattatcaatcttatattattcggatcagaaaataaagcaatctcagaaatgcttagagtttttactactggaaaagcccaataatggaacaatatggaatagatatggtgctattttggccaatactaagtcgtatcactctgcgataaatgcgtacaataaatgcaaacaactaagaccgaattttacaagggttcgttataatttagcgatcgcctacatgaataagggtgactatgtaaaagcaagcaaaatgctaatcgaagttatactgttacgaagtaaaggatatgaacacaacaaagcaaaaatgcaaaacaaatttatgcaaaatttaaaaaatgctctcatcgcttcaaaaaattttgattcacttgatctaataaatggttctcataatacagaatcgttaatatcaaccttaaaagctatttataacaaaatggattag

SEQ ID NO: 3636 - DNA, 1545 bp, Saccharomyces cerevisiae
atgcctaacgcttcccaagtttacagatctaccagatccagctctccaaagacaatctcttttgaagaggctatcattcaaggtctggccactgacggtggtcttttcattccaccaactattccacaagtggaccaagccactcttttcaatgattggtcaaagctctccttccaagacttagcctttgctatcatgagactatacattgcccaagaagagattccagatgctgatctaaaggacttgatcaagagatcttattctactttccgttctgatgaagtcacccccttggtgcaaaacgtcactggtgacaaggagaatttgcacattttagaattattccacggtcctacctacgctttcaaagacgttgctttacaatttgtcggtaatctttttgaatacttcttacaaagaaccaacgccaatttacctgaaggcgagaaaaagcaaatcactgtggtcggtgctacttccggtgacactggttctgcagccatctacggtttaagaggcaaaaaggacgtttccgttttcatcttatatccaaccggtagaatttccccaattcaagaagaacaaatgaccaccgttccagatgaaaacgtccagactttgtctgttaccggtactttcgacaactgtcaagatatcgtcaaagctattttcggtgacaaagaattcaactctaaacacaacgtcggtgctgttaactccatcaactgggcaagaatcttggcccaaatgacctattacttttattcattcttccaagccaccaacggtaaggactccaagaaggtcaagttcgttgtgccaagtgggaacttcggtgatatattggccggttattttgccaagaaaatgggtttgcctattgaaaaactggccatcgctaccaatgaaaacgacattttggacagatttttgaaatctggtctatacgaaagatcagacaaggttgctgctactttatccccagcaatggatatcttaatctcttctaactttgaaagactactatggtacctagctcgtgaatacctagctaatggtgatgatttgaaagccggtgaaatcgtcaacaattggttccaggaattgaagaccaacggtaagttccaagttgacaaatccatcattgaaggcgcatcaaaggactttacatcagaaagagtttccaatgaagaaacatctgaaacaatcaagaagatctacgaatcatctgtaaatccaaaacattacatcttagatcctcacacagctgtcggtgtttgcgccacagaaagattgattgcaaaagataatgacaagtccatccaatacatttctctatctaccgctcacccagctaaatttgccgatgctgtaaacaatgcattgtctggattttccaattattcatttgaaaaggatgttttgcctgaggaattgaagaaactatccacattaaagaagaaattaaaattcatcgaaagagctgacgttgaattggtcaaaaacgctattgaagaagaacttgctaaaatgaaattataa

SEQ ID NO: 3637 - DNA, 1545 bp, Saccharomyces cerevisiae
atggaggaacaacgtgaaatactggaacaattgaagaaaactctgcagatgctaactgtagagccatctaaaaataaccaaatcgccaacgaagaaaaggaaaagaaagaaaatgaaaattcgtggtgcatcctcgagcacaattatgaggatattgcacaggaattcattgatttcatttacaagaaccctaccacttaccatgtagtatcatttttcgcggagctgttagataagcataacttcaaatacttgagcgagaaatccaattggcaggactccattggcgaagatggtgggaaattctacactataagaaatggaactaacctatctgcctttatcctgggcaaaaactggagagccgaaaagggtgtcggtgtcattggatctcatgtggacgctttgacggtcaaattgaagcccgtctcctttaaagacacagcggaaggttacggaagaattgctgttgctccctatggaggtacactgaatgaattgtggctagacagagacctaggtattggtggtcgccttctttacaagaagaagggcactaacgaaattaaaagcgccttggttgattctacacccctacctgtttgtcgaattccttccttggctccccatttcggtaaacctgctgaaggcccatttgataaagaggaccaaactatcccggtcatcggcttccccactccggatgaggaaggtaatgaacctcccacggatgatgaaaagaaatcgcccttatttggcaaacactgcatccacctgttaaggtacgttgccaaattagccggtgtggaagtgtccgaattgattcaaatggatttagacttattcgatgtgcaaaagggtaccattggaggtattggtaaacacttcctttttgcaccacgtctagatgacaggttgtgtagtttcgcagcaatgattgctttgatttgctacgctaaggatgttaataccgaggaatcagatttattctctactgtcactttgtatgataatgaagaaatcggatcgttgacaagacaaggcgcaaaaggtggcttgttggagtcagtggtggaacgcagttcttctgcattcactaagaaaccggtcgatttgcatacggtttgggctaattccatcatcttgtccgcagacgtcaaccacctctacaacccaaactttcctgaagtctatttgaagaatcattttccagtgcctaatgtcggaatcactttatcactggatcctaacggtcatatggccacagatgtcgtaggaactgccctagtagaagaattagcacgccgcaatggagacaaagtgcaatatttccaaatcaaaaacaactcaagatcaggtggtactatcggcccatcattggcttctcaaacaggtgctcgtaccatagacctgggaattgcacagttgtccatgcacagcatcagagctgctacagggtccaaggatgtcggattaggtgttaagttcttcaacggatttttcaagcactggagatcagtctacgatgaattcggcgagttgtga

SEQ ID NO: 3638 - DNA, 1545 bp, Saccharomyces cerevisiae
atggttgcagaatttcaaatagcgagtgcacagtcatcggcattgacatctactgaagaagagcattgttcaataaactcagacaaagccgcaaaactggatctggaattgaccagtgaacgaaaaaatgacggcaaacaatcgcatgaagtgaccttcaacgaggacatcgcggacccagaagatatagcacggcatatgagcaccgcccgccggtattatatttcctcgttaattacattcacatcgatggtaattacgatgatctcgtccagctggacgcttccttcaacgcacataatcgaacactttcatatttcgcacgaagtcagcactctgggaattacgctttatgtgtttgggctcggtataggacctttatttctgtctccactaagtgaactatatggacgaaggatcacatttttatacgcccttacgctcagtatcatatggcagtgtttgaccatttggtccaagaccattacgggtgtcatgtttggcagatttctatccgggttttttggttcagcctttctaagtgtggctggcggcgccattgccgatatattcgacaaagaccaaattggtattcctatggcaatatacactacatcggcctttttggggccctctttaggaccaatcattggtggagccttataccatcaaagttataaatggacatttatcacacttctcatcacttctggatgttgtctcgttatgatcatctttaccatacctgaaacctacaaaccaatgctgttaatacgtaaagctaagagattgaggaaagagaaaaatgatcaacggtattatgctgtcctggaagtcacccgcgaacagacttccttactttccgcaatctttctctcaaccaaaagaccctttggcctgttacttcgagaccgaatgatgggtgtgctttgcttctatactggattggaacttgccataatatatttatatttcgtagcgtttccttatgtgttcaagaaactttacaactttgggcccatggagattgcatgctcctatatcggtattatggtcggcatgatactctcggctcctacttgcttgttattccaaaaaacgtttgagtggagagtcaaaagaaataatggcgtcaagactcccgaaatgagattcgagcctctgttctacggcgcctttttgaccccagttgggctcttcatttttgcattcacctgctacaagcatgtccattggattgcaccaattataggcagtgcaattttcggttcaggtgtttatttcgtctttaccggtgtttttgcgtatacagtggatgcctatagaagatatgcagcttctggaatggcttgtaacacatttgtgagatgcataatggccggtgtcttccctcttttcggactccagatgtacaagtcaatgggagtgaattgggccggctttctcttggcaatggtgaccgtagcgatgattcctgtcccatttctgtttaccaaatacggtgcccgactgagagccaagtcgccgtatgcatgggatgattga

SEQ ID NO: 3639 - DNA, 1545 bp, Saccharomyces cerevisiae
atgtctactttcataagaggtcccatctgcggtacagacaactgcccctcacggctttggcgtatcattgatgggagaagaacctgccaatatggtcacgttatggaaggtgacgtggaatttaacgacgatgaagatgatctcaacggcctcggtgcaggtgttatcacaagacgtctgaatcttaccaccaatgccactggtagttttcaatctagtcaacttaccaactcgcaactgctgcaacaacagcaaaggcaatctcataaaaaatttaaaaaacttatcggtcatgaggccaaattactatttctcaaatccttccagttcatcttgaaaaggcaaatccgctggctcataactgaaatgcggtttccgaaagagttcgaacatgtcgccaagataatttggctcaagatattaaagacgattaacgaccaaccgcaagaagaactaaaacttcaattacatatgacttcgacaatttcgatcctctaccttgcatccactcatttgtccctaccagtttatacctgtgactacatcaaatggatatgcaccgccaaaatgccgtatttccaggcaagtgaaatactaccgaaatcgtggaggatccagctgccaaattattatgtttccatactagagggctcaatttcaccttttaatgggcaactgtacaacaaaatcgcattgacgtgtggtatgatccacttcaaagaattcttcaactctgaaatttcgtgtcagggcttattactgaaactagtgatgcaatgcgctcttcctccagaattttatttttataccaaacaagttatcgaatttgaagaaacagacattcggaacctgacactgtgggaaagaacggacgaacgtcacacagggcgagtaagtaatcatgccgaactcagggtcctctcttattttatgctcacaataaattggatgctttcttttgatagagaccgacaatacccactaaaatggatcctttccctcacggaatcattgactcagcgcacaaccacaagtgaatctatcggcagaaatatcgttaaagtggtttacccagacaaaccgacttctagtgattatttccagtggtctgaggaggagaccctagagtttttgaagtggatggaaaagcaatttttgcccacacaaacaaaatctttgcataatgagaatggttcgatggagatgacaattgatcaaaaaattgctagaaggaaactgtacaagattttccccttggatcgagaggccaatcatgatggcgaatttaatgactcaacgcatcagttaacttttattgaagatctgcaagaaagatacgctaaacaaacccccttttttgaaagcaacaaaatacgtgattctctcaattatcaagaggctaatccaccggccagaaaggaggctatcggtagacttctaacccatatagcatcacagcttttagtggattttgccatttctaaagagcaactgaaagactgcatttcaaggatcaaaaatgcctgtctgcataggatgaattga

SEQ ID NO: 3640 - DNA, 1548 bp, Saccharomyces cerevisiae
atgaaagcgtacgcaaagaaacgtatctcttacatgccatcgtcaccatcacaaaatgttattaactttgaagaaatcgaaactcaaaaagaaaacattcttcccctgaaggaaggcagatcagcagcggcactctcgaaagcgatacatcaaccactggtggaaataaaccaagttaaatcaagcttcgaacaaagactgatagatgagctccctgcattaagcgacccaattactttgtatcttgaatacataaagtggctgaacaacgcctatccacaaggcggtaattccaaacaatctggaatgctcacccttttggagcgatgtttatctcacttaaaggatttggagagatatcgcaatgatgttaggtttcttaaaatatggttttggtacatagaactttttaccagaaattcattcatggaaagcagagacattttcatgtatatgttaagaaatggaattggttccgagttagcgtcattttatgaagaatttacgaatctattaattcagaaagaaaaatttcaatatgccgtgaaaattctacagctaggaatcaaaaataaggctaggcctaataaggttttagaagaccggttaaaccatctcctgagagaactgggggagaacaatattcagctaggaaatgaaatatcgatggactcattagagtctacagtacttgggaaaaccagatctgaatttgtcaatagactagagcttgcaaatcaaaatggcacatcaagtgacgtcaatttaacaaaaaacaacgtatttgtagatggagaagagtctgatgtagaactattcgaaactccgaatagaggtgtttatagagatggctgggaaaattttgacttaaaggcagaaaggaacaaagaaaacaaccttcgaatatcattgctagaagcaaataccaatttgggtgagcttaaacaacatgagatgttatcgcaaaaaaagagaccatatgatgaaaaactaccgatctttagagattctataggtagaagtgaccctgtttatcaaatgattaatacaaaggaccagaaaccagaaaaaattgactgtaattttaaactgatttattgtgaagatgaggaatctaaaggtggtagactagaattttcgctagaagaagtcttggcaatttctagaaacgtttataaaagggttaggacaaataggaaacatccaagagaagcaaatttagggcaagaagaaagcgcaaatcaaaaagaagctgaagcacaatcgaaaagaccaaaaataagtagaaaagccttagtctccaagtcgttgaccccctcaaaccagggaagaatgttttctggcgaagagtacataaactgccctatgacgccaaagggacgaagcactgagacgtctgatatcatctcagctgtcaagccgcggcagttaaccccaattttagaaatgagagaatcaaattctttttctcaaagcaaaaattctgagatcatttcagatgatgacaagtcgagttcgtctttcatatcgtacccaccacagcgttga

SEQ ID NO: 3641 - DNA, 1548 bp, Saccharomyces cerevisiae
atgacacaagacaaagaagtcaaagtggttgccccagatgttgcgcccgaccaagaagtagaaattaataaatctgtaaaagatgcaaaacatcaaaccaatgatgattcgttacttcaacataaaaagaagggcaagaaaggtaaaaaatcgaagcccatagtgaccccagaacatatcgctaaggttcgtgccgaaagggaagttatgagaaaggctaaaagagatgcaatgttggctcaaggtgttgatccggactgcccgccagagctgcattttatcagaagacctttcctatctctacatgaggcagagccagtaactggatttagattcaagctaatgacttataattgcttggcgcaagctctaatccgcagaaagctgttcccggatagtggtgacgctttaaaatggtacaggcgttctaaagttctcttaaacgagtttaaatattataattccgatgtcatttgtttgcaagagattgatcatattcagtttcaaagcttttggaaagatgaattcagtaaattgggatacgatggacaatattatagaaatgctacaaaaaaccatggtgtcgcgataatgtggaggagagaattatttcaccaggttgacaaaatgctaatcgactatgataaagaaagttcagaaagcatttccactagaacaacgacaaacaacgtgggattagtcttagccttgaagttttctgagaaagtactgtcgaatttgggtaaaaaatcgtctaaaaaatgcggtatcttgatcggcactacgcatctattttggcatccatttggtacttatgaacgaacaagacaatgctatattgttttaaaaaagatgaaggaattcatgcatcgtgtgaatgttttacagaacgaaaatgatggggatttatctcattggtttccttttttctgtggtgattttaattcccagccgttcgacacaccatatttatctatgacatccaaaccagtgcactatagaaacagggcaaagaccgtcattgggtgcagcacttcatataagttttccaaggtccgtgatggcgaagaaggtgcagatgacgaagaaggcgggaatattgaaaaatatggtaaagatcaacctgagagccccgttcctgaaaaatttcatgctaatgaagaacagtctgaactcgtagataaaatggcacaactccataactcattggatatgagggctatttcactatactctgttgggtataagaatgttcatccagaaaatgcaggtcttgataatgatagaggtgagcctgaaatttcaaattgggcaaacacttggcgtggtttattagactatctattttatgtaaagaaatgggacccacaaagtaattgtcaggaagtggaaacccttggcgattttgaaaaagaaaataaagttaaatgcagaggttttttgagaatgccgcccggtaatgaaatgacaaagcatggacaaccacatgttggagaatatgcaagtgatcatttgtctatggtgtgtgatttagagttacaactatag

SEQ ID NO: 3642 - DNA, 1548 bp, Saccharomyces cerevisiae
atggatcttgaaaatgtttcatgtcccatttgtctaaggaagtttgataacttacaagcactaaatgcacatttagatgttgagcatgggtttaacgataatgaagattcactcggttccaatgacagtcgtttagtcaatggtaaacaaaaaaaggccagatctgttgatagcagtgcgcaaaagttgaaaagaagccattgggaaaaattcaaaaaagggaagagctgctgtcacacatgtggaaggactttgaataacaatattggcgccattaattgtaggaaatgtggtaaactgtattgcagaaggcatcttcctaatatgattaaacttaatctttccgcacagtatgaccccagaaacgggaaatggtacaattgctgccatgattgtttcgtcacaaaacctggctataacgattatggcgaagtaatagatttaacaccagaattctttaaggtacgaaatataaaaagagaggacaaaaacttaaggctattacaattagaaaatcggtttgtccgtctagttgatggtctgattacactctataacacatattctagatccattattcataatttgaagatgaatagtgaaatgtccaagttagaacgtacagttactccatggagagatgatagaagtgtactcttttgtaacatatgttccgaaccatttgggctattactaaggaagcatcactgcagattatgtggtatggttgtttgtgatgatgcaaacaggaactgctcaaacgaaataagcataggttatttaatgtctgcagcgtcagatctgccattcgaatacaatatacagaaggatgatttacttcatattcctatatccataagattgtgctcgcactgtatcgatatgctatttattggcaggaaatttaacaaggacgttagaatgccgctaagtggaatatttgctaaatatgatagcatgcaaaatatatccaaagtaattgatagtctcctgcccatttttgaagactcattgaatagcctgaaggtggagactgccaaggattctgaaaatacacttgatccaaagaatctgaatgatctcgctcgattaagacataaattactcaattcttttaacttgtataatacactaacaagacagctcttaagtgtagaacctcaaagtcatctagagagacaacttcaaaattcgatcaagatagcttccgctgcatacataaacgaaaaaatcctaccgttgaagtcgcttccggcaattttgaacccagagggccataaaacgaatgaagatgggcaaaaagctgaaccagaggtaaagaaattatcgcaactaatgatcgaaaacttgaccataaaagaagtgaaagagctgagagaagaattgatggtcctaaaggaacaaagctaccttattgagtccacaattcaggactataagaagcagcgtagattggaggagatcgtcacacttaataagaacttagaagaattgcactcaagaatacataccgttcaatcgaagctgggtgaccatgggtttaattaa

SEQ ID NO: 3643 - DNA, 1548 bp, Saccharomyces cerevisiae
atgggtgttaccgttcaagacatatgttttgcctttttgcaaaactactacgaaagaatgaggaccgacccttccaaattggcatatttttatgcaagtacagccgagttgacgcatactaattatcagtccaagtcaacaaacgaaaaagatgacgttcttccaacggtgaaagttactggacgtgaaaacattaataagtttttttctagaaatgatgccaaagttaggagcttgaaactaaaattagatactatagatttccagtacactgggcacttgcacaaaagcattctgatcatggccacgggtgaaatgttttggacaggaactccggtctataagttttgtcaaacatttatcctgctaccatccagcaatgggtctacgtttgacattaccaatgatataatcagatttatttccaattcattcaagccttatgtcttaacagatgcttctttgtcacaatctaacgaggagaactctgtcagtgcagttgaagaagataaaataaggcatgagtccggagttgaaaaagaaaaagaaaaagaaaaatcaccagaaatatcgaaaccaaaggccaaaaaggaaacggtcaaagacacaactgcgccaactgaatcgtcaactcaggaaaaaccaattgtcgatcatagtcaacctcgggctatacccgtcactaaagagtccaagattcacaccgaaacggtaccatctagtactaagggcaaccacaaacaagatgaggtctctacagaagagttaggaaacgttactaaactaaatgaaaaatctcacaaagccgaaaagaaagctgcaccaatcaagacaaaggaaggctctgttgaggccataaatgctgttaataactcttctttgcccaacggtaaagaagttagtgatgaaaaaccggtacctgggggcgtaaaggaagctgaaactgaaattaaaccaatagagccacaggtttccgacgccaaagaatccggcaataacgcttcaacaccttcatcttctccagagcccgttgcgaatccaccaaagatgacatgggcctcaaagttgatgaatgaaaactccgacagaattagcaaaaataataccacggttgaatacatcagacctgaaacactacccaagaaaccgactgaaagaaaatttgaaatggggaatcggagggacaacgctagtgctaacagcaaaaataagaaaaaaccagtattcagcaccgttaacaaggacggcttttatccaatctacattagaggtacaaatggcttaagagaagaaaaattgagaagtgccttagaaaaagaattcggtaaagttatgaggataacagctgcagacaattttgccgtcgtcgactttgaaactcaaaagagccaaatcgatgctttagagaagaagaaaaagtcaattgatggtattgaagtatgcttagaaagaaaaacagtaaagaagcccacgagcaataatcctcctggcatatttactaatggaacacgttctcatagaaagcaacccctaaaaagaaaggactag

SEQ ID NO: 3644 - DNA, 1548 bp, Saccharomyces cerevisiae
atgtcaactagctcctccgtaacgcagaaaaacttggatacaaacgcggaagccttgaaaaaggaggataaagtattatcagagtttgatattcaggatgagaggcctaaatcccttttatgggagagtgcctttgtcggagtgctgtgctctgcccaactaatgactcaggcaggacttggacaatcattagcgccgcttcacatcatcggtaacagttttggaacaacgaatgctggacaacttagttggtttgcttccgcatattcgctaactgttggtacattcattttaattgctggaagactcggagatatcttcggacacaagaaattctttgtccttggcttcttttggtacgcactttggtccttacttgctgggtttagcgtctactctaatcagattttttttgactgctgtcgtgcatttcaaggcatgggtccggcctttttgttgccaaatgccattgcgattctcggacgcacatataagccaggaagaagaaaaaacatggtctttagtctgtttggtgcttcagcacctggtggcttcttccttggggctgttttctcatccatgttgggtcaactggcgtggtggccatgggcttactggataatgggtattgcatgctttgttttagctgtagcaggttactttgtaatccctcacacccccatgccaagccgcgatgcctcatctttcaagttgttggaacgaatcgattttgcagggtcagttaccggcgttgttggattaattctctttaatttcgcttggaaccaaggccccgttgtgggttggcaaactccatacacatacgctcttttgatagttggtacctttttcttggttatttttgcatatatcgagtcccgagcagctttccctctgctaccatttgctgctctttctagtgatactgcttttgtacttagctgcatagctgcgggatgggccagctttggtatttggatattctatacatggcagttcatggaagactcaaggggccaaaccccccttctttctagtgcacagttttcacctgtagcaatcagtggattttgtgcagccgtgacgacaggtttccttctaagccatacacccccaagcacagttatgctttttgcgatgacagctttcacagtcggaactatattgattgctacggcccccgttcaccaaacgtattgggctcaaacgtttgtgtcaatcattgttatgccttggggaatggacatgtcctttccggccgctacaataatgcttagtgactcgatgccacacgaacatcaaggtcttgcagcctctttggttaatacggtggtaaactattcgatatcgataggtttgggtattgcaggtacaattgaatctagagtaaatgacggaggtgccaagcctttgaaaggatatcgttgttcgtggtacatgggcatcgggttgagcggacttggcatttttgtcgcagcaacgtatgcatggagcacttttatgaagtctaaaaaaaggatctccgaaaagcagcattttatagaataa

SEQ ID NO: 3645 - DNA, 1548 bp, Saccharomyces cerevisiae
atgtccaccctgattcctccaccttctaagaaacaaaagaaagaggctcaacttcccagagaagtagctattattccgaaagatttacccaatgtttcaatcaagttccaagctttagatactggtgacaatgtaggtggcgccctgagagttcccggtgctatctccgagaaacagttagaagaacttttaaatcaattgaacggtacttcagacgatccagtgccatataccttcagctgtacaattcaaggtaagaaggccagtgaccctgtgaagacgattgatataacagataacctatattcttcattaataaaaccaggctataacagtacagaagatcagatcacgctactgtatacgccaagagcagttttcaaagtcaagccggtaactagaagttcatcagccattgcaggtcacggttccacaattttgtgttctgccttcgcaccacatacgagttctaggatggtaaccggtgcaggtgataatactgcaaggatttgggactgtgacacccaaacgccaatgcatactctaaagggtcactacaattgggttctctgcgtttcctggtcccccgatggagaagtaattgctacgggatccatggacaataccataagattatgggacccaaaaagcggtcagtgtctaggtgatgctctcagaggtcattccaagtggatcacttctttaagttgggaacctatacatcttgtgaagccgggctccaaaccaagattagcttcatcttctaaggatggtactattaagatttgggacactgtgagcagagtttgccagtatacgatgagtggtcacacaaattcagtgtcttgtgtcaaatggggcggccaaggtctattgtatagtggctctcacgatagaaccgtacgtgtatgggacatcaattcgcagggcagatgtatcaacattttgaagtcgcatgcgcactgggttaatcacttatctttatctacagattacgcattgcgcattggtgcattcgatcatacaggtaagaagccttctacaccagaagaagcccagaaaaaggcattggaaaattatgaaaaaatctgtaaaaagaatggaaattcagaagaaatgatggttactgcaagcgatgattataccatgtttttatggaacccactaaaatctaccaagcctatagcaagaatgaccggtcaccaaaaattagtcaatcatgtggcgttcagccctgatggtaggtatattgtctcagcgtcttttgataactctatcaaactttgggacggtagagatggtaagtttatctccacatttagagggcatgtagccagcgtataccaggttgcgtggtcatcggactgccgactactggtgtcatgttccaaagataccacgttgaaagtgtgggatgtaagaactagaaaactttctgttgacctccctggtcataaagacgaagtttataccgtcgactggagtgtcgacggtaaaagagtgtgtagtggtgggaaagacaagatggtaagattgtggacgcattga

SEQ ID NO: 3646 - DNA, 1548 bp, Saccharomyces cerevisiae
atgtcgaaattgggacaagaaaaaaatgaagtaaattactctgatgtaagagaggatagagttgtgacaaactccactggtaatccaatcaatgaaccatttgtcacccaacgtattggggaacatggccctttgcttttgcaagattataacttaattgattctttggctcatttcaacagggaaaatattcctcaaaggaatccacatgctcatggttctggtgccttcggctattttgaagtaaccgatgacattactgatatctgcgggtctgctatgtttagtaaaattgggaaaagaacgaaatgtctaacaagattttcgactgtgggtggtgataaaggtagtgccgacacggttcgtgatccaagggggtttgccaccaaattctacactgaagaaggtaatttagattgggtctacaataatacaccggtattctttatcagagacccttccaagttccctcactttatccacacacagaagagaaacccacaaaccaacctaagggatgctgacatgttttgggatttcctcaccactcctgaaaatcaggtggccattcatcaagtaatgatccttttttcagaccgtggtacccctgccaactaccgtagtatgcatggttattctggtcatacctataaatggtccaataaaaacggagattggcattatgtgcaagttcatatcaaaaccgatcaaggaataaagaatttgaccatagaagaggctaccaaaattgcgggatccaatccagattactgccagcaggatttatttgaggctattcagaatggaaactatccttcctggacagtttatattcaaacaatgaccgaacgcgatgccaaaaaattaccattttcagtctttgatttgactaaagtatggcctcaggggcaattccctttacggcgtgtgggtaagattgttttgaacgagaatccactgaacttcttcgcacaggtggaacaagctgccttcgcccccagtaccacggttccttaccaagaagcaagcgctgatccagtattacaggcccgtttgttttcatatgcggatgctcatagatacaggctaggtcctaacttccatcaaatacccgtaaactgtccatatgcatctaaatttttcaatcccgctatcagagatggaccgatgaatgttaacggcaacttcggctcagaacctacatatttggccaacgataaatcgtacacgtatatccaacaggacagacccattcaacaacaccaagaggtatggaatgggccagctatcccttatcattgggcaacatccccaggtgatgtagatttcgtgcaagcaagaaatctctaccgcgttttgggtaaacaacctggacagcaaaagaacttggcatataacatcggcattcatgtagaaggcgcctgtcctcaaatacagcagcgcgtttatgatatgtttgctcgtgttgataagggactatctgaggcaattaaaaaagtagctgaggcaaaacatgcttctgagctttcgagtaactccaaattttga

SEQ ID NO: 3647 - DNA, 1548 bp, Saccharomyces cerevisiae
atgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgttttagttctgtcttctctatcacaatccccgtgtgtatcatcatcatcatctttgtccacgccatgcattatagatgcgtacagtaataatttcggattatcgccatcatccacgaattctactccctctacgattcagggattgtccaatattgcaacaccagttgaaaacgaacattcgatatcactaccacctttggaggaaagcctatcgccagccgcagcagatctgaaagatacgttgtcgggaacttcaaatggtaattatatacaactccaggacttggttcagttggggaaaattggtgctggaaattctggaactgtggtgaaggcactacatgttcctgattccaaaatagttgccaaaaaaaccattcctgtggaacagaataacagtacaatcatcaaccaattagttagggaattatctatcgtcaaaaacgttaagccccatgaaaacattatcaccttctatggagcttattataaccagcatataaataatgaaatcataattttaatggaatactctgattgtggttctttagataaaatactgtccgtttataaaaggtttgttcaaagagggactgtttcgagtaagaaaacctggttcaacgaattaacaatatcaaaaatagcgtatggcgtactaaatggcttggatcatttgtaccgacaatataagatcattcatcgtgatatcaagccttccaatgttctgattaatagtaaggggcagattaagttatgtgattttggagtttccaaaaaactaataaattctatcgctgatacatttgttggaacgtccacttatatgtcaccagagaggatacaaggaaacgtttattctatcaaaggggacgtttggtcattgggcttaatgatcatcgagctggtaactggagagtttcccctaggtgggcataacgatacacctgatggcatattggatttgctgcaacgtattgtcaacgagccttcaccaagattacccaaagaccgtatctattccaaggaaatgacagattttgtcaataggtgttgtattaagaatgaaagggaaaggtcatcgattcatgaattgctacatcatgatcttataatgaaatacgtatcaccgtctaaagatgataaatttagacattggtgtagaaaaataaaatctaaaataaaggaagacaagagaattaaaagagaagccttggaccgtgccaagttagaaaagaaacaatcggaaagatcaacccattga

SEQ ID NO: 3648 - DNA, 1551 bp, Saccharomyces cerevisiae
atgaattccggaggtgaagaaccaactataaagccaaatgtatttaatattactcaacttttaaactcaaatggtgaaaaaccgggaattgcttgcatcttcttaagtaaatttgacatgaaaaagggaaatatcataatatggtctaaaagtattaatggtgcggcaattgacttaagcaatattgaatttaaatcgttaccagccggtattcacgaacaaactgacgatgttgtcaattttgtagttcctaaagaattagatgtctgtcaaactgccaagacgacaacttatgattacggcatcgcctatttcaaacaaaattcgttcgatattattgagaatgacaatcgtattgataggagtaaagttcaaatgttttctcttggtgtaattatcgatgtccaaaatgcctcatcagatagtaaaaagcacttttataaggaaatataccatgcgtatgctgccaacagatactcaagctatctagaaagtttactcggtcaatggataaggcagcgtgatcttgataagtttgatatttttgaaaagttttttgacgagaataaccaagggcacatggctgaaaattcagtagaagtctttgaacattcacccaaagaaagacggcatttggttgaatatttgccatactggacaaggaagttagggcctctcatatttccactttggaaagcaagtctccttcagtcaaggatattgatactagttcctcaaggagaatcgttcgaattgtgcaattctttggcctattgtgtcttcttaatatcaatgcttccaaaaaacttgataggaaaccatgtaagcgatgaatatattaagcctattttcacggtatcaacatcagatattccttttctagagtcgttcaaaaaggggaacggttatgtggctacgaccagcgaggaaattttgttgtataagcctgaaatttacgacatagtagtcaaacttacttcgagctcaactatagaagaatcaccagaaaaagaagtggaaattcttaccgcatctggtgaacaaaacaaagcaactcctcttgacttagaggtgtatgaaaaacttatactgggggagttacaagaggatgcctctacaaatgcgacatgtcgacatcatgaggtgacagaacccatatcatggctacagtttttaattgatgggttttttcttttaactactgcaggctatctggtagcgccatatcaccttgcaaataatttcaagattccgaggcacgtttctggcccagaacccaacaattcagaaatacagatcgctgaaaatttagttcgctattttcaccgcagaacatcaaatctgtacaacgatctgaaggatgtcatacaaaaaagtgaaaatattgattcagaacaaccgattactatcgcagcttcatttttaaccaagttaaatttggattgctttagcaaacaagatcatcaattcgtcaaggatatcgcccttaaatggttccaaagaagcattgatattagcaacctaccagaatgtttgggaaatctctgttaa

SEQ ID NO: 3649 - DNA, 1551 bp, Saccharomyces cerevisiae
atgatgaggtatcaatggtggctttatttagtatatgccatcggcctaatgctatgcctaggcccgtcgtatattcatccagatgaacatttccaatgcatcgagattttggctatgcagttcatgaaggtcaaaggtaccatcccatgggaatttaaatcaaaatttgctgctaggagttacggccccctattattggtttacgggcctttgttcactattttagaatcttttcccgaaattcaggacaacccagcgttaattctgtattcgatgagactacaaaactatgtgatgtacctattgtgctatcattttttaatacctaaattaataagggatgagagaaaggccgtacaattcatcaaaaaaagtctacttttaacttcttacgtaacctggacgtaccaaacacacacgttttccaattccatagaaacgctggctttaatctcaactttaactgtaatggaagatatggtaaacgaaaaaaatattcaaagaagtaatttcaaaaattcggttatattgggacttatatttagttttggtgtttttaatagagttacttttcctgcatttattttcttaccatgtttgatattattctggaagttttaccgggtccattggaaatccttttctttacttttactttcattttcattttcctcgtgtctatttgttcttattgatacaaatatttataacaacggaaagggatttgtcattacgcccttgaataacctgaaatacaacctcaatgtccaaaatttgcaagtacatggattacatccaagatacacccatctgctggtcaatttacctcaaatagttggcccagtattgctgctagcgattttttccggttacaaactcgataaattatctacttacgcaatcatatctggcctgctttttctttcattctttcaacatcaagaattaagattccttgtaccgctagtgccactactcgtgacaaacttaaactggacacctctgagttccacgttagtaaacaagaaaattttcaagggaacttggcttctttttaacataatcatggcgttcatcatgggaatttcacatcaagcaggaattatccaatttttgggagattacttccactttcgtaccgaacaaatgggcgttcacatatggtggaaaacatactcaccacccacctggatgtatatgagcaataacctaaccgtttcttctcttatcaatacacaggatggtattgagtcgatagatgaagtggcattcagtgtaggtaaccatcatgtaatagaccttaaaggctgtgatttaccacttttaacagaaacaattaggcggctgcgtttaaacgggtccataactccactaactttagtaactcccaattccatgacatcagaattgaaaaagttgaagagagatggcactattaacttaatacccaaaagaaattacttgttccatttggatttggatcatcttgatttcaatgatttcacgacttttaagccagggctaacagtgtactccatcgaactactataa

SEQ ID NO: 3650 - DNA, 1551 bp, Saccharomyces cerevisiae
atggcagagaaatcaatatttaatgagcctgatgtggatttccatttgaaattaaatcaacaattatttcatattccttatgaactactgtccaaacgtatcaagcatactcaagcggtaattaataaggaaaccaaatcactacatgaacacacggccgcattaaatcaaatatttgaacataatgacgttgagcacgacgagttggcactagcaaaaataactgaaatgattaggaaagttgaccatatagaaagatttttaaatacgcaaatcaagtcctactgtcagattttgaacagaattaaaaaaaggctggagtttttccacgaactgaaggacatcaagtcacaaaattcaggaacatcgcacaatggaaataatgagggtaccaggactaaattgatacagtggtatcagagttatacaaacattttaattggtgattatctgacgaggaataacccgattaaatacaactcggagacaaaggatcattggaactctggcgtagtgtttttgaaacagagccaactggatgatctcattgattatgatgtcctcttggaggctaatagaatttcgacttcgttactacatgagcgtaatctcttacccctaatttcatggataaacgagaacaaaaagacactgaccaaaaagtcctctatattagagtttcaagcaagattgcaagaatatattgaactactaaaggtggataactataccgacgctatagtatgttttcaaagattccttttaccattcgttaagagcaacttcaccgatttaaaattagcatctggacttctgatttttatcaaatactgtaatgatcaaaagccaacttcttctaccagctctggattcgatactgaagagattaagtctcaaagtttaccaatgaagaaagatcgaatatttcaacatttttttcacaaatctttacctagaattacctccaaacctgcggtgaatacaacagactatgacaagagttccttaataaatttacaaagtggagatttcgaaagatatctgaatttattagatgatcaaagatggtcggtattaaatgatttattcttgagcgacttttattccatgtatggcatatcacaaaatgaccctttattgatatacctgtcactaggtatatcgtctttgaagacaagagattgcctgcacccttctgacgatgaaaatggaaatcaagagacggaaactgccacaacagcagagaaagaagttgaagatttacaactctttacgctacattcactaaaaaggaaaaattgtcccgtttgcagtgagactttcaaaccaataacacaggcattaccatttgctcatcacattcagtctcaattatttgaaaatccaatactattaccaaatggaaatgtttacgacagtaaaaaattgaagaaattggccaaaacattgaaaaagcaaaacttaatttctttaaatccaggtcaaattatggatccagttgacatgaaaatattttgcgaatcagattctatcaaaatgtacccaacctga

SEQ ID NO: 3651 - DNA, 1551 bp, Saccharomyces cerevisiae
atgtccactgagtatgtcaaaaactacaaatacgaccttatttggtaactagtttgttgtcggttacatctgaatttgaagtacccaaattgataatacttcaggaaaagttaacgcacattcaaaacgtgtttttttacaataacctatggtgatcgaacctaattataaaaagaagcacttgaagtagtttatcttcttcaagtacctttcgtaggggattttcatttttaatgaacaaaggcattgtttgttagtatctattacttgtaatacaccgataatttcattgatagatatttccagcatgtctctgcatctcccttccatcgaatgaaaagtggtgttttcaattcgatgtaactgaatctttgttcttaatatgacttctttgctaacatttttttcatttttgaatagaaaaatcttgactcctgaatctcaattgaagaagactaaagctcaacaaaagactgcagaacaaattgctgcagagagagctgcccgtaaagccgtatgttcatttaccatgtttgaaagatattatatcattccttttacagtgagttcacaaaaatataatactttgttaaagagatcttttctcggttttacatttccttggcatttgttagtcgcgaacaattttcactttttgcaacgttttttttctttcttaatgatgaaaactattccttattctcgactagtctttgacaatgctgtcgtttaatcaccatctttcggctgactagtaaagaaaatgcaagagtgagaatatgccaagaatctgcaagattgagttaagttttcttagaaagttttatcgtgcatatttttcactaaattggaatgacgttaaaaccaaaagtactgatcttactaacattaatcaaaaattcttgatgaatattattttaggctaacaaggaaaaaagagctattattttggaaagaaacgccgcttaccaaaaggaatacgaaactgctgaaagaaacatcattcaagctaagcgtgatgccaaggctgctggttcctactacgtcgaagctcaacacaagttggtcttcgttgtcagaatcaagggtattaacaagattccacctaagccaagaaaggttctacaattgctaagattgacaagaatcaactctggtacattcgtcaaagttaccaaggctactttggaactattgaagttgattgaaccatacgttgcttacggttacccatcctactctactattagacaattggtctacaagagaggtttcggtaagatcaacaagcaaagagttccattgtccgacaatgctatcatcgaagccaacttgggtaagtatggtatcttgtccattgacgatttgattcacgaaatcatcactgttggtccacacttcaagcaagctaacaactttttgtggccattcaagttgtccaacccatctggtggttggggtgtcccaagaaagttcaagcatttcatccaaggtggttctttcggtaaccgtgaagaattcatcaataaattggttaaggctatgaactaa

SEQ ID NO: 3652 - DNA, 1551 bp, Saccharomyces cerevisiae
atgtctacacagcagcaatcttacacaatttggtctccacaagatactgttaaagatgtcgctgagtcgcttgggttggaaaatatcaacgatgacgtgttgaaagcacttgctatggacgttgaataccgtattctagagattattgaacaggcagtcaagtttaaaagacactctaaaagagatgttttaactacagacgatgtatcgaaggccctgcgtgttctgaatgtggaacctttatatggatattatgatggctctgaagttaataaagctgtatcatttagtaaggttaacacaagtggaggacagtcggtttactacctggatgaggaagaagtagattttgatagattaataaatgagccattaccgcaagtgcctcgtctaccaacttttactacacattggctagcagttgaaggggttcaacctgccataatccaaaatccaaatttgaatgatataagggtatcccaaccaccatttattagaggtgctattgtcactgctttgaatgataacagcctccaaacacctgtaacgtcgacgacagcaagtgcttctgtgacggatacaggcgcctctcaacacctgtctaatgttaaaccaggacagaatactgaagtcaaacctttagtgaaacacgttttatccaaagaattacagatttatttcaataaggtcatttcaaccttgacagcgaagagtcaagctgatgaagctgcacagcatatgaaacaagcagctttgacttcactacgaactgatagtggcctgcaccaactggttccatattttattcaatttattgccgaacaaatcacacaaaatctttccgatttacaattgctaacaacaattttggaaatgatttactctttactaagcaatacttctattttcctggacccttatattcattcgttaatgccttccattttaaccttgctattagcaaaaaaacttggtggatcaccaaaagatgattcgccgcaagaaattcatgaatttttagaaagaacgaatgcactacgtgattttgccgcatctttgttggactatgtattgaaaaaatttcctcaagcatacaaatccctgaagccaagagtaactaggacactgctaaagacatttttggacataaaccgtgtttttgggacttactatgggtgcttaaagggtgtatcggtactagaaggtgaatccatcagattcttcttaggaaacctaaataattgggcgcgcttggtattcaatgaaagcggaataactctagacaatatagaggaacatttgaacgatgactccaatccaactaggaccaaatttactaaagaagaaactcaaatcttggttgatactgtaattagtgcattgttagttctaaaaaaggatttaccagatttgtacgagggtaaaggtgaaaaagttacggatgaggataaggaaaaattgctagagaggtgtggtgtcactattggatttcacattttgaaaagagacgacgcaaaagaattaattagtgcgatattttttggcgaatag

SEQ ID NO: 3653 - DNA, 1551 bp, Saccharomyces cerevisiae
atgtttttagccaaaaatctaaaaaataataaaatcaaggtatgcttgcctaaaaagaaatttgctgcgctgagtacagcgtctatacaaactaatgaaagaccaaatccagataaggttttgaaggacatcgcgaaatatgtccatgaaaccccattaaaatcatctttggctctagatacagcacgactctgtttccttgatactctaggctgtggcttggcggctttgaaatttaagcaggctcaaaatattattaaaccaattgtgccaggaacaatagttcccagtggaacaaaaatattgggcacatcttacgttatggatccagtgaagggagcttttgccattggtactctaatacgttggttagattacaatgactgctggttagctgccgagtgggggcacccatcagataaccttgggggaattttagctgtcgcggatcacttgtccagattaaacaaggctacccacggaaagaatggaaaacagtttcttgttaaagacgtattagaggcaatgattaaagcgcatgaaatccaaggtattatagcgctcgaaaattctttcaataaagtaggtttagatcatgtggtactcgtgaaagtagcaacggctggtgttgtctcgaagatgctgggcctgagccaggaacaaactattgaagcattgtcacaagcatttgtagacggtcaatcactgcgtacttaccgtcatgccccaaatactggatctagaaagtcgtgggcggcgggagatgcagtttcgagggctgtaaacttggcttatttagtcaaaaatgctaatgttggcacgataccttcagtattaacagctagaacctggggattttatgacgttttatttaagggtaaacctttttcattccaacaaagatcaaaatatgattcctacgtcatggaaaacgttctgttcaagatatcatttcctgccgaattccatgcgcaaactgctgtagaagctgctgtaaaagcatataggattcttgccaaacaagggaaaacttttaaagatattaaatcgatcagaattagaactcaagaggcggcaatgaggattatagataaatccggtcctctgtataattatgccgatagggatcattgtatccagtacatgatcgcggttccgctgattactggtaatctcacagctactgattattcggatgaggtcgcaagaaatcctgagatcgataacttgagatcgaaaatgtactgtatcgaagatactcatctcactcaaaactatcacgatcctgataaaaggtcgataggaaacgctcttctcatagagctgaacgatgggacgcagttggatgaaatttttgtagagtaccctgttggtcacaaatttagacgagaggaaggaataccattactaatgaataaatttcaaaggcatctgcgcgaacattttgtagagagccctgataaagtcgaccttataatgaaggtaagttcaaaaacaaactttttgaatatgcaaatcgacaaatacatggatttgtttactgagggatga

SEQ ID NO: 3654 - DNA, 1554 bp, Saccharomyces cerevisiae
atgactacgtttaggccactatcaagttttgaaaaaaaaattctcactcaatctttgaatgaccaaagaaatggaactattttttcgagtacatattcaaaatctttaagtagagaaaatgacgctgactggcattctgatgaagtcacgctcggaacaaattcttccaaagatgattctcgtctgactctgcccctaatagcaacaactttgaagagattgattaaatcgcaaccggcattgtttgcaactgtaaacgaagaatgggaattcgagccattgaagcagctgaaaacttccgatattgttaatgtgattgagtttgaaaccataaaagataaggaggtcaattgccattggggtgttccacctccttatctcttgcgtcatgccttcaacaagactagatttgttcccggatcaaataaacctttatggacactatatgtaattgacgaagcgctattggtttttcatggtcacgacgtattgtttgatatattttcagcagctaactttcacaaattatttttaaaagagttaaacgaaatcagcacagtaacacactctgaagataggattttgtttgatgtcaatgacatcaatctctcagaattaaaatttcccaaatcgatatatgatagcgcaaaattacacctgcccgctatgacaccacaaatcttccacaagcaaactcagtcatttttcaaatcaatatactataacactttaaaaagacctttcggctatttaaccaatcaaacttccctcagctcgtcagtatctgcaacacagctgaaaaagtataatgatattctaaatgcgcacacctcattatgcgggacaacagtatttgggatagtaaacaaccaaaggtttaactatttaaagtcaatcgttaatcaagagcatatatgtctaagaagtttcatctgtggtattgcaatgatatgtttaaaacctctcgttaaggatttcagcggtacaatagtatttactattcccataaatttaagaaaccacttaggcttaggtgggtcattgggtctcttcttcaaagaactaagggtcgaatgtccactttctctaattgatgacgaactttccgccaacgaatttttgaccaacagtaacgataacgaggataatgatgatgagtttaatgaaagattgatggaatatcaatttaataaagttacaaagcacgttagcggttttattatggcaaaactgaggagttgggaaaagaatgggtttaatgatgacgatataaggaggatgaagtatgacaatgacgacgatttccatatccaaaattcaaggacaaaattgattcaaatcaatgatgtttccgacatatcgttatcgatgaacggcgatgacaaatctttcaaaattgtaagtacgggatttacaagttcgataaatcgccccacattaatgtctctttcctatacatactgtgaagagatgggcctgaatatctgtattcactaccctgattcgtataatttagaatcttttgtagaatgcttcgaatcctttattgaatag

SEQ ID NO: 3655 - DNA, 1554 bp, Saccharomyces cerevisiae
atgagtactagtgcggacactgataccatcaagaagccaatccttgcggtgccagagcctgcactggccgatacgcattcagaggagatatcacgctctggagaagaacatgaatcagagaacaacgagcactcagatgaagaaggcgataattattctgaaagagagcaatctgtgtcaaccgaaccactggatacattgccgttaagaaaaaagttgaaaaatctttcatatattacatttttcgccataggaataggtcttttatggccgtggaactgtatcctcagtgcctcgcaatattttaagcacgatattttcaaagacacctccatttgggcaaagatcttcacaagctctatgatgtccttttctaccatatcgtcaatgctgttcaacatctacttggccaaaagacagtacaaatactcgagaagggtcataaacgggcttgtgtgggagattattgtctttactgtcatgtgcttctttacaattttgcatttccttttacctaaatggttcaatttcatgtttataatgatgcttgtagtgatcagttccatggggacagccatgacacagaatggtatcatggccatagccaacgtcttcggttccgagtacagtcaaggtgtcatggtggggcaagccgttgctggtgtcctgccctccctagtgctttttgccctagctttcatcgagaactcttctgtgtctactacgggcgggattcttctatacttttttaccacaacactcgtggtcaccatttgtgtggtcatgttcagcgtgagcaaaatcagtcggaaagtgaacgagaattggaatgtggaagacggacatatcactgatgtgttgttagggtctctgcgctccaatgaggaggaaatccgtattgttggccgcattgaccaaatggaggatgaagaccaccgccgcaccaacggcactcgcgacgacaacgacgaaggtgaggaactccaactaaaagtgcctttcgaggtcttatttgccaaactaaagtacctggttctttccatattcaccacgtttgtcgtaactcttgtttttcctgtatttgcgtctgccacctacgtgacagggcttcctttaagcaacgcacagtacatacctctcatattcacgctgtggaacctaggcgacctttacggaagagtcattgccgactggcccatgttccgtgaccagaaatttacgccacgcaaaaccttcatctactcattgttgcgggtggccgcaataccactgttcttgatgttcacagccatcacctcctcttcaagcggcgatgaagagcacaatggctccgtaatcgttgacttgtgttacatgctactgcagttccttttcggcgtaaccaacgggcacgtcatctctatgagtttcatgaaggtgccagagcaactggacaacgacgacgagaaggaagcggccggtggattcactaatattttcgtttctacaggactagctctgggcagcatcataagctacgtattcgtcttcataattgactttattatcaggtag

SEQ ID NO: 3656 - DNA, 1554 bp, Saccharomyces cerevisiae
atgcaagtgaccacaagatttatatctgcgatagtctcgttttgcctgtttgcttctttcacgttggctgaaaacagcgcaagagctacgccgggatcagatttactcgttctaacagagaagaaatttaaatcattcatcgaatctcatccgttagtcctcgtcgagttttttgctccatggtgtttgcattctcagatcttacgccctcacttagaagaggccgcctctattttaaaggagcataacgtcccagttgttcaaattgattgtgaggctaacagtatggtttgcctgcaacaaactataaatacctacccaaccttgaaaatctttaaaaatggtcgtatttttgatggtcaagtctatcgcggtgtcaagatcaccgatgaaatcactcagtacatgattcagctatacgaggcttctgtcatttatttaaattccgaagatgaaatccaaccatacttggaaaatgcaactttaccagtagtaataaacagaggcttgacaggcttgaatgaaacgtatcaagaagtcgcactggaccttgctgaggattacgtctttttatcccttctagattcagaagataagtcattatcaatccacttgccaaacactacagaaccaattctgtttgatggaaatgtagactctttggtcggaaattccgttgctctaactcagtggttaaaagtggtaattttaccttactttaccgacatcgaacctgatctcttccccaagtacatttctagcaatttgccgttggcttacttcttttatacttctgaggaagaattggaagattacactgatcttttcacgcagttaggtaaggaaaatcgtggccaaataaatttcattgcattaaactctacaatgttcccacaccacgttagattcctaaatatgagagaacagttcccattatttgctatccataatatgatcaataatctgaaatatggtttaccacaactaccagaagaagagtacgcgaaattagaaaaaccacaaccactagacagagatatgatcgttcagttggtaaaagattaccgtgaaggtactgccaagccaattgttaagtcagaagagattccaaaagaacaaaagtccaatgtttataaaatagttgggaagacacatgacgacattgttcatgatgatgacaaggatgtccttgtcaaatattacgcgacatggtgtattcatagtaaaaggtttgcgcctatttacgaagaaattgcaaatgtcttagcatctgatgaatctgttcgcgataaaatcttgatcgccgaagtagattcaggggcaaatgatatcttaagttttcctgtgacaggatatccaaccattgctttgtatcctgccggaaataactctaagcctattatcttcaataaaattagaaatttggaagatgttttcgaatttatcaaggaatcaggtacacatcacattgacggccaggcaatttatgataaattgcaccaggccaaggattctgaagtgtctactgaagataccgtacatgatgaattataa

SEQ ID NO: 3657 - DNA, 1554 bp, Saccharomyces cerevisiae
atggctataagattgaatccaaaagtcagaaggttcttgctggataagtgtcgacaaaaacgatatggtttcctctttttaggatgtatcttcgccatactttactgtatggggacctggccatttttcgcaaaagatattgtacatgatccaaataatttgccttattccttacaggattattcgactgacaaagacgagccatttttccggggctgcactgatacaaagctgtacttgcaaaatcctgcttactccaaaatgaacgcatctttcgttatgctaacgagaaacgaagaaatagaagacgtactgaaaactatgagaagtatagagggccatttcaataagtggttcaaatatccgtacgttttcttgaatgatgacccctttacagatcattttaaggaccaaattcaagctgcaactaatgccactgtagagtttggcactgttgatgaaattatgtgggagtttcctgctaaggttcgtaattcattgcagtttaaggcttcattagaagaccaaaacgatcgcggtataatgtatggtaatatggaatcatatcacaagatgtgtcgattttactccgggatcttttataaacatccattagtttccaagtatgaatggtattggagaatagaacctgatgtggactttttttgtgacatctcgtatgatccctttttcgagatggccaaacataacaagaaatatgggtttaccgtacttataactgaactgtactggactgtccccaacttgttcagaacaaccaaaagctttataaaaaaaacggcaggtttaaaggaaaatctcggcacgttgtggaaattatttacatttaattataatattctagatacagatgatgaagaaatttctaggtgggtcaattttccctgggatgcaaagccaaagttgacagaaaagttgatggtagactttttgctagagaatcatggtcaagtcaataatgaggaagatttggaaggtatacaatatctcgttgaaagggcccgctctaaggtgccaatgctagaggattcccttgaaggggaagattacaatttgtgtcatttttggagtaactttgaaattgcccgcgttgatttattcgacaatgagatctataacgcctattttaaatttttggaagagtctggaggtttctggactgaaaggtggggtgacgcgccaattcattcaattgggttgggaatgaccttggatctagaagacgttcattatttcagagacattggttatagacactcatcgctgcagcattgtccgaagaatgccttacaaagccaagaaaatctcaacactttcgatgaaggttataacttcggatgtggatgtcgatgcgtgtgccccaagaaaggtgaagacatcgaagaccactccaccccttgcatggatattttttttgaattgcttcacggcagggaatatgagaaggaattccctggttgttacaagccctccataaaggacaaagacgtgattgaagagatcagaagagaaaattttagagtaattgaatag

SEQ ID NO: 3658 - DNA, 1554 bp, Saccharomyces cerevisiae
atggttttgtctgataaggagttgtttgccataaataagaaagccgtcgaacaaggtttcaatgtgaagcctagattgaactataatacggtcagtggtgtgaacggtccattagtcattttggaaaaggtcaagttcccacgttacaacgaaattgttaatttgacattgccagatggaaccgtgagacaaggtcaagttttggaaattagaggagatagagccattgtgcaagtgtttgaaggtacatctggtattgatgtcaagaagactaccgtggaattcactggtgagagtttgagaattcctgtgtctgaagacatgttgggtagaatttttgacggttctggtagacccattgacaacggtcctaaagttttcgcagaggattacttggacattaacggttctcctatcaacccatatgctcgtatttatccagaagaaatgatttctactggtgtttctgctattgacacaatgaactccattgccagaggtcaaaagatcccaattttctccgcatcaggtttaccacacaacgaaattgcagcacaaatttgtagacaggctggtttggtgagacctaccaaggatgttcatgatggtcatgaagaaaatttctccatcgtttttgctgccatgggtgtcaacttggaaaccgctagatttttcaaacaggatttcgaagaaaatgggtctttggaaagaacttcattatttttgaacttggctaatgaccctaccattgaaagaattatcactccaagattggccttgaccaccgctgaataccttgcttaccaaacggaacgtcatgtgttgaccatcttgaccgatatgtcatcgtatgctgatgctcttagagaagtttccgctgctagagaagaagttccaggtagaagaggttatcctggttacatgtatacagatttgtccacaatttatgaaagagcaggtagagtagagggtcgtaacgggtccatcactcaaatacctatcttgacaatgcctaacgatgatattacgcatccaattccggatttgaccggttatattaccgagggtcaaatcttcgttgaccgtcaattacataacaagggtatctacccaccaatcaacgtcttgccttcgttgagtagattgatgaaatctgccatcggtgaaggtatgaccagaaaggaccacggtgacgtttctaaccaattgtatgccaagtacgccatcggtaaggacgctgctgctatgaaggccgttgtcggtgaagaggcgttatccatcgaagataagttatctttggaatttttggaaaaattcgaaaagacctttatcacacaaggcgcctacgaggacagaaccgttttcgaaagtttggaccaggcatggagtttgctaagaatctaccctaaggagatgttgaatagaatctccccaaagattcttgatgaattttacgatagagccagagacgatgccgacgaagatgaagaagatcccgacacaagaagctccggtaagaagaaggacgccagccaagaagaatctctaatctaa

SEQ ID NO: 3659 - DNA, 1557 bp, Saccharomyces cerevisiae
atgacttatgaaattggggacagactcaagattggtggatatttttgcaccatcaaattcataggtgttattaagccgtggccttcggtaaaagcttatggggtggaatgggacgatcacagccggggaaaacattctggaacaatagatgacatacactattttgacgttcaaattcctaattcaggatcatttttgaaggagtctaagattaaatctccaggtgtacgcagaattacgttttacgaagcattgtcagaaaagtatggaggctcgagtaataacattaatgacctatctataggtaacaaaagggttgagggtttgggattcgatgaactaaatgcgagaaataagaattataagaagttaagaaaaatagctttgcgagattccgatgtcgctatattgtttcaaaatcaagatgagttaaaccgtgtaatacaaaattgtgtgaacgtcaaggaccttgatttatcgcttaatctattcacgaatatcaactctttatgtgagttcatagaacctttgaagaacttggagagccttaatatatctcaaaataaacttttaagcggttgggacaacttgaaagaatatgacctatcacacatcaaaactttacgtctgtcttcctgtggtttaagttataaacatattggtaagctgctcaaaagcttcaggacactgaaaatgttggatttaagctataacaacttgaccagtgcgggaatccaaaattttgagaatgaaataccgtgtactttggaggaactgaatattagcggaaataatcttatatcgtttccattgtttccaaaaaatttgacattgaaaggtttaaatgtctccaataatcaaatttctagagcaccaagtattgctatttattctgttgaatccttggatataacagataacaaatttaaggaaagaagtttgatagatgatttgaataagacatttccctctttgaaaaatatccatctgagtggcaacgaattcaactacaacggaaattatattaacgtcgaagaacaggctactttttatgaagtactggctaggtttgatcgtgtgatggtattgaatggatcaatatgtgatgtaaaaacaagaagagaggctgagatgttttttgtttccaaggtaatgaataacgaattgagctatgacaccaatctgccgcgttggtcaagcctcataaagtcgtatgaaatcgatatgagtaagctaagtttcaacaatgaaagagaaacacggcaatctcttgtcttaaaaataaagataagagctggcaagaagccgagtagtgatttagattattgggtccttcccagttttacagtaaggtacgttaagagtgtaatatgtcgaaagctaaactttgacatactgaatgttaagttatttcatgaaaattctgaagggatgataaacgaaataaagtataattttcgccccatttcagattttaatgttgtgaacggagatattattcatgtttcgtctccagtaaataacaagagcattcagaaggttaacagcccatcgtaa

SEQ ID NO: 3660 - DNA, 1557 bp, Saccharomyces cerevisiae
atgattactacagtgcaagaaatcagcaaatggagaaacctgtgcttcattaggatgcaatctcgcaaatggtacccagtacttaaaaagactcctttagtagcggacggtcgaaagatcattaaacatgccgataaagttcctcatccggaagaaataattcacccattttaccaaccaacagcaatagaacaattcacggcatgcgctacggaatacaatcctagcctgcttgatggcaaaaaaattgctccatcactgataaaacacccggtgagcctaaaaaccatactagttgatagcaaattaaagtttgatgatattaggggagtgaataaatggttgatggaattcgttgcaagacgacaacatcaaagaaatattgtacttacacctgcgagcaaaagcgttagatcttttcacgttctgcatttgtcttcaaccgatattgccaaattaagaggtcttgaaaatatattatcagagattgaaaacacgaatgatttgcaatccagggtcgagtccgtaaataatgaactacagaatatttttgaccgcgacagtaaacagacaagattattttgcgagaatatactggcttatttgataaagaattatggaaactcgactgaaaaacttatactactaataaatgttactgagatgcaattatattcacgtttagaccaaatgaaggccatgaacattattttatataatatcctttgtaaagtggaagcaaatgaaaacccaccgtacagtcccacattggttaccgcactagaaaacctattggcagcgatcaacaacagattttttccagggcgttgcgaaaattcattgcacccaatagtaattgaacaactattatcatatttcattaaaaccggcaatttgaatgaaagcaaaaattttttgggccatttaataaaaaagggtattttaccagaggctactatcattaatagatatttggaggcaattgatgttcatttcgataaaagcactaagatttttgatataagatccaaatttgcattcatagcagatcttgcacccataatagaaaattatggaacaatagacctgttcaaatttttgatacctatgtgccggcatttcgacgaattgtgttctctgctaaatattattcgaaaatccaataacgcaaaacgggctgtggatagcaccttacctatttttatcaaaaaagtattaacatttactaaagatccaatgatcaactccggaaatctatccactgttttcaatatagtgagcccaatatatggacaaaacgtgcccagcgaattcgtggagaaatttatactgtcttttgcacttcaaggaaattacactatgatggctcatatgatagatacatataagatcaaactaagtcataaataccaactacaaattattagggctctcaaaaatagtgagagaaatcacgcgcttaagaatacgggcgctgtaggttataataaggaatttaaaaagtacttcatcgagaaatatttgaattgcactgaacgagaagctttacgcccataa

SEQ ID NO: 3661 - DNA, 1557 bp, Saccharomyces cerevisiae
atggaagacaaagatatcacatcggtaaatgagaaggaagtgaacgagaacactaatcctagaataataaaatatgatgccgagaggcgtgcaacccgtactgaaacctcaaagaaagataaatggaaaaacatagttacaatcattgcgtccggttttgctctgataagtgatggttacgtaaatggttcaatgagtatgctaaacaaggtttttgttatggagtacggtaagaaaaactatagctcaaaagtgtcgactagagtttccaacgcagccctagttggtattatttttggccaattctttatgggtatcgctgctgattattatagtagaaaatcttgtatccttgtggccactgctatcttggttattggtagtgctctgtgtgctgcctctcacggtactactgtacctggcatgttttggatgttaacagttatgagaggtttggtaggtattggtgttggtgcagaatatcctaccagtacattaagtgctaatgagtctgctaatgaatataccactaccaaaagaggtggtatcctggttatggtgacaaatttgccactagccttcggtggtccatttgctacgatcatctttttaatcgtctacaaaatctgttcaggaacaaaacatttagaggcgatctggaggactgtttttgcaatagggtgcttctggccattgagtgtgttctattttagatggaagactgctactacagaagtctatgaaaaaggtagaatcaagagaaatataccatatttcctagcattgaaattttattggaaaaggttacttggtacatgtggtacatggtttatgtatgattttgttaccttcccaaatggtattttcagttcaacaattatcagttccgttatcaaggaccaaaatgatttagtaaaagtggcagagtggaacttactgttgggagttttagctgtactgggtgtaccaattggtgcttatctgtccgatcgtattggtcgtaaatatacgttgatgtttggtttctctgggtacatcatctttggtctaatcattggatgtgcgtacgaccaattgaaaaaaatcacccccttgtttattatcttctacgcattcatgaatatgttaggtaatgctggaccaggtgatatgcttggtgttattagtagtgaagcgtcagcaaccgctgttagaggtgttttctatggtttatctgctgtgactggtaaaatcggttctgtagtaggcgtcgaatgtttccaacccattagggataatttgggtgcaagatggacttttattattgctgcaatttgtggtcttattggtatcattattacatatttctttgttccacattctcttgaaagcgatttaatgaagcaagacgttgaatttcacaactatttggtatccaatggctggactggtaagatgggatttgatgagacagatgaagaatcaatggttagaactattgaagttgaagagaatggtactaattgtagtaagaaaaacgcagaaataatttcagtcagacaggtcgatcaaagttga

SEQ ID NO: 3662 - DNA, 1557 bp, Saccharomyces cerevisiae
atggaattcacacctatagatccgcaccagcaccaaaatgctgctactcttctatgttgtaactgtggtaccccaatcgatgggtccactgggctggttatgtgttatgactgtatcaaactgactgtggacattactcaaggtattccaagagaagcgaacatttcattttgcagaaactgtgaaagatttttgcaaccacctggacaatggatcagagcagaattagaatctagagaattactggccatttgtttgcgtcgtttgaagggcctaacaaaagtcagattagtggatgcttcattcatttggacagaaccccattctagacgtattagaattaaacttaccgtgcagggagaagccatgacaaatactattattcagcaaactttcgaagtagaatacattgttattgcgatgcaatgtccagactgtgccagatcctacactacaaatacttggagggctactgtccaaattagacaaaaagtgcctcacaagagaacatttttgtttttggaacaactgattttgaaacataatgctcatgtggataccatttccattagtgaagctaaggacgggttggatttcttctatgcgcaaaaaaaccacgcagttaagatgattgattttttgaacgctgttgttccgattaaacataaaaagtctgaagaacttatttctcaagatacacatactggtgcatctacttataaattttcatattctgtcgagattgttcctatctgtaaagatgacttggtcgttttaccaaaaaaactggctaaatctatgggtaacatttctcaatttgttctatgttctaagatttctaacactgtccagtttatggatccgactactttgcaaaccgcggatctgtcaccatctgtgtactggagggctccattcaacgccctggctgatgtgacccagttggtggagttcattgttctggacgtggattctacaggtataagcaggggaaatcgtgtcttagctgacattactgttgctagaacgtctgacttgggtgttaatgaccaagtctactacgtcaggtctcatctcggtggtatttgccatgcaggtgatagtgttatgggttatttcattgcaaactcgaattacaactcagatctttttgatgggttaaatatcgattatgtgcctgatgtagttcttgtgaagaaattgtatcaaagaaagagcaaaaagagcagacactggaagttaaagagaatggctaaggaacacaaagatatcgatgcatccttagattacaattcaagagctcaaaagcaagaaatggaacgtgcagaaaaggactacgaattattcttacaagaattagaagaggatgctgaattaagacaaagtgttaacctatacaaaaaccgcgaagcaaatgtacctcctgaagagcatgaaatggatgaagacgaggatgaagacgctccacaaatcaacattgatgaattattggacgagttagatgaaatgacattagaagatggagtcgagaacacacccgttgaatctcagcagtaa

SEQ ID NO: 3663 - DNA, 1557 bp, Saccharomyces cerevisiae
atggatgaatatagtagtatatattcacaaccaaagactcctcggttgaaacaagaaggatttcccgactccattggcgatcaacacgaaaaggcattgattgatgaaaatggtgaggaagataaaaaaatggcatccactgaagggaccactggtgattctcgcagtacacctttgactgtatctattccgacgtttgaaaatgtccaagcattacctacaccgatgacctacactccgttatccccaggcaatctgtcaatgtcacctatagatcaatcctcgttgaatatacccaaaagacgaagtcatgcacgattactggatgatatgctttctgttacacaaccaaaccaaagagttgtttctgaacttattgcaccagctaatttatccccccaaagggttgtttccttaccaacagtgactgaagaggctttagtaaatgattctgttgatagtgataactacacgaaagaaccttattttcccgaaagtagtagttctaccgaaaagtgtgacgatgatatatttcagggatttcttttagatcactgggatcgcccgttattatggaaaaaggtcaggcccattggttcaggaaattttagtaccgtacttttatatgaactcatggaccaaagcaatcctaaactgaaacaagtggccgttaaacgactcaaatatcccgaggaattatcaaatgttgaacaaatcaatacatcgttacgatataaggaaactttatcccgtttggaaaattctctgactagggaattgcaggtgctaaaatcactaaatcacccatgtatagttaaactacttgggataaacaatccaatttttgttactagcaaaaaacctttatgcgatttgattataaaaactccaagagctctgccgccttgtgatatgattatgtcttattgtcctgcaggagacttattagctgccgtcatggcccgtaacggaagactagaagcgtggctgattcaaaggatttttacggaagtagtactggcagtaaaatatttgcacgaaaacagtattattcatcgggacctaaaattagagaatatactactgaaatatagttttgatgatatcaacagttttagggactcacccatttactgcaagcaaaatttcattgagctagcagattttggtctctgcaaaaaaattgagaacaatgagatgtgtacagcaagatgtggatcagaggattatgtctcaccagaaatcctgatgggagttccctacgatggccatttaagcgacacgtgggccttaggtgtcatactatacagcttgtttgaggacagattaccatttgaccctcctccaaacgcttcagcaagacagcgtagcagagctacgtcacatcgtattgccaggtttgattggagatggtaccggttaagcgattataaaactaatgtgggaaaacagattgtggaaaatacgctaacgaggaagaaccaacgttggtcgattaatgaaatttacgaatcccccttcgttaaaacgatcgctgatactctaagtttttcttga

SEQ ID NO: 3664 - DNA, 1557 bp, Saccharomyces cerevisiae
atggcgcccatctttagaaattaccggttcgctatcggtgcttttgccgttattatgctcattttgttgattaaaacatcttccatcggtccaccttctattgcacgtacagttactcctaatgctagtattcccaaaactccggaggacatctctatcttgcccgtcaatgatgaaccaggttaccttcaagattcgaagactgaacaaaactatcctgagcttgccgatgctgtgaagtcacaaacaagtcaaacatgcagcgaagaacataagtatgttatcatgatcgatgccggctctaccggttcccgagtacatatatacaagtttgacgtctgtacttccccacctacattacttgatgaaaaattcgacatgttagagcctggtttatcttctttcgataccgattccgttggtgccgctaactcccttgacccattactgaaagtagcaatgaactatgtccctattaaggcaagaagttgtactcccgttgcggtgaaagctactgcaggcctaagactcttgggtgatgccaaatcttcaaaaattttgagcgctgtaagggatcatttggagaaggactatcctttcccagttgtcgaaggtgatggtgtttccatcatgggcggtgatgaagaaggtgtcttcgcctggattactacaaactacctattaggtaatatcggtgctaatggccccaagttacctactgctgccgtttttgacttaggcggagggtctacacaaattgtttttgagcctactttcccaataaatgaaaaaatggtcgatggtgagcataaatttgatttgaagtttggtgatgaaaattacaccttgtaccaattttctcatctaggttacggtttgaaggaaggaagaaataaagttaactctgttcttgtggaaaatgcattaaaagacggcaaaatattgaagggtgataacactaagactcatcaattgtcatctccatgcctaccgcctaaagttaatgccacaaatgaaaaggttacattagaatccaaggaaacttataccattgactttatagggccggacgagccaagtggtgcacaatgtagatttctgactgatgaaattttgaataaagatgctcagtgccagtctccaccatgctctttcaatggggttcaccaaccttctttagttcgtacattcaaagaatcgaacgatatctatattttctcttatttctacgacagaacccgtccattgggtatgcccttgtcctttactttgaatgaattgaacgatttggcaagaatagtgtgtaaaggcgaagaaacttggaatagtgtcttcagtggcattgcggggtccctagatgaattggaaagtgactcgcacttctgtttggacttatcttttcaagtgtccttattacatacgggatatgacattccattacaaagagaattgagaactggaaagaaaattgccaataaagaaatcggttggtgtttaggtgcgtcattaccattgttgaaagctgataactggaaatgtaaaattcaatcagcttga

SEQ ID NO: 3665 - DNA, 1557 bp, Saccharomyces cerevisiae
atggctccaaaaatttcaatatccttaaacccaccgtacaacggggagttttatagctctaatgatcaaatgtcagggatagttagtcttcagttaacaaaagcgctatctataaggaaaatttccgtcattctaaaaggattctcagagaccttaacaaaaattgatcaagagtacatgtttcaacagaatggcatgatgatgccgggccaagacaacaaatcctttcatacattaatgaaattcgaacagagagttttccctccagataatgtatggaatgctcttgatggctcctccaagccgttcaaagttaaaccaggttcatataattatagctttcaatttgacaagtttcccagaaagcctgaatgtctgaaaaatcatacggcaaagacagtagcgtttgtgacaagaagtaatgcccgactcccacctacgttcaatagtcattggcaagaatttaataaaatcgataatctggatttgtatttttactcttttggaaaagttatatatatggtgcaagttcaattagagctagggaaatcttcatcttggtttaagccattccataaactgataagggaaatcgagacgttcgaatttatacctgagccaaaagatcttattatagaacctgatgaagatgacaatgaagaacttaatgccttcagtaacaatagtagaggaaatagtatggtcaccaacaatgaatttttcaatagttcaaatttaaaggtgccatcaaaggacgtcaaagtcgttaatggagtcggatatataaaaagtgacaggaacttttctcaagctaattctatattgatagaaaacggcgacattagatcgagaccggtatcatcagtcacatcaacaagacaatctactcgcctagtaaatggtatgaaagttttcccatctacttataaaatggggttgcctgatggggaaagcaatatgagaatagaggttagaagtcgagatttgaagcaaatatacaggaaagactacttgtttaggtctggcagccaaaattttgacaaggtctatgtagtcatggaggggaatatagcaagtttgagcaaaatgcaaattaccccacttaaactacaactgaacttgctagagactacaacatatttatctcagggaatagcgaacggcaattactcttctttgaagctaatcgagattgatttgaatcagctcaaatccaataaacctcttttggacttaaacgaaatacgagaaaattttgatggttctatgtttgaatgtgaattacggttaaaggatcaccccattttaagaaagttggtatttaatgaagaagactatagacatcgcggcaataggttgtatagtttcaagacatgcacgataaaaagaacattcagtttacagctactgatagaatggggaatcaatggaattaggaagcaatctgaagtaaacattgatcctgttcagatcttttgtcaagttagagagcacgttgaagctgaagctctgcccagatatgtaccgccaccgacatatactgaaatggcgagttaa

SEQ ID NO: 3666 - DNA, 1557 bp, Saccharomyces cerevisiae
atgtcgatagcttggtctagcgttttcaaaagagaattacggcttgaaagatttttaccaagagtatattcgacgaaagttcctgataatgcaccaagagcggctgacaatgaacaatggctagaaaccctaagacctataactcacccagaacagaaaaagtccgaccatgatgtcagttacacaagacacattaatgttcctctgggcgaagtcacttctgtcaactatctacaacggtataataagcataagcatagccagggcaatttcgtggatgttcgaatagtgaaatgcaaaagtggcgctggtggaagtggagctgtctccttctttagggatgcagggaggtctataggtcctccggatggtggagatgggggagctggtggtagtgtttatattcaagctgttgcggggttgggatctctggcgaagatgaagaccacatataccgctgaagacggagaagcaggtgctgccaggcaactggatggcatgcgaggaagagatgttttaatacaagttcctgtgggtactgttgtaaaatggtgcttaccaccccaaaaagttcgagagctcgtggaaagagaaatgcgcaaagacaataatgctacattaaggtctatacttggctcaacagccgtcaacttaagcgtttcttctggttctcatcggaaaaaaatacaactatacagacatgaaatggcggagagttggctcttcaaggacaaggccaaggaataccatgagaataaggactggttcaaagatttacataagaaaatggaggcatacgaccactcgttagaacaatctgaactgtttaatgatcagtttccactggctggtcttgacttaaatcagccaatgacgaaaccagtatgtctgctgaaaggtggccaaggtggactcggtaacatgcactttttaacaaatttgattagaaatccaagattttccaaacccggcaggaatgggttggaacagcattttttattcgaattgaaaagcattgctgatcttggactcattggtttgcctaacgctggaaaatcaactatactaaacaaaatctcaaatgcaaaaccgaaaatagggcactggcaattcaccacactgagccctacgattggcacagtttccttgggttttgggcaagacgtcttcactgtggccgatatacctggaataatacagggagcatcattagacaaagggatgggtcttgagtttctaaggcatatagaacgttccaatggttgggtatttgtccttgacctctctaataaaaaccctttgaatgacttacaattactgatagaggaagttggtactttagagaaagtcaagaccaaaaacatactaattgtatgtaataaagtcgatattgatgccgagaaatccgaatcatttgccaagtacctacaggttgagaaattttccaaaagtcaggaatgggactgtgttccgataagcgccctcagagaggaaaacatagatgtgttaaagaaaaagatgtttaagtgtgctcgtcagtctgaatttgacaagtag

SEQ ID NO: 3667 - DNA, 1560 bp, Saccharomyces cerevisiae
atgccctctaccacgctactgtttccgcagaaacatattagggccattccaggcaagatatacgcgttcttcagagagctcgtcagcggagttattatatccaagccagatctaagtcatcattattcttgtgaaaatgcgacaaaggaggaaggcaaagatgcagcagatgaagaaaagactaccacaagtttgtttcccgaatcaaataatatagaccgttctttaaatggtggctgctctgtgatcccttgctccatggatgtcagcgatttgaacacgccaatatcgatcacactatctcctgagaatcgtatcaaatcagaagtaaatgccaagtcactgctcggatcaaggccagaacaagatacaggcgcccctatcaaaatgtctactggtgtcacaagctctccattaagtccatcaggctccaccccagaacattccaccaaggtcttgaacaacggcgaagaggagttcatttgtcactactgtgacgctactttcaggattagaggatatctaacgagacatattaagaagcacgccatcgaaaaggcgtatcactgtccattttttaacagtgccactcctcctgatcttagatgccacaattcgggtggttttagcagacgcgatacttataaaactcatttgaaggcaaggcacgtgctgtaccccaaaggtgttaaaccacaagaccgtaacaagtcgtccggccattgcgctcaatgtggtgaatacttttccaccattgaaaatttcgttgagaatcacattgagtctggggactgtaaagctttaccgcaggggtataccaagaaaaatgaaaaaagatctggaaaattaaggaagatcaagacatctaatggtcattctagattcatatccacttcgcaaagtgttgtagaacctaaagtacttttcaacaaggatgccgtagaggctatgaccatagtggctaataacagttcgggcaatgatattatatccaagtacggaaacaacaaattaatgttaaactcggaaaactttaaagtcgacatacccaagagaaagagaaaatatatcaagaaaaagcagcaacaggtatctggatcgacggtaaccacaccagaggtagctacacaaaacaatcaagaagtggcacctgatgaaatctcatccgccacaattttttcaccttttgatactcatctactcgagcccgtcccttctagttcatcggaatcttccgctgaagttatgttccatggcaagcaaatgaagaattttttgattgacataaacagcttcacaaatcaacagcagcaggcacaagataatccttcgttcctgccactcgatattgaacaatcttcatatgatttgagcgaagacgcaatgtcatatcccatcatatccacacaaagcaaccgtgattgcacgcagtatgataacacaaaaatctcacaaatcttacaatcacaactaaatccagaatatctcagcgaaaatcacatgagagagacacaacaatatttgaatttttacaatgacaactttgggtcacaattttga

SEQ ID NO: 3668 - DNA, 1560 bp, Saccharomyces cerevisiae
atgccttccgaatcatccgtctctatctacaagcttgatcagttggagtatcagtaccattatttgacaaaatcattacagaagtttgaaccaagatatccaaaaactgccaaattatacaattgtataggtaaaaagaacaaaaagaaaattgaaaaactgttaaactctttagagttgaaaactttggacaaagaactagatgaaagttactcaaagttactcaataataagattcactattacgagacgcatttatcaaaatgtataaaagaacaaattcagaaaatatccaaaaaaaattctagtaaagtgaaggatgctcaaaaaaataaatcaccctctatagatattgaaaagatgcttgctacgcagttgtcattagatgatttagcactcttcatgacaagatttaggctgatcaaaatcttacaccagaggatcaaacaaaaaagcaaaaagattgaaggtgatacgaataataaaacttggttgaataacaatgattatagtggttatatcaatgataagacaagtaagtggaacccaagcaatatatggaatgaagttattacgaagctgccaagttgtgaaaagttaaacgcactaattggtcaaagtaaaatcgttcaaaatctaaccgaatcattcgatttgagtatttgtctcatatttggatttgatgtaagcgctatgaaagcaaagaagtatggagcaagggagaagacggccaatgctaatcagacgcactccaacattgactatgacaccgatgacggcaatgaaaagaatgccatcgatagcaaatctaatgcgatcggcgcacaaactcaaagcaataaagaaacaacgtccgacaatgaggatctattgataaaggaatacgagggaatgctaggcagttcaggagatgaaggggaaggcggcggatacttgaaccctaatatcaattacaatgaagtaacagatgaagaacctagcgaagcgtcatccgatgaggatgacagtgacgaacgcttcagcgactctgaagagaatgaaccaaggagaaaaaaaccaaaattgcataatttacctgaactaatggctggttattacagtggaaatgacactgaagaggaaagcgatgaagacaacaaaaatgttaagggaaagaagaaaaagagagacacagcagaagaccgtacggccagagagcagatgtcaaacgagccaaagaggaaaaacagacgtgggcaaagggcaagaagaaagatttgggaaaaaaaatacggctcacaagccaagcacgttcaaagggaattggaaaaggaaatggaagatagaaagcagaggcaaatcgagtacgaagcaagagtagctaagcgtgaagctaaagcagcatcattagaggcctctaggagtagggaacgcgaagacagacgtactgaaacgaacaataagaaagaaaaagaaagtgcatccactggagaagaacatccttcttggattgcaaaaagattagctgaagaaaaattacaaaaagctaaatttgaaggtaagaagatcaaatttgattga

SEQ ID NO: 3669 - DNA, 1560 bp, Saccharomyces cerevisiae
atggtcgctataatacctcatgcttcctttaccacaattaaactaacccagaaaactgagggaagccaaatgccaactgaggagatctgcaaaatcaatatgaggactcgtaaatttgatgtgggcgggaattctcgagattttgagtgcttttattcgaattttgttcaaactgttatattgttgggcacttttttttactgtgttgaaaggcttcagccgtggtccattgttaccgctgatatatcttataaacaaatctttgtaaatgtctttgtggtgtgtttgataatggttggtctgatattcacaaaatattggcaacatggttacaaaagcctacccaagttcgataccatttacagtttatatttaccgtttatggtttcgttgttgttcgatacatcatctacggtgataaatactattttgatcctttcggtattaaattcatatagatggcgaactcagttggtagtgatcattttacagctctgcctcatattttttaattttgaggctggtgacaggttaaagaatattattagcatagtaataaattctttactgtcgttaattttgaagtatattgggcaattgaaaagtttagataatatcgactctaatctttttagtatcctattaaccaatattctgtacgtttcagaggctggcacagtacattttagaattttgaagggcattatccttgctctcacaacaataatttcaattaactatgtgctcaaaaaggtaatgcactttaaaccgtttatgctgtcaatatcctttgccatcgggcttccactttttgccaataccttcattcatttagaagacggtgaaaatccgctactttggctggtaaaatatatcttagagtctactattcgtcaaaagattttgtttgcttggtcttcaattcttatactgtccataccaagtatattgatcgagaaggacagtctatcgttgaacacctcccgaaaattgtggcatttcatcattttcttactcataataccgtcattccaaatggattcaaactttgtgaaaattgcattgtccggaacaataccagtcttcttatcaattgagtacataagatttcaaaacctaccgccgttaggatctgctattgaattacaactaagaaggtttgctgatgatagggaccacagcgggccattgatcatatcatacctttatttactcttcggaatatcaacacctttattaatgaataactctccaatgggtctaataggattgggaattggtgattccttagcatctattattggtaaaaggtatggccgcattcgttggaaaggtacacaaaaaactttagagggaactcttgcgtttatagtaacgagttttatcgtttgtttggtattgttacgttttgataaagctgcaatttttaaccacctaactactttacaattgcttaccctttgtacactgagtggagtgctagaaggtaatagtgtgcttaatgacaatattttgatacctgcatttatgatgatttgtgaaaaattaattactctttga

SEQ ID NO: 3670 - DNA, 1560 bp, Saccharomyces cerevisiae
atgttacgctctcttcattctgcggctacgttatctaacaagaggttttactctctcatatctcattcaaatagaaagaacataatcaaaaagcttctacgtcacccttctttcgatccaattcgtcatcatttgcctgaagatataaccaccattgacccatactctctatcgcagaatgttatcgaaagtttaaacaaattagaggttcctaaaaaggatgcggccatggtacacaatatgatgatagaaaacttaagtgatcttgactacggcgttgcaacaattcactcaaataatttgcgtgatcttgatttaaaaccttcacttcccgccatcaaacaaattattaggaataatccaggaagagtacaaagctcttgggaactttttacacaatacaaggcctcaatggaaaatgttcctgatgaactgatggaagtggtcttagaaaaaattatcaagtttgacaaggcagaaaaggttgatggaaaaaagagtctgacttatcaagacctcgttagatgtctttatttaatcaaccatttttcttcaaattataatttgccttcagagctcgtggaacctatccttatttacatagtggacaacggaattcccaatgttttaggttctgtactcaaatataaaataccgctgagcttttttgataagtatgtcagtgaaatgacacaataccaaatttgtgaactttatgatttttattcgcttgataatatagtagctgatccattagtactacacaagtgtctaactgttctgggcgaaaacgagaaaattcagcaaactgaagaagaaaaagaaattattagcaagttggaggaagaaatagatattgttaaatcacaatgtcatgataattggagcctcgaatttccgaattggagtgtacgcaaaactgcaacttcattcgaagaattatttttagagatccaaaaaagaaacatagacaagaaggatttcgaattagctcacaagctgttaagattaattggcgctttcaaaggtaaagtttctctattttttaaattatacgacgaatatctcttaaaattcaaaaataatgaggacgacttaatgtttgaagcgtttttaacgctctgctgccagggttataaaagcagtaatgaaaaaatgctacaatacgctgaagcttttattaaagaagactttgattccaaactagagagtaaaattcaaagtgtgttaattgttgctaacgcgaaagcaaatattgatctatctctcaaaatttacaattctaatatatctactgctaaacgagagaaagataagtacacagatcttgctgaaagtgacgtattaactgaatcgctcattttagcattcttatccagagatgatgctgattttgccagggtcatctttgatggcgcactaggagaaaagctgatatcagggccgactgctgcaaaaaaaataaaaaatctcttagcccagtatggagaagcgttagaaacaaaaacaagcaaacaagttatgcagactaagatagaacattatatggaaagcatataa

SEQ ID NO: 3671 - DNA, 1560 bp, Saccharomyces cerevisiae
atgttcagtagatctacgctctgcttaaagacgtctgcatcctccattgggagacttcaattgagatatttctcacaccttcctatgacagtgcctatcaagctgcccaatgggttggaatatgagcaaccaacggggttgttcatcaacaacaagtttgttccttctaaacagaacaagaccttcgaagtcattaacccttccacggaagaagaaatatgtcatatttatgaaggtagagaggacgatgtggaagaggccgtgcaggccgccgaccgtgccttctctaatgggtcttggaacggtatcgaccctattgacaggggtaaggctttgtacaggttagccgaattaattgaacaggacaaggatgtcattgcttccatcgagactttggataacggtaaagctatctcttcctcgagaggagatgttgatttagtcatcaactatttgaaatcttctgctggctttgctgataaaattgatggtagaatgattgatactggtagaacccatttttcttacactaagagacagcctttgggtgtttgtgggcagattattccttggaatttcccactgttgatgtgggcctggaagattgcccctgctttggtcaccggtaacaccgtcgtgttgaagactgccgaatccaccccattgtccgctttgtatgtgtctaaatacatcccacaggcgggtattccacctggtgtgatcaacattgtatccgggtttggtaagattgtgggtgaggccattacaaaccatccaaaaatcaaaaaggttgccttcacagggtccacggctacgggtagacacatttaccagtccgcagccgcaggcttgaaaaaagtgactttggagctgggtggtaaatcaccaaacattgtcttcgcggacgccgagttgaaaaaagccgtgcaaaacattatccttggtatctactacaattctggtgaggtctgttgtgcgggttcaagggtgtatgttgaagaatctatttacgacaaattcattgaagagttcaaagccgcttctgaatccatcaaggtgggcgacccattcgatgaatctactttccaaggtgcacaaacctctcaaatgcaactaaacaaaatcttgaaatacgttgacattggtaagaatgaaggtgctactttgattaccggtggtgaaagattaggtagcaagggttacttcattaagccaactgtctttggtgacgttaaggaagacatgagaattgtcaaagaggaaatctttggccctgttgtcactgtaaccaaattcaaatctgccgacgaagtcattaacatggcgaacgattctgaatacgggttggctgctggtattcacacctctaatattaataccgccttaaaagtggctgatagagttaatgcgggtacggtctggataaacacttataacgatttccaccacgcagttcctttcggtgggttcaatgcatctggtttgggcagggaaatgtctgttgatgctttacaaaactacttgcaagttaaagcggtccgtgccaaattggacgagtaa

SEQ ID NO: 3672 - DNA, 1563 bp, Saccharomyces cerevisiae
atgaatacaaacgttccaatattcagttctccggtcagagatttaccaaggtctttcgaacaaaaacatttagcggttgtagatgcatttttccaaacataccatgtcaaacctgattttatcgctaggtctcctggcagagtaaatctgattggtgagcatatagattattgcgatttttcagttttgccattagccattgatgtggatatgctttgcgcagttaaaattttagacgaaaaaaatccatccattaccttaacaaatgcggaccctaaatttgctcagcgaaagtttgatctgcctttagatggttcctacatggccatagatccgtctgtgtcggaatggtcgaattactttaaatgcggactacatgtggcacattcatacttgaaaaaaattgctccggaaagatttaataatacacccttagtaggtgcgcagatcttttgccagagcgatattcctactggtggtggactctcatctgcatttacttgcgcggcagcactagccacaattagagccaatatgggaaaaaattttgatatttccaaaaaagacttgacccgcatcacagcggttgctgagcactatgttggagtcaataatggtggtatggatcaagcaacgtctgtttatggggaagaagatcatgctctatacgtagagtttaggccaaaactaaaggccacacctttcaagtttcctcaattgaaaaatcatgaaatcagtttcgtcatcgccaatactcttgtaaagtctaataaattcgaaactgctcctacaaattacaatttaagagtaatagaggtaacagttgctgccaacgccttggcgaccagatacagcgtggccttaccatctcacaaggacaattctaactcagaaagagggaatctaagagattttatggatgcttactacgccagatacgaaaaccaagcccaaccatggaatggagatatcggaactggtattgaacgtttactcaagatgctacaattggtagaagaatctttctcgaggaaaaagagcggattcactgtacatgaagcctctacggcgctaaactgttcacgtgaggagttcactagagattacctgacaacttttcccgtccgcttccaagtcttgaaactatatcaaagagctaaacacgtttactccgaatccttaagggtgcttaaggctttaaaaatgatgacaagtgccacttttcacacggacgaagatttctttacagattttggccgactaatgaatgagtcccaggcctcttgtgataaactttatgaatgttcgtgcatagaaaccaatcaaatatgctcgattgccctagcaaatggttctttcggctcccgtctcactggcgctggttggggcggttgcactatccaccttgttcctagtggcgctaatgggaacgtggaacaggtacgaaaagcactaatcgaaaaattctacaatgtaagatatccggatctcacagatgaagaactaaaagacgcaattatagtttcgaagcctgccttgggtacttgtttgtacgaacaataa

SEQ ID NO: 3673 - DNA, 1563 bp, Saccharomyces cerevisiae
atgagagtcagaaagcgccaatctagaagaacatctaccaagttgaaggaaggtattaagaagaaggcttctgcccatagaaaaaaggaaaagaagatggctaagaaggacgttacttggagatcaaggtctaagaaagaccctggtattccttctaactttccttataaggctaagatcttagaagaaatagaagccaaaaaaatgaaggacttagaggaaagagagcttgccaaacaacaacgattggaggctaggaaagctgccaaggaacaaggcgttgatgcaatggatgaagacatgatagaagacgatgaaaatggattagcagctttggttgagtctgctcagcaagcagctgctgaatatgagggcacaccctctaatgatgcagatgttcgtgatgatgaattggacgtcattgattataacattgatttctacggtgaagatgtagaaggcgagtcagaacttgaaaaatctaggaaagcttatgacaagattttcaaatccgttattgatgcttctgatgtcatcctatatgttttggatgccagagatccagagagtacaagatcaagaaaggtggaagaagccgtcttacaaagtcagggtaaaaggctgattttaatactgaacaaagttgatttaattcccccacatgtattggaacaatggttaaattacttaaagtctagttttcctacaatcccattaagagcttcttctggtgcagtcaacggaacttctttcaacagaaagctaagccaaaccactactgcaagtgcactgctagagtcgctgaaaacttactctaataacagcaatttgaagagatctattgtagtgggtgttatcggttatccaaatgttggtaaatcatctgttatcaacgctcttttggcgcgccgtggaggtcaatcaaaggcttgcccagtcggtaatgaagcaggtgttactacctctctgagagagatcaaaatcgacaacaagttgaagattctagattctcctggtatatgtttcccaagcgaaaataagaaaagatcgaaagttgaacatgaagctgaattagctcttctaaatgctctaccggcaaaacacattgttgatccgtatccagctgtcttaatgttggtaaagagactagctaaatcagatgaaatgacagagagctttaaaaagctgtatgaaattcctcctattcctgctaatgatgcagatacgtttacaaaacatttcttaattcacgtcgctcgtaaaagaggtagattagggaaaggcggtattccaaatcttgccagtgctggtctttcggtacttaatgactggagggatggtaaaattcttggttgggttttaccaaatacatcggcagctgcatctcaacaagataaacaaaatctaagtactataaacactggcactaaacaagctccaattgcagcaaatgaatccaccattgtatccgagtggtccaaagaatttgatttggatggattatttagctctcttgacaaggccatagatgctagcaaagatcaagatacaatgatggaataa

SEQ ID NO: 3674 - DNA, 1563 bp, Saccharomyces cerevisiae
atgagtttaaaggaggaacaagtgtccattaagcaggacccggaacaagaagagcgtcagcatgatcaattcaatgatgttcagatcaaacaagagtcgcaggatcatgatggagtggactcgcagtacacgaacggtacgcaaaatgacgacagcgagagatttgaggcagctgaatccgatgtaaaggtggaacccggcctcggtatgggcatcacctcctctcagagcgaaaagggtcaagttctgcctgaccaaccggagattaagttcattcgtcgtcaaatcaatggttatgtagggtttgctaatttgcccaagcaatggcacagaaggtccataaagaacggattcagtttcaatctcctatgtgtcggccctgatggtattggtaagacaactttaatgaaaactttatttaataatgatgatattgaggccaatttagtgaaagattacgaggaggaacttgcaaatgatcaggaagaagaggagggtcagggcgagggtcacgagaaccaatcacaagaacaaaggcacaaggtcaaaattaagtcatatgagtcggttattgaagaaaatggtgttaaactgaatttgaacgtgatcgatactgaaggatttggtgattttttaaataatgatcaaaaatcatgggacccgatcattaaggagattgactctcgttttgatcaatacttggatgcggagaacaaaatcaacagacattcaataaacgataaaagaatccatgcatgtctttatttcattgaacctacaggacattacttaaagcccctggacctgaagtttatgcaatctgtatatgaaaaatgtaacttgattcctgtcattgctaaatctgacatcttaactgatgaagagatcttaagtttcaagaagaccattatgaaccagttaatccaatctaatatcgagctgttcaagcctccaatttattccaacgatgatgcagaaaatagccatttatccgaaagactatttagtagtttaccttatgctgttattggttccaacgatattgtagagaactacagtggtaatcaagtgagaggccgttcctatccatggggggtgatcgaagtggacaatgacaaccactctgatttcaaccttttgaaaaatttattgatcaagcaattcatggaggaattaaaggaaaggacaagcaagatactatacgaaaactacaggtcttctaaattggcaaaacttggtattaagcaagataattcagttttcaaagagttcgatccaatatctaaacaacaagaagaaaaaactttacatgaggcaaaactagccaaactagaaattgaaatgaaaacagttttccaacaaaaagtttccgaaaaggagaaaaaactacaaaaatcagaaactgaattgtttgctagacataaagaaatgaaggaaaaattaactaaacaattaaaagctttggaggacaagaaaaaacagctagaactttcaataaatagtgcttctcccaatgttaaccactcccccgtccctacaaagaagaagggatttttacgttag

SEQ ID NO: 3675 - DNA, 1563 bp, Saccharomyces cerevisiae
atgctttctcgcacaagagctgcagctccgaattccagaatattcactagaagcttgttacgtctttattctcaagcaccattacgcgttccaattactcttccaaatggtttcacctacgaacagccaacagggttattcatcaatggtgaatttgttgcctcgaagcaaaagaaaacgtttgacgtgatcaatccatctaacgaagaaaagataacaactgtatacaaggctatggaagatgatgttgatgaagccgttgcagcggctaaaaaagcttttgaaacgaagtggtctattgtagagccggaggttcgcgctaaagctttattcaatctcgctgacttggttgagaaacaccaagaaacactggctgccattgagtcaatggataatggtaagtcattgttttgtgcgcgcggtgacgtcgctttagtatctaaatacttgcgttcttgcggtggttgggcagataaaatctacggtaacgttattgacacaggtaaaaaccattttacctactcaattaaggaaccattaggcgtttgcggccaaataatcccttggaacttccctttattgatgtggtcatggaaaattgggcctgctctggctacaggtaacaccgtcgtattgaaacccgctgaaacaacacctttatctgcccttttcgcttcccagttgtgtcaggaagcaggcatacccgctggtgtagtcaatatccttccgggttccggtagagttgttggagaaagattgagtgcacacccagacgtgaagaagattgcttttacaggctctactgccaccggccgccatattatgaaggtcgctgccgatactgtcaagaaagtcactttggagctgggaggtaaatcaccaaatattgtgtttgctgacgctgatctagataaagccgtcaagaacattgccttcggtattttttacaactctggtgaagtttgctgcgctggttccagaatatacattcaagatacagtatacgaggaggtgttgcaaaaactaaaggattacaccgagtcactaaaggtcggtgacccatttgatgaggaagttttccaaggtgctcaaacatctgacaaacagctgcataaaattttagactatgtcgatgtagcaaaatcagagggggctcgtcttgtgactggaggggccagacatggcagtaaaggttattttgtcaagccaacagtgtttgctgatgtcaaagaagatatgagaattgttaaggaggaagtgtttggtcccattgtaactgtatccaagttttctactgttgatgaagtgattgctatggcaaatgattctcaatatgggttagccgcaggtattcacactaacgatattaacaaggctgttgatgtgtccaaaagagtgaaagctggtactgtttggataaatacctataacaacttccaccaaaatgttcctttcggtggcttcggccagtcaggtattggccgtgaaatgggtgaggctgctttaagtaactacactcaaacaaaatctgtcagaattgccattgacaagccaattcgttga

SEQ ID NO: 3676 - DNA, 1563 bp, Saccharomyces cerevisiae
atgtcatcaagcgaaaacacgttactggatggaaagtcagagaacacaatacgatttttaactttcaatgtcaatggtataagaaccttttttcattatcaaccattttctcaaatgaatcaatcccttagatctgttttcgacttttttcgagcagacataataacattccaagagctcaagacggaaaaattgtctatctctaagtgggggagagttgatggtttttattcttttatttctatccctcaaaccagaaagggatattctggcgttggctgctggattagaattccggaaaagaaccacccactataccatgcattacaagtcgttaaggcagaagaaggtataacgggttacttgacaataaaaaatggtaagcattcagcaatctcctatagaaacgacgtaaatcaaggaattggtggttacgattctttagatcccgatttagatgagaaaagtgcactggaactagattcagaaggcagatgtgttatggttgaactggcatgtggaatagttattatcagtgtatattgtcccgcaaattcgaactcatcggaggagggtgagatgtttagattaaggttcttgaaagttttattaagaagagttcggaatttggacaaaattgggaagaagattgtgctaatgggcgacgtaaatgtttgccgggatcttatagacagtgccgatacattagaacaattctcaattccaataacagatcccatgggtggaacaaagttagaagcacaatatagggataaagcaatccaatttattatcaatccggacacgccacatcggaggatatttaatcaaatattggctgattcacttttaccagacgcgagtaaaagggggatactgatagacactacgaggctaattcaaacaagaaatcgacttaaaatgtatacagtctggaatatgttaaaaaatttaagaccttcgaattatggctcacggatagattttatcctagtgtccttaaagcttgaacgatgcataaaagcagctgacattcttccggatatattgggctctgaccattgtcctgtgtattctgatttagatatactggacgacagaattgaacctggtacgacacaagttcccataccaaaattcgaagcaaggtacaaatataatttaagaaaccataatgttttagagatgtttgccaaaaaggatacgaataaagaatctaataaacaaaaatattgtgtatcaaaagtcatgaataccaaaaaaaacagcaacatcaaaaacaaatcgctcgactcatttttccagaaggtaaatggagaaaaagatgacaggattaaagaatcctctgaaattccacagcaagctaaaaaaagaatctccacgccaaagttgaatttcaaggatgtctttggaaagcctcccctgtgcaggcatggggaggaatccatgctgaaaacatcgaaaacttcggccaatccaggtagaaagttctggatttgcaagagatctcggggtgattcaaataatacagaatcatcttgtgggttttttcagtgggtttaa

SEQ ID NO: 3677 - DNA, 1563 bp, Saccharomyces cerevisiae
atgttgaaatctgcaagccaaaacttttttagagcttattctagtagaattggtcgatatgctgctacagcatcagggaaactggcacagtctcgtttatcgaatatacccactccaaaagcattgaagaaattcctcgatgagtacattgttggtcaagagattggtaagaaggttttaagcgtggcagtttataatcactatttaagaatcaatgacaagcaaaagaaaggggaattacaaaggcagagagaattgatggaacgagagaaaatcgcggatgatagggatgaaccaattttcagtggaaacagcgaatcaaaggctggttggaggaatcttcaaagacagtttaatttagcaggtagagaggttgacgaagatttagagttaagcaaaagtaatgtccttgtcgttggtccctcaggttctggtaagactttgttggcaacaacattggcgaaaatattaaacgttccaattgcaattacagattgtacacaattgactcaagcaggttacataggtgaagatgttgaagtatgcattgaaagattgctcgtaaatgctgaatttgatgttgcgagagcagaaaaaggtattattgttcttgatgagattgataaactagccaagcctgccgcaagcattggcactaaagacgtgtccggagaaggggttcaacagtcattattgaaaatcattgagggccataaagtggaaattaccgttaaaaggcctgttaagcatgatattgacggacaaaaaaatcaaactacaacaaagaaggacgaagtatttgttgtagacacttcaaatattcttttcatgattatgggagcttttgttggtttagataagcatattgttaaaaggatagaagatatgaagaaaatacagaaggcaggagagtctgttgaatcatcgaatagtaaagaagttgaaaaagaaagagcgaagaagttcagatttagcaatacgcttgagcaggttgaattagataacggaaaaaaagtgtgtgctttagacttgaccacccccacagatttagttagctttggtctaattcctgaattaattggcagagtcccaattataactgctctgcagcctctacaaagagacgatttatttcatatattaaaagaacctaaaaatgccttattggatcaatatgaatatatttttaagcaatttggggtaagattgtgtgttacacaaaaggcgctaaagaaagttgctcaatttgctctcaaggaaggaactggcgccagagggttgagagggataatggaaagacttctgctaaacgttaattatgattgcccgggttctaacatagcatacgttttaatcgacgaagctactgtcgactcgttacaggaaacagagcactctttggcttcccaagtggacgtaaaatactattctggtgatgaaaaggacagtttaattcgtgacgtttctgaagaagataaaaaattaggagttatgctagaaaaagagttgggtcattctgctaacattcataccccaacaattcccaagagaagcttaacataa

SEQ ID NO: 3678 - DNA, 1563 bp, Saccharomyces cerevisiae
atgttgcataaaagcccttcaagaaagagatttgcttctcctttgcatctaggatgcattctaacgcttacagtgctctgccttattgcttactactttgctttaccggattatttatcggtagggaagagctcatccaggggtgccatggatcaaaaatctgatggaacctttagacttaagtctatctacaggcatggcgtcggagcaaaccatcggctacaccagaggctggaggtcactccagaagttatttctgccgctggaatgctgtatcaagaaaccacaactcaaggacaggatttcgaagaccaagaacccctatggactactaatgccgaatatgccaccactaacccattcgattttgagtttgagctacgaaggatgccgctattgatgaagcggatgaaggaaagagatcctgaattcatagagtcgtacatttacggagaaacatacatgacggaggaggaagaacacgccatgtggatagatgatgacattgtggcacccaatatcacagatagaggtacagtagtgtcgttagcattaatgtcgtctaatgcttacgtgagaataccgcaaacgggagactggcgtaacgtcacggagccgtggaatgaaacagagccggaagattttggttgggatggtgatggtatacgtggtcacgtcttttacaatgaagtggagaatatcgtggtactctcgataaagggaaccagcgctcagggtttgccagggtctggcgaagatgagacaactggaaacgacaagatcaacgataatttgttattttcgtgttgttgtgcaagagtgagctacctgtggactaccgtgtgcgattgctatgtgaagtcgtatatatgcgatgagtcttgcctggaaaaggaactgagacgtaaggatagattttactctgcagtcgttgacatatacaaaggcgtcctcaaagaataccccgatgcggccatatgggtcacaggccactcactgggaggcgcattggccagtttactgggccgcacttttggattgcctgcggtcgcattcgagtcccctggagagctactaccttcaaaaagacttcacttaccattcccaccgggacttccctcatacatggagggtatctggcacttcggtcacaacgcagacccaatcttcatgggtacatgcaacggagctagttcaagttgctcactggtgggctacgctatggaaaccgcgtgccacactggtagagtctgtgtctacgatgtggtcaacgacaagggctggagtgtaaacatgttcaaccacagaatccacaaagtcattgacgaagttctccttggatacgagcaggctgccaagtgcgttgaaccagagccctgcgtagattgctacaactggaagtttattccaagcagagactgggaatcctcatcgaggctcattaccaagactaaaagccacgctgcaccaaccacgacgactcgcaccactgctactactacctcttcatctacctgtgtaggccgcaattggcttggcttctgcaccaaatacgagttgtaa

SEQ ID NO: 3679 - DNA, 1565 bp, Saccharomyces cerevisiae
atgtcccaaggtactttatacattaatagatctccaagaaactacgcttctgaagctttgatttcttactttaaactagatgtcaagatcgttgatctagaacaatctagcgagtttgcttctttgttcccattgaagcaagcccctgcatttttgggtccaaagggcttaaagctaactgaagctttggctatccaattttattgtatgttccatattttattttaacacttccacatacattgttttgcgcgtttcccgttcgtttatttggcacgtcatttttcttcgaaacataatgatgaaaaaaaattttatcaaacagttatccctgtctgaatgggtaataataggtaacctctcatatgttgatatttgtatttctgatatgtttcttaaagaaaaatgaaagtcaaaataacaaaaaggaagtacaaagcgtgtcctaatccaggaaaaaatataaaggattgttttactaacatttcttcaattaatggttgtataaccatcgagatgatgtatatttagtggctaatcaagttgccgatgaaaaagaaagagctcgcttattaggttccgacgttatcgaaaagtctcaaatccttagatgggcatctctagctaattccgatgtcatgagcaacattgctcgtccattcctttctttcaaaggtttgattccatacaacaagaaagacgttgatgcttgttttgttaaaatcgacaacctagctgctgtcttcgatgctagattgagagactacacctttgttgctaccgaaaacatttctctaggtgaccttcatgccgctggttcttgggcttttggtttggccactattttgggccctgaatggagagctaagcatcctcatttgatgagatggttcaacactgttgctgcttctccaatcgtgaagactccatttgctgaagtcaaattggctgaaaaggctctaacctacactccaccaaagaagcaaaaggctgaaaagccaaaggccgaaaagtcaaaggctgaaaagaagaaggacgaagctaagccagcagatgatgctgctccagctaaaaagccaaagcacccattggaagctttaggaaagtccacatttgtcttggatgactggaagagaaagtactccaacgacgacaccagaccagttgctttgccatggttctgggaacactacaaccctgaagaatactccatctggaaggttggttacaaatacaacgacgaacttaccttgactttcatgtccaacaacttggtcggtggttttttcaacagattgtccgcttctactaagtacatgttcggttgtttagttgtctatggtgaaaacaacaataatggtattgttggtgccgttatggtcagaggccaagatttcgctccagcctttgatgtcgctccagactgggaatcttacgaatacaccaagttggacccaaccaaggaagaagacaaagaatttgtcaacaacatgtgggcttgggataagcctgttgttgtcaatggcgaagataaggaaattgttgacggtaaggttttgaaataa

SEQ ID NO: 3680 - DNA, 1566 bp, Saccharomyces cerevisiae
atgacgactcgtttgctccaactcactcgtcctcattacagattattatccctacctctccagaaacccttcaatataaaaaggcagatgtccgctgcgaacccttctccatttggcaattatttgaacacgatcactaagtccctacaacagaatttacaaacatgctttcatttccaagcaaaagaaatcgatataatcgaatctccatctcagttttacgatctcttgaagacaaaaatacttaattcacaaaatagaatattcattgcgtctctgtatttaggcaaaagcgagactgagttggtggactgcatatcccaggcattgaccaagaaccccaagttgaaagtttcttttctacttgatggccttcgaggaacaagagaattgccttccgcctgttccgccactttattatcgtctttagtagccaaatatgggtcagagagagtggattgccgattgtacaagacgcctgcttatcatggttggaaaaaagtcttggttcccaagagatttaatgaaggtttaggcttacaacatatgaaaatatatgggtttgataacgaggtcattctttcgggagccaacctttcgaacgactatttcaccaacagacaagatagatactatctctttaaatctcgaaacttctccaactattattttaaattacatcaactcataagttccttcagttatcagattataaagccaatggtggatggtagcatcaacatcatttggccagattcgaatcctactgttgaaccgacgaaaaataaaaggctgtttttaagggaagcatctcaattactagatggctttttaaagagttctaaacaaagcctcccgattactgccgtgggtcaattctccacattagtttacccaatttctcaattcactccactttttcccaaatataatgacaaatcgaccgaaaaaagaacaatattgtcattgctttccactataacaagcaatgccatttcttggacgttcactgcaggatacttcaatattttgccagacatcaaagcaaaactgctggcaacgccggttgctgaggcaaatgtaataacagcttccccctttgcaaacggcttttaccaatcaaagggcgtctcatcaaatttacctggtgcttacttgtacctgtcaaaaaaatttctacaagatgtatgtaggtacagacaagatcatgctattacattaagagaatggcaaagaggcgtagtaaataagccgaatggttggtcatatcacgcaaaaggtatttggctttccgctcgtgataaaaatgatgctaacaattggaaaccctttatcacggttataggatcttcaaactatacgagaagggcgtattcattagatttggaatcgaatgctctcattattacaagagatgaagagctaagaaaaaaaatgaaagcagagttagataatttattacaatatacaaaacctgtaactctagaagactttcaatcagacccagaaagacatgttggcactggtgtaaagatagctacctccattttgggtaaaaaactttag

SEQ ID NO: 3681 - DNA, 1566 bp, Saccharomyces cerevisiae
atgagctcagacagtttaacgcctaaagacactatagttccagaagaacaaaccaaccaactgcggcaacctgatttagatgaggatagcatacattatgatccagaagctgatgatttagagtcattagagactactgcctcttacgcgtcaacgtcggtgtcggcaaaggtgtataccaagaaggaagtaaataaaggaactgacattgaaagccaaccacattggggtgaaaatacctcgagcacgcacgacagtgacaaagaagaagattccaatgaagaaattgaaagcttcccggagggtggattcaaggcttgggttgtgacatttggttgcttcttgggtctaattgcatgctttggtttattaaactcaacgggggtcatagaaagtcatctacaggacaatcaattatccagtgaaagtgtttctaccattggttggctgttttctttgtttctttttgtttgctctgcctcatgtatcattagtggtacttactttgatagaaatggatttaggacaattatgattgtgggcacggtttttcatgtagccggtctgttcgctaccgccaactctactaaatattggcacttcatactgtcctttgccattgtctgcgggttcggtaatggtattgtactgagtcccctagtaagtgttcccgcccactatttttttaagagacgtggtactgcattggcaatggccactattggtggtagtgtgggtggcgtcgttttcccaattatgttgcgtagtttcttctctatgaagtcagacactgatccaacttatggatttgtttggggcattagaactttaggatttttagatttggctttgctaactctgtcaatcattttagtcaaagagaggttaccacatgttatcgaaaattccaaagatggtgagtcacgttggagatacatactcagagtttatattctgcaatgttttgatgcgaaggctttcctggatatgaaatatcttttttgtgtcctgggaacggtatttagtgagttatccattaattcagctcttacttattatggatcatacgccaccagccatggaatttctgctaatgacgcctacaccttgattatgattataaatgtctgcggcatacccgggagatgggttcctggctatttgagcgataagttcggtaggtttaacgtcgcaattgcaactctactcactctatttatcgtcatgtttgttggttggttaccatttggtaccaatttgacaaatatgtacgttattagtgccctatatggattttgttctggaagcgttttctccttacttcctgtttgctgtggccagatatctaaaacggaagagttcggtaaacgttactctacaatgtacttcgttgtcggtttcggtactttagtcggcattccgataacaggtgccattatctctatcaagacaacggccgattaccaacactatattattttttgcggtttggcaacttttgtaagcgctgtttgctacataatttcgagagcatactgtgttggcttcaagtgggtcagattttaa

SEQ ID NO: 3682 - DNA, 1566 bp, Saccharomyces cerevisiae
atgtcccatctcttcccaccatcatcaccagttgctggtaaacctttggaaagcccacaaaaagaacctggtaagcttgctaatacttctgtattgaccttaggaagaaaacggtataattacgaattggaagagtatcctactccagacccgtcgtctagcatcggaagacaatcttcaccagtgaaagatatcacttcacgtttaaatgagaccaaatctgccttgtcatctccttcaaagcaagaaaaggtgcttgcaggccctatcgagattgaattagatgcatcggatccctcacgtttagccatcggtaggaaaaaatcagtctgcaacattattttgccatgcagaaagaatatctctaggcagcacgcttttatttcatacgccgccgacagaaatgaaataaaattggaatgtaatggaactaatgggttgtccgttcacttgccttactccatgcagttgcatttggtaaaacccttcccaacaaggaacttttataaactagtggcagaagagcctttgacctcgcaaaatactaaacaatcgcatggaaaaactcttcaaaagaaccaaaacttcatcagctttgttttggctaaaggtgaaactgttactttcccctatatccaaggaagtttcataaattttacaggcgtcacagtctgtctttcattgaaaaaagtagcaccttatcctggcgatggcaacaataactttgacgaagagaactcgacagaaacggaggatgagttgtgtttattaacaacaacgagcgatgatttttcttggcaaaaagaaacaccttcgatgaaatttgtcccagttgagcattcacctcgtacagaacagatctcaaaaccattacttattgcatctcctgctcttgtgaaaaactcccccattagttatagaacaacaccccaaacatctttcgttattaatcagccatcaactccaaagaaactgaagcgtaaatcaatttcattgaaaaataacactatacaagagacaccacttcctaaagataaaataattgggacattaagtgccagtactaggagtggtggcattaatgaagaagaatctttcgcagcagttgcaaaaaaaactaaagagctgtcttctacaaccgcgattgtatctcctgcacaaaaacgtcttaagacttcattgaatattattcccgaaatttctcggtcgctctcagaaagaggaattcggtttgatgacctagttcatgtgctatgtaatcatcttgcattttctaaccttcaacaaacgcctttatcccaattgcaaaacatcaattccaacacttcacaattaagcaaagatgaactaaaaaaggtcttggagactatttcttgcattggtattattgtgcgtgaaggaaaagatgcgtctggcaagccattagaagacgagtattactatgatgttgaaaacgatgatagcgacgagagaaagattttgtataattcgttaaaaggcaggagccgattaaggtcgtgcaggaagaaacataaacagtatttctggaagaggccgaccaaataa

SEQ ID NO: 3683 - DNA, 1569 bp, Saccharomyces cerevisiae
atgaagttttctgctggtgccgtcctgtcatggtcctccctgctgctcgcctcctctgttttcgcccaacaagaggctgtggcccctgaagactccgctgtcgttaagttggccaccgactccttcaatgagtacattcagtcgcacgacttggtgcttgcggagttttttgctccatggtgtggccactgtaagaacatggctcctgaatacgttaaagccgccgagactttagttgagaaaaacattaccttggcccagatcgactgtactgaaaaccaggatctgtgtatggaacacaacattccagggttcccaagcttgaagattttcaaaaacagcgatgttaacaactcgatcgattacgagggacctagaactgccgaggccattgtccaattcatgatcaagcaaagccaaccggctgtcgccgttgttgctgatctaccagcttaccttgctaacgagacttttgtcactccagttatcgtccaatccggtaagattgacgccgacttcaacgccaccttttactccatggccaacaaacacttcaacgactacgactttgtctccgctgaaaacgcagacgatgatttcaagctttctatttacttgccctccgccatggacgagcctgtagtatacaacggtaagaaagccgatatcgctgacgctgatgtttttgaaaaatggttgcaagtggaagccttgccctactttggtgaaatcgacggttccgttttcgcccaatacgtcgaaagcggtttgcctttgggttacttattctacaatgacgaggaagaattggaagaatacaagcctctctttaccgagttggccaaaaagaacagaggtctaatgaactttgttagcatcgatgccagaaaattcggcagacacgccggcaacttgaacatgaaggaacaattccctctatttgccatccacgacatgactgaagacttgaagtacggtttgcctcaactctctgaagaggcgtttgacgaattgagcgacaagatcgtgttggagtctaaggctattgaatctttggttaaggacttcttgaaaggtgatgcctccccaatcgtgaagtcccaagagatcttcgagaaccaagattcctctgtcttccaattggtcggtaagaaccatgacgaaatcgtcaacgacccaaagaaggacgttcttgttttgtactatgccccatggtgtggtcactgtaagagattggccccaacttaccaagaactagctgatacctacgccaacgccacatccgacgttttgattgctaaactagaccacactgaaaacgatgtcagaggcgtcgtaattgaaggttacccaacaatcgtcttatacccaggtggtaagaagtccgaatctgttgtgtaccaaggttcaagatccttggactctttattcgacttcatcaaggaaaacggtcacttcgacgtcgacggtaaggccttgtacgaagaagcccaggaaaaagctgctgaggaagccgatgctgacgctgaattggctgacgaagaagatgccattcacgatgaattgtaa

SEQ ID NO: 3684 - DNA, 1569 bp, Saccharomyces cerevisiae
atgccggaattaacagaatttcagaaaaaacgtttagagaacatcaaaaggaataacgatttattgaaaaaactccatttgtctggagtagcatctcaaattaagcacgaggctggggtgttggaaaaatctagagctcctgcaaaaaagaaacaaaaaacaactaataccagagcaaccaagtctgcgagtcccactttacctacacgaagatcaagaaggctaaggggtgagtctgcagacgatgtgaaaggaatacccaatgtgaacgataatcagttgcttaaaatgggttctccagatggccaggataagaattttatagacgcaataaaggagaaacctgtaataggagatgtgaaattaagtgatctgatcaaggatgaagacgaaagtgcccttttagagaaattcaagaggtttaataacggaaacttttcttctggtgatttctttgaagaaataaaaaagagacagggtgacgttacggggatggacgaatttgatttggatctatatgacgtttttcaaccgaacgaaattaagattacatacgaaagaatctctgccacttacttccatcctgctatggaaaaaaagctaataattgcaggtgatacaagcggtactgtgggtttttggaacgttagagatgaaccactagctgacagcgaagaggaccgaatggaagaacccgatatcaccagagtgaaactatttaccaaaaacgtcggccgtattgattgcttccctgcggacacatcgaagatattgctcacctcttacgacggaagcatcaggtcagttcacttgaataacttacagagtgaagaggttctcaccttgaaaaatgaatatgacgattcactgggtatcagcgattgccagtttagctacgaaaacccaaatgttttattcctcaccacattaggtggtgaattcaccacgtttgacacaagagtaaaaaaatcagagtataatctgcgaagactcgcagacaagaagatcgggtctatggcaataaatcccatgagaccctacgagattgccaccggatcacttgatagaacactcaaaatctgggatacaagaaaccttgttaaaaagccagagtggtcacaatatgaagactatcccagtcatgaaattgtctccacatatgactcaagattgagcgtctctgcagtttcttactcaccgacagatggcaccttagtgtgcaatggctatgacgataccatccgcttattcgatgtcaagagtagggatcacctttctgcgaagttggagcccaaactaacgattcagcacaattgccaaacaggaagatggacaagcatcctcaaggccaggttcaagccgaacaagaatgtttttgcaatagctaacatgaagcgcgccatcgacatatacaacagcgaaggccagcaactggctcacctacccacagctactgtcccagctgtaattagttggcacccgctgcgaaactggattgcaggtggtaattctagcggcaaaatattcctctttactgatgactccggaaccataaagcaggaagaatga

SEQ ID NO: 3685 - DNA, 1569 bp, Saccharomyces cerevisiae
atggcattggcaaattccagacctttgcaaataccaactttagagaatgaaattcttcataactcaaattctccagtatttcagttgaattcaatgggatttacaactagagctgacactatttcgaatccaggcacggatcttatcggcaaccagccaggcatggcccttgatgataataatttggccggttcttcgttttcctcatctcaggaaataaaagctaccaaacctaagaaggactttggtgctcccaaaaaagacaatccattattagaaatttctaagctaatacctgttactggtgagaggccaaaacccgaaaatagagactcccctctggatgatgacgttcttcacgcagtttttttaatattatgggaaatggatccgaatcaacaaggcatgaccgtcaaacaactgtgtgacttgcttttgcaaaaacatccagatatgtccaatttatcaaccaagttgtcaaatttaatttccgcaaaactgaacgcttatgttaaaaaaattgaaaaaggtgagaaaacgttaacttatgctttatcaagggaatggtctaattcatctcctagaaggatgctctatatatacagaggcatattatctcccgattacaaggagcatgctcaagctgttacgatgcaacttaaacaacaattggagacctccggtgatacaagcgactttaattcaaatggcaagaaaaaaagggagtccagcagtaaccagctagttaacaatgacagttattcaagttctatgacggacatgaaaaatatgtcttctaacagttccttctcaaaaaatttgaatgtagggaatctggccttttcattaagtccagaattcaacataccttattccacttctccagtgtcactaaatctttccccatcgatgagtaataatcagcaacaattactgacacctaattcggcatcgaagagtaaaaacaataataaaaaaagaaattacatggatgaagatactaacgagtcaatgaccgagccaaagaaaaccaaaactactaaacctggcaaacaaacaaaatcccaatctttatcagttttatccacccccaaaaagggttcctctgcatctctttctacatttgcaagctccaagaatatttcgccagattcttctctgtcgcataatgcatcgtcaaatacttatgttactgccgctgccgctgcaccaaggctttctaagcttttgccgaaaaatgggtttaagaaaaattcacgtagctcttctgaactggctgctatccataaagtaatctctacacagactccaattgagagctcttcagagagctctcaatataacagtagtagtagttcaccagttaatagtgcagctgcttcttctgctgaatctttatccgacatcaattccagtcaggataacggaagagaatcaaacccaagttcccaagaatcacgaaacgaagttacgaattggatgaaaattgtgagaaatggatttttgacacatgatattgaatctcctgaatcaatcacattagatgacctagaaaatatattcaattga

SEQ ID NO: 3686 - DNA, 1569 bp, Saccharomyces cerevisiae
atgtacacgcctatccctgctaatacccctgctcccactgcaccaacttcatcgatgacgtccaactcttcatccgcatcaaatgccaacaccactagcagtagtggcataaacccaaggaacagagccagtggtactccatccaatgagcgggctcgtccggcgtcgggtatcagttcgtttttgaataccttcggaattaggcaaaatagccagacagcttcttcttctgcggctcctgatcagcgtctattcggcacaaccccatctaactcacatatgagtgtggccatggaaagtatcgataccgctccgcaacagcaggaaccacgtctgcatcatcctatacaaatgcctctgtcggcccagttccacgttcatcgcaactatcaactccccatctccatatctctcactgcccctacaaccacagaccaccagcaatcatctgcgcataatttcgaaggcaacaatgttggtaacgttcaagagtctttgaatcagcggcagcctaacggtactaacaataccacaacctcgataatttccatggcgccagcggctacaacgagaaatatagtcggtggtgcagatggatctactattgttaacaacagtcaggaaatgtataagaatttacgtcacttgatatatgctgcaaaccagccaaatgggaccgaaattttacatttggatttacctgcaacaagtgcagaggagtcaaacaatatgttcaatgtagatgaggtcactttgaagcaaaggaaagataagcatggtctttttagtataagactaaccccatttattgatagttcgtccacgacaaatcaaggtttattctttgaaccgattataagaaaggctggccctggatcccaattggttattggccgctatactgagcgtgttcgcgatgcaatttctaaaatacctgaacaatatcatccagttgtatttaaatccaaagttgtttcaaggacacatggttgttttaaagttgactctcaaggtaactggtatataaaggatgtgaaatcatctagtggaactttcttaaatcaccaaaggctctcacccgcttcctctttatcgaaagatacccctcttcgtgatggtgatattttacagttaggaatggattttagaggtggcacggaagaaatctatcgttgtgtaaggatgaggattgagctaaatagatcatggaaactaaaggcaaattcgttcaacaaagaagctttacagcgtttgcagaatttacaaaaattaactacaggtattgaagaagaagattgttcgatttgcctatgtaagatcaaaccgtgtcaagcaattttcatatcaccatgcgcacatagctggcatttccgttgtgtaagaagattggtcatgctctcatatccgcaatttgtttgccccaactgtagatcaagttgtgatttggaggcctcctttgaaagtagtgacgaggaagatgaaagtgatgtggaaagtgaaggtgatcaactggtggatcaacttagcgtcttaatggaaacttcaaaggatgttgatagccatccttaa

SEQ ID NO: 3687 - DNA, 1569 bp, Saccharomyces cerevisiae
atgttgctaataagaaggacgataaatgcatttctgggatgtatccattgcaatcttacggcgacgtgcatcctgattgccttcgtcataaccatgtatgtggtacttgtatctgagcctgcatccgtagacggaactatgggaaattttcttccgttttccaagatggatcttgcgacgaagagggacagacccttttattcgaattgtgtgaatactcaggactatttgttgaatccatcgtacatcaagcagaatgcctcgtttgtcatgctaacaaggaacggggagctagaagatgttatcaagactatcaacagtatagaagagcatttcaatcagtggttccactatccatatgtgttcttaaatgaccagccgtttgaagaggacttcaaagcaaaagtacgtgatgttacagtgggcgcgctggtggaatttggcactatcgatgagatatcttggaattttcccagtgacgtaaaggatacgttcgagttctacaacgcaattgaggatcaaggtgatagaagcatactttacggaaacttagaatcatatcataagatgtgccggttttattcaggattattttacaagcacccgctagtacagaagtacgaatggtattggagattggaacccgatgttgagtttttctgtgatattacctacgatccctttttggagatgctccgaactaataagaaatatggatttacgatcatcatccccgaattgtattggacagtcccaaatttgtttagacacactaaaagctttatcagtcaaaaaggcgttacgcttgggtcattatggaaactatttacaaaggattacgacatttttgaatccgatgatccggagttacgggactggatcaactatgattttcaggccaaggctaagatatccgaaaagatagccatcgagcagcttttgaaaaagggtgatgatttccaacagataaatgatgacaaagagggaataatgaatttgatacataaggctcgctctaggaagcatatcgtagaagacaaatttttcaatgaagagtacaatctatgccatttctggagtaattttgagattgcgcggctaagcgtgttcgacaatgacatttacaacagtttttttcaatatttggagaaaagtggtggattttggaaggaaagatggggggacgctcctgttcactctattggattgtcgctaactctggatttggacgatgtacactattttagagacatcggatatagacactccacaatacagcattgtccacataatgccatggggaatgaggaattctcctacttagccagtgactcaaaattcaaacgtaaaaacgcggcctacgacgagggaagggaatttgggtgtggctgcaggtgcagatgtcccaagaaaaagcgtgaaattgaggattccatgggtttctgcgtaaatatttgggtaaatctgcttaaccaacagaggggacacgaacgccacgtcgaagcactcaacggcaatgaaatggaggagcacataagggaagactatctaagacagttcggaaactag

SEQ ID NO: 3688 - DNA, 1572 bp, Saccharomyces cerevisiae
atgaaaaacatgtcacaacgatccatggacgtggagaagaaggcagctaacgctgatagttgttccgtaagtacctcgagcattaatgtagacgatgcggacgttgctttaagattcctgaaacagaacggtctcgacgaaagctccacggctaatgaagacgatgttgtagcaggcgaagaagccaacttctatggttcccatgaattatctcctaaggtcctgagaaaagttgacctcttcatcctgccctttttatgctgtacatatcttctgatgtttttggataaggctctgctgaactacgctgcatctatgggtatcaaagatcatttgaaaggtaacgaattttctaatttgggtactatcttttctgctgcttacattttcatggaacctgtggtcacttacttaattcaaaaattccccatttccaaaatcctaggtacttttattaccgtctggggtatcgtgttggcttgccatgctgcttgtaagacgtacgcctcgttgatggtcgttcgtactctcctaggtctctttgaatcctcgagtgcagttggttgtatcgctattagtggtatgtactatactaaatctgaacagagtgcaagaattggattctgggccacacaggctggtacaggttatattgtgggcgggttaatttcttttggctttttacattatcatggtaccgctttcacctcttggcaaataatgtttttggtcgttggtctggttacagttgcgtttggtgttctaacattcttataccttccagataacgtcaccaatgcttggttcctaaacaaagaggaaaaaattcaagttgttgagcatatcagagctaaccaaactggcctggaaacaaagaagtttaagaagcagcaagttaaagaactattccttcatgataagtttacttggccgatgcttttattaactgcatgttctcaaatttctactggtgccattggtacattttcagtgaccatcactggtacttttggtttcgacaagtacgaaacagcattactgcagttgcctattggtgccattacggctatgattattcttataacaactcaaatgttgtcccgctggggtcatatcacactcataaccacatctatgtatattccagctattataggttgtatcgttcttatcagtttacccttatcccataagatcggtaacttattttctctgtacttgctttacagtggttcctgtgtcattaccaatatttacatctggaattcatgcaacacctccggttacaccaaaagagtttttagaaatgctattacaatgattgtatacaatgtctcctgtattattgctccacagatgtttagggcatactctgctccacgttacataccagcaaagattgccttattggtcactcagtgtgtttgtgttcccctacaattatacattggctacatttgcaagaaggagaacgaaaagcgtgataaggaacaagaaggtcaagaaaggaagaagtaccaatttttggacttgactgatatcgaaaacagaaatttcaggtacatttactaa

SEQ ID NO: 3689 - DNA, 1572 bp, Saccharomyces cerevisiae
atgaaacatccgtatgaggaattccccacaggttccaagtcaccatataacatgtctagaggagctcatccaggcgccgttttgctatcaccacaatcttctgccataaacaagaacaatccgggcagcaattctggcaataaccagggcaattcatccgtgaccgcgaatgttttgtcccctcaatcccatagtatgtcactcaatgacatgcttgatcagcaatcctttatgctagacactgcgggaaccagggctcagccgctccagcaacaacagcagcagcaacaacagcaacagcaggcgtcgttgccttcccttaatattcaaacagtttcgtctacagcagctggttctgctatcgtttcccccatgatgcaatctccaaaggcgttgcaatctactttatcttcaacatctatgtatttggattcatttcagagatctccaaataatattttgggtattccatcgcagagtggttcaattcctttgccgcaatcccgtcaatcgcaacaacagtctcaatcccaaaaaaacgatccgaacatgggcaccaatttcagccaagacatcaaccaattatgttcttggatatccatgctgaacagcagccaacaaaatactgtaatggacaatatcctttccattttgaatgatgatgttttgaaatatactaagttaaaaatagagactttgacaaacactcccttcatctccccaccgctacctgcaattgcatcacctatacctaatagggatgacacacaaattttgaatattgattcagtcttttcttcaagtcctataactaatgaccctgaaaataccgataacttgttgtatcaaaattggtcccctcagccacattcaataccaattagccaacccatatatgacaacatcaccgacgctagtcaaaggtccaagtcggctgagcctcatgttaattcaagcccaaatctcattcctgtccagaaacaattcaacaacggtaacagtaccaaatataaaaagttgccatcagagaatcccaactatctttctcactctctctcaagttcccattcttttttccaaccaaagaaaaggtctaacatgggaaatgagtacaattctcatcaccatcattcattgcatcatcctctgcataataccacctcatatttttcgaatacttcaagaccatcaggaactgatttgaataagtccaaccagaacgtgttcaataataccattacgcatcctaatgctggtcctacaagtgccacatcgacatctacatcatctaacggaaacactcctttatcgagtaactcttcgatgaatccaaagagtttgacagaccccaagctactaaaaaatatacccatgtggttaaaatcgttaagactacacaagtattcagatgccttaagcggaaccccgtggatcgaattgatttacttagatgacgagactttagaaaaaaaaggcgttcttgccttgggtgcaaggagaaaattgttgaaggcttttggaatcgttattgattacaaagaacgtgatttaattgatagatctgcttattaa

SEQ ID NO: 3690 - DNA, 1572 bp, Saccharomyces cerevisiae
atgacaaaggaagaaatcgcagacaagaagagaaaggttgtagatgaggaggtaattgaaaaaaagaagagtaagaaacacaaaaaggataagaaagacaagaaggaaaagaaggataaaaagcataaaaagcataagaaggagaagaagggtgagaaggaagtggaagtaccagagaaagaatctgaaaagaaacctgaacctacttctgcagtggctagtgagttttatgttcagagtgaagcactaaccagtcttccacaatctgatattgacgaatatttcaaggaaaatgaaattgctgttgaggattctctggatctagccctacgtccgctattatcatttgattatctttctttagactcttccattcaagcagaaatttccaaatttccaaaaccaacgcctattcaagccgtagcctggccatatttgttatctggtaaagatgttgttggtgttgctgagaccggttctggtaaaacatttgctttcggtgttccagctatcagccatttaatgaacgatcaaaagaaaaggggcatacaggttctagtcatttccccaactagagaacttgcttcccaaatttatgataatctgattgtattaactgacaaggttggtatgcagtgttgttgtgtttatggtggtgttccaaaggatgagcaaagaattcagttaaaaaagtcacaagtggtggttgctacacctggtagattattagacctattgcaggaaggatctgttgacttatctcaagttaattacttagtattagacgaggcagacagaatgttggaaaaaggttttgaagaagacatcaagaatattatcagagaaactgatgcgtccaaaagacaaactctaatgtttaccgctacctggccaaaggaagtccgtgaattagcttccacgttcatgaacaacccaatcaaagtatctattggtaacacggaccaactaactgctaacaaaagaattacacagattgttgaagtggtggacccacgtggaaaagaaagaaagttattggaactgttgaaaaagtaccactctggtccaaaaaagaatgaaaaggtcttgatttttgctctttataagaaggaagctgctcgtgttgaaaggaatttgaaatataacgggtataacgtcgcagctatccatggtgatttgtcccagcaacaaagaacgcaagcattgaatgagttcaaaagcgggaagtctaacttgttactggccaccgacgttgcagcaagaggtttagatataccaaatgttaagacagttattaatttaactttcccattgactgtggaggattatgtccatagaatcggtagaactggtagagctggtcaaacaggcacagcacacactctgttcactgaacaagaaaagcatttggctggtggactggttaacgttttgaatggtgccaatcaacctgttcctgaagatttgataaagttcggtactcacactaagaagaaggaacatagcgcttatggttcattctttaaggacgtcgatttgactaagaaaccaaaaaaaattactttcgattag

SEQ ID NO: 3691 - DNA, 1572 bp, Saccharomyces cerevisiae
atgagagtatatcagttttgccgacctttccaattattcacctgcttcttatgctaccttctagtgttcgtaaaagctaacaaggaaaagataagtcaaaagaattatcaagtatgcgcaggtatgtattccaaagaagattggaagggcaaaatagacccgtttatatcattcaatcttaaaaaaataagtggattgagtgatgagtctgatccaggcttagtcgttgcaatctatgatttccaagactttgagcacttaggtgtgcaattgccggatgaagaaatgtattatatttgtgatgattatgcaattgatatcgggatttgtgaagaggagaatcgtgatgagtttattgttcaagatgttgtatatgatccatatacttccacaaatagatctttggccaatccaatcatgacgttttctcaaaatgaggtcggccttcatgatactagatacccaataaaagaaaccggattttattgtgttactgcgttcagatcatcgacgtctaccaagttcaacgctgtggtgaatttcaggaatgcttatggtcagcttgcgggcaccgagatcaacaaattgccactatatggtcttttggcggtcgcatacgttgtggcgatggcgttatattccttcgccttctggaagcacaagcatgaattgttaccattacaaaagtatttgctggccttttttgtatttttaaccgcagaaaccatatttgtatgggcttactatgatttgaaaaatgaaaaaggtgatactgcgggaataaaagtttatatggtgttcttgtcgatattgacggctggtaaagttacattttcatttttcctattattgattatcgctttgggctacggtatcgtgtaccctaagttgaataaaacgttgatgaggcgttgccaaatgtatggtgcgttaacttatgcaatttgcattggatttttgatccaaagttatttgaccgacatggaggcaccatctccactaatcttgatcaccttgattcctatggcgcttgcattaatcatattttactacatgattattagatccatgacaaaaacagttatctatttgaaagagcaaaggcagatcgtaaaattgaacatgtacaagaagctactatacatcatttatgcgtcctttttgagtgtactagctggtagtatagtttcgtcatttatttacgttggcatgaacactattgatatgattgagaagaactggaggtcaaggttcttcgttactgatttctggcctacgttagtgtatttcattgttttcgttaccatcgcgttcttatggagaccaacagatacttcatacatgctagccgcatcccaacaactacccacagacccagaaaatgtcgcggactttgacttgggcgatttgcaatcgtttgacgatcaagatgacgcaagtatcatcactggtgagcgtggcatagacgaggatgacctcaatttgaattttactgatgatgaagaaggacacgataatgtaaataaccatagccaaggccacgggccagtgtctccctctccaacaaaataa

SEQ ID NO: 3692 - DNA, 1572 bp, Saccharomyces cerevisiae
atgagtggtaacacaactaacgtgcatgagactagagccaagtttgcagagacgctgcaaccgaggattggtggcaatactacaaaagtgatacgagctgctttggaaaagaacgaagctgaaagcggggtgtctgaggataatgataacgggtcattggagaaagttaacgtagctacttcgccgcttttgacatcaacaccgcccacaatctcaaaggcgttggtgaaattgtacccttatttaattctcattgacgaattcctaaacgttgttacatggacaggaaagaatatttggagcagtgttttgatgctgtgtctctttattactaccgttgagtattttgaaacgctggtgaagtactttggacatcttgccatcattgctattttgtggggttattccctattggacaattatattgagggtacgttgagctcctcaccaacattagaagatattgctctcttaatgaacagagtatccttgaagtcagatattttgctctcccccatggttaaccttggaacgcaagatattcaacggcttctatatactacggtcatattatctccaatatacgtgatgataacctggctacttttaccaccgagaagcttgatgctgatggtgggcatgttccttttaacgtatcactcaccatggtctaaagtagcaagaaggcttttatggaagtttaagattgtcaggctgcttgttttctacgtcacgggtttagaccttggtggaataaataaggaccagggtatttttgctacagtgcagaagcaagtgaaaaagttggcatcaacagaaaacagtaatggcgtattatccgattccaagcctatccgttttacttatgttttgtacgagaaccagcgtcgttggttaggtattggatggaagcctagtatgttgagttatgagaggactccatggaccgatgaatttttgaatgaggctccctctcctgaaaacttccatctacctgaagagactaacactatggtttggagatgggtcgacaagacatggaggctagacatgactaatgacggtgccattcaagtgcccaattcaaaggcaagaacttccgcagatccctcccctgacgagggatttatatattacgacaatacctggaaaaaaccaagtaaagaagattccttttctaaatatacaagaagaagaagatgggtaagaaccgcagaattggtcaaaacttctgactttgatgaaagcgtgataaattcgaatagaaattctgccattgaacaaaaggttgaagaaaacagcacgaatggtttaaccgctgagcaagagcttgggagcaacaagcaagagaaagataatgcgaaaaaagtaggagagcctacaacagaagagacaaaagaatttgccgaagcatcaaacatcaacgaaggcgagtttgaaagaatttcctcgaccgatgaagaagttttaaaatctagggcaagagatcgactggcaaaagtattagatgatactgaagagaaagagcaatcaaatccaaccattggtcgcgatagcaagaaggccgtatga

SEQ ID NO: 3693 - DNA, 1572 bp, Saccharomyces cerevisiae
atggatccctttcacaatggcaataaaaggagctcaatatcgtttggctcatcgcagcggcagccatataacaagaacaattacttgagtggtactaatgggccttcctcggcggcacaagatcaaggtagaggcccatctccctttggaatgtctggcaacactaccaatggcggtaacagcaaaaggaatagtggctgtgacctaagtgccacgtactatgcaagtcgatcgccgatgtattcaccgttagatttctcgccaccagttttttcaccaaatcattctcagttacagcaggcgaggggctatgctgcaaatattccggttgtaagcaatctgatgaacccttccatggcctccgtgtgcgaatatcaatcacactatccactctttgggctcgattggagcgccgacgactacgtctgcttgggttcgtacaaagaggacagcagaaataagttgcaggttctgcactctaatgatctactgagctgggaaagcgtagtggacgcagatgtggtttatcctgtgagcaaaatccaatgggtcccctctcaattgtatccaaggaaactcgcgacgtgttctgactccttacggatttggagcgttagccctgaggaaagacagttccaagaacaaataaatctatctctgtgtaaatacaatagacagcaccccgccaatcccgcggccgcagatgacatgaaggtcataggcactttcccaccaataacatcatttgactggaacacggtcgatactaacttgataatctcaagttccatcgacaccacatgcattgtatgggatctgcaaagcagtcactacgttaagacccaattgatcgctcacgacagcgaagtttttgatgtaaggtttttgacaaaatcgacccaattatttgctagttgtggtggggacggtagtgtacgagtatttgatttaagatcgcttgcgcacagtacaattatttacgagcctccctcttcctcagtgtctggagccactgcgggtactataacaccgtcgtcgaaaggttcggacgccttattgaggctggagccatcaccgtatgacccaaatgtgttggccacttttgcagctgactcgaacaaaatcattattctagatatgaggaacccagaatcccctatactaaacttacaaggccacggttcttcggtaaacgggattaaatggcatcccacaaagcgcaatgttttgctctcgtgcggagatgactgccaggtgctctattgggacttgaacagctcctttatggaaattaacgctgcaggtagcaaatcccccagtattcatggaacttccttggaggaccctgacggcgacacagagatgacagacggtggcgcaggatccggtttaaacgaggatcccttaagtttaaacaacaacagcaagcaggtgtgcaagacactagagactcctaacatgatgtatgccaataaaacacaagagataaacaacattgcatggaggccccagaggggcgattggtttgggtgcgtgagcggcaagaagtttcaaaacgtccgcgtcctttga

SEQ ID NO: 3694 - DNA, 1572 bp, Saccharomyces cerevisiae
atggccgccattagagactacaagaccgcactagactttaccaagagcctaccaagaccggatggtttgtcagtgcaggaattgatggactccaagatcagaggtgggttgacttataacgattttttaatcttaccaggtttagtcgattttgcgtcctctgaagttagcctacagaccaagctaaccaggaatattactttaaatattccattagtttcctctccaatggacacggtgacagagtcagaaatggccacttttatggctctgttgggtggtatcggtttcattcaccataactgtaccccagaggaccaagctgacatggtcagaagagtcaagaactatgaaaatgggtttattaacaaccctatagtgatttctccaactacgaccgttggtgaagctaagagcatgaaggaaaagtatggatttgcaggcttccctgtcacgacagatggaaagagaaatgcaaagttggtgggtgtcatcacctctcgtgatatacaattcgttgaggacaactctttactcgttcaggatgtcatgaccaaaaaccctgttaccggcgcacaaggtatcacattatcagaaggtaacgaaattctaaagaaaatcaaaaagggtaggctattggttgttgatgaaaagggtaacttagtttctatgctttcccgaactgatttaatgaaaaatcagaactacccattagcgtccaaatctgccaacaccaagcaactgttatgtggtgcttctattgggactatggacgctgataaagaaagactaagattattggtaaaagctgggttggatgtcgtcatattggattcatcccaaggaaactctatcttcgaattgaacatgctcaagtgggtcaaagagagtttcccaggtctggaagtcatcgctggtaacgttgtcaccagggaacaagctgccaatttgattgctgccggtgcggacggtttgagaattggtatgggaactggctctatttgtattacccaagaagttatggcttgtggtaggccacaaggtacagccgtctacaatgtgtgtgaatttgctaaccaattcggtgttccatgtatggctgatggtggtgttcaaaacattggtcatattaccaaagctttggctcttggttcttctactgttatgatgggtggtatgttggccggtactaccgaatcaccaggtgaatatttctatcaagatggtaaaagattgaaggcgtatcgtggtatgggctccattgacgccatgcaaaagactggtaccaaaggtaatgcatctacctcccgttacttttccgaatcagacagtgttttggtcgcacaaggtgtctccggtgctgtcgttgacaaaggatccattaagaaatttattccatatttgtacaatggtttacaacattcctgtcaagacatcggctgtaggtcgctaactttattaaagaataatgttcaaaggggtaaagttagatttgaattcagaaccgcttctgctcaactagaaggtggcgttcataatttacattcttacgaaaagcgtttacataactga

SEQ ID NO: 3695 - DNA, 1572 bp, Saccharomyces cerevisiae
atggccgccgttagagactacaagactgccttggaattcgccaagagcttaccaagactagatggtttgtctgtccaggagttgatggactccaagaccagaggtgggttgacttataacgactttttggttttgccaggtctggttgatttcccatcttctgaagttagcctacaaactaagttgacaaggaatatcactttgaacaccccattcgtttcctctccaatggacaccgtgacagaatcagaaatggccatcttcatggctttgttgggtggtatcggttttattcaccacaactgtaccccagaggaccaagctgacatggtcagaagagtcaagaactatgaaaatgggtttattaacaaccctatagtgatttccccaactactactgtgggtgaagctaagagtatgaaggaaagatttggattttccggtttccccgttacagaagatggtaaaagaaacggaaaattgatgggtatcgtcacttctcgtgatattcagttcgttgaagacaactctttgcttgttcaagatgttatgaccaaaaaccctgtcaccggtgcacaaggtattacattgtctgaaggtaatgaaattttaaagaagattaaaaagggtaagctattgattgttgacgacaatggtaacttagtttctatgctttccagaactgatttaatgaaaaatcagaactatccattggcttctaaatctgccaccaccaagcaactgttatgtggtgctgctatcggtactatcgatgctgataaggaaaggttaagactattagtcgaagcaggtttggatgttgttatcttagattcctctcaaggtaactctattttccaattgaacatgatcaaatggattaaagaaactttcccagatttggaaatcattgctggtaacgttgccaccagagaacaagctgctaacttgattgctgccggtgccgatggtttaagaattggtatgggttcaggctctatttgtatcactcaagaagttatggcctgtggtagaccacaaggtacagccgtctacaacgtgtgtgaatttgctaaccaattcggtattccatgtatggctgatggtggtgttcaaaacattggtcatattaccaaagctttggctcttggttcttctactgttatgatgggtggtatgttagctggtactactgaatctcctggtgaatatttctatcaagatggtaaaagattgaaggcatatcgtggtatgggttccattgacgccatgcaaaagactggtactaaaggtaatgcatctacctcccgttacttttccgaatcagacagtgttttggtcgcacaaggtgtctccggtgctgtcgttgacaaaggttctatcaagaaatttattccatatttgtacaacggtttacaacattcttgtcaagacattggttacaagtccctaactttattaaaggaaaatgtccaaagcggtaaagttagatttgaatttagaaccgcttctgctcaactagaaggtggtgttcataacttacattcttacgaaaagcgtttacataactaa

SEQ ID NO: 3696 - DNA, 1572 bp, Saccharomyces cerevisiae
atggctagcactgcagtaatgatggacgtggattcttccggggtcaatgacttgcaccattctgagaagaaatatgcggaagaagatcaggttcaggaactattgaaagttttgaatgagatctccaagaccactttaacgctggacccaagatatatatggaggagtttaaaggacttgagctctttaaggaaccaggagcttttgaatgcggaaactttatgtttcacagtgaatgtgctgtaccctgattcttcttcattcaagaagaatctgctgaagttcattacttctaaccataaatcgtccgtaccggggtcagctgagcttagaaactcatatccagcctctttttattccgtaaacactgagaaaaagaccattgaagtgacagctgaaattaattgcttcatgcatctactagtccagttgtttttatgggacagtaaagaattagaacaattggtagagtttaataggaaggttgttatcccaaatttattgtgttattacaatttgcgttccttgaatttaatcaacgctaagttatggttctacatctacttgagtcatgaaacgttagcgcgcagctccgaggagattaacagcgacaaccaaaatataatcttaaggtccacgatgatgaagtttttgaaaatcgcttccctgaagcacgacaacgaaaccaaagccatgctgattaacttgatcttgagagattttttgaataatggcgaggttgatagcgcgtctgatttcatttctaaactagaatatcctcacacagacgtttccagttcattggaggcaagatatttcttctatttatcgaaaattaacgccattcaactggattattccactgcgaacgagtacattattgcagccataagaaaagccccacataattccaagagtttagggttcttacagcaatcaaacaaactgcattgttgtattcaattactcatgggtgatattccagaattatcatttttccatcaatcaaatatgcagaaatctctccttccttattaccatttgaccaaagccgttaaattaggtgacttgaaaaaattcacatctacaatcacaaagtataagcagttgctattgaaggatgacacctatcaactctgtgttagattaagatctaatgttatcaagacaggtatcaggatcatctccttaacgtataaaaaaatttcattaagagatatttgtttgaaactgaatttggattcggagcaaactgtagaatacatggtttcaagggctattagagatggtgttattgaagccaagattaatcacgaggatggctttatcgaaaccacagaattactaaacatttatgatagtgaagatcctcagcaagtatttgatgaaagaatcaaatttgccaaccaattacatgatgaataccttgtttcaatgaggtaccctgaggataaaaagactcaacaaaatgagaaaagtgaaaatggtgaaaatgatgatgatacgctagatggtgatttgatggatgacatgtctgatatctcggatctcgacgatttgggattcttataa

SEQ ID NO: 3697 - DNA, 1572 bp, Saccharomyces cerevisiae
atggctattaaccaggcacatgttcatccgcattacacgttacctggtgtaatgcactacttgcaaacggagttcacgaagaatgaaagagatagaatcacctgggagctagaaaggtcggaaatgaaagcaagaattgcagaactagagggcgaaaatagagatttgaagcatcaattgaatcaaatacaatcgaaagctgtttctcctgaaggtgaaaaggaagaaaaacatgtgcctgattcattactgcagtctaagctagctgttcaagaaaatgtgaaggaaataatttatttgttgaaaggccctaacacggtcaatcagttagagtcattaaatagcagagaagcgggttctgaattgcacgatttagagaaactgaacgtgaatactcccaaggaagagggcagtgcgaagacaaatgggatggatattttaaataatgccctcttggacaccaaacccaatccaaagcaaggtccttcagagtcaccatcaccaaccaaagtgaaatctttgtttagcacagccaacaagcgtgaaaataatgaaacaatatccaagatacactcggaattgtcgaaagtcgacattatcagctcctacggggactgtatggcactttatgatgcagacaccaaatcgttagaaatacaccaagtggacgcaaacttgaattccaaactcttaaagaaaatatctttagggcaagatagcgacattatgaaatttttctgggtttcgacgtccaaactccttgttattgaaaagagtttccatttgaaattgttctctatttctagcgcatctttgatctcagatgtggacctattacaagactcagaacagccgttttcgtctagtgatatcattaatatagacttcaaaaataaatggttgttgatagctagtaagaataaatctcaaattagaatctgggaattggacaatatagaggctcctgaggatgtcccaattaacataaaagaaacatatgaaataacacatgataatgatgacgatgatagtaatgattccacaaacattctggattgtatattgggtataacagaaaaatccttaatattactgtcttcaaatccataccagcttaccatatatgatttcgagggtaagcttctacaaaaaattgatttgaagattgatacaatattatcgggtaagccagaagaagaaggttaccatttatttttggatagaaaaacttctaagctactgattcagctaagcaatgagagattattggtttattcttttgataagaaaaaagttgtactgaaggaacaattgactccatcgtcaacactaccaatacaactcgatttgaacgacagcataatcaccgtatcatatagtaatggagactttgagtttaggaatttagaaaacctaaaaccatccatcgacgaatttgtcgtagcagacatcaacttctcggaaagaaaagagcctgtggtattttcttcaaatctgattgtagattctacgccggtgttaatcaccgtgaataaaaataacgaagtccttttgcacaagattaaaatataa

SEQ ID NO: 3698 - DNA, 1572 bp, Saccharomyces cerevisiae
atgggtgaagattttatgcacccaccgtttcaaacgtacccttcaaagaacagcgaagggaaaaaacatattgtcattgtaggtggcggtatcatcggttgctgtactgcttactacttgacccagcatccaagtttcagcccttcgacgcatcatattaccatcattgaatcgaggcgcattgctggaggggcttctggtaaagcaggtggcttgcttgcatcttgggctttccctcaccaaatcgtacctttaagtttccagctacatcaggagttgagtgatgaatatgatggagaaaacaactgggactacagaagattgacgactgtgtccttagaagcagatgttcgcgaagaagtcattgaaaactacgaaagactgagcaagaaggcatataatctgaatgtccctcctccaaagaagagaccgggctacatatccaacaagtttaacatcggggactctaattcatctttgagttcttcgggctcttctttgaaaaacgactccgctagtaacgaggaagaaggatcagacattcatgtttctagctcagtacccagtttacactctctaacaaatgagcgcatgagaagccacacaaatagcgcatctgatcttgactctgtaagtcccgtggagcaactgagagagactaatatccataatcctttgcctgctgatttagattggataagaagagaattggttaatgattggtcatcactaggtggtactgataccacagcgcagcttcatccctataaattcacccatttcatcttatcgaaggcaatggaaacaggtgctgtcgatcttctcctaggtaaggtagttgggctaaagtgtgacgagatggattgtgttcattctcttaagtaccttccatctgtcgtcaagaatcgcagaaatagcagagggcatgcagaaaatccagacattaagctgggtacaatcttcaacgatgagaacgcgaagcccattgaaatcaatgacatccagcagattgttttgagtatgggaccctggacttccaagattctaaaagattgtccaatttctggattgagagcccactctgtcaccattaagcctagtgaaaagacagtttcaccttacgctattcttgctgaactaaaagttaacgaccgtgaatttttctcccctgaaatgtatgctagaaaagatgaagtttatgtgtgcggcgaaggcgacactttagtcaatatacctgaaagttcggacgatgtggaggtagtttcggagaagtgtgatgaattgtaccattacgtatccaaattatcgccaactctatcaaagggccatctcttgcggaaacaagcctgttttttgccagttttaaacgttcctacaagttctggtcccttaattggtgagacaaatgtcaaggatctttatattgcaagtggacattcttgttggggtattaacaatgcgccagcaacaggtaaattaatggctgagattctccttgatggcgaagcaacctctgcggaaatctcaagtttggatccaaagttatatttcgacgccaccatcctttcttaa

SEQ ID NO: 3699 - DNA, 1572 bp, Saccharomyces cerevisiae
atgtaccaaaataatgtattgaatgctattttggcttctgaaaaatcaaactttcaatacgatagtggaacaatattaagaaaccacaaaagaccaataataacatttaataacaacatagagcacacagtatccgaacctaataattttacaggctatgaggaaaaggaagatttggatataatggatatttgtccttattacccaaaagcaagaatgctggcggatgccattcaacatgccaaaacgagcgcaagtgaaaacaaaatggaactatcaatgaaaactatcccatgtctcaagaaggaaaacgtccatgttgagaaagggcacgattggtctcaactcagtacgagcagaatttgtaaaattttagaagacatagcagataaaaaaaataaaactagaaggcaatctgccccattacaaaagacgaagtatttcccaacaaatgagaatcaaaataccgatatagaaaatcagaattggtcccaaatccccaatgaagacatatgtgcacttatagagaagattgctagcagacgcaataaaaatcgcaaacggaaaaatctttcatgttctaaagtccaagaaattcagggaaatattgatttacccaaaaaagacgtacaagagggagatatttcagattcgtctctatttgcagcagtaagaggaaccaaaaaagtttccggatatgattacaattcagaagataagatacctaatgcgatacgtcttccttactgtaagcaaatattacgattattctcacttttacaaatgaagagaaatgacttaatagtcacctctgaaaattgtaatagcggagttttcttcagcaattttaattatcaacttcaagttaaatcgaattgtattgcaaatatttcttctacactcagttttctaccccatcatgaaataaccgtatacacatcctttattctctatccaaacgttgtcgataatatttgggaatgcacacgatacgctattcaacttttgaagtccgaagcagcacagtttacgctactgcgtgatatatatagtggcttcacaattatactttcaaatcatcgatatcatcctaagggttttagcgctgattactgttacagtgcaaatgaattgacattatttctttttgttattcgaacagggcaaaaaaaagtactttatcgatctattcctcacaacacagcagcaattgaaaaagacagttcttttgatacagaaaatagaaagagaaggtccgaggaagaggttgttcttaaatgtaggaagtgttctaataattcattggcattaaaagaaatcagcacctatcgtttggatagcgcagaaggttttgagaagtctcagcctctaaaagatgaagcaaagctcagtgatatgaattatgtacaaggtagtatcagctataacaggactattcttaccggcttatggaaattatttcacagattgtgctgcaaagatcgttataggaaaaccaatctgtcagaaacattgttctatgacgattcaacggaaagatgggttagaatgggagagttaatgcactattga

SEQ ID NO: 3700 - DNA, 1572 bp, Saccharomyces cerevisiae
atgtcctataaacaaacaacatattatcctagcaggggtaatctggtaagaaacgactcatctccgtacactaatactatttcctcagaaaccaacaatagcagtacaagcgtattgagtcttcaaggcgcatctaacgtgagtttagggaccactggtaaccaattgtacatgggcgacttggatcctacatgggataagaataccgttaggcaaatttgggcatctctgggagaagcgaatattaatgtccggatgatgtggaataatacgcttaataatgggtcgagatcatcaatgggtccaaagaataatcaaggatattgctttgttgattttccctcatctactcatgcagcaaatgcacttttaaagaatggtatgcttatacccaattttccaaataaaaaattgaaattaaactgggctacatcctcatattcaaacagcaacaattctcttaacaacgtgaagagtggtaacaactgttctatatttgttggagacttagcaccaaatgttacagagtctcaattatttgaacttttcattaacagatatgcttctacttctcatgccaaaattgtgcacgaccaggttaccgggatgtctaagggctacggttttgtaaagtttaccaattctgatgaacaacagttagctctgtcagaaatgcaaggcgtatttttaaatggtagagccataaaagtaggacccacatctggtcagcagcagcatgtcagcggtaacaacgattacaaccgtagttcttcgtcactaaacaacgaaaatgtagactcgagatttctttccaagggtcaatcatttttaagcaatggaaataataacatgggctttaagagaaaccatatgtctcaattcatttatccagtccaacagcagccgtctttaaaccacttcactgatccgaataacaccactgtgtttatcggaggattgtcatcactggtgactgaagacgaattacgtgcttatttccaaccttttggcacgatagtctatgtcaaaattccggtaggcaaatgttgcgggtttgtccagtatgttgatcggctatcggctgaggctgccattgctgggatgcaagggttccccattgcaaattcaagagttagactgtcttggggcaggtctgctaagcaaacagcgttgcttcagcaagccatgttaagtaactctttacaggttcaacaacagcaaccaggtttacagcaacctaactacggatacattccatccagtacgtgtgaagcacctgttctgccagataataatgtttcatccacgatgcttcctggatgtcaaattctgaattattctaatccatacgctaatgcgaatggattaggctcgaacaatttcagtttctacagtaataataatgctacaaatacgcaagctactagtttactggctgacactagctctatggacctctcaggcacgggtggccaacaagttatcatgcaaggaagcgaagcggttgttaacagcactaatgcaatgttaaaccgtttggaacaaggcagtaatggttttatgtttgcttga

SEQ ID NO: 3701 - DNA, 1572 bp, Saccharomyces cerevisiae
atgttgttttcgtcttcatcttcttcacttaattccgaggtttcacaagtgttctcggaaaatatatctagtagatccactactctgactgaaagttccacacaaagcgagataaggcagcattttggtaatgaagatttcagtggtgaactaccaaaaaaattaattcaactcaagaaattaaaaaatggtggcactacaatcaagaaggctaaggaagaccttgagtattgctatgattcactacggctgtacgaaaatccctatgtaacatcatctgtagataaaaaatgtggttacagcattgaattgtatctagataacaagtacaaaacactaatgttctccgatttacaattgaatgctgactatccgttgtattacgattcctcactggataatatatctacaaatgttgaaagagaaagagccactcctctacaaatcaaaggaaagattaggataaacattgatagagaagaccaggccctcttaatcacttcccattcaatttctttaaaatgtttcacaaaggaatatgcatgctttgtaaattcagaaactagcaaaaactcctatagtgacaaaattatcaaagaacttaatcacacagagttttttgagtcttccacctaccccaaacagcagttgagagtcatacaccactcattaaatgataagaaaattctattgacaaagggcacgtacgattacccattcacttttacccttcaagcaaatactttcccagcaagtttctcttccttctttggcaagacccattttcgaatagaaagcttaacaacaataatgagaataccaagtaaacctaaaaacttactcaaatttttgaagaatgaaagttttacagataagatcattttaacagaagaaattaaagttaaaagagtcctgccttcaacgagtatgcttaagtttgaaacatttcaattaaggtcatacaatactgcaagtgagatcgtagtatcggtcattggaaactccaagttgattgaaattggtatgcctttccaaatgatattatcaattaccaaaacagattcttccattgaattacaggaagcttctttggcagttgcacagagaatggcaataccaagtattgatttgaagaccaagaaaatactacgagagccatacattaaaaagtccgagtatttactaagaactgtagaaagccaaagtttcgattccgacaagaccattttcggattttgctttgatgacgttgtcatcccaacctatgcggatggtctaccgagctggtttaaaacattctactgtgaaccaagttcattttatcccaatcatgctgccctcaaagtaactcatttgcttttgttcagaataacctatagcaggaatgaattggtggaagggcttgaaatgaaaaaaaattatcgtattacggtgaattttccaattttagttggcgatagtgatatttcgaccagctctttgttacccaaatatgaaaaatttgaaaatattagtgatctacaagatgaacccccactatattctatggtagcaggtgagaatagcttatga

SEQ ID NO: 3702 - DNA, 1575 bp, Saccharomyces cerevisiae
atgcaactatctaaaagtatactactggcagcattagctgctacaccatctctggtgaatgccatgctccccatccatatcaagaattataggttcattaagccatcctctgccacaaatagcgaatccgataacgaagttttttttgtgaaaggtgtcgattatcagcctggtgggtcgtctggttacgatgctgactctgatacagatattctttctgaccctgaagtgtgtgccagagacgcctacgctttccaacaacttggtgtcaacacagtgagaatttactccctgaaccctgacctaaatcatgacaagtgcatgactatcttcaacaatgctggtatctacgccattttggatgttaatagtggtaattacggggagagtttgaaccgtgctgacccatctggaacatatgactctttgtatttgtcaagagtcttcaaatttattgacgctttcaagaactaccctaacgtgctaggattcttttctggcaacgaagtcataaatgatcaaagcgactatgcaaaaattgatcctccatacatccgcgctgttcaaagagatatgaaacagtatatttcaaaacatgcgaacagaagcatcccagtcggatattctgctgctgacaatactgatttgaggttagcaaccttcaagtacttgcagtgtaattcgttggatggaaacaaagtcaatgatgatttggacatatctaaatctgatttctttggcctaaatacttatgaatggtgctctggcacttctagttgggaatcttctggctatgacaagttaaactcaactttcgaagatgctgttattccgttgatattttctgagtatggttgcaacaaaaatacaccaagaacttttgacgaagtctctgagggtttgtatggtggtttaaagaacgtcttctctggtgggttggtatacgaatacactgaagaagctaataattacggtttggttaagcttgatgatagcggttctttaacttataaggatgattttgttaatttagaatcacaattgaagaacgtttcattgccaacaacaaaagaaagcgaaatatcttctgactctatctacaagtgcgataacagtgccatcaccaatatttattctggctttggaacgaacaatttcactttgccttctcaaccagcagaaattgccaatatgattgaatacggtgttaatggcaccaacaccggtaagatattgactgattatgctgttccaactacttttaactatacaattaaaaacaataaagatgataccatttcagctactatttcatacgacaaagctaactcactgaacgaactagacgtcacagccacaacggtcgcaaagtcagcttccacatcacaatcatcttctcgctccttaacttcaagcaccagtccatcttcaagcactggctcatcttcaagcaccggttcatcttcagcttcaagcagctccaaaagtaaaggcgtcggaaatattgttaatgtttcctttagtcagtctggataccttgcattatttgcaggtctgatttctgctctactctga

SEQ ID NO: 3703 - DNA, 1575 bp, Saccharomyces cerevisiae
atggaacaccaagcacttcgaaggcttgtactgtactgccccaatttcatccgacgtggtgctcttaggcaaaatatgactagagtgagctgtagacatatgtcaggcaagggtggagggagagatgagaaaggtgattgcaatgaagaaaaggattcttccaaagatttggggagggtaccgtcgaagatgaaacgagcatatgatggtgaaacagttattaaagagggagattcgcatgctgagtcgctagcgcagcagggaaagcagcccacagacctcgcatataacagcagatcgaagatatctggttctaatttgcatttattggttcctagagttgcgtctacagactatatttcgaataaagaggttcacacggagggcctgtttgccggctatcgacccttgtttctggggaactcaggttttccgtctgatgcaagaaagggtaaaaactttcatgagttagacgacgttcttcccaatatacaggtagtggacgcttccgagaaagatggcaaactcaatgtgcaggagattattgaggacttacaaagaacaagtttgagagaaagcattcatagtatggaacagttaccatcttcgcacaaacgtaaacccgtaataccgtgggacgcatctataagtggcatggtttataatgacatgcctttcaaatatgtgcccaaaaatattattctgaaaatgaagccatttaaacttttgcgtattgagagaaaaagtcaagcgaagaatgcaagaaagcctactatgataaaacttcagtttcacaatcgaagaatcaatgacaccccagagttagtgaatttataccataataaatcccgtttgcacgagtcactttacaatacaaaaccccttcaagaatctggatattcaagtgcaaatacaagtaaaagacagaaaatgttaaaagcaagaagcgactttgaacataaacagaaaaattatgcatacaaacacacatttatcaaaaatgatcaggaactgttccgcaatgaactaactaagttaaataagatacttgctagagaattcaaaaaattgacaaagctatccatacataatgagttcaagagagaacacttgcccctggccgtttatgtgagcaaatcaaagggcacaaagaaactgtttagaagatcactgaagatgaaaatcatggaccacatatacccagtttataccacgatattgtcaactttaacaaattccagagactctaagaaatttgaaaacaaaatcaaggcgtatattgaaaaaatcatagtgcggttatcagatgaagtaccatccacatattttttccaagatggcgtagattgtattattcaaccaagtccgattcataatttcaagagaatgcattggttaagatacaccaagaggcacaataccttttgggggaggactatacataaggacgttcaagtcagcttcaatgacaagtatgttgttactaggagcggcgtgaggtatacgaggtatcccactaatttgaatacacaattattggaaactgcatttgaagaatgggactactatgagtga

SEQ ID NO: 3704 - DNA, 1575 bp, Saccharomyces cerevisiae
atggagaaagatcaaatccagcctagggtgttggagtcagtagacacaaactcattatccttgctttcgtccaataccagctcaaatatgaatagcaacaccaacaataaactcagtataattgccagtgatatttctacaggatccgtactttccaggcccttgactcctccagtcgtccaggatatagagaataactccatgttacaatggcaatttgaaaagaaggaatttatcttcgatagtaacagcactccttcgaagcaggcaaaaccattgcagagaaattctccataccaaggcaatagtcaaagtgaaaatcagaaccaacagttattgaatgtaagaaagcgtcgctcacaattgataggtgccaagcctaaaattccatccaaattgtaccaatctgtttccaaattagatctaattgatgacaagagctttacgtctttgccaattgcgcctccatgcaatatcgaaactaatgaagatgacagtggaaacaacgaatacaacaacaataaaaaacggcccaggttgaatcctgtaaatgaactgcgagtgcataacaacaaacgtaataggtacgtcagttatgggccgagtttagatacaaaaaactacgagctaacagaaaatacttctcaggatataccaccgctagtcctggttgaagactacataccgtatacccaaagtaaatcaacaaaaaaaatggtatctatttcagatttgaaatcaaaactaagtaaaagaagagataatcatatcccgctgagagtaaaaaattcatattctgaaattaataaggaaaccaatagaaatagctttgaaccgaattcactaacactgataccccatatattaaggaatactgaagaaaatagggacgaaagtaacaaccccttagattttatcaaagaggaaattgaaataagtgatatttccataccaaattccattgaaaatatggtggttaacttggttaatattccatcttccaataaaagttacgatgatctttatctatcggaattaaatgttcattcccaactgaggaaatgtgtcatctgcgaaaaggccctatatgaaattagctcgagacttttaaattcaggatactataaagaaattgtatgtgagcaatgcacagttagatatgaagaagccgctaaaatctttgagaactgcgagttcgaatcatctatggatgaatcaaatctaagcagcggtacttttagtgatctagagaattcagcagaaccgtttcatttatcgacagatgttccaaaaaaaataaataggcacatagaagataacaagatcgaccttaaaaaggaaatatcaaaaaaaaaggacagcttctctaaggaactaatagaacgattgcagttgcaattgctagaaaatgataagtcaatcaaacatcattttaataaagatgcaatgggctctaaatcaatgaattggtttttggaagcaagaagaaaattgaagtggaagtggagaataaatggtttacttccgcatttcttacgcaatcaaaatagtgatcgtttaaattttcaaccttga

SEQ ID NO: 3705 - DNA, 1575 bp, Saccharomyces cerevisiae
atgggtatcaataatccaattcctcgaagcttgaaaagcgagaccaagtatgttcatatatatgcttcctgctgcccctcctctaaacttatggatgcagctaaaatgttcaagatagctctctagtctgtgtccattgcttatggggcatgagttttcaaaagtaatgtactaacaactttatgattgatttatttcgaatgttttaactacaggaaggccgcgaaagttctaaggagttttgttaaaccaaatcaagtatttggagcagaccaagttattccaccatatgtgctaaaaagagctaaaggtctagcaattatcacggttttaaaggctggcttcttgttttcagggagagcaggttctggggtgattgtggccaggttaaaagacggtacatggtcggctccctctgctatcgctatggcaggtgctggtgcaggtggtatggtcggcgttgaattgacagattttgtttttattttaaattcggaagaggcagtgaggtccttttctgaatttggtacaattactttaggtggtaatgtgtcagtttccgcaggtcctcttggaagaagtgcagaagctgcagcttctgcatccacaggtggtgtctcggcagtttttgcctattccaaaagcaaaggtttatttgccggtgtgtctgtggaaggttcagccatcttggagagaagggaagctaatcgaaagttttacggcgataactgtacatcaaagatgattttgtcaggtagagtaaaagttccaccagcagcagaccccctactccgtatcttggaatcaagagcgttcaactttacacgccacgaccatgatgacaacgctagcggtgatgatttttatgatgacggtcaatacagcgacaacacaagccattattacgacgatattccagattcctttgattctactgatgaatcctcaacacgtccaaacacaagatcatcaagaagaagaggaatgtcgctggggtcacgcagtcgttatgatgatgattatgatgatgatggttacggacgtggtcgcgggtatggagattttgatagcgaagatgaagattatgattacggaagatctccaaatagaaacagcagccgcaatagaggcccacagatagataggggtactaagccgcgtgcgaatacccgatgggaagatgatttgtatgatagagatactgaatactcccgtcccaaccattccggtagggattatgataatacccgaggaaataggcgtggttatggtagagaaaggggttatagccttggtcatggcccaactcaccccagcaatatgagcaatgtcgatgatttatcacataaaatgtcgaagacagggttaggtaatgaatccactgctacaaattcggcgacaccaacggctgttgctctctacaattttgctggagaacaaccaggcgacttggctttcaaaaaaggtgatgttattactatcttaaaaaaatcagattctcaaaatgattggtggacaggcaggactaacggaaaagaaggaatattccctgcaaactacgttagagtttcttaa

SEQ ID NO: 3706 - DNA, 1575 bp, Saccharomyces cerevisiae
atgtcccaacgatcttcacaacacattgtaggtattcattatgctgtaggacctaagattggcgaagggtctttcggagtaatatttgagggagagaacattcttcattcttgtcaagcgcagaccggtagcaagagggactctagtataataatggcgaacgagccagtcgcaattaaattcgaaccgcgacattcggacgcaccccagttgcgtgacgaatttagagcctataggatattgaatggctgcgttggaattccccatgcttattattttggtcaagaaggtatgcacaacatcttgattatcgatttactagggccatcattggaagatctctttgagtggtgtggtagaaaattttcagtgaaaacaacctgtatggttgccaagcaaatgattgatagagttagagcaattcatgatcacgacttaatctatcgcgatattaaacccgataactttttaatttctcaatatcaaagaatttcacctgaaggaaaagtcattaaatcatgtgcctcctcttctaataatgatcccaatttaatatacatggttgactttggtatggcaaaacaatatagagatccaagaacgaaacaacatataccataccgtgaacgaaaatcattgagcggtaccgccagatatatgtctattaatactcattttggaagagaacagtcacgtagggatgatttagaatcgctaggtcacgtttttttttatttcttgaggggatccttgccatggcaaggtttgaaagcaccaaacaacaaactgaagtatgaaaagattggtatgactaaacagaaattgaatcctgatgatcttttattgaataatgctattccttatcagtttgccacatatttaaaatatgcacgttccttgaagttcgacgaagatccggattatgactatttaatctcgttaatggatgacgctttgagattaaacgacttaaaggatgatggacactatgactggatggatttgaatggtggtaaaggctggaatatcaagattaatagaagagctaacttgcatggttacggaaatccaaatccaagagtcaatggcaatactgcaagaaacaatgtgaatacgaattcaaagacacgaaatacaacgccagttgcgacacctaagcaacaagctcaaaacagttataacaaggacaattcgaaatccagaatttcttcgaacccgcagagctttactaaacaacaacacgtcttgaaaaaaatcgaacccaatagtaaatatattcctgaaacacattcaaatcttcaacggccaattaaaagtcaaagtcaaacgtacgactccatcagtcatacacaaaattcaccatttgtaccatattcaagttctaaagctaaccctaaaagaagtaataatgagcacaacttaccaaaccactacacaaaccttgcaaataagaatatcaattatcaaagtcaacgaaattacgaacaagaaaatgatgcttattctgatgacgagaatgatacattttgttctaaaatatacaaatattgttgttgctgtttttgttgctgttga

SEQ ID NO: 3707 - DNA, 1578 bp, Saccharomyces cerevisiae
atgaatgaaatcgatgagaaaaatcaggcccccgtgcaacaagaatgcctgaaagagatgattcagaatgggcatgctcggcgtatgggatctgttgaagatctgtatgttgctctcaacagacaaaacttatatcgaaacttctgcacatatggagaattgagtgattactgtactagggatcagctcacattagctttgagggaaatctgcctgaaaaatccaactcttttacatattgttctaccaacaagatggccaaatcatgaaaattattatcgcagttccgaatactattcacggccacatccagtgcatgattatatttcagtattacaagaattgaaactgagtggtgtggttctcaatgaacaacctgagtacagtgcagtaatgaagcaaatattagaagaattcaaaaatagtaagggttcctatactgcaaaaatttttaaacttactaccactttgactattccttactttggaccaacaggaccgagttggcggctaatttgtcttccagaagagcacacagaaaagtggaaaaaatttatctttgtatctaatcattgcatgtctgatggtcggtcttcgatccacttttttcatgatttaagagacgaattaaataatattaaaactccaccaaaaaaattagattacattttcaagtacgaggaggattaccaattattgaggaaacttccagaaccgatcgaaaaggtgatagactttagaccaccgtacttgtttattccgaagtcacttctttcgggtttcatctacaatcatttgagattttcttcaaaaggtgtctgtatgagaatggatgatgtggaaaaaaccgatgatgttgtcaccgagatcatcaatatttcaccaacagaatttcaagcgattaaagcaaatattaaatcaaatatccaaggtaagtgtactatcactccgtttttacatgtttgttggtttgtatctcttcataaatggggtaaatttttcaaaccattgaacttcgaatggcttacggatatttttatccccgcagattgccgctcacaactaccagatgatgatgaaatgagacagatgtacagatatggcgctaacgttggatttattgacttcaccccctggataagcgaatttgacatgaatgataacaaagaaaatttttggccacttattgagcactaccatgaagtaatttcggaagctttaagaaataaaaagcatctccatggcttagggttcaatatacaaggcttcgttcaaaaatatgtgaacattgacaaggtaatgtgcgatcgtgccatcgggaaaagacgcggaggtacattgttaagcaatgtaggtctgtttaatcagttagaggagcccgatgccaaatattctatatgcgatttggcatttggccaatttcaaggatcctggcaccaagcattttccttgggtgtttgttcgactaatgtaaaggggatgaatattgttgttgcttcaacaaagaatgttgttggtagtcaagaatctctcgaagagctttgctccatttacaaagctctccttttaggcccttag

SEQ ID NO: 3708 - DNA, 1578 bp, Saccharomyces cerevisiae
atgacgttgccgaaactcagtagcgtttctgtttcatcaggacatgttagtgccaactcacatggtttctcaatactaagcaaacaccctcacccaaataatcttgtccattcccactcactttctcacacaaatgcgaagagccacctgcctatcagtagcactagcactaaagagaacagcacgaacaaggaggaggcggaatcactcaaaaaaaacaacccctcttcttgggaccctagtgatgatatcaagctccgccacctgaaagagatcaagaacttgggctggaaggagattgcacatcatttcccaaatagaactcctaacgcttgtcaattcagatggaggagactgaaatcaggcaacttaaagtctaacaagaccgcagttattgacatcaataagctattcggcgtgtatgcgactggtgatgctaccccatccgcgggtactccgtctgcggaagaagccgtaaaagaggaagctgttgaggatgaagatattactgcaggttctagtgctatcgaggattctccaccggatttcaagccattagttaagcctaaatacatggacagaaaactgataactcaaagatctacatcaacattttcggaccatgagccacaacacacgaaaccaaggaaactgtttgttaagccaaggtccttctctcattctataacaaccaacacgcctaatgtaaagactgctcagcagacaaatctaagcctttataacactacttcagcaaagacaaataaagctgttaattccaatgattatgagaatattggtcttgtgcctaaaattattatcaggtctagaaggaactcctttattccttcaactcaaatccctcattcaacgacgaagactaggaaaaactcgcattccgtaatttcttctagaagatcatcttttaacatgatgcattcaagaagatcatccttcaactctcacgctcctacggagcctatttctagaagagcttccttggtagttagcccgtatatgtcacccagaaggttatctacatcgcaatccgttcattatcatccacagcaccaatactatcttaaccccatagcgtctcccaactgcaagacagaccacgcaaatgacaaaatcacgcacacgaggactttcttagatatgcaaaaattcgctaataaacacccgtggtctagagaagatgatgaagtgctacttaacaatacgaaggacaaacaaaaccatttgtcgccgctagaaatttctattgttctgcctaataatagatccgagttggaaatccaacaaagaatggattatttaaagagaaaaggacgtgtaagtggttttcatacaaatgaaggatgcaaagacgaggaggaggaggatgacattgacccactgcacaaggagaatggcattaacacgccatcgcagcaatcgcaaaattacggtatgttagaggctaaacatgataatccaaagtctagtgagctttcttctatgaccagcgcaaatgacatacgcaatgagcaagatgaacttccaggtataaattctatctttaaaaatatattttaa

SEQ ID NO: 3709 - DNA, 1578 bp, Saccharomyces cerevisiae
atgattttctcactagatgaagaacttcatcgtgtgtcactagatgataaaaagaatgacattaaagtagattattcctcggcaatatacaatgatatcaatcatgaacaaggcagctccatcacatatgaggagagtataaatcacctctcggttcattcaaatgcgattccgctaaatggcatgagtcctgcacataggatgagaagaaggtcctcagcttattccaaattccctattctcactccaccaaatacgagaagattttctattacaggttcggacgcaatgcgaactaatacgaatagactatccataacacctcaggacattatttcctctaatattggagaaaatgaattatcaaggaacctgcacgattttaagcccgtgagagtcctaggccaaggtgcctacggtaaagttcttcttgttaaggacgtcaatacatccaagctgtatgctatgaagcaattacggaaagcagaaattttaatttctcaaacagccacagattccaagagagaagacgaagataaaaatgatggtaataacaacgataatgacgatggattatcaaagaggcttgagagaacatttgccgaacggtctattctatctgaaatagaacatccaaacattgtcaagttattttattcttttcacgataactcaaagttatatttactgctacaatatatccctggcggtgaactattttaccacttgaaggaacacgggaccctagatgagacgacagtttcgttttacgcggcagaaatcagctgtgccttgagatttttgcatacgaaaggtgttgtctatagagatttaaaacctgaaaactgtttattgaatcaacgtggacatttagtattgacagattttggtctgagtaaaaaaagtgctaatgattccgcggttgatgaggaggatccagagaacgtcaatgccctatactcgattatcggtacgcctgaatactgtgcgcctgaaatattattaggtaaagcttacagtcagaattgtgattggtattctttgggatgtctgttgtatgacatgttagtaggtaagcctccatatactggtagcaatcataaggtgatcattaataagattcaacaaaacaagcaaggccccaaaattccattttatctgagcgagggaatgaaagatatattaaacgcgctgttgaagaaggaaactgccaaaaggtggaatgttgacaaatactgggccaaaaccggggctaataataagcctactaagtctaagaagaagaaatcaggggctgcaagaactagtcttttcactgaacattttatctttagaaaaatagactggaagttattagaatctggacaattgcaaaaaaccactctaggcccaattgttccagttattacggatttggaactagcggaaaattttgacacagaatttacttctatgtcatatgaggaaacctatacggatagcaagccgattaatatcaattcggtgagcaagtccccggatatgttcaagggatttagttataaagcaagtggtagctatttggagaagtacttttga

SEQ ID NO: 3710 - DNA, 1578 bp, Saccharomyces cerevisiae
atgccaaaaaatcgtggtgtcttggatgccatcactcgcagtgtgatagatggtagtgatcaggagtcgagctcatctttcaactcggacaaggaatatgcggctgtgacgaagggcctcagcagctcaagagtacaaaagaagtcatctttaaggcagatgaaaagcaaagtcaaggagcttcaatctttagtgaatcattaccgagaaaatgaagccgctttagtgtctagcgccaagttattgtccggcgagatcataggctatgaaattaagatggctagtttacatggaaaaatgaaaagtatcctggatgagaacaacgcgttaaaggaaacgcacaagagctctgctgaaaagagaatcgaacttgttcgacttccctctagcaaagaagaacgcaactacgatgaatacactttgcttgttaatctcaagaaggaaatctgcgccaagttacaggactacaaaaacgtccagaacacggtgaacaccaagttagatgagattcacacgttccatgaaaaatactacgaaggactagaactaagtttagacagcaaggtgtttgatgcagaaagctcaaaagagctggccaaagtgaggcgagaactgaataacgtgagaaaaaattccgaaatcaaagtgaataacttgaaaatgcaactgctacaagcaaccaaatcactggagcacttgaagaagcaggctaaagcaaaggatgactatcttaaatgtattcctgagctggtcgacaaagccaatctcacgatgttatcctacaagaaaagcatcgctaaccagagggagactatcgaagcattacaagcagaactatcgcaacaatcagaaacaaaggggcaaatagaaacagaaacacaaaatcaagtacaaatccccaccaatgtgactttggtggacccctttgaggaaaacaatccagaggatttgttcgctatccaggaacaggaattgcaagatctaaggttgcataagaaaatggccgatgagaggagccgaactacccacttgcatttagaaagaaaaaataataccatcaagctactgcagagttacgtgcaatcattaattcaacggctaccaccagcccagcgcaaacaccatttgggcatattccaaaaacttggtagcgaaaaatcgtgtccactcgcccccgctgtggcaagtacatatgcgcctcttctactcttatcccagcattcgaaccatcaagaaattgacaacacccctcaacggcttctattagcggctccagacgggcagtcatattccgaaaagagcacaacactaaaccttgattactcatcaaggaaatcctacttatcaagactacaaccaccacatatagccaacctgaagtctttgactctgaaaactctgccaagggtgcccacggacagtcctcaacttccttcaaaagacaaatctcaagagactgcaaagaaagacgatcggccaaaattggtggcaaatgaaccagtcacactagacacatcaactcctcctgtggcacaaagcttggcggattcaaagcattgttcaggactacataaataa

SEQ ID NO: 3711 - DNA, 1578 bp, Saccharomyces cerevisiae
atggatgcaaagaaaaatactggtgaagccaataatgatgtattggaagaggaagcagcgattcagttgattgcaccaggtatagcgagaaacttaacacaagaagtcattaccggtatcttctgtaatgtagtaatatatcctcttcttctaatatattttgtcttaactttccgttacatgactacaaatattgtaccttatgaatttatagatgaaaagtttcacgttggccaaactttgacctatttaaaaggtaaatggactcaatgggaccctaaaataacaaccccccctggaatctatattttgggtttaattaattattattgtataaagcccatattcaagtcgtggagcacactaaccatactaagattagttaatttacttggagggattatcgttttccccattttagtactcaggccaatattcctttttaatgccttaggtttttggcccgtttcattaatgagcttcccattgatgacaacttattattacttattttacaccgatgtgtggtctacaattctgatattgcaatcactcagctgcgtgttaacattaccgtttggccccgtgaagagtatatggttgagtgctttttttgctggtgtaagctgtctcttcagacaaacgaatatcatttggacgggatttataatgattcttgctgttgaacgcccagccattttacaaaaacagttcaacacgcatacgttcaataactatttgaaattattcattcatgctattgacgatttctccaaccttgttctgccctatatgataaattttgttttgttcttcatttatctgatttggaacagatccataacactaggtgataagtccagccactcagcaggcctgcatatagtacaaatattctattgtttcacattcatcaccgttttcagtttacctatatggatatctcgtaattttatgaagttgtacaaattaagaataaaacggaagccagtacaaactttttttgaatttattggtattatgctaatcataagatactttacaaaagttcacccatttttgttagcagataatagacactacacgttctacctcttcagaagattgataggcaacaaaagtagactaatcaagtacttttttatgacaccaatctatcatttctccactttcgcataccttgaagtgatgagacccaaccagctcacctttcaccccatcactccactccccatcaaagaacctgtacatttacccatacaactgacacatgtatcgtggacggccttaataacgtgcaccatggtaactatcgttccatcacccttattcgaacctcgttactatatattgccctatttcttttggagaatatttattacctgcagctgcgaacctttgataaaggatttaaaacctgctaaagaaggcgaaaacccaattaccataagcagtacgaaaagactgttcatggaatttttatggttcatgctcttcaatgtcgttactttagttatcttttccaaggtctcatttccttggaccactgagccctatttgcaaagaataatatggtga

SEQ ID NO: 3712 - DNA, 1578 bp, Saccharomyces cerevisiae
atggctgccggtgaacaagtttctaacatgtttgacactatcttagtgttagactttggttctcaatactctcatttgattaccagaagattaagagagtttaacatctatgctgagatgttgccatgcactcagaagatctctgagttgggctggactccaaagggtgtcattctttctggtggtccatattccgtatacgctgaagacgctccacacgtagaccatgctatctttgatttgaacgttccaatcctgggtatctgttacggtatgcaagaattggcttggattaatggtaaacaagttggtcgtggtgacaagagagagtacggtcctgccactttgaaggtgattgacgattccaactctctattcaaaggtatgaacgactctactgtctggatgtctcacggtgataaattgcacggcttgccaactggttacaagaccattgccacctccgataactccccatactgtggtattgtccacgaaactaagccaatctatggtattcaattccacccagaagttacacattctacccaaggtaagactcttttgaaaaacttcgccgttgatttgtgtcacgctaagcaaaactggactatggaaaactttatcgacactgaaataaacagaatcagaaaactggtcggtccaactgctgaagtcattggtgctgtttccggtggtgttgattctactgttgcatccaaattgatgacagaagccatcggtgatagattccatgccatcttggtcgataacggtgttttgagattaaatgaagctgctaacgttaaaaagacccttgtcgaaggtttaggtatcaacttgatggttgtcgatgcttccgaagaatttttaagtaaattgaagggtgtcactgacccagaaaagaagagaaagattattggtaacacatttatccacgtctttgaaagagaagctgaaaaaattaagccaaaagatggtaaggagattcaattcctgttacaaggtactctttatccagatgtcatcgaatccatttctttcaaaggtccttctcaaaccattaaaactcatcacaacgtcggtggtttactagagaacatgaaattaaagctaattgaaccattgagagaactgttcaaagacgaagtcaggcatctaggtgaattattaggaatccctcatgatctagtctggagacaccctttccctggtccaggtattgctattcgtgttctaggtgaagttactaaggaacaagtcgaaatagcaagaaaagctgacaacatttacattgaagaaatcaagaaggccggcttatacaaccaaatttcccaagcctttgcctgtttgttgcccgttaaatccgttggtgttatgggtgaccaaagaacctatgatcaagttattgctttgagggccattgaaactactgatttcatgactgctgactggttcccattcgaacacagtttcttgaagaaagtcgcctcaagaattgtcaatgaagtcgatggggttgctagggtcacttacgatataacttccaaacctcctgcaactgttgaatgggaatga

SEQ ID NO: 3713 - DNA, 1578 bp, Saccharomyces cerevisiae
atgtctcaagaacagtacacagaaaacttgaaggttatcgttgccgaaaaactggctggtataccaaactttaacgaagatatcaagtatgttgcggagtatattgtcttattgatcgttaacggtggtactgttgaatctgtcgtagacgagctggctagtttgtttgatagtgtttcgagagatacgcttgcaaatgttgttcaaacagcctttttcgcattagaagctctgcaacagggagaaagtgctgaaaatattgtttccaaaattagaatgatgaatgcgcaaagcttgggacaatcggatatcgcacaacagcaacaacagcaacaacaacaacagcaaccagacatcgcgcaacagcaacctcaacagcaacctcaacagcaacctcaacagcaacctcaacagcaacctcaacagcaacctcaacagcaacctcaacagcaacctcaacagcaacctcaacttcaaccacttcagccacaactagggacccagaatgcaatgcagacagatgctcctgcaactccatcccccatatcagccttttccggcgttgttaacgctgcagctccccctcagtttgcgcctgtagataacagccaaaggttcactcaacgtggcggaggcgccgttggaaagaatcgtagaggtggtcgcggtgggaaccgtggaggacgcaacaataattccacacgttttaatccgttagcaaaagcacttggaatggcgggtgagagtaatatgaacttcactccaaccaagaaagaggggcgttgcagattgtttcctcactgtcctcttggtagatcatgcccacatgcacacccaactaaggtatgtaatgaatatccaaattgtccaaagcctcccggaacttgtgagtttttacatccaaatgaagatgaagagttgatgaaggaaatggaaagaactcgtgaagaatttcaaaaaagaaaagctgatttattggcggcaaaaaggaaaccggtacaaactggtatcgttctgtgtaaatttggggctctgtgttccaatccatcatgcccatttggtcatccaacaccagcaaatgaagatgcgaaagtcattgatctaatgtggtgtgacaagaatttgacatgtgataatcctgagtgtagaaaggcccactcttcattgtcgaagatcaaggaagtaaaaccaataagccagaagaaagcagctccacctccggttgaaaagtccttagaacaatgtaagttcggtacgcactgcaccaataaacgttgcaaatatagacatgctcgttctcatattatgtgccgtgaaggagcaaactgtactagaattgattgtttatttggccatccaattaatgaagattgtagatttggtgtcaattgtaagaatatttactgtctattcagacatcctccaggcagagtacttccggaaaagaaaggcgctgcacccaattcaaacgttcctaccaatgaaaggccatttgcattgccagaaaacgcaataattgaaaatgctcctccgcaaaccagttttacgcaccaagaacaagatacggaaatgaactga

SEQ ID NO: 3714 - DNA, 1578 bp, Saccharomyces cerevisiae
atgtgcgggattctattgcattattgtccaaacaataactacctgaatgatgagttaatcgaatttccagaaggaactgaatttggagatacaacatgtaccaatgaatcgtcgattttcaacaaaatcattccgtacatagccgcaagaggtccaaactactcctctcttcgagctgtcaaagcttatcgaataagttggttttcttctgttttatctttgaggcagcctttcacgaaacagagtattaacgtggatgacagatatttcctacaattcaatggtgagttatacaataaagagatatcgcagggtgataatgatagtctttatattgcttctatgttgcagaatttgaaagagggtatgggcgttattgatgttataaaatcactggaaggcgagtatgcttatactatatatgacgtgaactcatccaaactctatttcggcagagatccaattggcaggcgaagtttgtcttattcggtcactccagacaacgaattgtacgtcgctagtgtaacggggtctgctgggtcctttcaagattgtataggtggagttatttatgaatatgatacacgaactaagttgttaaattccaatcagaggtcacatcttccatacgaagtgacatcagagatagatctgaatttcacatcattgtcagaggtgtctaaaaatttatatgctgtgctacgtgattctgtaaaaaaaagggtagagtccatacatcccaggcatattgaaaactctcctattgcggtactattctcaggaggaattgattgttcagtaatagtagcgttgatctgcgaggtgttgcaagaaaatgattataaatgtggaaaaccagttatagagcttctaaatgtatccttcgaaaaccccaggactggtctttttcccagtgatacacctgatagaaaactgtccattaacagtgcaaagactttacaaaacttatatcctaatgttgatatcaaactggttgaagttgacgttccttatgatgagtatttaaaatggaagccatttgttatcaatttaatgtatcctaaacagactgaaatggacttgtctatagccattgcttttttttttgcgtcgagaggtagaggtttcttaacttctctgaatggggaaagaacgccatatcagcgccatgggatagtgttattcagcggactgggagcagacgaactctacggtggatatcacaagtttgccaacaaaccaccccatgaacttgtggaggaacttacaaggcaaataaacaacatttatgatcgcaacctgaatcgtgatgataaagtgatagctcataatggcgtggaggtgagatacccatttttagatgaatatgttataaagttatctacagcagaaattcccattaatttcaaggttaacaaattaatccttcgaaaagttgcctcgcagtatttgaagttggatggaatatcatcagaaccaaaaagggccattcaattcggtgctaaaagcgctaaaatgacaaaggatggtaataagcatggaacagatttattaaaagaaaataggaattgttcataa

SEQ ID NO: 3715 - DNA, 1581 bp, Saccharomyces cerevisiae
atgaatagtgcatctttcttacaatcacggcttatttcgagatcctttctcgtaagaaggtcgttaaagaggtactccggacttgcaaagccttataccttccagcaaccaaccatatatgcattatctacaccagcaaatcaaacctctgcgatagcaatcataagaatatctggtacccatgctaagtacatttacaatcgactagttgattcaagtacagttccgccgatcaggaaggctattttgaggaacatttattcgccgtcctcttgtagtgtgaaacctcatgatcaaaaggaaagtaaaatattattagacacatcgttgttgctatatttccaagctccttattcatttactggtgaggatgtgttagagctgcacgttcacggcgggaaagccgtagttaatagtatactgaaagctatcggctcgttacacgatagaagcagtggtaaagatataagatttgccttgcctggcgacttctccaggagggcgtttcaaaatggaaagtttgaccttacccaacttgaaggtatcaaagatcttattgattcggaaacagaatctcaaaggagatctgccttgtcaagtttcaatggggataacaaaatcctatttgagaactggagggaaaccattatcgagaatatggcacagttgactgctataatagattttgccgacgataatagccaagaaattcagaatacggatgagattttccataatgtagaaaagaacatcatatgtctgcgagaccaaatcgttactttcatgcaaaaagtcgaaaagtctaccatactgcaaaatggaataaagctggtattacttggtgctcccaatgtcggtaagtcatcattagttaacagcttgactaacgatgatatatcaattgtcagtgatatacctggcactactagggattctattgatgcaatgataaacgtgaatggctataaggttattatctgtgatacggcaggtataagagaaaagagttctgacaagatagaaatgctgggtatagatagagcaaagaagaaaagtgtacagagcgacttatgtttattcattgtagatcctactgatttatcaaaacttttgcctgaggacatattagcacatctatcatcgaagacgtttggaaataagagaataattattgtagtcaataagagcgacttagtttccgatgatgagatgacgaaagttttgaacaaattacaaactagactcggatcaaagtaccccatattaagcgtgtcctgtaagaccaaggagggaatagaatcgttaattagcactttgacaagtaattttgaaagcttgtctcaatcaagtgccgatgcaagtcctgtcattgtttccaaaagagtgtcagagattctcaaaaacgacgtactgtacggcttggaagagtttttcaaatccaaagatttccataatgatatagtattggccacagaaaatttgaggtatgcatccgatggaatagctaagataacaggacaagctattggtattgaggaaatcttagattcagtgttcagcaaattttgtataggaaaataa

SEQ ID NO: 3716 - DNA, 1581 bp, Saccharomyces cerevisiae
atgacaatttctaatttgttaaagcagagagttaggtatgctccctatctgaaaaaagttaaggaagctcacgagcttattccattgttcaagaatggtcagtaccttgggtggtccggttttacaggagtgggtactcccaaggcagtgccggaggcactgatagatcacgtggagaagaacaatttacaagggaagttgagattcaacctttttgttggagcttctgctggtccagaggaaaaccgttgggctgaacacgacatgatcattaagagagcccctcatcaagtagggaaacccattgcaaaggcaattaaccagggtagaattgagttctttgataaacatctgtccatgttccctcaggatctgacatacgggttctacaccagggaaagaaaagacaacaaaatccttgattatactataatcgaggcaacggccattaaagaggacgggtctatcgtcccaggtccctctgtcggtggttctccagaattcattacagtcagtgataaagtgattattgaggttaacacggctacgccttcgttcgagggtattcacgatatagacatgcccgtgaacccacctttcaggaaaccatacccatatctgaaagtggacgacaagtgtggtgttgactccatcccggttgatcctgaaaaggttgttgcgattgtggagtccaccatgagggaccaggtcccaccaaatacgccctctgacgacatgtccagggctattgcaggtcatttggtcgagtttttcagaaacgaggtaaaacatggtaggctacctgaaaacctgctgcctttacaaagtggtataggtaacattgctaacgctgtcattgaagggcttgctggcgcccaattcaagcacttgactgtatggacggaagtgctgcaggactcgttcttggatcttttcgagaacggatctttggactacgccactgctacttccgtgagattgactgaaaagggtttcgacagagcctttgcaaactgggaaaatttcaaacacagattgtgtttgagatctcaagttgtctcgaacaatccggaaatgatccgtagattgggtgtcatcgccatgaataccccagtagaagttgacatttacgcgcacgccaattctacaaatgtgaatggttcccgtatgttgaacgggttgggtggatctgctgatttcttgagaaatgcaaagttgtccatcatgcatgccccctctgcaagaccaactaaagtagaccctaccggtatctctaccattgttcctatggcctctcatgtagatcaaactgagcatgacctggacatcttggtcactgaccaaggtttggcggatctaagaggtctatcgcctaaggaaagagcccgtgaaatcatcaacaagtgtgctcatcccgattatcaagctttgttgaccgattacttggacagagcagagcattacgctaaaaagcacaattgcttgcatgaaccacacatgctaaagaatgctttcaagttccacaccaacttagctgaaaagggtacaatgaaggtcgacagctgggaaccagttgactag

SEQ ID NO: 3717 - DNA, 1581 bp, Saccharomyces cerevisiae
atgacattgactatcaaaataggaaccttaaacgatagcgatcaatctgcagtgcataatggtacagaaaatggctctgattttcgaaagataactcccacagaggaagagatctgtgatgacgtagttttgttatggaaggaagagcccggaactgaagacgctacgattcagcatctttatgacaggattacggaaagaaatcaatcgtggaaattgagtgcttctcgttttcgaaaaattctaaatgagcaccatctttatgacacagatctagagaccgtttctctatataaagataaaatacattttccaaaagccctagattctgatgctaaggtcgaagtgaaatttattgatgacgaacatggaaggggccttttcgctaaaagagatttttccaagggccaaatcatcctgaaagaaaataaacctatcgtatatattccaccactggacaagctttttttaatatctaatggaaaggcatgtgctcgatgtggtaaggcgctatatgatttgacccagcacaaaattatggtccattatttggattgtgaagtttgcaaagctatttggtgcagtgaaaaatgtaaaaaagcacatgcgtcgttacatgagcttttataccactcatggagatcgaatagaatagacattcttcatgctggtaattggaaaagatttgttaactactgtgagaaatattgttttaccgctgccttttcagttggtcttatatatggatccatgcttttggatactacaggagaggtcaaagagcaatggcaaaaattggcaagcatctcacaaagggaaagaattaaattaagagacgccagcggtatcggcagtacgtttagtttactgaatggtacaactgtacatactgaagaggaatctgataatggtaccaaaaagggcgttgagaagaatattgatgacgagactgtttgggagaagtgctacgaattattttgcggtgcatttccaaaagcttctgaagaaatagatttcgagaaatttttgaccatgatcgggacgttcaatatcaatcaatataacggccaggtatatcattggatctccttcataaaccatgattgtgaaccaaacgcctatattgagcaagtagaagaacatgaggaactgaggttgcatgcaaggaaaccaataaagaagggggaacaaatacgtattacgtacgtcaatcccttacatggggtgaggttgaggcgtagggaattaagagttaactggggcttcttatgccagtgtgaccgctgtcaaaatgaactatctacatttgaaagagttccaaatctagagaaaaagaatgcggatgctaatttaggagtagaaaaaatagattccaatgatagtagtgaagatggctctaagaaatcaactggtaatcgtaaatcttccatgagagaggcccagccagatttaaaagaaatactgaagaatggaaaagaatttgaattagacataccagaaactgttgatacacaagggaatgtaagaaaaacctcagtcagattcgattcaaacgtttcggtcgcagtggatgaaagataa

SEQ ID NO: 3718 - DNA, 1581 bp, Saccharomyces cerevisiae
atgcctgactctaagtacacaatgcaaggttataaccttgttaagctattaaaaaggctagaagaagccactgcaagattagaggatgtcaccatctatcaagaaggttatattcagaataaattggaggcatctaaaaataacaagccttccgactccggggccgatgcgaatactacgaatgaaccttctgcagaaaatgctcctgaagtagaacaagatccgaaatgcataactgcgttccaatcttacatcggtgagaatattgatccgctggtagaattatcaggaaagatcgacacggtggtcttagatgctttgcagttgctaaagggaggctttcaatcgcaattgacttttttaagagctgctgtgagatcaagaaaaccggattattcttctcaaactttcgctgattctttaagacctatcaacgaaaatattataaagctgggtcaattgaaggaatcaaaccgtcaaagcaaatacttcgcatatttgagcgctttatctgagggtgctcctttgttctcctgggttgcagtggacactcccgtgtctatggtcacagatttcaaggacgcagcacagttttggactaatagaattttgaaagaatacagagagtctgatcctaatgctgttgaatgggttaagaaatttttggcctctttcgataatttgaaagcctacattaaagagtatcatactactggggtttcctggaaaaaagacggtatggattttgctgacgcgatggcacaatcaacgaagaatacaggtgctacttcatctccttcgccagcaagtgctacagcggctccagcaccaccacctcctccaccagccccaccagcttccgtctttgaaatctctaatgatacaccagcaacgagtagtgatgctaacaaaggcggtattggcgcggtcttcgccgaactaaatcagggtgaaaatatcactaagggtttgaaaaaagtagacaaatcccaacaaactcacaaaaatcctgaattacgtcaatcctctacagtttcttccacaggaagtaaatccggtccaccaccaaggccaaaaaagccatcaacattgaaaactaagaggcctcctagaaaggaattggtaggaaacaaatggtttattgagaattacgaaaatgaaactgaatctctggttattgatgcaaataaagatgagtctatcttcataggtaaatgttctcaagttcttgttcaaataaaaggaaaagttaacgctatctcgttgagtgaaactgagtcatgcagtgttgttcttgattctagcatttccggtatggatgtcatcaaatccaacaagtttggcattcaagttaaccattccctacctcaaatctccattgataaatctgacggcggtaacatctatttatccaaggaatccttgaatactgaaatctacacctcgtgctcaactgctattaacgtcaacttaccaatcggcgaggacgatgattacgtagaattcccaatccctgaacagatgaagcatagcttcgctgatggtaagttcaaatctgctgttttcgaacatgctggttaa

SEQ ID NO: 3719 - DNA, 1581 bp, Saccharomyces cerevisiae
atggcacaaaacaattttgattttaaattcagccaatgttttggtgataaagcagatattgtggtgacagaggcggatctaattacagctgtagaatttgactatactggaaattatctggccactggtgataaaggtggccgtgtggtactttttgaaagaagtaatagtagacattgcgaatataagtttttaacagagtttcaaagtcatgacgcagaatttgattatttaaaatccttagaaattgaagagaagataaatgaaatcaaatggttacgaccaactcaaagatcacactttcttttgagcacaaatgataaaactataaaactttggaaagtttatgagaaaaatataaaattggtaagccagaacaacttaacagaaggggttacgtttgcgaaaaaaggcaagcccgataaccataacagtagaggaggctccgtgagggctgtattatctttacaatcgctgaaactgcctcaattatcacagcatgacaaaatcattgctgccaccccaaagcgtatatatagtaatgcacatacctatcacattaattcgatatcgttgaattctgatcaggaaacatttttaagtgctgacgacttgagaatcaatttatggaatctggacataccagatcagagcttcaacatcgtagatatcaagccaaccaatatggaagaacttaccgaagtgatcacaagcgctgaatttcatccgcaagaatgtaatttattcatgtactcttcttccaaaggtacaataaagttgtgtgatatgagacaaaattccctatgtgacaataaaaccaaaacatttgaagaatatttggatccaatcaatcataatttttttacagaaatcacgtcgtcaatttccgacataaaatttagtccaaatggtaggtatattgcatccagagattatttaactgtcaaaatttgggacgtaaatatggataataagcctttgaaaaccataaacatacatgagcaattgaaggaaagattgagtgatacctatgaaaacgatgcgattttcgataaatttgaagttaattttagtggtgatagttcaagtgtaatgactggttcttacaataacaatttcatgatctatcctaatgtagtaacttctggtgataatgataatggcatagtcaaaacttttgatgaacacaacgcacctaatagcaacagcaataaaaatatccacaacagcatacaaaataaagattctagtagtagtggcaacagccacaagcgtaggagtaacggacgcaacacaggcatggtgggaagtagtaatagctctagaagcagtatagcgggaggagaaggagcaaattcggaggactcgggaaccgaaatgaatgaaatcgtgttacaagctgacaaaacagcgttcaggaacaaaagatacggttcgctagcgcaaaggtctgcaagaaataaggattggggtgacgatattgatttcaagaagaatattttacatttctcatggcatccaagagaaaatagtattgctgttgcagcaactaataatttattcattttttccgcattataa

SEQ ID NO: 3720 - DNA, 1581 bp, Saccharomyces cerevisiae
atgtccaccctttttctgattggaatacacgagattgagaaatctcaaacaattgtacagaatgaacactattttgatagagtgattgagcttcaagatttggattctctgatggtagcattgtataaggacagagtttcgccttttccaaacgtccataactttgaaacgggcgtatctatagttctttatgacccttcaaaatttcaattatctgtgcgacaattggatgttctattcaagcgatttttcccatctttcaatatttctgcgatagatcatacacgagaggaaaacctgcaacgtcttgaatgtgttgagcgtgaaaatagcatctgtcgtaatagaataacgagaattaaccactggatgtatcaccatcatgatgatactccagacggtattaacaaaaacagctatggtactgtaaatgggaattctgtccccactcaagcatgtgaagcaaacatttacactttattattgcatttgaatgattccaaggcacaacatttacgaaaggcatcagtgccaaggctaattcgcaacatcgagtttatgtcttttttgtcagatccaatagaaaaaatttctcaagagggatcacattattggaacattctatcaacttgggacttttgtgctttatcattaagcactcaagaattgatttggtgcgggttcacgcttatcaaaaagttatctaaggatgcaaaagtactcattgcagataataagttactgctactactatttactttagaatcatcctatcatcaagttaacaaatttcacaattttaggcatgccatcgatgtcatgcaagccacatggcgattgtgtacatatcttcttaaagataatcctgtacaaacattactgttgtgtatggctgccataggtcatgatgtcggtcatcctgggactaacaatcaactattgtgcaactgtgaatcagaggttgctcaaaatttcaaaaatgtctctatcttggagaattttcacagggaattatttcaacaattgctatcagagcattggcctcaattgctatctatctccaaaaaaaaatttgattttatttccgaggctattctggccacagatatggcattgcattctcagtatgaggatagattaatgcatgaaaacccaatgaaacaaatcactttgatatctctaattattaaagctgcagacatctctaatgtgacgagaaccttgtcaatatcagcacgttgggcatacctcattactctcgaatttaatgattgcgctcttttggaaacatttcataaagctcaccgcccagaacaagactgttttggcgattcatacaagaatgttgattctccgaaagaagatttggaatcaattcaaaatattttggtgaacgtaacagaccctgatgatattatcaaagaccatccgcatattccaaacggtcaaatatttttcattaatacgtttgctgaagtatttttcaacgcattaagtcaaaaattctcaggattaaaatttttaagcgataatgtcaaaatcaataaagaatactggatgaaacacaagaaaccacaatag

SEQ ID NO: 3721 - DNA, 1581 bp, Saccharomyces cerevisiae
atgtctactatcccatttagaaagaactatgtgttcaaaaactgggccggaatttattctgcaaaaccagaacgttacttccaaccaagttcaattgatgaggttgtcgagttagtaaagagtgccaggctagctgaaaaaagcttagttactgttggttcgggccattctcctagtaacatgtgcgttactgatgaatggcttgttaacttagacagattggacaaagtacaaaagtttgttgaatatcctgagttacattatgccgatgtcacagttgatgccggtatgaggctttaccaattgaatgaatttttgggtgcgaaaggttactctatccaaaatttaggctctatctcagaacaaagtgttgctggcataatctctactggtagtcatggttcctcaccttatcacggtttgatttcttctcaatacgtaaacttgactattgttaatggtaagggcgaattgaagttcttggatgctgaaaacgatccagaagtctttaaagctgctttactttcagttggaaaaattggtatcattgtctctgctactatcagggttgttcccggcttcaatattaaatccactcaagaagtgattacttttgaaaaccttttgaagcaatgggataccctatggacttcatctgaatttatcagagtttggtggtacccttatactagaaaatgtgttctatggaggggtaacaaaactacagatgcccaaaatggtccagccaagtcatggtggggtaccaagctgggtagatttttctacgaaactctattatggatctctaccaaaatctatgcgccattaaccccatttgtggaaaagttcgttttcaacaggcaatacgggaaattggagaagagctctactggtgatgttaatgttaccgattctatcagcggatttaatatggactgtttgttttcacaatttgttgatgaatgggggtgccctatggataatggtttggaagtcttacgttcattggatcattctattgcgcaggctgccataaacaaagaattttatgtccacgtgcctatggaagtccgttgctcaaatactacattaccttctgaacccttggatactagcaagagaacaaacaccagtcccggtcccgtttatggcaatgtgtgccgcccattcctggataacacaccatcccattgcagatttgctccgttggaaaatgttaccaacagtcagttgacgttgtacataaatgctaccatttataggccgtttggctgtaatactccaattcataaatggtttaccctttttgaaaatactatgatggtagcgggaggtaagccacattgggccaagaacttcctaggctcaaccactctagctgctggaccagtgaaaaaggatactgattacgatgactttgaaatgagggggatggcattgaaggttgaagaatggtatggcgaggatttgaaaaagttccggaaaataagaaaggagcaagatcccgataatgtattcttggcaaacaaacagtgggctatcataaatggtattatagatcctagtgagttgtccgactag

SEQ ID NO: 3722 - DNA, 1581 bp, Saccharomyces cerevisiae
atgtggatactcatatacctatttatcatatggtcctcactgcgaacgtgggttactgctgttgactctactacgacagttggcgatgatctgaatgagaccgtttcagcatctgtctggccgacgatgtcccctcaaatgacggtggcctttaggtcccaaagagatgtcatgggaaacttaactatagaccagctgccgtatgttggtttgaatctacgacgggttctgttgaacaatgagactagcatggtaaatgaaggtaataatacaagattactgactttgttcaaatctatgctatcctccgaagcaaatgcttttgtcctcgacttggaacaatataataatgatttgagagtggtagatacgacattgttatttagcgacgttctaactgctttacagtcattcatcttcagcacacaaaacaacctctatgcgaatatcattgtactgttgctgaatatatcagctcctgaactggattccacagaataccgccaccaaaaccaaactttgaacactacttatatactggacaaaaatttaggaaatagtttcatttacaagcctacggatttacaaagtgatagagcaaagaataatacctggaacatctacggaaaatcgtccattgacggttggcccactctgggctctgtgctatatgaacaaaagaagagactggttataggtgagctgaccgatttttttaatgaaactactgctccatatatttttcctcatgacgtctttcattatgagcaggggaactctacattagattgcccctctactgtagagggtctgactgatttatcatctatccattggagattcttagattcgctgttcaattccgtggacatcaaagagtatatttcgtgtggtttatcaccaataataagcaattcagcgtacgtcaataatgtgacgcagttagcagatataattcatgaaggcagcgtttggtcatgggatagtgaccaaccttcagttactcagtcaacttctaaatctggcagctcatccgggaccttagaggcttacaattgcgttctcttgtactactttgctaacaatgagacagtaacatggcgagtaggtaactgttacaattctaatattgggctctgtagatatgaaaatatggcattccgatggttggtgagatcaaataaggctacgtactttgattttgatagttaccagggatctaaatgtcccgatcagtattcatttaatattcctagaagcccattggagcagagatcgtttattgcatatatgaggaattcctccttctctgacacacaaatatggatagatttgaactctatatcagtaagcaattgttgggtaagtggtggtccttatgctagttgcccatatgaaaaagtcatttctaggagaaatttcgtaacaatgatggtccctgcgtcagtctgttcctttgccctactgtgtattgtcgtttacttgagtgtattgagggtccccatttatgataatagaaaaaattggagaagagttatcaataaaatctctaaatccgagctagaaggtgtcccttcttaa

SEQ ID NO: 3723 - DNA, 1584 bp, Saccharomyces cerevisiae
atgaatgtcatattttctttggcgagtttcgtcaaaaacatgtataatgcaagtttgaaccaacgtaatctaataagcctgccgttcaacttcatgcttaattttgcgccagtgtttatttggctgtctatattcaagcgcgctggtctgatacccataaggctcagacctgacattcatagcaagtttgctttttttgctgatcaattcctctttggggactattggcatgaacttactgtacaattgcccgataatacttcgaagctatttttctggtcattcatatcatcttctgcatttctcttagtatttctgatatgtattccctttgccatttggtactacatctattacattaagcacgttaactataatctgttagagtggttcgcaaatatttttcattacccctgcaagcgcaagcagcggccgatccaaaagagatttcggacaattttcataccgtttgccttgcccctgtttacatttgttatactcaacattgatcatttctttgcttaccagtcggatgcaaactttactaagaccaaggatttactggcttggttctcctatgtcatcctgcacttgacagctccaattttaacagctgtatacttatacgtcttccaaccaccggggactttaaaatgctttagttttgccctaggattacaaaatatagcgggggtccttacccatctgcttgttccaatggcctccccatggtttactcatctgtacggtattgatgacaccgaacatgttaattacacccaggaagggtttgctgccggtttgataagagtagatagccatttgggtactcatttgaacactaaaggatttcacatgtctcctattgtgtttggtgctgttccttcactacactccgccattgcatttcaatgtttcttgtttttggtttcaaggtccaccagcttaaaacacagattttccaatgctggaggtttcacaatgcacaataatgattcttccactttcaagttgagtgaggaagacagcgaagatgaaggtgacaatagcataccgcccacgattggccctaacgacttagagatggaaccattgggtaccgttgagcctgtagatatttcaaatgagcggtcctcctccccttcatcttcattcaccgtatccagtaatgaaagaagcaccggcggcggcgacggcagcattattaacagcaatggcaataagaaacctctccagtttgtccatttatatgatgaagacacgaacttcacaaacaaatggatttttaaaatagtcaacgatgggtttataccaaaattctgggctatcctatatataatactacaatggtgggctaccatgtatctggaccaccattatagatttgaccttttcgttggtgttttatatgcaatgacaagtttcatcatcataaactggtttgttttacaaccaaaagttttaaaaaagtggattcatataaggttaggcgacaaagtggatacaagaaacgaagctcgcacttttggcatgagagtattttgtggcaccaagatggaatggttttttgatccgcttgcatag

SEQ ID NO: 3724 - DNA, 1584 bp, Saccharomyces cerevisiae
atgagtctctcgcaggtgtcacctttaccccatatcaaggatgttgttttaggagatacagtaggccaaggcgcattcgcctgcgttaaaaatgctcatcttcaaatggatccctccattattctagctgttaaattcattcatgttcccacttgcaaaaaaatgggactcagtgacaaggatatcacaaaagaggttgttttgcaatcgaagtgttctaagcatcctaatgttttgagacttatcgattgtaatgtctctaaagaatatatgtggataattctggagatggcagatggtggtgatctatttgataagattgagcctgacgttggagttgattccgacgtggcccaattttactttcaacagctcgttagtgctattaattatctgcatgtagaatgtggagttgctcacagagacatcaagcctgaaaacatcttactcgataagaacggaaatctgaagctagctgattttgggctcgcctctcaatttaggaggaaagatggtacattacgtgtatccatggatcaaaggggttctccaccctacatggctcctgaagtattatattctgaagagggttattacgcagatcgaacagatatatggtctattggcatcctcttgttcgtattgttgactggtcaaacgccttgggaattaccttcattagagaacgaagatttcgtcttttttattgaaaatgatggaaatttaaactggggaccctggtcaaagatagaatttactcacttgaacctactccgaaaaattttacaacctgacccaaataagagggtgacattgaaggctttaaagttacatccttgggtattacgtcgagcttcattttctggggatgatggtctctgtaatgaccctgaactcttggctaagaaactgttttctcacttaaaagtctcactgagtaacgaaaattatttgaaattcactcaagatacaaactctaataataggtacatttctactcagccaattggtaacgaattggctgagcttgaacacgactcaatgcatttccagacagtttcgaatacacaacgtgcatttacctcgtatgattcaaatacgaactataatagcggaacaggtatgacacaagaggctaagtggacgcaattcataagctatgatatcgctgccttacagtttcattctgatgaaaatgattgtaatgaattagtaaaacgacatttacaatttaatccgaataaacttaccaagttctacacgttgcaacctatggatgttttgttaccgattttggagaaagccttgaatttatcacaaattagagtaaaacccgacctttttgcgaattttgaaagattgtgcgaattattgggttatgataacgttttcccacttattataaatattaaaaccaaaagtaatgggggttatcaattatgcggtagcatttccatcataaagattgaagaagagttgaaaagtgtcggatttgaaagaaaaactggtgatcctttagaatggagaagattgttcaagaaaatttcaactatctgtagggatattatcctaattcccaactga

SEQ ID NO: 3725 - DNA, 1584 bp, Saccharomyces cerevisiae
atgagtgacttacaagaccaagaacctagcattattatcaacggtaatttggaaccagttggtgaaccagatatcgttgaagaaacggaagttgtagctcaagaaacacaagaaacacaagatgctgataagccaaagaagaaagtcgccttcactggcttggaagaagacggggaaactgaagaagaaaaaaggaaaagggaatttgaagaaggtggtggtttgcccgaacaaccattaaaccctgatttttcaaaattaaacccactatccgccgaaattatcaacaggcaagctacaataaacatcggtaccatcggtcatgtcgcccacggtaaatccacagtagttagggctatttcaggtgtccaaacagtccgttttaaggatgaattagaacgtaacattactattaagttaggttacgctaatgctaaaatttataaatgtcaagagcctacatgtcccgaacctgattgttatagatcattcaaatctgataaagaaatcagtcctaaatgtcaaagaccaggttgtccggggcgttacaaattggtccgtcacgtttcttttgttgactgtcccggtcacgatatcttaatgagtactatgttatcaggtgctgctgttatggatgctgcgttactgttgattgcaggtaatgaatcttgtccacaacctcaaacctcagagcatttagctgccattgaaatcatgaaattaaagcacgtcatcatcttacagaataaggtcgatttaatgcgtgaagaaagtgccttagaacaccaaaaatccatcttgaagttcatcagaggtaccattgctgacggtgctcctattgtaccaatatccgctcagttgaagtataacatcgacgcagttaatgaatttattgtcaagactattcccgtaccaccaagagattttatgatttctccaaggttaattgttattcgttcatttgatgttaataagccaggtgctgaaatcgaggacctgaaaggtggtgttgccggtggttctattttgaatggtgttttcaaattaggtgatgaaattgagattagaccaggtattgtcaccaaggatgataagggtaaaattcaatgtaaaccaatcttttctaacattgtctccttatttgccgaacaaaatgacttgaagtttgctgttcccggtggtctgattggtgttggtactaaagttgatcctaccttgtgtagagctgatcgtcttgtcggtcaagtcgtcggtgctaagggtcatttgccaaacatttatactgatatcgaaatcaactactttttgctacgtcgtctattaggtgtcaaaacagatggtcaaaagcaagccaaagtcagaaaattagagccaaatgaagttcttatggtcaacattggttctaccgctacgggggctcgtgtggttgccgttaaagctgatatggcaagattacagttaacgtcgcccgcttgtactgaaattaacgagaagattgctttgtcgagacgtatcgaaaagcattggcgtttgattggttgggcaaccattaaaaagggtactacattggaacccatcgcttaa

SEQ ID NO: 3726 - DNA, 1584 bp, Saccharomyces cerevisiae
atgagtgtacagatatttggagaccaggttacagaagaaagagcggaaaacgcccgtttgtcggcgtttgtcggtgccattgccgtgggtgatttggtgaaaagcacattaggcccaaaagggatggataaattattgcaaagtgcgtccagtaacacttgcatggtaacaaacgatggtgctacgattctgaagtcaattccgctggataatcccgcagccaaagtgttggtgaacatcagtaaggtgcaggatgacgaagttggagatggtaccactagtgttactgttttgagcgcagagttgcttagagaagcagagaagttgattgatcaatccaaaatccaccctcaaactattattgaaggttaccgactagcttcagcagccgcattggatgcgttaacgaaagcggctgttgacaactctcatgataagaccatgttccgtgaagatctgatccatattgccaagactactttatcttccaaaattttgtctcaggataaggatcacttcgcagaattagcaactaatgctattttgagattgaagggctccactaacttagaacatattcagatcattaagattcttggtggaaagctatcagattcgttccttgacgaaggtttcattcttgccaaaaaatttggtaacaaccaacccaagagaattgaaaatgctaagattctaatcgccaatacaactttggatacagacaaggtcaaaatattcggcaccaaattcaaagtcgattctactgctaaattggcacaactagaaaaggcagaacgtgaaaagatgaagaataaaattgccaagatttccaagtttggtatcaacactttcatcaatagacaactaatttatgactatccagagcaattatttacagatttgggcataaactcaattgagcatgctgattttgaaggtgtagaaaggctcgccctggttacaggcggtgaggtggtgtctacatttgacgagccaagtaaatgcaaactgggagaatgtgacgtgatcgaggaaattatgcttggtgaacagccattcttgaagtttagtggttgcaaagctggtgaagcttgtaccatcgtcctaagaggtgctaccgaccaaacgcttgatgaagctgagagatccctgcatgacgcattgtccgtgttgtcacagaccacaaaggaaacaagaactgttcttggcggcggttgcgccgagatggtcatgtcaaaagctgtggacaccgaagctcaaaacatcgacggaaagaagtcccttgccgtggaggcttttgcccgtgctctgagacaactgccaaccattttggcagataatgctggttttgacagcagcgaacttgtgtccaaactaagatcctccatatacaacggtatctccacctcaggtttagatctcaacaacggaaccattgccgacatgagacagttaggtatcgtcgagagttacaagctaaaacgagcagtagtcagctctgcatctgaagccgctgaagttctactaagggtggataacatcatccgtgcaagaccaagaaccgccaatagacaacatatgtaa

SEQ ID NO: 3727 - DNA, 1584 bp, Saccharomyces cerevisiae
atgccaatggatttccaacctacatcaagtcattcgaactgggtcgtgcaaaagttcggtggtacatctgtcggtaaatttcccgtccaaatagtggatgacattgtgaagcactattctaaacctgacggcccaaacaataatgtcgctgtcgtttgttccgcccgttcttcatacaccaaggctgaaggtaccacttctcgtcttttgaaatgttgtgatttggcttcgcaagaatctgaatttcaagacattatcgaagttatcagacaagaccatatcgataatgccgaccgcttcattctcaatcctgccttgcaagccaagttagtggatgataccaataaagaacttgaactggtcaagaaatatttaaatgcttcaaaagttttgggtgaagtgagttcacgtacagtagatctggtgatgtcatgtggtgagaagttgagttgtttgttcatgactgctttatgtaatgaccgtggctgtaaggccaaatatgtggatttgagccacattgttccctctgatttcagtgccagcgctttggataacagtttctacactttcctggttcaagcattgaaagaaaaattggccccctttgtaagtgctaaagagcgtatcgttccagtctttacagggttttttggtttagttccaactggtcttctgaatggtgttggtcgtggctataccgatttatgtgccgctttgatagcagttgctgtaaatgctgatgaactacaagtttggaaggaagttgatggtatatttactgctgatcctcgtaaggttcctgaagcacgtttgctagacagtgttactccagaagaagcttctgaattaacatattatggttccgaagttatacatccttttacgatggaacaagttattagggctaagattcctattagaatcaagaatgttcaaaatccattaggtaacggtaccattatctacccagataatgtagcaaagaagggtgaatctactccaccacatcctcctgagaacttatcctcatctttctatgaaaagagaaagagaggtgccactgctatcaccaccaaaaatgacattttcgtcatcaacattcattccaataagaaaaccctatcccatggtttcctagctcaaatatttaccatcctggataagtacaagttagtcgtagatttaatatctacttctgaagttcatgtttcgatggctttgcccattccagatgcagactcattaaaatctctgagacaagctgaggaaaaattgagaattttaggttctgttgatatcacaaagaagttgtctattgtttcattagttggtaaacatatgaaacaatacatcggcattgctggtaccatgtttactactcttgctgaagaaggcatcaacattgaaatgatttctcaaggggcaaatgaaataaacatatcctgcgttatcaatgaatctgactccataaaagcgctacaatgtattcatgccaagttactaagtgagcggacaaatacttcaaaccaatttgaacatgccattgatgaacgtttagaacaattgaaaagacttggaatttaa

SEQ ID NO: 3728 - DNA, 1584 bp, Saccharomyces cerevisiae
atgcctcaaaatacaagacacacgtccatcgtagaaatgctttctaccccacctcaattaccgaattccacagatttaaatagtttgagcgaacagacagacaagaacactgaagcaaacaaaagcgacacagaatcactacataaatctatttcgaaatcgtcatcttcatcttctctctccacgctggataacacggaatactcaaacaataatggcaactccttgtccaccttgaattcacagaatctgttatctgttcataggcaggagtggcaacacactcctctgtcaaatttggtggaacagaacaaattgattttcatcagaggttctatttccgtagaggaagcattcaacacgctggtcaagcaccagctaacgtctttgcctgtggagaattttccgggagacatgaattgtttaacattcgactataatgatctcaatgcgtaccttcttcttgtattaaacaggatcaaggtgagcaacgacaagataacctcagactgccagaatggtaagtccgtgcccgtgggcgagatagtaaagttgacacctaagaatccattctacaaattgcccgaaacggaaaacttatcgacggtaataggcatactaggctcaggtgtgcatcgtgttgccatcacgaacgtggaaatgacacagattaaaggtatactttcccaacgtcgattgattaagtatctgtgggagaatgcgagatcatttcccaacttgaagcctctcttggactcttccctggaggagctgaatattggtgtactaaatgcagcccgtgataaacctacattcaagcagtcacgtgtcatatccatccaaggtgacgagcatctaattatggctctgcataaaatgtatgtcgaaagaatctcttccattgcggtagttgacccgcagggaaacttgattggtaatatttcagtaacagacgtcaaacacgtcaccagaacttcacaatatcctttattacacaatacatgtcgtcattttgtctcggttattttgaatttaaggggcctagagaccggtaaggactcatttcctattttccatgtgtatccaacaagttccctggcaagaacgtttgccaaattggtcgctaccaaatctcacagattatggatagtacaaccaaatgacaatcaaccaacagcatcttccgaaaaatcctcatctccatcaccaagtactccacccgtaacgacattgccatcgcttgcgtcgtcataccattcgaacacgcaatcttccaggatggccaactctcctgttctaaaatcttcagatacatcaaacaataaaataaatgtaaatataaatttgagtggtccctcaccttctcaaccacagtctccatcggccacaatgccaccacctcaaagtccaagtaattgtcccgcatctccaactccagcacatttcgaaaaggagtatagaacaggtaaattgataggtgttgtgtcattgactgacatattaagtgttttggcaagaaaacaaacgcatcataaggaaattgatccgcagatggcaagaaagcaaagagggcatataggctga

SEQ ID NO: 3729 - DNA, 1584 bp, Saccharomyces cerevisiae
atggctgatgaaaagagactggaggatttgagatccaaaataatggagtctataggaaaatcagaaaaggatgttgtgccgattgagaacaaaagattcaacacggataatgcagttatagatacacattttaagaggcaaaaaagtgacggtgagcttccgaaagcgccaaaaagtagaaacgtttcacattctaataacagaggaccatcgtcaataattactatgagcacgaatcgaacgacttatgaacaaacaagggcaggtcctcatcgtcaaagttatcgggatgcatcgggaagatcatataacagggagaatcggtatagtagtcacaatactgggccccaatggaacaacaatccctataataggcaacgggatgaaagaagaggaagaaatgaaaggttcgatagaaggggaagaaatggaaacggaaactacgatcgtttcaattaccaaaggaagaacgaaggttctaaattcaatggcgaccgtgataaaaggcagttgcaaactaataaatatgacatgaactataattcccaaaatgtaatgtacccgggttcatcattcgattctccggcttactacaacatggcctcatccaaggcaaattcaaggcttgtaatttcgggcttgtctcaaagcagcgaccccagcattgtagcaagattgaaagatttgctggaaaattttatttcaggtctccagaaaactgagagtaatgcggaggactttaaaatttccaacttttatattggtgaaggaaggccggaccatattattgttgagtttagttctcagatctgtagcactatggttttggcctgtcgatcattctttaatgcgaagcttggtactttcgacttaaaatggagaagacctaatgattatgttcaacaacttgatcatctggtcgatttttgcaggggtacggtaattgcattggaaaatttggaaaatataggcgagggtgaagattatagaatgaaagagcttttttcgtcattgaatgtaacaaacggtaccgctaagccacttttttacaaatgttcgtccaatacaaacaacactggcaaagaatccgaattcactaaatgtattctattatcgtttgaagtcgtcactcaggatattcttgataaattaaaaccatacaaatggttcaagccaaatgatggaaagatatcacaagttacttcatggattacgtttcaaagcctgccaaatctggttacccaatctgttcgtgttgaatcgagagttttgttgctcttaaattgtcttgatccattggatttgaaagatgaaacctttatcacagaaattaaagaaacattaaagtatagtatcgcgggagcagatacgattaaaatatgccaacccggcgtcgattacagacttaattttgaaaacttggcttccggagccggtaatatttatatcaagttcaagaccttggaggcagcaaaacacgcaatggaagaattgccgggtacgcaattcaacgatcgcactgttctgtgtacttatatagatgaggacgactttgacatgatggaagcaacccaactttcctaa

SEQ ID NO: 3730 - DNA, 1584 bp, Saccharomyces cerevisiae
atggcttctacttcgaacacgttccctccaagccaaagcaattcttccaacaaccttccaacttctagacatgcatccattgtggagatgctgtctactccgccattgctgccccacgttcaagtgaacgatacagacgacaaggaacaaccagaagagtccacgccgccaacagcaacagcggcagcgcctggtccaggttgtgctgctacacccgcccccttgcgcgatgaaaagcctcaattcaaactatcagctgttcctatgacccagacgccatcgcagtgtctgtcatgtgtgcacgcccaaaaatggcaacacataccgttgtcgcaattgatcgaacagaataagcttatttttgttccaggttccatatcggtagaggaggcattcaacactttgatcaagtatcatctaaactctattcccgtggaatctttccccggcgacatgaactgttttactttcgactacaatgaccttaattcgtaccttttgctggttttgaataaaatcaccgtcagcaacaaacagcttactgcagattgccagaatggaaaacccgtaccagtgggcgaaatggtgaaactaactcctaagaatccgttctataagctgccggagaatgagagtttgtccacggtgatggggattctcggttcgggtgtccatcgtgtagcgataacaaacgaagagatgaccaaagttaaaggtattttgtcccaacgtcgtttgataaagtatctttgggacaacgctagatcttttacaagcttagaacctctattaaactcctcattacaagatttgcacatcggtgttctcaatattcaatctaagccaacttcaagacaatcccgtgtcatctctattcaaggcgaggagcccttaatcatgggcctttataaaatgcatgtggaaagaatttcttccattgcagtcatcgacaaacaaggtaatttgctaggtaacatatcggtaacggacgtaaaacatgtcacaagaacctcccaataccccttactacataagacatgtcgccatttcatttctgtcattttaaactccagaggattagaaacgggtaaagattctttccccatttttcacgtataccccagtagttcactagcaaggactcttgccaagttagttgctacaaagtctcatagactatggatcgtacaaccgccggagtcgtcaacctcggcgtcatccacaaatttaacagctgctaatactgcagccaatgcagtttctgccaccgctcaatcgtctgctaatggtgcgactccaatgtcaaagtcatcctcttcaacatccctcaactcccactctccgttgatgacagcaatggaagacccaccatccccacgttcttcggccatcgcgatcccaccaccaagtcccgcttcctcaacaaacacaccaaacctattcgaaaaggaatatagaacgggtaagttgatcggtgtggtctcattgacagacatcatcaacttattagcaaggaaacaaacagggaataaagaagtggatccgcaatccgcaagaagacagagaggcagtatcgccatgtga

SEQ ID NO: 3731 - DNA, 1587 bp, Saccharomyces cerevisiae
atgaaattgtcttccgcttttgtattatctgctatcaccgttgccgctttaggcgaaagtattactactacgataactgctaccaaaaatgggcatgtttacaccaagactgtcactcaagatgctacttttgtctgggcaggagaaggcgctgcggtaacctccgcagtaactgaagcgtctactgtcgctgcaacgtctgctgccgctgaaacatctgttgccgctgaaacatctattgttgagccttccacttctgctcagggcacctctgctgatgaagggtctggttcgagtataaccaccactattacagccaccaaaaatggacatgtctacacaaagaccgtcacccaggatgctactttcgtatggactggagagggtgaacgtgctcctgcctcaactgttgctactgtcgaaacatctgttgccgctgaaacatctgttgctgaaccttctacctctgctcagggcacctctgctgatgaagggtctggttcgagtataaccaccactattacagccaccaaaaatggacatgtctacacaaagaccgtcacccaggacgctactttcgtatggactggtgagggtgaacgtgctcctgtctcaaccgttgctactgtcgaaacagctgcttctccagtaacatctgttgctgaaccttctgcctctactgatgaaggatctggttcgagtataactaccactattacagccaccaaaaatggacatgtctacacaaagaccgtcacccaggacgctactttcgtatggactggtgagggtgaacgcgctcctgcctccaccgttgcaacttctagtatttctgctattgaaattccctccactactgaggcctctattgtggaggcttcttctgctgttgagacttcctctgctgctgagacttcctctgctgttgagacttcctctgctgttgagacttcctctgctgttgagacttcttctgctgctgagacttcctctgctgctgagacttcctctgccgttgagacttcctctgctgttgagatttcttctgctgttgagacttctgctgttgagacttcttcttcttcctctactatcgagaccacttctgttaaaagcttatctcctactcagacttctctttcatcttctgtccaggcttcttctcctattgagacttcttctgctgcaaaaacctcttctgttgtgccaactttttcttctactactactgaaaattcctctaattctaaatccacgtctgcagttgtagcatctactaccacctcctctgagtcaagcgctactattgttactcctactagaattgggcaagcttacacagagagttcttctagggatgcccaatctgttcgtacccatgaaagtaacaattggtcatcaagttcttctgcaagcacaaaaatggtatcctctattacaagagttcaaaccactaccgctggtattttcactaacggtaagtcgtccacaactcctcaaatcgtgaattacacgggtgcggctgattctatcgccgctggtacgggtctgatgggcgctgcgctcgctgccgttatctttttgtaa

SEQ ID NO: 3732 - DNA, 1587 bp, Saccharomyces cerevisiae
atgaattatggcgtggagaagctgaaattgaaatattcgaagcatgggtgtattacttgcaagatcagaaagaagagatgctctgaagataaacctgtgtgccgggactgtcgtcgattaagttttccctgtatctatatatcagaatctgttgataagcagtctttgaaaaaaataaaggcagatatacagcaccagttgatcagcaagaaaagaaagcatgctcctgacagtgctcagaaagcggccgtggccacccgtactcgacgggtcggtagcgacgaacaggataaccaggtatatttgtcaaaaccgctggaagattgcatttctcagaagctggactctatgggattgcagctgtacaactactacaggtctcaccttgcaaacataatttccatcgcgcccatgaaccagaactactatctgaacattttcttgccaatggcccacgagaatgatggtatattgtttgctattcttgcttggtcagctaatcatttgtctatatcatcatcaaatgagctgcgaaaggatgaaatatttgtcaacttggcgaacaagtatacatacatgtcgttatcgcatctaaagacaaacgagggctcaagtgcctgtgctaaactggggtttctatattcactagcacaaatcctaatcttatgtggttcagagatatgtcagggtgatgtgaaattttggaagatattattgaatataggaaaaaatttgatcgaaaaccatgtgggcaaggatgtctcacggatactaaccactactacagaagaaccctccctagaggagaggataatcttccccaatttcaattccgttgttaagtactggctgattgtgaattttatatatcatgatattttgaatttcaatacaacgtccttcccgatcgaacaatacgagaaattcttccaaagggatcagaactctttacccagctcagccaactttattgagtcaatagactcgccaattgaggaaatagaccctttaattggcatcaacaagcctattttactactattgggacaagtcacaaatttgacgaggtttttgcagactatggaacaggaagaaatgctagagcatggcgataaaattttgagtttgcaagtcgagatttataaattacaaccttcgcttatggcgctggaacatttggatgatgaaaagaaattttactatttagaactattcgagataatgaaaatttctaccttaatgttctttcaattaactttattaaagattgacaaagattcgctggaactacagatactgagaaacaaattggactcgaagctagacaaggtcatcggaacttttttggaaggatcgttatgcttcccacttttcatttacggtgtatgcattcaggtagaagatatggagaaaaaaatagatttggaagccaaatttgacgacattttaaaacgatataaatgttacaatttccaaaatgctagattattgatacggaaaatttggcaaaacgaggctgatggcatcagtgagcatgacctggtccacatgattgacgaattagattacaatattaattttgcctga

SEQ ID NO: 3733 - DNA, 1587 bp, Saccharomyces cerevisiae
atgactaaatctcattcagaagaagtgattgtacctgagttcaattctagcgcaaaggaattaccaagaccattggccgaaaagtgcccgagcataattaagaaatttataagcgcttatgatgctaaaccggattttgttgctagatcgcctggtagagtcaatctaattggtgaacatattgattattgtgacttctcggttttacctttagctattgattttgatatgctttgcgccgtcaaagttttgaacgagaaaaatccatccattaccttaataaatgctgatcccaaatttgctcaaaggaagttcgatttgccgttggacggttcttatgtcacaattgatccttctgtgtcggactggtctaattactttaaatgtggtctccatgttgctcactcttttctaaagaaacttgcaccggaaaggtttgccagtgctcctctggccgggctgcaagtcttctgtgagggtgatgtaccaactggcagtggattgtcttcttcggccgcattcatttgtgccgttgctttagctgttgttaaagcgaatatgggccctggttatcatatgtccaagcaaaatttaatgcgtattacggtcgttgcagaacattatgttggtgttaacaatggcggtatggatcaggctgcctctgtttgcggtgaggaagatcatgctctatacgttgagttcaaaccgcagttgaaggctactccgtttaaatttccgcaattaaaaaaccatgaaattagctttgttattgcgaacacccttgttgtatctaacaagtttgaaaccgccccaaccaactataatttaagagtggtagaagtcactacagctgcaaatgttttagctgccacgtacggtgttgttttactttctggaaaagaaggatcgagcacgaataaaggtaatctaagagatttcatgaacgtttattatgccagatatcacaacatttccacaccctggaacggcgatattgaatccggcatcgaacggttaacaaagatgctagtactagttgaagagtctctcgccaataagaaacagggctttagtgttgacgatgtcgcacaatccttgaattgttctcgcgaagaattcacaagagactacttaacaacatctccagtgagatttcaagtcttaaagctatatcagagggctaagcatgtgtattctgaatctttaagagtcttgaaggctgtgaaattaatgactacagcgagctttactgccgacgaagactttttcaagcaatttggtgccttgatgaacgagtctcaagcttcttgcgataaactttacgaatgttcttgtccagagattgacaaaatttgttccattgctttgtcaaatggatcatatggttcccgtttgaccggagctggctggggtggttgtactgttcacttggttccagggggcccaaatggcaacatagaaaaggtaaaagaagcccttgccaatgagttctacaaggtcaagtaccctaagatcactgatgctgagctagaaaatgctatcatcgtctctaaaccagcattgggcagctgtctatatgaattataa

SEQ ID NO: 3734 - DNA, 1587 bp, Saccharomyces cerevisiae
atgagctatggaactataaatgatatgaatgaatcggtaacgaactatcgaataaaaaaagcccaaaacaatatcaagggatggtacgcttactcattttctagcgaaccatttgtcgtttctgcggtttcaacgtatattcccttactactgcagcaatttgcgagtataaatggtgtaaaagttcacgatcactccataccctgcctgtcagaaacgggtagtgattcagataagtgtgttcttggtttgttcaacaatcggatcttcgtagatacttcaagttttgcattatatgtcttttcccttagcgttttattccaaactataatagtcatttccgtttcagggatagtagatctctgggggagcgttaaattcaaaggcagaattctggtttggtttggtattgtgggcgcattgtcgactgttgcgatttcaaaattgaatgatacccagatttattctctggctgggctttatatagtggccaatggttgttttggcgttatcaatgttgttgggaattctcttctgcccatttttgtcaaggattctttgaaatgtcaaagtcaaggagcttatgaacctgataaggtagactcgttaactactgttattagcggtagaggtgcatctttaggttattcaagtgccctcattgttcagattgtatctatgttcttagtcgcatctaaaaagggcagtaagcaggatgttcaagtggctgttcttttcgttgggatttggtggtttgtgtggcaactgcccatgatctggttgattgacgatgtgacaataccgataagagttgacgattctacattagcatccgcccgcagtccgtatcccggtgagcaagacgccttgggtcaactaaactggaagaattacctttcatatggttgggtttcgcttttcgaatcgtttaaacatgccagactattgaaagatgtgatgatttttcttattgcgtggtttattattagtgattccattacaactataaattctacagcggttttgttctccaaggcagaactgcacatgagtaccctcaatttaatcatgataagtgttttgaccgttgtaaatgcaatgctgggtgcctttatgattccacaatttcttgccacaaagtttcggtggacttctagtcaaactttgatgtacattatcatttgggcaagtttcataccattttatggtattcttggatttttcttcaatgcgttcggtttaaagcataagtttgaaatgttcttattggccatttggtatggattatcactaggtggcctgtccgcggtttcaagatcagttttcagtttgattgtacctccaggaaaagaatccacgttttttagtatgttcagtatcacagataaggggtcgtccatcctgggacccttccttgttggactgcttaccgataaaacgcataatattcgctattcgttttatttcttctttttgcttttgatgctatcattgcctgtgctaaactgtttggatgtcaagagaggtagaagagaggctgaagaactcagtcaagttttacctgaaagtgaaagaaggttggattag

SEQ ID NO: 3735 - DNA, 1587 bp, Saccharomyces cerevisiae
atgcaaaatgctcaaataaagagctcttctaaaggcagcggaatagatggtacagatcgcaatagcaaagatggtgtagaaaagagacccctggaagatgtaaagcaaatgattgacgctggaacaccagatgttggccacaaatctactgttgaaactaagccaaacgttggatggcaagcctctcacagtaatttggctgcattacacgaaaaagagcagaaatatgaaatggagcaccatcatgctcgtcataaactgcatcgtcaagttattccggattacacgtctgcctcgaccgcaatgttcagcgattgtatgttcaacgcagcaccagataaagtacgaagtctcagtacgatgaagtcttctggactctcgccaaaacacccatttaacgtagtcgccacctttaaaggaccattcccgcagcatagtgtagaatcaaagcctctcgatggtggatactctgccaaagaccattttccctcatttaagatgttgcaagcccagcagcacccagcccatcgccattacaaagacaacgacaagtacggtcttaaatcaccttcccggtccttcgtgaaggacaagaaaaggttggttcaccggtttttgaaatccatggagccttcttcgtctgggcaatctaaggattcgtctgcactggcgccggctttcgatccaatattgcccaatgttatatctaagccttccaagcgacccacacatcattcgcattcatcagacgggagttctagcacgcagacagatatatcgttacagagcttgctttaccatgatcttgaaagctcaccaaagaaacatgtttcgccctcaagaccgccctctgtagcttccgaatcctctcctgccgttgctaatcccattgggctttcgccaaaagacgcctgcaatgcatcgttttcgcagtcgtcctcatcttcgttgtcttcttcttcatcgtcttcatcatcgacgtcattctcacagtcagtggctgttgatcctcttgaacctcctggaaatatcacatatagtagttcgaatctttcgctaaattcagatgaattagactactatcagcgtcatatcggattgcagttacagcagacagaagctttactaaagcacagtttgaaagatgaggttctgaaagatgaaaatgaccttgttaaaaacattgcaaattttgacaagatcgttaaagagctaagggacttaagatccaggaccattggatggaaagagcttgttgaagaggattatttaatgaatttgaaacaggattttgacaaggaaaaccccgaatcatttgaggcacgtttgagtgatacaataaatacaaacgtggcaaaattacaagatttagagaaaagaatggcttcttgcaaagacaggttggcctctaggaaggaagtaatgaggaaaatggaaagtttattgtctttggagaattccttaatgatatccaaaaaaaatgtaacattcgcatctaaataccgcaacgaggcccttgatattgtctttttaattatcatcatcgtcatatgctataccttcaagcatctagtatcgcataaataa

SEQ ID NO: 3736 - DNA, 1587 bp, Saccharomyces cerevisiae
atgcaacaaaacacgtctttatatgactctttgaacgttactgccgctgcatccacatctgagattaagaaagcttacaggaacgctgcattaaaatatcatcctgataaaaacaatcatacagaagaatccaagcgaaagtttcaagagatatgccaggcatacgaaatacttaaagacaatcgtttaagagctttgtatgaccagtacggtaccacagatgaagtcctgattcaagagcagcaggcgcaggcgcaacgccaacaagccgggccgttcagttcatcctcaaatttcgatacggaagcaatgtcattcccggatctatctccaggtgatcttttcgcgcagttttttaatagttctgctaccccctcttctaatggctccaaaagcagttttaattttagcttcaataatagctctacgccgagcttctcctttgttaatggcagtggcgtgaacaatctgtactcctcgtcagcaaaatacaactccaacgatgaggaccatcatttggatagaggccctgatatcaaacataatctaaagtgcacattgaaggaactctacatgggtaagactgcaaagttgggtttgaataggacaaggatttgcagtgtttgtgatgggcacggtggtctaaagaaatgcacttgtaaaacatgcaaagggcaaggtattcaaacccaaactaggcgtatgggacctctagtacaaagttggtctcaaacttgtgcagattgcgggggtgccggggtttttgtcaaaaataaagatatttgccaacagtgccaaggtcttggcttcattaaggagaggaagattctacaagtcaccgttcaaccgggatcgtgtcataaccaacttatagtacttacgggcgaaggtgacgaagttattagtactaagggaggcggtcacgaaaaggtaatacctggtgacgtcgttatcaccattttacgtttaaaagatccgaatttccaggttatcaactactccaatttgatatgtaagaagtgcaaaatcgacttcatgaccagtttatgtggaggcgtagtttatattgaagggcaccctagcggtaagttgatcaaacttgatattatacctggcgagatactgaagcctggttgtttcaagactgttgaggacatggggatgcccaagtttatcaacggtgttcggagcggtttcggtcatctatatgtcaaattcgatgtgacgtatccagagagactggaacctgaaaatgctaagaaaatacaaaatattctggctaatgataaatacattaaagcagaacgttccaccatggaaaccgcagattcagactgctattgcgatttggagaagtcatatgacagtgtggaagagcatgtgttaagtagctttgaggcccctaatttaaacaatgaagttattgaagacgacgaccttggtgatttgattaatgaaagagattctcggaaaaggaacaaccgtcgattcgacgaaagtaatattaataataataatgaaacgaaacgaaataaatattcttcaccggtaagcggtttttatgaccatgatattaatggatattga

SEQ ID NO: 3737 - DNA, 1587 bp, Saccharomyces cerevisiae
atgcctcaaacgcacgaaatgtccctgaacggcactcaatacttaaaatatgaacttaaagaccttgagtctcgagctcacgatgcaaagactccttcaacaaatgaattctatgatgatgtagaatcgcacggaacagaagaattagttgaagctaaactgtcgtttttgaacagaattgctgctggtttaagtgccgagacaaagggtattgaaccgattacagaagatgaaaaaactgatgattctatactgaacgctgcatctatgtggttttcagcaaatatggttctgcctgcttatgccattggcgccctagggcctatggtgtttgatctaaatttcggccaaagcgttttcgttattattttctttaacctcttaggcttggtatcagttgctttcttttctgttttcggtgcagagctgggcctaagacagatgattttgtctagatatttagttggcaatatcgcagccaggatcttctctttcatcaattttattgcctgtatcggttggggtatcgttaataccgtagcaagctcgcaagtcctgaatatggttaaccccggtcatcaatgtcctctctgggctggttgtatagttattatcggtgctactgtaattgtaacttttttcggctatggagtcattcatgcttacgagaaatgggcgtgggtaccaaattttgccgtttttttggtaataattgctcgtttggcaaggtctaaaaaatttgtccttggggagtggacatctggtcctactacagcaggtaacgtgctttcatttggatcaacagtttatgggtttgctgcaggctggacaacatatgcggctgactataccgtttatatgccaaggaaaacgaacaagtataaaatttttttctcgcttgtagttgggttagcaacaccattatattttactatgatacttggtgcagctgtagcaatggcagctatcggcgatccagcctggaagacgtattatgacgaaaattccataggtggtttaacttttgccgttcttgtccctaattctgttcacggattcggtcagttctgttgcgtgttattgtctctgtccactatcgctaataatgttcccaacatgtatactattgctttatcggtgcaagccacgtgggaacctcttgcgaaagtcccaagagttatttggactttattaggcaatgcggccgcactgggtattgccattcctgcctgctactatttttctaccttcatgaattacttcatggattccataggttattatttggctatttatattgccattgcatgttcagagcattttatttataggcgttccttcagtgcttacaatgttgatgattgggatagttgggaacgtctacctatcggcattgcaggtactgctgccttaattgttggtgcctttggcgtagcgttgggtatgtgccaaacttattgggttggcgagatcagccgtttgatcggagactacggtggtgatattggattcgagttaggactaagttgggcatttatagtttacaacattgctagaccctttgagctcaagtactttggtcgttaa

SEQ ID NO: 3738 - DNA, 1587 bp, Saccharomyces cerevisiae
atgtcctacaataatggcaatacttattcaaagagttatagcagaaataataagagacccttgttcggaaagaggtcgccaaatcctcagtccctagcgagaccaccgccaccaaagagaatacggactgatagtggttaccagtcgaatatggacaatatatcttctcatagggtaaattcaaatgaccaaccaggccacacgaaaagtcgtggtaacaataatttatctcgctataacgatacatcctttcaaacaagttccagatatcaaggttcaagatacaacaataataatacgtcgtatgaaaataggcctaaaagcataaaaagggatgaaacaaaggctgaattcctgtctcatttgccaaaggggcccaaatctgttgagaaatcaagatataataattcatccaatactagtaatgatataaaaaatggctatcatgcttcaaaatactataaccacaaaggccaggaagggcggtctgtcatagctaagaaagttccagtttcggttctaacgcagcaaaggagcacgtcagtttacctaaggataatgcaagtcggagaaggaacatatggtaaagtttacaaggcaaaaaacacgaatacagagaagttagtagcgctgaaaaaattgagattacaaggagagagggaaggctttcccataacctctatacgagagattaaactactacaaagttttgatcatccaaatgtctctactataaaagaaataatggtcgaatctcaaaaaactgtatatatgatatttgaatatgctgacaacgacttaagtggattactattaaataaggaagtccaaatttctcactcacaatgcaaacatctcttcaaacaattgctattaggaatggaatatttacatgataataagattttacaccgtgatgttaaaggctcaaacatcttaatcgataaccaggggaatctaaaaataacagattttggactagcgaggaaaatgaattcgcgagctgattacactaaccgtgtcattacgttgtggtacagaccaccagaactattgttgggaactacaaattatggaacagaagttgacatgtggggttgtggctgcctcctggtggaattattcaataaaactgcaattttccagggctctaatgaattagagcaaatagaatcaattttcaagattatgggaactcctacaataaatagctggccaacgctttacgatatgccgtggttttttatgattatgccacagcaaactaccaagtatgtcaacaatttttctgagaaatttaaaagcgttttaccatcttcaaaatgtctgcaattggcgattaatttgttatgttatgatcagacgaaaaggtttagtgcaaccgaagctttacaaagcgactatttcaaggaagaaccaaagcctgaacctttagttcttgatggattggtaagttgccacgaatatgaagtcaaattggcaagaaaacaaaagcgtcctaacatactatccaccaacacaaacaataagggtaatggtaatagtaataataataataataataataatgacgatgatgataaataa

SEQ ID NO: 3739 - DNA, 1587 bp, Saccharomyces cerevisiae
atgtctgctaaagttccatctaacgccacgtttaagaacaaggaaaaacctcaagaggttcgcaaagccaacatcatcgctgcacgttctgttgcagatgccatccgtacttcattgggtcccaagggtatggacaagatgattaagacatctcgtggagaaatcatcatctctaatgatggccacaccattctaaaacagatggccattctgcatccggtggccagaatgctagtagaggtttctgccgcgcaggactcggaagccggtgatggtaccacttctgtggtgatcttgaccggagctctattgggtgctgctgagaggctgttaaacaagggcatccatccaaccatcattgcggactcctttcaaagtgctgcgaagagatctgtcgatattcttttagaaatgtgccataaggtttcgttgagcgatagagaacagctggttcgtgctgcatccacttctttgagttccaagattgtgtctcaatactcttcgtttttggcgcccttggcagtggactccgtattgaagatatctgatgaaaactctaagaatgttgacctgaacgatatcagactggtcaaaaaagttggtggtaccattgatgacacagaaatgatagatggtgtggtcttgacacaaacggcaatcaaatctgctggtggtccgacaagaaaggaaaaagcaaagattgggttaattcaattccaaatatctcctccaaagcccgacacagaaaataatatcatcgttaatgactatagacaaatggataagatccttaaagaagaaagagcgtatttgctaaatatctgtaaaaaaattaaaaaggccaagtgtaacgtgctgttgattcagaaatccatcttgagagatgcggtaaatgatttggctcttcatttcttgtcaaaattgaacataatggtggtaaaggatatcgagagagaagaaatcgagtttctgtcgaagggcttgggttgtaagccaattgctgatatagaattgttcaccgaagatagattgggttccgctgatttagttgaggagatcgatagcgatggttccaagatagttagagtaactggtataagaaacaataatgcaagaccaaccgtctctgttgttattcgtggtgcaaacaacatgatcattgatgaaacagagcgttccctccatgatgcactatgtgttattcgttgtctagtgaaagagagaggtttaatcgctggtggtggtgctccagaaattgaaatatcccgtaggttgagtaaggaagcaaggtctatggaaggtgtacaggcttttatttggcaagaatttgcctctgctttggaagttattccaacgactttggctgaaaacgcaggtttgaatagtatcaaagttgtcacagaattgcgctctaagcatgaaaatggtgaattgaatgacggtatctctgttagacgatctggtactacgaacacctatgaagaacacatcttacaacccgtacttgttagtacaagtgcaattaccttagcgtctgaatgtgttaaatccatcttacgtattgatgatattgcattcagccgttaa

SEQ ID NO: 3740 - DNA, 1587 bp, Saccharomyces cerevisiae
atgttcaggcagtcaaaaagaagaattgcctcaaggaagaattttagttcatacgatgatattgtcaaaagcgaattggacgtaggcaacacaaatgcagctaaccagatcatcttaagttcaagttcatctgaagaagagaaaaaactttacgctaggctgtatgagtctaaattatcattttacgatttaccaccacagggagaaataacgttggaacaatttgagatctgggcaatcgatcgtctcaaaattctgttagagatcgaatcttgcctttcaagaaacaaatcgatcaaagaaattgaaaccattatcaagccgcagttccaaaaactactgcctttcaacacagagagtttagaagacagaaaaaaggattactactctcatttcattttaagattgtgcttttgtcgttcaaaagaactgcgggaaaaattcgtcagggctgaaacgtttttgttcaaaattagatttaacatgctaacctccaccgatcaaacaaaatttgttcaatcattggacttacccttactacagtttatctcaaatgaagaaaaggccgaattatctcatcagttgtatcaaacagtttctgcgtctctacagttccaattgaatttaaacgaggaacatcaaagaaaacagtatttccaacaggaaaaattcataaaattacctttcgaaaatgtgatagaactggtaggaaaccgtttagtgtttttgaaggacgggtacgcatatttaccacaattccagcaattgaatttactttctaatgagtttgctagcaaattgaaccaggagttaataaaaacgtaccagtacttaccaagactgaatgaggatgaccggttgttaccaattctaaatcatctttcgtcggggtacactatcgcggatttcaaccagcaaaaggcaaaccaattcagtgagaacgtagatgatgagattaatgcgcaaagtgtctggtctgaagagattagctcaaactatccgctatgtatcaaaaacctgatggagggtcttaaaaagaaccatcatttgaggtattatgggagacaacaactgagtctgtttttgaaaggtatcggcctgagcgctgatgaagcgttaaaattttggtctgaggcatttacaagaaatgggaacatgacaatggagaagttcaataaagaataccgttacagcttcaggcataattacggtcttgaaggtaacagaatcaactacaaaccatgggactgtcacactatcctttccaagcccagacctgggcgcggagattatcatggatgccctttccgtgattggagtcacgagagactatctgcagaattgcgctctatgaagttgacccaagcgcagatcatcagtgttctggattcctgccagaaaggtgaatacacaattgcttgcactaaagtgtttgaaatgacacacaactctgcatcagcggatttggaaattggcgagcaaacgcatatcgcgcatcctaacctatacttcgaaagatcaaggcaactgcaaaagaaacagcagaagctggaaaaggaaaaactattcaataatggtaatcattag

SEQ ID NO: 3741 - DNA, 1587 bp, Saccharomyces cerevisiae
atgtttggaatacgttcaggcaataataacggtggatttactaacctcacgtcgcaagcaccacagacaacccagatgtttcaatcgcaatcacagttgcagccacaaccgcaaccgcaaccacaacaacagcagcaacacttgcaattcaatggatcatccgatgcaagttctttacgatttggaaactcactttccaatactgtaaacgccaataactatagtagtaatatcggtaacaatagcatcaacaacaacaacattaaaaacggcacaaataacataagccaacatggccaagggaataatcctagctgggtgaataatcctaaaaagagattcactcctcatacggtgataagaaggaagacaacaaagcaaaattcttcttctgacatcaaccagaatgatgattcatcttctatgaacgctactatgagaaatttcagtaagcaaaatcaagattccaagcataatgaaagaaataagtctgcggcaaataatgacatcaattctctgttgtcaaattttaacgatattccaccctccgttactttacaggattggcaacgcgaggatgaattcggttctattccatcattaacaactcagtttgttaccgacaaatacacggcgaagaaaacaaataggtcagcttatgattccaaaaatactccaaatgtttttgataaagactcttatgttagaatagcaaacattgaacagaaccatttagataataattacaacaccgccgaaacaaacaataaagtccatgaaacatcttccaagtcttctagtttgagcgcaattatcgtatttggctatcctgaatcaatttccaatgaattgattgaacacttctcccatttcggtcatattatggaagactttcaagtattgcgattgggtcgcgggattaaccccaacaccttcagaatattccataatcatgatacaggctgtgatgaaaacgattctactgttaataaatctattactttaaaaggcagaaataatgagtcgaataacaaaaaatatccaatatttactggtgaaagttgggtcaaactcacttataattctccatcttctgctttgagagcactgcaggaaaatggaaccatatttcgcggttctttgattggttgcatcccatattcaaaaaatgcggtggagcaattagctggctgcaaaattgataatgtcgacgacattggagaattcaacgtttctatgtatcaaaattcctccacatcgtcgacatctaatacaccatccccaccaaacgtaataataactgatggcactcttctgagggaagacgataatactcctgccggtcatgctggtaatccaacaaatatttcaagtccaatagtagcaaattctccgaataagcggctggatgtaatagatggcaaattgccattcatgcaaaatgcaggaccgaattcgaatattcctaatctgttgcgaaacctagaatcgaaaatgcgtcagcaagaagcgaaatacagaaataatgaacctgctggttttacgcacaaactgagtaattggttatttggttggaatgacctataa

SEQ ID NO: 3742 - DNA, 1590 bp, Saccharomyces cerevisiae
atgactataagcgaagctcgtctatcaccgcaagtcaatcttctcccaataaagaggcactcaaacgaagaggtagaggagactgcagcgattctaaaaaagcgtactatagataatgaaaagtgtaaagacagcgaccctggttttggttcccttcaaagaaggttactgcagcaactttatggcacacttcctacggacgaaaagataatcttcacatatttacaagattgtcaacaagagatcgatagaatcattaaacaatccattattcagaaagagagtcattcagtaattctcgtggggcccagacaaagttacaaaacatacttattagactatgaactgtctttgttgcaacaatcttataaagagcagtttataactatcaggttgaatgggtttattcactccgaacaaacagctattaacggtatagcaactcaattggaacagcagttgcagaaaattcatggcagtgaagaaaaaattgacgatacttcattagagactattagcagtggttctttgacagaagtgtttgagaaaattcttttactcttagattcgaccacgaagacaagaaatgaagatagtggtgaggttgacagagagagtataacaaagataacagttgtttttatattcgatgaaattgatacatttgctgggcctgtgaggcaaactttattatacaatctttttgacatggtagaacattctcgggtacctgtttgcatttttggctgcacaacgaaattaaatatcttggaatatttagaaaagagggtaaagagtagattttctcaaagagtgatttatatgccgcaaatacagaatctagacgatatggttgacgccgtcagaaatttacttacagttcgctctgaaatctccccctgggtttcacaatggaatgaaacgttggaaaaagaactatccgaccctcgatcgaatttgaatagacatattaggatgaatttcgaaacctttaggtcattacctacattgaaaaatagcataattccattagtagcgacatccaaaaattttggttcactctgcactgccataaaatcgtgttcttttcttgacatatacaataagaaccaactatctaataatttaacaggaaggctccaatctttatccgatttagagttagccattttgatctcagccgctagggttgccttaagggcgaaagacggatcttttaattttaatttagcttatgcagagtatgaaaagatgattaaagctatcaactccagaattcccaccgtggctcctactacaaatgtgggaacaggtcaaagtactttttctatcgacaatactatcaaactatggttgaaaaaggacgtcaagaacgtttgggaaaatttagtgcaactggatttttttaccgagaaatcagccgttggtttgagagataatgcgaccgcagcattttacgctagcaattatcaatttcagggcaccatgatcccgtttgacttgagaagttaccagatgcagatcattcttcaggaattaagaagaattatccccaaatctaatatgtactactcctggacacaactgtga

SEQ ID NO: 3743 - DNA, 1590 bp, Saccharomyces cerevisiae
atggttttggaataccaacaaagggaaggtaaaggatcctcatctaaaagcatgccacctgattcctcgtcaacgactattcacacatgctctgaagcacaaactggggaagacaaaggcttacttgaccctcatctatcagtattggaattgttgagtaagacagggcattcgccttcgccaatgggacagaacttggttacgtccattgacatatccggcaaccacaatgtaaacgatagtatatcaggatcgtggcaagccattcagcctttggacttgggcgcttctttcatcccagaaaggtgctcttctcaaacgactaatggaagtattctatcatctagtgatacttctgaagaagaacaagagctgcttcaagcgcctgctgctgatataataaatattattaaacaaggacaagaaggagcaaatgtcgtttcaccgtctcatccctttaaacagttacagaagataatatcgctgcccttgcctggtaaggaaaaaactccttttaacgagcaagatgatgatggtgatgaagatgaggcttttgaggaagatagtgtgacgataacaaaaagcttgacttcttcgacaaactcttttgttatgcccaaactatcactaacacaaaagaatccagtttttcgccttctaatactgggaaggactggttccagcttttatcaatcaataccaaaagaataccaatctctttttgaattacccaaatatcacgattccgcaacattcccgcaatatacggggattgtcataatttttcaggagctgagagagatggtatctctgctaaacaggatcgttcaatattctcaaggcaagcctgtaataccgatctgccagcctgggcaagtcatccaagtgaaaaacgtcctgaagtcattcttaaggaataaacttgttaaattattgtttcctccagttgttgtgaccaacaaaagagatttgaaaaaaatgtttcaaagattacaagatttatccttggaatacggagaagatgtgaatgaggaagataatgatgacgaagctatacatacaaagtctcggtcctattgtcgtaacaaaaaagccgaaaactcaaaaaagaaatcccctaaatcgaataaaaaacccaagagaaagaagcagaagttcttcacgagctggttcacttggggcatttcaattactataggaattagttttggatgttgtgtgacatactttgtcactgcagcatacgaacaccaaacagttaagtctttaagtttgcggccctccatattggcctctttactttccttagattcctctagcgacacaatcaatacgcccgccactgcatctccttcttcaactgagcagtttttatggtttgataagggtacgcttcagataaacttccactccgatggattcattatgaaaagtcttaccataatcaaggagacttggggcaaaatgaatacttttgtcttgcatgctctttctaaacctttaaaatttttggagaaccttaataaaagctctgaattttccattgatgaatctaatcggattttggcactgggttatattctattgtaa

SEQ ID NO: 3744 - DNA, 1590 bp, Saccharomyces cerevisiae
atgtgcactccagatgaaaacgattacaaaacatcaactgacccagatacatctgcaaatacaaatcatactctcgaaaaaaagaagagaaaaaagagaaaaaacacaaacgtggcatgcgtgaactgttcgagattgcatgtgtcatgtgaggccaaaaggccatgcttacgatgtatcagcaagggcctcacggctacatgcgttgacgctccaagaaagaaaagcaagtacttggctggaataccgaatagagagctcccaatgaacatacaaccggaccttccaccccgcaagatcatgatacccatttataacaactccagcaatagtagcctcaacgtaaataacatgggagaacagcaaaaattcaccagcccacaacatatagttcacaaagctaaattcctatcgaatgctgcagattccgagtactctattctgtcgaatatcatctatcaagacacattgtctaacaagatccctattgacatcctgtactccaacaccaattccacatccaactccacaataggcaatagcagtaacaatagccctacgggcacaaatacaagccctgaagaaacagaaatggagaaaattcgccagttgtacagcgaacagcgagcaaacatacccccacatccgtatccatcttccaatcaaaacgtttattctattctactgggaccaaattcagccaagattgtagcttcgcaagttaatcttttcgcgaaccatttccccttagtgcccgttgattcagctgataattccttaaactttaaaagattattgccacgggacccatctgaaaagagctcccaaattaattgggactcaagcataaaccaatattacttgaacagcgaaacggtaacatttcccgagttggctatccccttaaagcggaggaaaaaccatttggtctctgtatccctggaaagctgttcaccagacgctgccaacatcaagagcaatgtagaatgggaacattcattacgttattctactccaatggaaatatacacctccataaatgcccccttttcgcatacacctggattccaccatcttttggtgtacctaaagcatcgattcaaccagcaggatctggtgaagatgtgtcggtccattgccgaattccggcccattttcattgcgtgttctgtaactttaaccgaggaggacatgatttttatggagcaatgctaccaaagaactctattagaatatgtaaaatttattgcacaaatcggtaccccgacatgtatttggcgaagaaatggtcaaatttcttatgtcaacgaggaatttgaaattctatgcggatggacaagagaggagctactaaacaagatgacttttatcgtagagatcatggacgatgaaagtgtacgcgattacttcaaaacgctctctaaagttgcatatagggacttcagaggatctgagaagatgaaagtttgcaggctcttaagccccatcaagggcaagataattcattgttgctgtatgtggacattaaaaagagatgtctctggtttgcccctcatgatcttgggtaacttcatgcccatactcaattga

SEQ ID NO: 3745 - DNA, 1593 bp, Saccharomyces cerevisiae
atgaaggagaatgacatgaataatggcgtagataaatgggtaaatgaggaagatggtcgaaatgatcatcataacaacaataataacttgatgaagaaggccatgatgaacaatgagcaaattgatagaactcaggatatcgacaacgccaaagaaatgttgaggaaaatatcaagtgaaagcagctcgcgcagaagctccctgttgaataaagattcatctctcgtgaacggcaatgcaaacagtggcggtggtacgagcattaacggaacaagaggaagttctaagagtagtaatacacactttcagtatgcctccacggcgtatggtgtaagaatgttgagtaaagatatatctaataccaaagtggaactggatgtggaaaatttgatgattgttacgaaactcaacgatgtctcactgtatttcttaacaagagagttggtagaatgggttttggtacattttccacgtgtgactgtttatgtggattccgaattgaaaaacagcaaaaaatttgccgctggcgagttatgtgaagatagtaaatgtagagaatcaaggatcaagtattggacaaaggatttcatcagggaacatgatgttttcttcgatttggtagtgactttgggtggcgacggtactgttctttttgtaagttccatttttcagagacatgtaccacccgttatgtcgttttcattagggtctctaggatttttaacaaattttaagtttgaacatttcagggaggatttacctcggattatgaatcataaaatcaagacaaatttacggttgaggttggagtgcacaatttatcgtagacaccgccctgaagtagacccaaacacggggaagaaaatatgtgtggtggaaaaactaagcacacaccacattttgaacgaagtgaccatcgatcgtggtccaagtccttttctatccatgttagaattgtatggtgacggctcattaatgaccgttgcgcaggcggacggactgattgctgctactccgactgggtccacggcctattctttgagtgcaggtgggtcattggtatgcccaaccgtcaatgcaatcgctttaacacccatttgtccacatgcattgagtttcagacccatcatcttaccagaaagtataaatttaaaagtgaaagtctcgatgaagtcaagggctccagcatgggcggcttttgatgggaaagatagaattgaattgcaaaaaggtgattttataaccatatgcgccagcccatatgcttttccaaccgtggaagcctcgcccgatgagtttattaacagtatcagtcgacaactaaactggaatgtgagggaacaacaaaagtcctttacgcatattttgtcccaaaagaaccaagaaaaatatgcacatgaggcgaacaaagtcagaaatcaagcagaacctttagaggtaataagagataaatactctctggaagcagacgctactaaggaaaacaacaacggaagcgatgatgagagcgacgatgagagtgtaaactgcgaagcttgcaaattaaagccttcgagcgtcccaaaaccttctcaagcaaggttttcagtataa

SEQ ID NO: 3746 - DNA, 1593 bp, Saccharomyces cerevisiae
atgaatttacttgaaacaaggaggtccttgttggaggagatggagattattgaaaatgccatagcagaaagaattcagcggaatccagagttatattaccactatatacaagaatcgagcaaggtgtttcctgatactaaactgcctagatcatcgttgattgcagagaataaaatatacaagtttaaaaaggttaagaggaagagaaaacagataattttgcagcaacatgagataaatatttttcttcgagactaccaagagaaacaacaaacttttaataaaatcaatcgtccagaagagacacaggaggatgacaaggatttgcctaatttcgaaagaaaactacaacagctagagaaggaactgaaaaatgaagatgagaactttgaattggatatcaactctaaaaaagacaaatacgctttattctcatcttcttctgatccatcgaggcgcacaaatatattgtctgacagagctcgagacctagacttaaatgaaatatttactagagatgagcaatatggtgaatatatggagctggaacaatttcattctttatggttgaatgtaattaaacggggcgattgttcactgcttcaatttctcgacatcctagaattatttttggacgacgagaaatatttgctaaccccaccgatggatcgcaagaatgatagatacatggcctttttgctaaagttgagcaaatatgtagaaacttttttcttcaaaagttatgctttgcttgacgctgcggcagttgaaaatctaatcaaatctgacttcgaacattcatactgtaggggatctcttcggtccgaggcaaaaggtatctattgccctttttgttcgaggtggttcaagacatcttccgttttcgaaagccatttagtagggaaaattcataagaaaaatgaatctaaaagaagaaattttgtgtactctgaatataaactgcatcggtatttgaaatatttaaatgatgaattttctcgaacgagaagttttgttgaaagaaaactggcatttactgcaaatgaaagaatggcagaaatggatatcttaacacagaagtatgaagcacctgcatatgattcgacggaaaaagagggggccgaacaagtggatggtgagcagagagatggtcaactgcaagaagagcacctctctggtaaatcgtttgacatgccattgggtccggatggattgcctatgccatactggctatacaaactgcatgggcttgacagagagtatcgctgcgaaatttgttcgaataaagtttataatgggcgacgcacttttgaaagacatttcaacgaagaaagacatatttatcacttgcgatgccttggtatcgaaccttcttcagtattcaagggcataaccaaaattaaggaggcacaagagctctggaaaaatatgcaggggcagtcacagttgacatctattgcagcagttcccccaaagcctaatccttcacaactaaaagttcctacagaattagaactagaagaagaagacgaagaaggaaatgtaatgagtaagaaggtctacgatgaacttaagaagcaaggtttggtgtga

SEQ ID NO: 3747 - DNA, 1593 bp, Saccharomyces cerevisiae
atgacaagaaagcaggctattgactatgcaatcaaacaagttccgcaaatattgcctttggaagagtctgatgtaaaagcgctgtgcgaacaagtactgagtacatcatctgatgatccagaacaaattgcttcaaaatttttggagttcctaggtcatgaagatctatcgtttgaatttgtaatgaagttcaatgaattattgaatcagaatgataaaaaagaggaaaaaaaaacgaaaaatgtgcatcttgaacatactgcccccacttcatggaaaaatgaatcaaaacagcccactaataactatatcaataagaagggagatgaaaaaccaaaaaaattaaaggatgagaagaaaagctcgacaacgaggcctaccgttcaaccatcaaatcaatctacgcaatcaaaccccataaaggagaaaaaagagcacagatcaaaggggaaattacaatcgttacaagaaatagacgaagcaatcaagatgctagagcttcgagatagcggttcttctaaaaattgtaattgtcaaggtacaaggcatccagttttcgacatcgcgccaaactgtcttcactgtggtaaagtggtttgtgttatagagggattgaataaaggtaaatgcggtcattgccatgaacagttgatttctgataacgaaagaacccaaatggtagaaattttaaatcaggaaaaaaacgaactaaacggttcatcatcgtccttatccaatgcgtcaaatggagctaatgtcccaaagaagaagactaaaacctacaaaataacttccggtatgggtaaaaatttatttgctgaacaggacaaattatttgatttcatcgaaaggaaaagagaaagagaaagaaagcgtaatgaagtgttgaaattgcaggaggaaaaagaagagagcgaagcaaaggaaagacaagcgagcgagcatgaccataaagctgaggaaaacccggagttgttagcagcacaagaacgattagatagacttttatatttccaagacacttcggcagaaagaacaaaaattattgataatgccagcgattttgacatgaatcaggaggtgggtttatggggcagcgcaagagaaagagctcttgcgttgaagaagcaacaacgtaatttgagaaagtgggaaaaagtagaaaaggaacggaatggcaggcgcgagaagtacgttgttagcatgaatataggttcaaacggtaaagttactatgacagaagtccctaaggatacagagaacgtaattgcaggttcagatgatgacatcagtgatataagtgacgaagaagatatcagcgaccttaaacatatacacgctctgaaaagtgaaataaatacaacgaaatccttggagaatttgcatttacagtccaaagcatgggattacgaacgtgataaaaaacaattcgataggcctacgtatgtgaaaaaaaattcagatactgcacaacagaatagaaaaacggaagaaaaggctcacgacatgcaagcttatgatttaaagtcaagagtacaagtggaccaaaatgcagacgcatcagtagaacagaatattcttgctgtactttga

SEQ ID NO: 3748 - DNA, 1593 bp, Saccharomyces cerevisiae
atgattagctcagaattaacgaatgatcaaatcatagaccttatatcggattataagaatttcaaaagaattatagaggcctctgtaccagaagatgatagaagaaggaaccaaaaccgccaaaatagaaataaagacctgacaaaattgtcgaatgtacaattttggcaactgacgactgatgtcaacgatgaattgatgaaaagattgacagattcgggtgcggatgcatcactaaatgatcttgatctgaaaagaggtaaagcacaatctaaactgtctcgattgaaggacgcgaagttccataaattgattcttgatattttcacggaaattgaaaggagaaacttacatcatttggatatggggacgcataacaatgggttagacgagggtgatctaaatttctatttaaatgacacattatttgaatccttcaaaataaacgatgattttatgagcgtgaatggtattatatccattgaagtcttccgagaattaaaaactcaatttacactttattttcaaaacacgctccatcgaattgatcctgtggataccaccaccacacgcctgccgattctgcttgagactataattaagatagcaaagttgataggcgatctcttacctgtcctatcatcagtttcactgcaaagttctttagaaaacgaaatagtatacttaaagagtgctttatctcatgctatcacttcaacaagatattttctcacatatggggacctaataccacgaattgtagctcaatcatctatttcggaagtgatttttgcgttctgcaatattgctcagattgtgaagatcaaatccacctcacgtgatgatatatcacgcaatgaaggagaactcagtgatatcgaggcaggtatgaaaccgttgaagattattgaaaaagtgaaaaatgagaaaaacggtaaggatatatcatctctgggtgatagcggtagtactgctgttagttttccatcctctggtaagcccattacaaaaaaatcggacatgccagtggttgtagcatcgccatcaatttccatcatagaaaaatctgaatcttctattcgagagagtgggaaggtacgaaataatacatctggagaaacaaacttagcgtctgtgtcgccgttaaaaaacactaagaattcttcaagaattacgagtgagccatctccgcgagaaggtttgcctctgaaagttgtctcgaactcgagaagtccaagtcctcaaggtaacacattgccgctaattggtaaatttcggcaggattatcaggcatcacctccgaagaaagttatcactaaaccagtggcagaaacggcgaagccgtatgcaaatattccgccagctgcagacgtactttactcgccaaccgtgaccaaaatgaggaaattcagagagaaagtgcagaaatttgctcccaactctggtcttggattaagaatatctacttcagaagaaaacttgaataattctgatgtcaactcaaccacgcacaacgctaacataaataacctcgtcgaatttgttgagagtaaatcaatggttgttcttcctatggcaggcagggcattttga

SEQ ID NO: 3749 - DNA, 1593 bp, Saccharomyces cerevisiae
atgccagaaaagttagccatgtcaatggtcgatataaaagatgcggggagtgaactaagggacctcgaatctggagctctggacacaaaatcttccgccgctgatgtatactatgagggtgtagaattgcatagaaccaacgaattcattgataataagccgtcctttttcaataggattgcagctgctttaaatgctgagacgaaaggtattgaaccagttacagaagatgaaaaaaatgatgactcgatactcaatgccgccactatatggttttcagctaatatggtgattgtagcctattccgtaggtgccttgggtcctctagtatttggcctaaatttcggccaaagtgttttagttatcatttttttcaatattttgggtttgatccctgttgcattattctcactttttggggtagaactgggcctaagacagatgattctatcgagatatttggctggtaacatcacagcaagatttttctctcttgttaatgtcattgcttgtgtcggttggtgtgttttaaatatttctgtttctgctcaacttttgaatatggtgaatgaaggctctgggcacaactgtcctatttgggcaggttgtttgattattgctggtggtaccgtgcttgtgactttttttggttacagtgtcgttcatgcatacgaaaaatggtcgtgggtacccaattttgctgcctttttggtcattattgcccaactatcgagatcaggaaaatttaaaggtggtgaatgggtagggggtgcaactactgcaggtggtgttctttcttttggttcatctgtttttgggtcagctgcgggttgggcgacttatgcagcagattacactgtttatatgccaaagaccacaagtaaatacaaaatttttttttccgtagtagccggtctagcgttccctctatttttcaccatgattcttggtgctgcttgcggtatggcggcccttaatgacccaacctggaagtcatattatgataaaaacgccatgggtggtgtcatatatgctatcctggtccctaactctctaaacggattcggtcaattctgctgtgttttgttggctctttcaactgttgctaataatgtccctggaatgtacactgtcgctttatccgctcaagctttgtgggcacctttggctaaaataccaagagtagtctggacaatggcaggtaatgctgccactttaggtatttccatccctgctacctattactttgacggctttatggagaattttatggattccattggttattatttggctatttatattgccattgcatgttcagagcattttatttataggcgttccttcagtgcttacaatattgatgattgggataattgggagcatctacctatcggtatcgcaggtactgctgccttaattgctggtgcctttggagtagcgttgggtatgtgccaaacttattgggttggtgagatcagtcgtttgatcggagagtacggcggtgacattgggttcgagttaggcggaagttgggcgttcatcatctataacattgtaagacctttagaactcaaatatttcggtcgatga

SEQ ID NO: 3750 - DNA, 1593 bp, Saccharomyces cerevisiae
atgctaagaaacattttggtgagaagtactggcagcaatttcaaatttgctggcagatatatgaaatcatcagctcttttaggatactatagaagagttaactattattcgaccaagatacaaaccagactgactagcgaaaactatccagacgtgcatcgagaccctagattcaaaaaattaacgtccgatgatctaaattattttaaatctattttatcggaacaagaaatattaagagccagcgaatcagaggatctttcattttataatgaagattggatgagaaagtacaaaggacagtccaagttagtattgagacctaagtcagtggaaaaagtttctttaatcttaaattattgtaatgatgaaaaaattgccgttgtcccacaaggcggtaacacggggttggtaggtggttctgtgcccatttttgatgaattaattctatctttagcaaatttaaacaaaataagagattttgaccctgtatcaggtatcttgaagtgtgatgctggtgtaatcttggaaaatgctaacaattacgtaatggaacaaaattatatgtttccgttggatctgggagctaaaggttcctgccatgttggtggcgtggttgcaaccaacgctggaggactaaggttattgcgttatggctcactacatggaagcgttttaggcttagaggtggtaatgcccaatggtcaaattgttaatagcatgcattccatgagaaaagacaacaccggttatgatctgaaacagctgttcattggctcagaaggtactatcggtatcatcactggtgtttcaatcttgactgttcctaagccaaaagcgtttaatgtatcttacttgtctgttgaaagttttgaagacgttcaaaaagtcttcgtcagagccaggcaagaattatctgagattttatccgcttttgaatttatggatgctaaatctcaagtattggccaagagccaattgaaggatgctgccttccctttggaggatgagcatccattttatattcttatcgaaacgtcagggtcaaacaaagatcacgatgattccaaacttgaaacatttttagaaaacgtcatggaagagggcatagtaacggatggtgtagtggcacaagatgaaaccgaactccaaaacttgtggaagtggagagaaatgattccagaggcaagtcaagctaatggtggtgtttacaaatacgatgtttctttaccactaaaggacctatattctttggttgaagccactaatgcaagactttctgaagctgaattagtgggtgattcgcccaaaccagtggtgggcgccattggatacggtcacgtgggtgatggtaatctacacttaaatgttgcagttagagagtacaacaagaacattgaaaagactttggaaccatttgtctacgagtttgtttcctcaaaacatggttccgttagtgccgaacatgggctaggtttccaaaagaaaaattacattggctattctaagagcccggaagaggtcaagatgatgaaggatttgaaggttcattatgatcctaatggaattttaaacccttacaaatacatttga

SEQ ID NO: 3751 - DNA, 1593 bp, Saccharomyces cerevisiae
atgtctgctaccaagtcaatcgttggagaggcattggaatacgtaaacattggtttaagtcatttcttggctttaccattggcccaaagaatctctttgatcataataattcctttcatttacaatattgtatggcaattactatattctttgagaaaggaccgtccacctctagtgttttactggattccatgggtcggtagtgctgttgtgtacggtatgaagccatacgagtttttcgaagaatgtcaaaagaaatacggtgatattttttcattcgttttgttaggaagagtcatgactgtgtatttaggaccaaagggtcacgaatttgtcttcaacgctaagttggcagatgtttcagcagaagctgcttacgctcatttgactactccagttttcggtaaaggtgttatttacgattgtccaaattctagattgatggagcaaaagaagtttgttaagggtgctctaaccaaagaagccttcaagagctacgttccattgattgctgaagaagtgtacaagtacttcagagactccaaaaacttccgtttgaatgaaagaactactggtactattgacgtgatggttactcaacctgaaatgactattttcaccgcttcaagatcattattgggtaaggaaatgagagcaaaattggataccgattttgcttacttgtacagtgatttggataagggtttcactccaatcaacttcgtcttccctaacttaccattggaacactatagaaagagagatcacgctcaaaaggctatctccggtacttacatgtctttgattaaggaaagaagaaagaacaacgacattcaagacagagatttgatcgattccttgatgaagaactctacctacaaggatggtgtgaagatgactgatcaagaaatcgctaacttgttaattggtgtcttaatgggtggtcaacatacttctgctgccacttctgcttggattttgttgcacttggctgaaagaccagatgtccaacaagaattgtacgaagaacaaatgcgtgttttggatggtggtaagaaggaattgacctacgatttattacaagaaatgccattgttgaaccaaactattaaggaaactctaagaatgcaccatccattgcactctttgttccgtaaggttatgaaagatatgcacgttccaaacacttcttatgtcatcccagcaggttatcacgttttggtttctccaggttacactcatttaagagacgaatacttccctaatgctcaccaattcaacattcaccgttggaacaaagattctgcctcctcttattccgtcggtgaagaagtcgattacggtttcggtgccatttctaagggtgtcagctctccatacttacctttcggtggtggtagacacagatgtatcggtgaacactttgcttactgtcagctaggtgttctaatgtccatttttatcagaacattaaaatggcattacccagagggtaagaccgttccacctcctgactttacatctatggttactcttccaaccggtccagccaagatcatctgggaaaagagaaatccagaacaaaagatctaa

SEQ ID NO: 3752 - DNA, 1596 bp, Saccharomyces cerevisiae
atggcttctacggaacttagcctaaaaagaaccttaacggatattttagaagacgagttgtaccatactaatccaggtcacagtcagtttacgagtcattatcaaaactatcatccaaatgctagtattactccatataagttggtgaataagaacaaggaaaacaacacttttacgtggaatcattcattacaacaccagaatgaatcgagtgcagcttcgatacccccacaacaaacctaccatttcccgatattcaacaaatacgcggatcctactttaactaccaccacctcttttacgactagtgaagcaacggccaacgatagacagattaataatgtccatctcataccaaacgagattaagggtgctagcgaaaccccattgcagaagaccgtcaatctaaagaatataatgaaagtatcagacccgtatgtaccgacacggaatacgttcaattatgatgttaaaatttccaacgattttttcgataacggtgacaatctatatggtaatgatgaagaagtgcttttctatgaggataattataatccgaaaatgcagtggtcacttcaagataatagcgccgcaataaacaatgaggatgcgagagctatttttaacaatgaatttgactctgatgacgacgatatcagtgatgatgaagaggatgaaatagaagaaaattgtttgcaacaagagcaacaccaagaggagcctttactgtcattggatgttacaccaatctcaatgtttggctcagatcaaaaaacgggtcgtgccaagagttctagtcatttatttaatgagtacagttacgttgactctaacatggacagcatttccagtgttgtatctgaagatctgttagatgaacggggacatgagaagatagaggatgaggatgaggataatgatcttgatgaagacgatatctacgatatctctctcttgaagaacagaagaaagcaaagttttgtcctcaataaaaacactattgattttgaaagatttccatctccctcaacctcggcaaacgtaccgtctactgctactaccggtaaaaggaaaccagcaaaatcatccagtaaccgtagttgcgttagtaacagtaatgaaaacggcacattagaaagaataaagaagcctacatcagctgtagtaagctcaaatgctagtaggcggaagctaattaattatactaagaagcacttatcttcacattcatctacaaattcgaattcgaaaccttcgactgcatcaccatcggcccatacgtcatcttctgacggtaataacgaaatatttacgtgtcagataatgaatctcattacaaatgaaccgtgtggtgcccaattttcaaggtcctatgatttaacgagacaccaaaataccattcacgctaaaaggaagattgtcttccgttgctcggagtgtataaaaattcttggatctgagggctatcagaagacgttttcgagactggatgctttaacaaggcatataaaatcgaagcatgaagatttgtcgttagaacaacgtcaagaagttacaaaatttgcaaaggctaatattggttatgtcatgggttaa

SEQ ID NO: 3753 - DNA, 1596 bp, Saccharomyces cerevisiae
atgtcaaaagttgacgtaaaaattggagcagactcgatctcctcttctgatgaaatcctagttccttcgagactcgctgatgttacgctagcattcatggaggagaatgacgcagcagttccagaaatcacgcctgaacaagaaaaaaaattaaagagaaagctttttctcacaatattcacctttgtctctgccattaaccttttactttacatggacaaagccactttatcctatgattcgattctaggcttctttgaagatacaggtcttacccaaaatacttacaatactgtaaatacgctgttttacgttggttttgcaatcggccaatttcctggacaatacttggctcaaaagttaccacttgggaaattcttgggtgggttgttggccacatggactatacttattttcctaagttgtaccgcatacaacttttccggtgtcgttgcgttgagatttttcttggggctaacagagagtgttgttatcccgatattaattaccactatgggtatgttcttcgatgcttcagaaagagctgctgctcagccatttttctttgcagcatgtatggggtctccaattccaactgggtttattgcttatggtgttcttcatataacaaatcccagcatttcgttatggaaaatattcactatcatcattggtggtttgacttttatcatgacggttgttgtaattctgtggtttcctaataatcctgctgatgtgaaattcttttcaatacaagaaagggtatggattatcaggagagttcaggcatccacaggctcttccattgaacaaaaagtcttcaaaaagagtcaattcagagaggcaatgaaagattatataacctggttatttggattgttttttcttcttcaacagttagccaacaatctgccctatcaacagaacctgctatttgaaggaatgggtggagttgatgctctaggttcgacattggtatcagttgccggtgctggtttcgccgtcgtttgtgccttcatcgctacgttgatgttagcaaaatggaaaaatatttcagctttaacagccatcttttggactttaccagcattggtgggatccatcgctgcagctgctttaccatgggacaataagattggtatcttagcaaatatctgtatggcaggacaaatatttggtattccttttattatagctcttagctgggcaagttcaagtgcatctgggtacaccaaaaaactcacaagaagttcggtgtccttatttgcgatgggaattgctaatatcatatcaccacaaatatggagagagaaggactctcctcgctttttacctgcctggattgttcaaatcgttttatcattctctcttgcaccagccattttgttactgatccatttcatactaaaaagaaggaataatcaaagactaaaaaattatgacgaaaatttacaaaattatttggacagaattcaactcattgaaagcgaaaatccttcttccattgaagaagggaaagtggtaacccacgagaacaatttggcagtctttgatttgactgatttagaaaacgaaacttttatatatcctttgtaa

SEQ ID NO: 3754 - DNA, 1599 bp, Saccharomyces cerevisiae
atgaaagcattcaccagtttactatgtggactaggcctgtccactacactcgctaaggccatctcattgcaaagaccgttgggtctagataaggacgttttgctgcaagctgcggaaaaatttggtttggacctcgacctggatcatctcttgaaggagttggactccaatgtattggacgcttgggcccaaatagagcatttgtacccaaaccaggttatgagccttgaaacttccactaagccaaaattccctgaagcaatcaaaacgaagaaagactgggactttgtggtcaagaatgacgcaattgaaaactatcagcttcgtgtcaacaagattaaggaccctaaaatcctgggcattgacccaaatgtcacacagtacacgggttacttggatgtggaagacgaggacaagcatttcttcttttggacttttgaaagtagaaacgatcctgcaaaggatccggtcatcctttggttgaacgggggtccaggttgttcttcactaaccgggctgttctttgaattaggaccctcatccattggacctgatttgaaacccatcgggaacccttactcttggaacagcaatgccaccgtgatcttccttgaccagcctgtcaacgttgggttctcgtattccgggtcctcaggtgtttccaacactgtcgccgctggtaaggatgtctataacttcttggagttgttcttcgatcagttccctgaatacgtcaacaagggccaagatttccacatcgctggggaatcctacgccggccattacatccctgtttttgcctctgaaattttgtctcacaaggacagaaacttcaacttaacctccgtcttgatcggaaatggcctcactgacccattgactcagtataactattacgaaccaatggcctgtggtgaaggtggcgaaccatctgttttgccctcggaggaatgctctgctatggaagactctttggaacgttgtttgggcttgatcgagtcgtgctatgactcgcaatccgtctggtcctgtgttccagctaccatttattgtaataacgcccaattggctccttaccaacgtaccggcagaaacgtttacgatatcaggaaggattgtgaaggtggcaatttgtgctacccaacgttacaagatatcgacgactacttaaaccaggactacgtcaaagaagctgtcggtgcggaggttgaccactacgaatcctgtaacttcgatatcaacagaaatttcctgtttgcgggtgattggatgaagccttaccacaccgccgtaacagatcttttgaatcaagacctacccattctggtatatgcaggcgataaagatttcatctgtaactggttgggtaataaggcgtggacggatgtcttgccatggaagtacgacgaagaatttgcaagccaaaaagtacgtaactggactgcttctatcaccgacgaggtcgctggtgaagtcaaatcctacaagcacttcacctatttgagagtcttcaatggtggccacatggttccatttgacgtccctgaaaacgccttaagtatggttaacgaatggatccacggtggtttctccttataa

SEQ ID NO: 3755 - DNA, 1599 bp, Saccharomyces cerevisiae
atgcttttgcaagctttccttttccttttggctggttttgcagccaaaatatctgcatcaatgacaaacgaaactagcgatagacctttggtccacttcacacccaacaagggctggatgaatgacccaaatgggttgtggtacgatgaaaaagatgccaaatggcatctgtactttcaatacaacccaaatgacaccgtatggggtacgccattgttttggggccatgctacttccgatgatttgactaattgggaagatcaacccattgctatcgctcccaagcgtaacgattcaggtgctttctctggctccatggtggttgattacaacaacacgagtgggtttttcaatgatactattgatccaagacaaagatgcgttgcgatttggacttataacactcctgaaagtgaagagcaatacattagctattctcttgatggtggttacacttttactgaataccaaaagaaccctgttttagctgccaactccactcaattcagagatccaaaggtgttctggtatgaaccttctcaaaaatggattatgacggctgccaaatcacaagactacaaaattgaaatttactcctctgatgacttgaagtcctggaagctagaatctgcatttgccaatgaaggtttcttaggctaccaatacgaatgtccaggtttgattgaagtcccaactgagcaagatccttccaaatcttattgggtcatgtttatttctatcaacccaggtgcacctgctggcggttccttcaaccaatattttgttggatccttcaatggtactcattttgaagcgtttgacaatcaatctagagtggtagattttggtaaggactactatgccttgcaaactttcttcaacactgacccaacctacggttcagcattaggtattgcctgggcttcaaactgggagtacagtgcctttgtcccaactaacccatggagatcatccatgtctttggtccgcaagttttctttgaacactgaatatcaagctaatccagagactgaattgatcaatttgaaagccgaaccaatattgaacattagtaatgctggtccctggtctcgttttgctactaacacaactctaactaaggccaattcttacaatgtcgatttgagcaactcgactggtaccctagagtttgagttggtttacgctgttaacaccacacaaaccatatccaaatccgtctttgccgacttatcactttggttcaagggtttagaagatcctgaagaatatttgagaatgggttttgaagtcagtgcttcttccttctttttggaccgtggtaactctaaggtcaagtttgtcaaggagaacccatatttcacaaacagaatgtctgtcaacaaccaaccattcaagtctgagaacgacctaagttactataaagtgtacggcctactggatcaaaacatcttggaattgtacttcaacgatggagatgtggtttctacaaatacctacttcatgaccaccggtaacgctctaggatctgtgaacatgaccactggtgtcgataatttgttctacattgacaagttccaagtaagggaagtaaaatag

SEQ ID NO: 3756 - DNA, 1599 bp, Saccharomyces cerevisiae
atggatagaacgtggctattactgacgtggctgttgctactctgtggggtagttcaagggaaccaagaaagcataaatcaaaaatatcacgatgtctgttcagggatgtattccaaggaggatttcaatggaaaagttgacccctatatatcgtttacgttggaggaattgtcacttgctgatgaagacgatgatggcgagggggttagtgttgctgtgtttgatttccaagattatgagcatattggtgtgcggttaccaaatggagaaattcagtatatttgcgatgactacgcattggatttgggcctctgtgaggattcgtcggaggggcaatttatcattcaagagacagccatcgatccgttcaccagtaaggaacataagctaacgagtcagattttgactttcactcaacaagaattgggcactaacgacaaggtatactcaattaacaaaactggttactattgtgtgaccacgtcatctttcatttcttccagttccaagtttaaggctacagtgaattttaggaacgcttacggtcaattggacgcttcagaggcgtacaagatgcctatttatgcctttttggccgtcgcttatgccgtctgtacattagtgtactcttggctatgctggaagcatagacatgagttactgcctttacaaaggtacattttggtattttgtattttcctaacagctgatactattttcgtctggatgtactatattattgagaaccagaagggaaactccagcgtcgctcttcatgtctatatggttttcatatcgatctttagcgccggtaagatgactttcacgcttctcctcgccttgctgatatctcttggatatggtatagtatatccaaaactggaccgtacattgctaagaagatgtcaaatatttgcgatatttacgtttgcagtgtgcgttgcattcctggtccaaaaatattcccagaattctgagtctttatccaatttgattttgattactgctatccccttagtattatgtctattcgctttctattatttgacactgtcttcaatgaacaaaacaatgacttatttgagggaacaaaaccaagtggtgaaattaaacatgtacagaaaactgatcatattgtgttatatttcgttgtttatactcttcttaggcttactagtctctacttttgcatacgtcggtatggacactgttgacatgatagaacaatattggaaaacagaattcctcatcacagatacttggcctagtttcgtttacttcttggtcttcgtcattttcgcattcttctggagacctacaagtacatcatatttactagcgtgctcgcatcaattaccaactgacatggaaaatgtatcagaattcgatttagatgacataaattccttgtctgatgaggcattgcctaatagagagccacgtaatgactaccaggaacacgatcacaatatggatattgatttagcatccgattttgaagaagtgccaagtgtaaatgcaaatacgaacgcaaataatgacgtattgttcgacgtagattacgacagagatgcaaaaaatgatagaagtactacataa

SEQ ID NO: 3757 - DNA, 1599 bp, Saccharomyces cerevisiae
atgtcaaacgacggctcaaaaatattgaattataccccagtgtctaaaatagatgaaatagttgaaatctcaagaaatttcttctttgagaaacaattgaaattgtcccacgaaaataacccaaggaaaaaagatctagaattcaggcagttgcagttgaaaaaactctattatgccgtcaaagatcatgaggaagaactgatcgatgctatgtacaaggactttcatcggaacaaaattgaatcggttctgaatgaaacgaccaaacttatgaacgatatacttcacctaattgagattttaccaaaattgatcaaacctcggagagtatctgattcttctcctccatttatgtttggtaaaacaatcgtggagaaaatatcaaggggcagtgtcttgattattgctcctttcaattttcccctacttttagcatttgccccattggcagcagctcttgctgcaggtaacaccattgttctgaagccaagtgaactaacaccacacactgctgtagttatggaaaatttgttaaccacagctggtttccctgatggattgattcaagtagttcagggagctatagatgaaactacaagactactagattgtggaaaatttgacctaatattctacacaggttctccccgtgtcggatcaatagttgctgagaaagcagcaaaaagtctaacaccttgtgtacttgaacttggtggtaaatcacctacctttattacagaaaatttcaaagcaagtaacataaaaattgctttgaaaaggattttttttggtgctttcggaaattctggccagatttgtgtttcaccagattatttgttagtacataaatctatctatccaaaagtcattaaagagtgtgaatcagtactaaatgaattttatccaagctttgatgaacaaacagatttcactcgtatgattcatgagcctgcttacaaaaaggccgttgcaagtataaactcaactaacggctccaagattgtgccttcaaaaatttctatcaattcagatactgaggatctatgccttgtaccaccaaccatagtttataacattggttgggatgatcctttgatgaaacaggaaaactttgctcctgtattgcccatcattgagtacgaggatcttgatgagaccattaacaagataatagaagaacatgacactccattggtgcaatacatattctctgatagccaaactgaaataaatcgtatcttgacgcgcttaagatctggtgactgtgttgtcggtgatacagtgattcatgtaggaattaccgacgctccatttggagggatcggtacttcaggttatggtaactatggtggatattatggattcaatacctttagtcatgaaagaacaatttttaaacaaccatattggaatgattttaccctttttatgagataccctccaaatagcgcacaaaaggaaaagctcgtccgttttgcgatggaaagaaaaccttggtttgacagaaatggcaataacaagtgggggttacgccaatatttttcattatctgccgccgttattttaattagtaccatttacgctcattgttcttcctga

SEQ ID NO: 3758 - DNA, 1602 bp, Saccharomyces cerevisiae
atgaacttgtggagacatagtccagaagaattggctgcttacaatagctgtcatccaatgaagctaggttcaggggtgctgatacaattgcctctttatgacaattcggcagtatatgcagaagatattacttttaggagtttctgctgtgaaagagtgcccgtttatgtatctacggtgctaagaaactcttccccatataggtatcttgatgaggtgatcaatgactggcaaaaattcattcaagtaagcgattatgtcggcggttctgctgagtatgcgatttatgctgtgattttgtcgataacttctaattttgtcatcacagtgttcctgactgtgatatgctgtataaatatcagcgggcgcgcatataagagaattctacaactactgaggatagcctcgttgttagcctcgttgaacttaacgatttttatcacgaaggtgttgcggagattggaaaaagagcacaatgtctatggtgtcgttcgggctcattccattatgcacatcttttccgatgatatgacatttgttgtcttggatttcttggctactttaatgttccaattttgccaagtcggcattgtcattaggctatttcaaagagctcaggaaaagagaataattttttttattggggtgatattaacaataaccgcaaatattttatgggtaattccaccgtttgctaaccatactacaaaacacagaaatgactggcagattctgcggccatttgtttaccttttccgtattgccatcgccacgtcatatgcatcaatcgtcatttatcacatctggcagaaaaaaaaattgtggtttaaattcaatcaaatgggtttacttacgctattgactattcttgtggtgcttctattaccgggtttcttccttgccgatgtgtcgaacttatggatatcggaactgggtgaagtgtttaacacgacatgctatgtcacttcgaccgtgatcacatgggagtggctggatagattaaatgttttggaaagaaaagaggaagcgcaaagcattttgggaagacctatcttcgaggaagagcaacaagactatcggtttgccaagtacgccttaagggttcaaaacgctttaaccaggagggaatctcaggacgcatcaacggatcggcacgatacgtcaagtaattcggaagtatgtgatttacagaccatatcacgctacgacccagaagatcagatatcagtgggcagaagcattgatcgaatgcatttcaatgataggggaacttataaagatgtagcgctgaagaaattaggctatgcgcgtgataaaattttatactttacagaccaaatcgtccagaaaagcgtaggccacaataatagcagcagctcgaaaaatgaaaaaaccaaacagagaaaggccatggtcaggaaacggttgggattagacaaaccaggcatatacatttattcgacaaaggatgtcgttttcaattcagatgaagatgacgatgagaacgcggaagatgaagatgacgatgaatatgaagttggcagtgaaggcaataacaatagctctgccacttttaccagcgaccatataggccatatttga

SEQ ID NO: 3759 - DNA, 1602 bp, Saccharomyces cerevisiae
atgacagaagataatattgctccaatcacctccgttaaagtagttaccgacaagtgcacgtacaaggacaacgagctgctcaccaagtacagctacgaaaatgctgtagttacgaagacagctagtggccgcttcgatgtaacgcccactgttcaagactacgtgttcaaacttgacttgaaaaagccggaaaaactaggaattatgctcattgggttaggtggcaacaatggctccactttagtggcctcggtattggcgaataagcacaatgtggagtttcaaactaaggaaggcgttaagcaaccaaactacttcggctccatgactcaatgttctaccttgaaactgggtatcgatgcggaggggaatgacgtttatgctccttttaactctctgttgcccatggttagcccaaacgactttgtcgtctctggttgggacatcaataacgcagatctatacgaagctatgcagagaagtcaagttctcgaatatgatctgcaacaacgcttgaaggcgaagatgtccttggtgaagcctcttccttccatttactaccctgatttcattgcagctaatcaagatgagagagccaataactgcatcaatttggatgaaaaaggcaacgtaaccacgaggggtaagtggacccatctgcaacgcatcagacgcgatatccagaatttcaaagaagaaaacgcccttgataaagtaatcgttctttggactgcaaatactgagaggtacgtagaagtatctcctggtgttaatgacaccatggaaaacctcttgcagtctattaagaatgaccatgaagagattgctccttccacgatctttgcagcagcatctatcttggaaggtgtcccctatattaatggttcaccgcagaatacttttgttcccggcttggttcagctggctgagcatgagggtacattcattgcgggagacgatctcaagtcgggacaaaccaagttgaagtctgttctggcccagttcttagtggatgcaggtattaaaccggtctccattgcatcctataaccatttaggcaataatgacggttataacttatctgctccaaaacaatttaggtctaaggagatttccaaaagttctgtcatagatgacatcatcgcgtctaatgatatcttgtacaatgataaactgggtaaaaaagttgaccactgcattgtcatcaaatatatgaagcccgtcggggactcaaaagtggcaatggacgagtattacagtgagttgatgttaggtggccataaccggatttccattcacaatgtttgcgaagattctttactggctacgcccttgatcatcgatcttttagtcatgactgagttttgtacaagagtgtcctataagaaggtggacccagttaaagaagatgctggcaaattcgagaacttttatccagttttaaccttcttgagttactggttaaaagctccattaacaagaccaggatttcacccggtgaatggcttaaacaagcaaagaaccgccttagaaaattttttaagattgttgattggattgccttctcaaaacgaactaagattcgaagagagattgttgtaa

SEQ ID NO: 3760 - DNA, 1602 bp, Saccharomyces cerevisiae
atggagcgattgaagcaactggaggaaaaaaggagacaattgaaagagctgcgtgagaggcgaaaacaagccagcttgttccctgggagcgagacgatgggccaccatcccacagaggtgcacgctaaggcaaccatggtcagcgtttcagtgcagaccgacatggaggaaggctcaaagattcaagagccccaatctgcatatcttcgacgtaaggaggttataacatacgacaaaggcattcaaacagatcaaattgaggaagaacaactgcaagaaaatgaaaatcacaccactactgatgctgtcgccattgaaactactgctgccgacgaaaataataaagacaaagctgaaaacgaccagccaaggttagaactagccaaaccttttcttgttgaagaggcggcggcaacgctgagcaacgctagttttgcgcggctggagacagaggtttctgcgtcaggccagcaggcgccatcgaacatgcaacaggataaagacaacctcatgcaatggaacatggtcagtgagaatttacaatcagagacagactgcgattgtatcgctcaggagtatgacccaggaaaaggcgtcttggttgtggtttatctacgattgccgccggcagacctacagtatgctagcagcgaagcggcgtggtctgtggtgaatgtagtcaagtgcgataatgccagcggacgcaacggcctcttgatagatatggtagagttccgtggtacgcggatcatgacagccacgatcctccgtcggtatcatccggaaagcaatgtaatatcaatcttgttggcgaccttgacgggcaagatcatattgtacgagcttagattgaaacagaaaaagccagaaacaccggtagtgtatgtcgtgcagcgaaatatggtggcaagacactactttcagcacccagtggtggctgtaattgaaacaagcagcgtgcaagatcaagagagagtacttgtggcagctgataatggcaatattatggagttgagctgcctggacttgactgttttgcggaagccacagcagctccgtcctgtaccgctatcacagcttttatctttggagaatgatacttgcacatatacggagcgattgcagcggttggcaaagtttgatgaggtaggtatagcttgcatggcgtacacgagtgaggacccgcagtacgtctggatcggtggcgaagacggtggtatatacaaggttttctgggaccaacctgggccgctgtacctctctttggacaacaatgggttccaacctgcagaaaaccactctacgagggtaaccgggttagagtttcattgggacgatgctcggcggctaatgcttctattatcatgttccacggactggacggtgcggctgtgggacgcgcgagcagggaaagctatcataggggcgccattgttgttaggggggcccgtactacgtgcacgctggctcgaaaaaaacaatggaggggaaaatagtcgcactctacggtgtcaagtgtggtgtgcagatggtcgcctcgttgttgtaaattgggctttcgatgctaagacgtccctctacacggccactgttatctcctaa

SEQ ID NO: 3761 - DNA, 1602 bp, Saccharomyces cerevisiae
atgtcagcacctgttcctcaattagtaaatatttctcatgccttgcaagcttccactatccagcaaattcgtttggatatggtagattttaataaagattgcaaattatcttccattcaactggcaagaattgacaagtatatcgattctttgcaagcggctttgaatcagtttaccaaagataacttgcacatagaacggaaggaaaagaacgtgactgaagcagatatacagctgtattctggcttaaaatcaatgtatctagattatttgaaccagctaattaaactaaagcatgagaaacaacaccactctacaccgcccatcgctaatgatgtctccctggacttcttcgttaaccaattgcctaagttttctcccgaggaaaggaaaaattacattgacaatttaatcctgaataaaaatagccataatcgattatctaaaatggatggtctggtagatgcagtcatcaatttatgcgtcttggatacttccgttgctgaaaatgtacgatcctatatgaaattattagatacattgggtttccaaaagggttcgaatagtactggtacaaaggccaacctcaaaaagaaattggctagttcgaaagcaaagataaaggattcagaaaaagaaaaggagaaggagaaggataaatcaaaagtcaagatgaaaactaaattaaaaccttctcctttgctcaataacgatgacaaaaattcttctccatcgcctactgcatctacctcttcaatgaagaaattgaagtcgggtttattcaataaaaatgaagctaagtctacagaatctctacctacttcttccaagaaaaaactatcattttctaaatatctgaacaaggatgacgcagatatgaccaagcttgggactaaacggtcaatagatgtggatttcaaagtcaaccccgaagcatccacggtggcttctaatatcatatcttcgtcaacgtcaggatcgtcaaccacaacggtagcgactcctgcttcttcagaagagcccttaaaaaaaaaaaccaaaatatccgtgcaagactctaatgtacaatcgattttgagaaatggtaaaccgaaaaaagcacgcataagtagcatcaaatttttggatgattcccaactaataaaagtttacggtgacgatctaccgaaccaagggctacaagtttctcctactcaattgaaaaaaattctgaaaccattcaaggagggggaaccgaaggaaattatattgttcgaggatatgtcaatcaaattaaaacctcttgatttgatgtttctgaagaacacaaacagtgatgactatatggatatatccgagactaaaggtggcccaatacattgtgaaacaaggaccccgttgatctatagaaaaaatttcaatcatttcaacccggacttgaataaaaggccgccaagagaacccatagaattcgacttaaatggaaatacgaactcaaccccgactatagcaaaggctttcggtaaaaatagtttattactaaggaaggacagaggtggtttgccatacaagcatgtccccatagtaaaaagaaataaatatcctccaagaccagtacactaa

SEQ ID NO: 3762 - DNA, 1602 bp, Saccharomyces cerevisiae
atgttggaagagggaaataatgtttacgaaatccaagacttggagaagagatctcctgtaataggctcaagcttggaaaacgaaaagaaggtagccgcttctgaaactttcacagcaacttccgaagatgaccaacagtatatcgttgaatcatcagaggccacaaaattatcgtggttccataagttctttgccagtttgaatgcagaaacaaagggtgttgaaccagttacagaggatgaaaaaacggacgattccatactgaatgctgcgtccatgtggttttcagctaatatggtcattgcatcatatgctttgggtgccttaggacccatggtgttcggtctaaattttggtcaaagtgttttagttatcatatttttcaatataatggggttgatatttgttgcgttcttttctgtctttggtgcagaactgggcttaagacagatgattttatcaagatatctggttggtaatgtaacggcaagaattttctctcttattaacgttattgcttgtgtcggttggggtattgtgaatacctcagtatccgcacaactgctgaatatggtgaatgaaggctccggccacgtctgtcctatttgggccggttgtctgatcattattggtggtaccgtgcttgtgactttttttggttacagtgtcattcatgcatacgagaaatggtcatgggtacccaattttgccgtctttttggttattattgcccaactatcgagatcaggaaagtttaaaggtggtgaatgggtaggaggtgcaactactgcaggtagtgttctttcttttggttcatctattttcggttttgccgcaggatggacgacctatgcagctgactacactgtttatatgccaaagagtacaaacaagtacaagatttttttctccctagttgctggtctagcgttccctctatttttcaccatgattcttggtgctgcttctgctatggctgctcttaatgacccaacctggaaggcatattatgacaaaaatgctatgggtggtgtcatatatgctatcctggttcctaactctctgaacggatttggtcaattctgctgcgttttgttagctctgtccactattgcaaataatattccaaatatgtatactgttgctttatccgctcaagctttgtgggcacctttggctaaaataccaagagtagtctggacaatggcaggtaatgctgccactttaggtatttccatccctgctacctattactttgatggctttatggagaatttcatggattctatcggttactacttagctatttacattgccatctcatgttcagaacatttcttctacagacgttccttcagtgcttacaatattgatgattgggataattgggagcatctacctatcggtatcgcaggtactgctgccttaattgttggtgccttcggtgttgcattgggtatgtgtcaaacctattgggttggtgaaattggccgcttaattggtaaatatggtggtgacattgggttcgagttgggtgcaagttgggccttcatcatctacaacatcttaagacctttagaattaaaatacttcggtcgttag

SEQ ID NO: 3763 - DNA, 1605 bp, Saccharomyces cerevisiae
atgagcaacaaatttacaatggagtcacctaagcatttggtggatgatgtgcttttcatatcacccaccaatgatggatcagaagaaaagcctacggaagtcacgttccaggaagatgaaggccatgacgctagcttgcataatcgcagccatgacaagaagtcggaacttgccaccgaacgggaaattatggctactaccacggatgatgacggcatcccctccccttcccatccaatggaaaagcgtgtcttgcgcaaaatggatatatacttgattcctcttatggggatgctatatttcctttctaacctggataaatcgaatattggtaacgcagaagttgcaggtctatccaaggatatccaccttgtaggaacgcaatataacacatgtgtcacagtttttttcgcgacgtatgttcttttcgaccccataggtactaaccttctgaaaattatgggtccgccattaatgatgagtatctgtttgacctgtttcggtgctatttcgctcggaactgcttgggttaagaattatgctcaattgatcgttgtcagactactactgggtgcctttgaaggtatgatttatcccgctattaacatgtacctttcagtctgctatagaagagaacaatatgctctgaggttcgcttttgtcttcagtgcagcctgtttgtcttcatcttttggtgggctgattgcttatggttgttccaaaatcagcggttctctaaaggactggcaatacatttacattgtcgaaggttgtatctctttggggttcgtaccattctatgccttcgggttgagcaaaaatttggaggattcgtggtttttcaataaggaggaaaaagagtacatttccgaaagatacaagactatgaacacttttgacccggacgaaaaatttgaatggttccaagtgtggcaagcagttaaggatgtcaagacttgggctagtgctgtggcattattcggtatcgatttgactacttttggtctaacagtcttcttgccgatcatcattaccagtatggggttcactaatgtcagagctcaattaatgaccgtgcccatctatttccttacagcaattgtgttcttcatttgtgccgtttggtctgatcgtataaagttgagatctccattcatcctgggtgcttgtctgacgacttcgataggcatagctatcgtccttggttctcaagttcatggtgtgagatattttggcgtttacattctttgtatgggtatttacgttaatgctgcctgtaactgtttatggttaagtggtaacactggtaattacttcaagagagccaccgctttaggaattaatctatttttcgggtctggttcagggttggtctctggtcaaatttttgttgccaaagacaagccaagatatatcaaagggctgtcgattagtctggcctttcaagtcttctccatatttatgacggttgtgcaaattttcctatacaagagggaaaacgataaaaagaaagcaataatagatcgctgtaatgaattgggagagcctattccatacgacgaaaggttaagcgacaaaaaccctgagtttaagtacatgtattag

SEQ ID NO: 3764 - DNA, 1605 bp, Saccharomyces cerevisiae
atgagctctgacgaagaagatttcaacgacatctacggcgatgataagcctaccactactgaagaagtcaaaaaagaagaagaacaaaataaggctggcagtggtacctcgcaattagatcaactagccgcactacaagcattatcttctagcttgaacaaactaaataatccaaatagtaacaacagtagtagtaataatagtaaccaagacacatcttctagtaagcaagatggcactgcgaatgacaaggaaggttccaatgaagacactaagaatgaaaaaaaacaagaaagcgctacatcagcaaatgccaatgccaacgctagttctgcaggaccttctggcttaccttgggaacaacttcaacaaaccatgtcacaattccagcaaccatcttctcaatcaccacctcaacagcaagtaactcaaaccaaagaggaacgttcgaaagcggatttgtctaaagaaagttgcaagatgttcattggtggtctgaattgggacactacggaagataatcttcgcgaatattttggtaagtatggtaccgtcactgatttgaaaatcatgaaagaccctgcaacaggtagatctagagggttcggtttcttatcttttgaaaaaccttctagtgttgatgaagtggtaaagacacaacatatcctcgatggtaaagttatcgacccaaaaagagctatcccaagagacgagcaagataaaaccggtaaaatctttgttggtggtattggtcctgatgtgagaccaaaggaatttgaagaatttttttctcagtggggtacgattatcgatgcgcaactgatgttagataaggataccggtcaatcaagaggttttggttttgtgacgtatgactccgctgacgccgttgacagagtttgtcagaataaattcatcgatttcaaagatcgcaagatcgaaatcaagagagctgagccaagacatatgcaacaaaaatcatcaaacaatggtggtaacaatggtggaaacaacatgaatcgtcgtggcggtaacttcggtaaccaaggcgatttcaaccaaatgtatcaaaaccctatgatgggcggttacaacccaatgatgaatccgcaagcaatgacagattactatcaaaagatgcaagaatattaccaacaaatgcaaaagcaaactggtatggattatactcaaatgtaccaacaacaaatgcagcaaatggcaatgatgatgccagggtttgccatgccacctaatgcaatgactttaaaccaaccacagcaagattcaaatgccactcaaggttccccagcaccttctgattccgataataataaatccaatgacgtccaaactattggtaatacatcaaacactgactctggttcaccgccattgaatttacctaatggtccaaagggcccatcacaatacaatgatgaccacaatagcggttatggctacaaccgtgatcgcggtgatcgtgatcgtaacgatcgtgaccgcgattacaatcaccgtagtggtggaaaccatagaagaaacggccgtggtggtcgcggtggatacaatagacgtaataatggctaccatccatataataggtaa

SEQ ID NO: 3765 - DNA, 1605 bp, Saccharomyces cerevisiae
atgcaagctccagtggtatttatgaatgcttctcaagagagaactaccggtcgtcaggcccaaatctccaatatcactgctgcaaaggcagttgccgatgtcattcgaacttgcttaggtccaaaagctatgttaaagatgttattggatcctatgggcggtcttgtgttgactaacgatggccacgctattttaagggaaattgatgttgcacatccagcagctaaatcaatgttggagttatcccgtactcaagacgaagaggttggtgacgggactacaacagttattattctagctggtgagattttagctcagtgtgcaccttatttgattgaaaaaaatattcaccctgttattattatccaagccttgaagaaagcactgactgatgcactagaagttatcaaacaagtaagtaaacctgtcgatgtggaaaatgatgccgctatgaaaaaattgattcaagcctctatcggtactaaatatgtcatacattggtcagagaaaatgtgtgaattagctctagacgctgttaagactgtccgtaaagacctgggacaaactgtggaaggtgaacctaattttgaaatcgatatcaaaagatatgtccgtgtggagaagattcctgggggggatgttctagattctcgcgtcttaaagggtgtcttattgaacaaggatgttgttcatccaaagatgtcccgtcacatagagaatccacgtgttgttcttttggattgtccactagaatataagaagggtgaatctcaaaccaacatagaaattgaaaaggaggaagattggaataggattttacaaatcgaggaagaacaagttcagctaatgtgtgaacaaattttagccgttaggccaacactagtcatcactgaaaaaggtgtttcagatctagcacagcattatttactaaagggtggatgtagtgttttaagaagagtgaagaaatcagacaataatagaattgctcgtgtaactggtgcaaccattgtcaatcgtgtagaggacttgaaggaaagtgatgtcggtacaaactgtggattattcaaagtagaaatgattggggacgaatatttctcatttttggataactgcaaggaaccaaaagcttgtaccataatgttacgtggtggttccaaagatatattaaacgaaatagatcgtaacctacaagatgctatggctgttgctcgtaatgtgatgttgagtccttccttgtccccaggtggtggtgccaccgagatggcagtttctgtcaaattagcagaaaaggcaaagcaattagaagggatccagcaatggccataccaagctgtagctgatgctatggagtgtattccacgtactttgatacaaaatgcaggtggtgatcctattagactcctatcccaactaagagccaaacacgcacagggaaattttacaacaggtattgatggtgacaaggggaaaattgtagatatggttagttacggtatttgggaacctgaagtcatcaagcagcaaagtgtcaaaaccgctattgaaagtgcatgtttactattaagggttgatgatattgttagtggtgtaagaaaacaagaataa

SEQ ID NO: 3766 - DNA, 1605 bp, Saccharomyces cerevisiae
atgcatcaccaaactaagttagatgtattcataatcagagcttataatttactgtctaacgagtctgtcattagtggtgcttccttgcagagtgttacaaactcgccacagacgacaacgaacacgccctcaggtatggttaacggggcggttggaacagggatagctaatccaacagggttgatggggtctgatagcacacctaacatcgatgagattataactagcactggtagtaatgctctgacgaaaaccaactcagatagcgctaatggtacgccgaatggtaattcaagttctacctcagccattagcaatgcaagcaatcctgccactactggtaataatgcgagctctagtgccacctcaaatggaatatatacgcaagcgcaatattctcaacttttcgccaaaatatcaaaactatataacgctacactatcatctgggtcaattgacgatagatcaacatcaccaaaatcggcaatcgaactatatcaaagatttcaacagatgattaaggaactagagctgagttttgacgcaagtccttacgcaaaatacttccgccggttggatggaaggctttggcaaataaagacagactcagaattagaaaacgatgaattgtggcgattagtctcaatgagcatatttacagtattcgatcctcagaccggccaaattctaactcaaggacgcaggaagggaaactccttaaatacatcaactaaaggctccccatcagatttacagggaataaacaacgggaacaataatgggaacaatggtaatattggaaatgggagtaatattaagaactatggaaataaaaacatgccaaacaaccgaacgaaaaaaagaggcaccagggtggctaaaaatgctaaaaatgggaaaaacaataaaaatagtaataaagagagaaacggcattacagatacgagtgcattcagtaatacaacaataagcaacccaggtaccaatatgctttttgatccatcattgtctcaacagttacaaaaacgactgcaaacgctatcacaagatgtcaattctcgttcgttgacaggatattatacacagccaaccagtcctggctcaggaggatttgaatttggtttgagtcatgcagatctgaaccccaatgcttccagtaataccatgggctataatacaatgtccaataatggatcccattcgtggaaacgaaggtcactgggatcgttagatgttaatacgctggatgacgaagcggtggaagaacttttgcaactgacaaatacgagtaagaggcagaggccgatgacaactgcagcagagggtgcgttaataaatgatggtccggacactaatttaaacgcgaataacacccaaatgaaagttgatttaaatccttcaaacagcatgggacctatagatacagaagccgtgatacgcccattgaaagaagcttatgacgcaatcatttctgaaaaaggccaaagaattgtgcaattagaaagagaattggaattacagcgccaagagacgcagtggttaaggaaaatgttaattgaagacatgggttgtgttagaagtatgttaagggatttacaaagatga

SEQ ID NO: 3767 - DNA, 1605 bp, Saccharomyces cerevisiae
atggaaaaatcactagcggatcaaatttccgatatcgccattaaaccggtcaataaagacttcgatattgaagatgaggaaaatgcatctttatttcaacacaatgaaaaaaatggagaaagtgatttaagcgactatggaaatagcaacacagaagaaaccaagaaggcgcactatttggaggtggaaaagtctaagttaagagcagaaaaaggtttagaactaaacgatccaaaatatacaggtgttaaaggttcaagacaagcattatatgaagaagtttccgagaatgaggacgaagaagaagaagaagaagaggaagaagaaaaagaggaagatgctctttcattcaggacagattctgaagatgaagaagtagagattgatgaagaagaatcagacgcggacggcggtgaaacggaggaggctcaacagaaaaggcatgcactatcgaaactaattcaacaagagactaaacaagctattaacaaactgtctcaatcagttcaaagagatgcttcgaagggttattccattttacaacagacaaaattatttgacaacatcattgatttgagaataaaactacaaaaagctgtaattgcagcaaataagctcccattaactacagagtcctgggaagaggctaaaatggatgattcagaggaaacaaagcgtttgctgaaggaaaacgaaaaactgttcaataatttattcaatcggttgataaatttcagaataaaattccaacttggcgatcatatcactcaaaatgaagaggtggcgaagcataaattgtccaaaaaaagatctctcaaagagctttaccaagaaactaatagcttagactcagaactaaaagagtacaggactgccgtattaaacaagtggtctaccaaagtttcttctgcatcaggtaacgctgctttatcatctaacaaattcaaagctatcaacttacctgcagatgtacaagtcgaaaaccaattatccgatatgtcccgtttgatgaaaagaacaaagttgaacaggagaaacataacgcctttgtatttccaaaaagactgtgctaatggcaggctaccagaattgatttctcccgttgtcaaagatagtgttgatgacaatgagaattcggatgatgggcttgatatcccgaaaaactatgacccaagaagaaaggataacaatgccattgacattaccgaaaacccatatgtttttgatgacgaagatttttaccgtgttttactaaacgatttaattgacaaaaagatttccaacgctcacaattctgaaagtgcagcaattacaatcacctcaactaatgctcgttcgaacaacaagctaaagaagaatatcgatactaaggcttccaagggtaggaaattgaactactcagttcaagatccaattgcgaattatgaagcccccatcacatccggatacaaatggtcagacgaccaaatcgatgaattctttgcgggattgttaggtcaacgagtgaactttaatgaaaatgaggatgaggaacaacatgccagaatagaaaatgacgaagaattagaggctgttaaaaacgatgatatccaaatctttggttga

SEQ ID NO: 3768 - DNA, 1605 bp, Saccharomyces cerevisiae
atggaagttgcaccggccttatcgactactcagtcggacgtggcgtttcagaaggtggagacacatgaaattgacaggtcttcatacttggggccatgttataatagcgatgagcttatgcaacttatctcggcttattacaatgtcgagcctctcgtgggttatctggaacagcacccggagtaccaaaacgtgaccttgcagtttcctgacgatttaatcaaggactcctcgttgatagtaaggctgctgcaatcgaaatttccccatgggaagataaagttttgggttttagctgacacagcgtacagtgcatgctgtgtagacgaggtcgctgctgaacacgtacatgcagaagtcgtggtacattttggtgacgcatgtttgaacgccatccaaaacttgcccgtggtttactcattcggaactccatttttggatttggcactggtggtggagaactttcagagggcattcccagacttatcctccaaaatttgtttgatggcaaacgcacccttctctaagcatttgtcacagctgtacaatattttgaagggcgacctgcactacacaaatatcatatattcccaagtgaacacctctgcggtagaagaaaaattcgtaaccatacttgacacctttcacgttcccgaagacgtagaccaggtgggtgtgttcgaaaaaaatagcgtgctgtttggtcagcacgacaaagcagacaacatctcgcccgaggactatcatcttttccatttgaccaccccacaggatccgagattactgtatttgtctactgtgtttcaatctgttcatattttcgatccggctttacctggcatggtaacggggccatttccctctctaatgaggcgttacaagtacatgcatgtggcaagaacagcgggatgtataggtattctggtcaacacgctgtcgctacgtaatacaagagaaactatcaacgagctggtcaagcttatcaaaactcgtgagaaaaaacactatttatttgttgtcggaaagccaaatgtggccaagctagcaaactttgaagatattgatatttggtgcattctcggttgtagccaaagcggtatcatcgttgatcaattcaacgagttttacaagcccattattacaccttatgaattaaacttggccttgagcgaagaggtcacatggaccgggaaatgggttgtggacttcagagacgccattgatgaaatcgagcagaatttgggcggacaagataccatctctgccagcacaacttccgatgaaccggagtttgatgtagttaggggaagatatactagcacatcaagaccactgcgagcgctaacgcacctggagttagaggcggccgacgacgacgattccaaacaactgactacaagacataccgcctcaggtgccgtcattaaaggtactgtatccacttcagcatcagcactgcagaatcgttcgtggaaaggtctaggaagcgatttcgactctactgaggttgataatactggagcggatatcgaagaaggtatttccggtgtcgcacgtggttatggatttgatcgcgaagacgctatgaaaaaggaaaacaaatga

SEQ ID NO: 3769 - DNA, 1605 bp, Saccharomyces cerevisiae
atgtacaccaattattcacttacaagcagtgacgcaatgccccgaacttacttggtcggcacagcctcaccagaaatgtctaagaaaaagcgccagtctgcaaattgtgacaagccaacgaggagggtgatccacatcatcgatactaatgagcactcagaagtcgacttgaaaaatgaactgccaataacatgcacgaatgaagacggtgagatgacatcaagctcatggacttcacaaaccgctaatgattttctcaaactggcatacgtaaacgcgaaattagacccgtctttgccatctcaatatttcaaacaagatatcataaatgttttacaaagcttggagattcctggatggtctgtgcccggctctaaagaatcctcgttgaataagaatttattaactttgacacaaatcaagggggcccttacaaatgttatttataagattcactatccaaacttaccccctttactgatgagaatttttggtgatagcatagattctgtaattgatagagagtatgaattaaaggttattgcgagattatcattttatgatttaggacccaaactagaagggttttttgaaaatggcagatttgaaaaatacattgagggttcgaggacatctactcaagccgactttatagatcgggatacttcaataaaaattgctaaaaaattgaaagagttgcattgtactgttccattaacgcataaagaaataacggatcaaccgtcatgctggacaacctttgatcagtggatcaaattaatagactcgcataaagagtgggtttccaataatgtaaatataagtgaaaatttacgctgttcaagttggaatttttttttaaagagtttcaaaaattataagcgttggttgtataatgattctgcttttacctcaaaattattaagagaggatgataaagatagtatgataaattctgggctaaaaatggtattttgccataacgacttacagcatggtaatttactttttaaaagtaagggtaaggatgacatctcagtgggcgatttaacaattattgactttgagtacgcaggccctaaccccgttgtatttgatttatcaaatcatttgaatgaatggatgcaagactataatgatgtgcagtctttcaagtctcatattgataagtatccaaaagaagaagatattttagtttttgcacaaagttatataaatcacatgaatgagaaccatgtcaaaattgcttctcaagaggttaggattctttacaatctaatcatcgaatggaggccttgtacacaattattctggtgcctttgggctcttttgcaaagcggaaggctaccacaacgaccactgatagaaggtgaaaaactaatgagcgaaaaggctggactaggtgatgaaacgcaccttatggagcacaaaaataaagagaatggaaaatacgattgttctgaagatgattcgttcaactatttaggattttgtaaagaaaaaatgtctgtcttttggggcgatttaattacattgggagttatcgacaaagactgcccagatattggaaaaacagattacttagacactaaacttattttttaa

SEQ ID NO: 3770 - DNA, 1605 bp, Saccharomyces cerevisiae
atgtccaatgcaaatctaagaaaatgggttggtttttgctttgttgccatttatctctttttaggtgttccactgtggtacaagctaactacagtttatagagcatcactaccaataaattacattgagtcacttcaaaataacaaattccaagatattcatctcgtaataccggtgtatgttaagtcagatacttacagatttcctgacgttcatgacgctatccaagtacaagttaaccatttattgaattctcaggagcaacgggtcccttggtctttacaagttcttccatataatgagactattgagcagatggaaagtgaaggcaaccagtttcatgtcgttactttgaagttagacgaatttattggttactcatcagcttacgacaccaaagaaacactagtatattacgacgatgctgccgttttaagtaatgatctaccgttttttgttgctcaaacattggtagagcacactttccaattggaatggacgcatttgaataaaacgtgtgaaggcgtttctacaaacaacgatgtcgcaatatcttatgatccaaacattcatttaagtgtaactttattgtcaggtgatgggaatcctgttgcatgggaaattgagcctacattaactgactacttttcaccttttaggaagttcttatcaccactggtaaattttacagtagattcatccattgtttatcataatgatttgaatttgcattcattaaatggatcatgtacaagcgttacgtggtttgatctctctcatactattgatctttctgaactttcttcaatggcctattacccagaagattctgcactgaatttagccatagtctttcctagtgcttcttcaagtcccgatggtctggcgttcattaatggcactcggatttcagacgaaataaccacattagattggaatagttatctagttcctcaatggggggttataataataaataaaatgccgttgaagccaaattcagtcattagcgaagattatttagaacctatgatgtaccgttttgcgacagatatttttcaactattgggattaacggagggctcgcaagatttgttatcaccttatattaccatagattcattcaaaaggttgacaattttacagaatctagataaagctacggaaacattatggtcgttagtgaaattaactcaacaatttcagggcatgtctatcccacgcgaagtatcggataatgttatcgaagctttagacttaaggctacagattattgatttattaaatgatcctggaaagggtggagatatcgtctggaacaatgccctgcatctaagtaatgaattggttaaactatgcgaaaaggcatttttcaatggagaaatggttcaacaaaatttcttcccacaagagcacatgatagctgtgtatttacctttattaggcccaatatcggcagtcatgttctttggtttctacaacgtgatgaaggaaaagaatcaaaagagtaaaaagaatggaaccgagagagaagttgctaaagaaaaattagagttgaaagaggctcaaaaattacatgctattgatggtgaagatgaattatga

SEQ ID NO: 3771 - DNA, 1608 bp, Saccharomyces cerevisiae
atgagtataacaagtgaagaactaaactacttgatatggaggtattgtcaagagatgggacacgaggtgagtgcattagcattgcaggatgaaacaagagtattggaatttgatgagaagtataaagaacacattcctttgggtacactggtgaatctagtacaaaggggaatcttgtatacagaaagtgagttaatggttgatagtaaaggtgatatcagcgctttaaatgaacatcatctttctgaagatttcaatttggttcaggcgctgcaaatagataaagaaaaatttcctgagatctcttctgaaggaaggttcactttggaaaccaattccgagagtaataaagcaggtgaagatggcgctagtactgttgaaagagaaacccaagaggacgatactaattctattgacagtagtgatgacctagacggatttgtcaaaatactgaaggagatagtaaaattagataatattgtttcctccacttggaatccattggatgaatctatactcgcatacggtgaaaaaaattctgttgcaagactagcgaggatagtagaaaccgatcaagaagggaaaaaatactggaaactcacgataatagcggagttgagacatccttttgctctgagtgcaagtagtggtaaaacgacgaatcaagtcacatgtcttgcttggtcacacgatggtaattcaattgtcacgggtgtagaaaatggtgagctaagactatggaataagacgggggcacttctgaatgttttaaattttcatagagcacctatagtatccgttaaatggaacaaagatggaacacatatcatatccatggacgtggaaaatgtcactatactctggaatgttataagcgggaccgtcatgcagcactttgaattaaaagaaaccggtggctcatccatcaacgcagagaaccatagtggcgatggttcacttggggttgacgttgaatgggtagacgatgacaaatttgtcattcctggccctaaaggtgctatatttgtataccaaattacagaaaaaacgcccactggtaaacttattggacaccatggacctatcagcgttttggagttcaatgacaccaataaacttctacttagtgcctcagacgatggtactctaagaatatggcatggcggtaacggcaattctcagaattgcttctacggacactcacaaagcatagtatcggcatcatgggtcggtgatgataaggtaatatcctgctcgatggatggctccgttcgcctatggtcgctgaagcagaatacgctattggctctatcaatcgtggatggtgtcccaatttttgctggaagaatatcacaagatggacagaagtacgcagttgctttcatggatgggcaggtaaacgtctacgatttaaaaaaactgaacagcaagtcacgaagtctttatggtaaccgtgatgggattttgaatccattaccaattcccctctacgctagctaccaaagcagccaagacaatgattatatatttgatctgtcatggaactgtgcgggaaacaagatttctgtagcatactcgcttcaagaaggttcagttgtagccatataa

SEQ ID NO: 3772 - DNA, 1608 bp, Saccharomyces cerevisiae
atggaagatatagaaggatacgaaccacatatcactcaagagttgatagaccgtggccatgcaagacgtatgggccacttggaaaactactttgctgttttgagtaggcagaaaatgtactcgaattttactgtttacgcggaattgaataaaggtgttaataagagacaactaatgcttgtcttgaaagtattacttcaaaaatactcaactcttgcgcatacaatcattcctaagcattatcctcatcatgaagcgtactactctagcgaagagtaccttagtaaaccttttccacagcatgatttcataaaggtgatttctcatcttgaattcgatgacttgattatgaataatcaaccagaatacagagaagtcatggagaaaatctcagaacagttcaaaaaggatgatttcaaagtcaccaataggttaatcgaattgattagccctgtaatcatacctctgggtaatccgaagaggcctaattggagattgatttgtttaccaggtaaggatactgatgggtttgaaacgtggaaaaacttcgtttatgtcactaaccactgcggctccgacggtgtcagtggatcgaattttttcaaagatttagctctactcttttgtaaaatcgaagaaaaagggtttgattatgatgaagagttcatcgaagatcaagtcatcattgactatgatcgagactacactgaaatttctaaattgccaaaaccgattacggatcgtattgactacaagccagcattgacttcattacccaaattctttttaacaaccttcatttatgaacattgtaattttaaaacctccagcgaatctacacttacagctagatatagcccctctagtaatgctaatgctagttacaattacttgttgcatttcagtactaagcaagtagaacaaatcagagctcagatcaagaaaaatgttcacgatgggtgcaccctaacacccttcattcaagcgtgctttcttgtagccctgtatagactggataagctgttcacaaaatctcttctcgagtatgggttcgatgtggctattccaagcaacgcaagaaggtttttaccaaacgatgaagagttaagagattcttataaatacggctccaacgttggaggttcgcattacgcctatctaatctcctcattcgacattcccgaaggtgacaatgacaagttttggagtcttgtcgaatactactatgaccgctttttagaatcgtacgacaacggtgaccacttgattggtctgggggtcctacaacttgattttatcgttgaaaacaagaatatagacagccttcttgccaactcttatttgcaccagcaaagaggcggtgcaatcatcagtaatacaggacttgtctcgcaagatacgaccaagccgtactacgttcgggatttaatcttctcgcagtctgcaggcgccttgagatttgcgttcggcctaaacgtttgctccacaaacgtgaatggtatgaacatggacatgagcgtggttcagggcactctacgggatcgtggcgaatgggaatcgttctgcaagctcttctaccaaaccatcggcgaatttgcgtcgctttaa

SEQ ID NO: 3773 - DNA, 1608 bp, Saccharomyces cerevisiae
atgggcatgttttttaatttaaggtcaaatataaagaagaaagccatggacaatggactaagcctgcccatttcaaggaacggtagctcgaacaacatcaaggacaaacgctcagagcataactccaactcattaaagggcaaatacaggtaccagccgcgctccacaccgtctaaattccagcttacggtgagtatcacatctcttattattatcgccgttctgtcgttatatctctttatatcatttctctccggaatgggcattggtgtatccacgcaaaatggtaggtcgttgttgggttcctcaaaatcctccgaaaattacaagactatcgacctagaagatgaagaatattacgactatgattttgaggatatcgatcctgaagtgatttcaaaatttgatgatggtgtgcaacattatctaatatcacaatttggttcagaagtgttgactcccaaggatgatgaaaaataccaaagggaactcaacatgctttttgattccactgttgaggagtacgacctgtcgaattttgaaggtgctccgaatggattggaaacacgtgatcacattcttttatgcattccactaagaaacgctgcggatgtattgccattaatgttcaagcatttaatgaacctaacctatccacacgagctgattgatctggcctttttagtcagtgattgctcagaaggtgacactacgttggatgctttaatagcgtattctaggcacttacaaaatggcacgttgtctcagatttttcaagagattgacgctgtcattgattcgcaaacaaaaggcaccgataaattatatcttaaatatatggacgaaggttatatcaaccgtgtccaccaggcattttcaccaccattccatgaaaattatgacaagccatttagatcagtacaaattttccaaaaggattttggccaagtaattggacaaggttttagtgacagacatgccgttaaggttcaaggtataagacgaaaactaatggggagggcaagaaattggttaactgccaatgctttgaaaccttaccactcatgggtttattggagagatgctgatgtagagctgtgccctggttcagtcattcaagatttgatgagcaaaaactacgatgttatcgtccctaacgtttggagaccactacctacatttttgggaactgaacaaccatatgatttgaattcttggatggaatctcaggaggcactagcattggcaaagactcttgacgaagatgatgttattgtagaaggctatgcagaatatcctacgtggagagttcacttagcctatatcagagatgcagaaggtgatccaaatgaagcggtggacttggacggtgtagggggagtttctattttggcgaaggccaaaatatttagaaacggggtacagtttcctgcatttacttttgaaaatcatgcagaaacagaagcatttggtaaaatggcaaagaaaatggggtacagggttggtggtttaccgcattatactatttggcatatttatgaaccgagcgatgacgatttgaaggaaattgcgtcaagggaaagagagaagagaagacaatcagagtaa

SEQ ID NO: 3774 - DNA, 1608 bp, Saccharomyces cerevisiae
atgtgccttgaaccaatctctcttgttgttttcggatccctggtgtttttctttggcttggtgaagtatttcaaacgtggagaacggcaaagaacaagaggaattttacagccagagtacaaagataagtattattacagtaaagaaaaaggggaagaaatgggcgaggtagcaaacgtaaatgaaattccggtcaagataagaaatcataagtatcctgcgaaagaacataacttgagggttaaagatttgttgttaaatcgcaatccgaagctatcaaagatatccacagcattttttattgctggtgaagaattagagggaaacaagtattgtgacaccaacaaagattttagacagaatagatatttttatcatttgtcaggtgttgatatacctgcttcggcgatattgtttaactgtagcacagataagctgacattgtttttgccaaacatcgatgaagaagatgtcatatggagcggtatgcctttgagtttggatgaggcaatgagagtgtttgacattgatgaggccttgtacatatctgatctggggaaaaaatttaaagaattgcaagacttcgctatctttacaaccgatttggacaatgttcatgacgagaatattgcaagatcactaattccttcagaccctaacttcttttatgctatggatgaaactagagcaattaaggattggtatgaaattgaaagcatcagaaaagcttgtcagatttcagacaagagccatttggccgttatgtccgcgttgcccatcgaactgaacgagttacaaatacaagctgaatttgaataccatgcaacccgtcaaggtggtcgttctttgggctatgaccccatttgttgttctggaccggcatgtggcactttacattacgtcaagaattcagaagatatcaaaggtaaacattccatcttaattgatgcaggtgcagaatggagacaatatacaagtgatatcaccagatgtttcccaacttcaggcaagtttactgcggaacatcgtgaagtttacgaaaccgttcttgacatgcaaaaccaagcaatggaaaggattaaacctggtgctaaatgggacgatttacatgcactgacacacaaggttcttattaaacatttcttaagtatgggtattttcaagaaagagttttctgaggacgaaatctttaaaagaagagcttcttgcgctttttatccccatggactagggcatatgttggggcttgatgtacacgacgttggtggtaatccaaactatgacgacccagatccaatgtttagatatttaagaatccgccgtcctttgaaagaaaatatggttatcactaatgaaccaggttgctactttaatcaatttttgatcaaagaatttttggaaaagcaccccgaaagattggaagttgtcgatatgagcgtattgaaaagatacatgtatgtcggtggtgttagaattgaagatgatatccttgttaccaaagatggttacgagaacttaactggtattacttctgaccctgatgaaattgaaaaaatcgttcaaaaaggtttgaagaaaccccgttcaggtttccacgtaatcgtttag

SEQ ID NO: 3775 - DNA, 1611 bp, Saccharomyces cerevisiae
atgacatttactagcaacttgccctcaagctccgagcagtcaatatcaccacctgcctcttcattttcttcatcgactgatacgttgaaagatattgatattccccataatggggccgatttgtctacatatagtaaatttctggccctgtattgcagaagcgacaaatgtgacgatttttactctttagaggaaaaacagaattgtaaatttggagaccaatggctcgactttatcaacactattcacaatctggacttttctgaatccgaagtaagtggacgggtttctgaaagaattttgccagcttctttagcaaataaatttaccaataatttaggagtggcaataaagatttctgaatatacacgcgatgacgaacgccagattcgtgggtgtgttacaacagttgagaatgaaaattctttcaataactggttcgtatatcatattttagaccaatctcaattatctctaagtgaacatccaattgtaaccaaagaagttaagtatcacgaattatttgcagatttttttgagaaaaatttgaaaaacacaatagttaatgatcaatggaattttggtggccgtgattattttattgaacgttcaagatattttaccgatcgatatttgagaattgaatgcatcttgccagcgtttccatgtaagtcatctaatgagcaaaaagtgtacggttccgttcctgacaaaggcgaagaactcgctttgaaaagattaataaaagccacacaagaccttgtcaagatatatccaccgggtatgaaaatttggatagttagtgatggccatgttttctccgattgtattggggtcgatgatgacgtcgtgagtacttacacgaccaaattgcacgaactgtataaaagagtggctatacctggtgttgacgccattggcttttgtggattgaacgatttattttttagcggtgcagctagtaaagttttcgatccaaagtgggttagtgatgttgaagttgcacactacacaggaactcaaatctgtcctaagtccgatttgtcgagacagattttgatgaaaggctgtgatacagatgcaggtcgtttgagaaagcagattgcaatagaaggacatccaagattgcatctgtataggggcttttcacgttttatgatggaagatttatctctactggaacatttccaaagttattccagaaaaaaattcaagaaaatcatttcaatgatcgcttttaacatgattaagagaaatgacgcgtattcgaacttagtggaattgatattccctcatcatttgagaatttctattcatgcgcacactaacagcgggcccaaatttggtataaaagtaatctccaacgaacagtgttctattgttagttcgttagaagaccttgatgaacccaaatttgaagattttttacatattcccacaccttggcataattgtgtcgtgaaggttgaggatgaaaaggagaaatactttttgacaaaatcaaaagtagtcaaggaggctctcgaaaagggtatgtatgatggtgtatggaaagatactcgtttcgatattggagaaggaggacatttcgttatcaagaaaatctcttaa

SEQ ID NO: 3776 - DNA, 1611 bp, Saccharomyces cerevisiae
atgatcatgttgagaataccgacacggtcttattgttcaccttcgaagctaataaagggcgtaggtctctcaccattgaagaaatctctgttatccaagaaaataaaggaagatatccatccttctttacctgttagaactaggtttgcgccttctccaactgggtttttacacttggggtcactgagaacagccctttacaattacctattagcaagaaacaccaatgggcagtttttgcttcgtttagaagatacagaccagaagaggctaatagagggagcagaagaaaacatctacgagattctgaaatggtgtaacataaactacgatgaaacccctataaagcaaagtgaaaggaaactaatatatgacaaatatgtaaaaatattactatcttctgggaaggcgtatagatgtttttgttcaaaggagcgattgaacgatttgagacactctgcaatggaattgaaacctccttcgatggcaagctatgatcgatgttgtgcacacttaggggaggaagaaataaaatctaagctagcgcaaggtatacctttcactgtgcggtttaaatcgccagaacgatatccaacgtttactgatcttttacatggacaaataaatcttcaaccgcaagtaaactttaacgataaacggtacgatgaccttatccttgttaagtcggataagttgccaacctatcatctggcaaatgttgtggatgaccatttgatgggaataacccatgttataagaggtgaggaatggctgccctctactcctaaacatatcgccctatataatgcatttgggtgggcttgcccaaagttcatccacattcccttattgacgacggttggtgataagaaattgagtaaaagaaaaggtgatatgtctatctcggatttaaaaagacagggagttttgccagaagctttgattaacttttgtgcgctatttggctggtctcctccaagagatctggcttcgaaaaagcatgagtgtttttcaatggaggaattggaaaccatttttaatttgaatggtttgacgaagggaaatgccaaagtcgatgataaaaaattgtggttcttcaataagcattttttgcaaaaaagaatacttaatccttctacattgagggagcttgtcgacgacattatgccttctttagagtccatatataacacatctaccataagccgtgagaaagtagctaaaattttactgaactgtggtggttctctatcaaggattaacgattttcatgatgaattttattatttttttgaaaagcccaaatataatgataatgatgctgtcacgaaatttctaagcaagaacgaaagccgccacattgctcacttattgaagaagcttggacagtttcaagagggcaccgatgctcaagaagtcgaatctatggtcgaaacgatgtattatgagaacggtttttctaggaaagtcacgtatcaggcaatgagatttgctcttgcgggatgtcacccaggtgccaaaatagcagccatgatagatattttgggcatcaaggaaagtaacaaaagattatccgaaggtttacagttcttgcaaagagagaaaaagtaa

SEQ ID NO: 3777 - DNA, 1614 bp, Saccharomyces cerevisiae
atgcaattgatttccatcctctctttgttgtcatcattgatgtgttcattgaccgttttagggtcttccgcaagttcctatgttaagtttcctgttcaaaagttggctgatattataaatatatgcacacaggatgtttctaccgtcttcaaaagaaatgaggttcttaacaccacagtgataaatggaataggagtgtatgttgtcaagatggaaatcggaacgcctccacaaacgttgtacctacagttagatactggctcttcagatatgattgtgaataatgctgacattgcctattgcaaatcgatgtctgacggatctgactacgcttcaactgataattacgagctcacagcaacgttcaatgggcttccttcgactaccatctcatcagaagcttataacactctctgctcttattggggtacattcgatgcaagcaactcatctacttttgagaataatgcgacgtttttcaataacacatacggagatggtacgtattatgcagggacttatggtacggatgttgtctctttcgaaaatattactctaaatgatttcacttttggtgtatcaaatgatacaataggcaatccaagtggcattttaggcatatcgcttcccattgcagaatttacagatggtatcgaatacgcattggcattgaacagaacacctttcatatatgataactttccaatggaattaaaaaatcagggaaagattaataaaatagcgtattctttatttttgaatggacctgatgcacacttcgggagcatcttgtttggtgcagtggacaaaagtaagtacacaggacagctttacaccctgcctatgctgcaggcattcaatacccttggctcaaatcctgggatgattattactgcacaaagtgtggcaattttggatagtgaatctggcaataaaactgtttcggatattcaatttccagtgatgttggattctggcacaactttctcctatttacccaccgaaattgcagaagcaatcggcaaaagttttgacggagagtacagctctgacgaccaaggctacatctttgattgttcaaaagtgaacgatactttactgtccgtcgactttggaggatttaatatatcggcaaacatatccaatttcgtaacatcagctaaggatcgttgcgttttaaatgttaagcaatccgagtccacttatatgctgggagatgctttccttgtcgacgcatatgtagtctacgatttagaaaactacgaaatttctattgctcaggctagctttaataatcaagaagaagatattgaggttatctccgatactgtcccaggtgccacccctgctcccggatactttagtacatgggtatataagcccggtagtcccatcggaacaggagattttattaatgtcagctggacctcgtattcggaattttcacagtacaaatcattgcttgccaccgcagcccaaagcgatgatgctagttctttctcaagtagtggcggctctagcgaaagcaccactaaaaaacaaaatgcaggttacaaataccgttcttctttctccttttcattattgtccttcatatcttattttcttttataa

SEQ ID NO: 3778 - DNA, 1614 bp, Saccharomyces cerevisiae
atgcacttttctttgaagcaattggctgtcgctgcgttttacgctaccaatttaggctctgcctatgtcattcctcaattcttccaggaagcctttcaacaagaagagccaattgagaattatcttccgcaattaaacgacgatgatagctctgccgttgctgccaacattccgaagccacatattccttacttcatgaaaccacatgtagaaagtgaaaaattgcaagataaaatcaaagttgacgatttgaatgctactgcttgggacctctaccgtttagctaactattctactcctgactacggtcaccctacccgtgtgatcgggtccaagggtcataacaagactatggaatacatattgaatgttttcgatgacatgcaggactactatgatgtttctttgcaagagttcgaagctttatccggtaagatcatctctttcaacctctctgacgccgaaaccggtaaaagctttgctaacactacagctttcgcactttctccacctgtggacgggttcgtaggtaagctagtcgaaattcctaacttgggatgtgaagagaaggattacgcctctgtagtcccaccaagacacaacgaaaagcaaattgcccttatcgaaagaggtaagtgtccttttggcgataagagtaatttggccggtaagttcggtttcaccgctgtggtcatttacgacaacgaacctaaatctaaagaaggactacacggtacattaggcgaacctaccaagcacactgtcgccaccgtcggtgttccatataaagttggtaaaaaattgattgccaatattgcattgaacatcgattattcattatattttgccatggactcttatgtagaatttatcaagacccagaacatcattgccgacacaaaacacggtgatcctgataatattgttgcccttggtgctcattcagactctgttgaggagggcccaggtatcaacgacgatggttccggtactatttccctattgaacgtcgctaagcaattgacccatttcaagatcaataacaaggtccgttttgcatggtgggctgctgaagaagaaggtttgctaggctctaacttctacgcttataacttgaccaaagaagaaaactccaagatcagagtatttatggactatgacatgatggcttctccaaactatgaatacgaaatttatgatgcgaacaacaaggagaaccctaaggggtctgaagagttgaaaaacctgtacgtagactactacaaggctcatcacttgaactacactttggtcccatttgacggtagatccgattatgtcgggtttatcaacaacggaattccagccggtggtattgccactggtgccgaaaagaataacgtcaacaacggaaaggtcttagacagatgctaccatcaattatgtgatgatgtctctaacttatcctgggacgcattcattaccaacaccaagttgattgctcactctgtggccacctatgctgactctttcgagggtttcccaaaaagagaaacccaaaagcacaaagaggtggacatattgaatgctcaacaaccacaatttaagtacagggccgacttcttgattatttaa

SEQ ID NO: 3779 - DNA, 1617 bp, Saccharomyces cerevisiae
atgagatttgtgttcgatgaggttttcaattcagatactgattctccagaatttgaggaaacatgttctacaacatcttctacgtcatcgcaatgccctacacctgagccgagcccagcaataaagttaccttcattcacgaaagttggcacgaagaaattggtaaatgagtcggtagttattttagatcctgctctagaaaacgccttgcgcgatttgaaccttcaatcgaaactgatccccattaatgagcccattgtagccgcgtcatcgataatagtaccgcattcaaccaatatgccactaccgagagcatcgcattcgtcattgctagataatgctaagaactcaaatgcgacagcacccttactcgaggcaatagaagaatcttttcaaaggaaaatgcaaaacttggtgcttgccaatcagaaagaaattcaatctattagagaaaataaacgtcgtgttgaagagcaacgtaagcgaaaagaggaggaagagcgcaaacgtaaggaagctgaggaaaaggccaagcgggagcaggaattattacgtcaaaagaaggatgaagaagaacgtaaacgcaaagaagctgaagcaaagctagcgcagcagaaacaagaagaagaaaggaagaaaatagaagaacagaatgaaaaggaaagacaattgaaaaaagaacatgaagccaaattattgcagcagaaggataaattgggtaaagcagttacaaactttgataaaatctccaaaatgttttggcattataaagacaaaattgctcaaataaagcaagacatagttctgcctataaaaaaagctgatgtgaatgtaaggaatttgctctcacgtcataaaaggaaaattaacccgaaattcggacaattaactaatagcaaccagcaactttttaaaatacagaatgaactaactcaattgataaatgatactaaaggcgactctctagcatatcattggattttaaactttattgccaaagccgtagtacatcaggcggaaacagaagtcagggtaaaaccagagtctgctctgcccctagggaaattgactttatatttgttagtccaattcccagagttacaggaattgtttatggcaagacttgtcaagaaatgcccctttgtgataggattcacgtgtgagattgacacagaaaaaggccgtcaaaacatgggatggaaaagaaacaacgagaataaatgggaagataacacatcctacgatgagagaatgggcgggatcttatcattatttgccataataacgagattacagttacctcaagaatttatcaccaccacgagtcatcctttccccatcgcattatcgtggcatattttggctagaatatgtaatacgccactaaatttaataacaaatacccattttgtcatactcggttcgtggtgggatgccgctgccgtacagtttcttcaggcgtatgggaaccaagcctctaaattgctaatcttgattggtgaggaattgacctccagaatggctgaaaagaaatatgtgggtgctgcgagattaagaattttattagaggcctggcaaaataataatatggagtcctttccggaaatgtctccttag

SEQ ID NO: 3780 - DNA, 1617 bp, Saccharomyces cerevisiae
atgagttctgtcgcagaaaatataatacaacatgccactcataattctacgctacaccaattggctaaagaccagccctctgtaggcgtcactactgccttcagtatcctggatacacttaagtctatgtcatatttgaaaatatttgctactttaatctgtattcttttggtttgggaccaagttgcatatcaaatcaagaaaggttccatcgcaggtccaaagtttaagttctggcccatcatcggtccatttttggaatccttagatccaaagtttgaagaatataaggctaagtgggcatccggtccactttcatgtgtttctattttccataaatttgttgttatcgcatctactagagacttggcaagaaagatcttgcaatcttccaaattcgtcaaaccttgcgttgtcgatgttgctgtgaagatcttaagaccttgcaattgggtttttttggacggtaaagctcatactgattacagaaaatcattaaacggtcttttcactaaacaagctttggctcaatacttaccttcattggaacaaatcatggataagtacatggataagtttgttcgtttatctaaggagaataactacgagccccaggtctttttccatgaaatgagagaaattctttgcgccttatcattgaactctttctgtggtaactatattaccgaagatcaagtcagaaagattgctgatgattactatttggttacagcagcattggaattagtcaacttcccaattattatcccttacactaaaacatggtatggtaagaaaactgcagacatggccatgaagattttcgaaaactgtgctcaaatggctaaggatcatattgctgcaggtggtaagccagtttgtgttatggatgcttggtgtaagttgatgcacgatgcaaagaatagtaacgatgatgattctagaatctaccacagagagtttactaacaaggaaatctccgaagctgttttcactttcttatttgcttctcaagatgcctcttcttctttagcttgttggttgttccaaattgttgctgaccgtccagatgtcttagctaagatcagagaagaacaattggctgttcgtaacaatgacatgtctaccgaattgaacttggatttgattgagaaaatgaagtacaccaatatggtcataaaagaaactttgcgttacagacctcctgtcttgatggttccatatgttgttaagaagaatttcccagtttcccctaactataccgcaccaaagggcgctatgttaattccaaccttatacccagctttacatgatcctgaagtttacgaaaatcctgatgagttcatccctgaaagatgggtagaaggctctaaggctagtgaagcaaagaagaattggttggtttttggttgtggtccacacgtttgcttaggtcaaacatatgtcatgattaccttcgccgctttgttgggtaaatttgcactatatactgatttccatcatacagtgactccattaagtgaaaaaatcaaggttttcgctacaattttcccaaaagatgatttgttactgactttcaaaaagagagacccaattactggagaagtcttcgaataa

SEQ ID NO: 3781 - DNA, 1617 bp, Saccharomyces cerevisiae
atggccaccaccacgcaaccacaaaatatactgatggatgaacctttaaatcttcctaataacagtgcccacaacaataactatggaaacataaatgcgaatataagaacttttgctggtatgagcatgcacatgcaccctgccaggctgaactctctggagtttttgcacaagcccaggagactatctaatgtaaaactgcacagattacctcaggacgagcttcaaagaaatacggacatgaataagggaatgtattttaatgggaaacaagttcatgcccatcacccgtttataaattctggagcgaactttaacgcacatcatcaagacgtcagtaaattaggcgaggaggaagacgaaatctctcctctatcacatgataatttccagtatgaatccgaggaaaatggtaatccttcacctcccatttacaagaaatctggagaactggttaagagttcattaaaaagaagatccaagtccctacccattactcccaaatctatattcaacaaaactggctctaagagtaaacatgtcaatttagatcatgtagatactaggctattgcaaagaagtaaaagtgtccatttcgatcgtgttttaccaataaagctgttcaatgaaaatgagaaacccatagatgttggcaaacaaatggttcaacaagatgttctgaatttcaagcataagcctttgacgagactaagtgcccttaatggcggtagtgatagcgtacctatagaagatttactatctgaaaacaaccaaaacgaatatggagatacatggctacaaaacccgaagggtgtattcctatttggtacaaattctaataatcgtagaaataaaaaaaagaagtttaaactaagtgacgatgacagtgatattgaaaatgacaatgatagtgacgacgctataaaccgtttagtaaggcaacaagacaaagaccaagctcatcttgcgcacgggttgaagaatttgttaataaacgatgacgacgattatttagaaacaagaacaaattctgctaaatcaggagccaacttgtttattggaaactctaaaagaattgttggtctttacaacaagaactttccaatattaagtgacaggaaccgtaagagtttaaaacttaacatatttctgaatctttcccgtggaaggcccgtttttttgcaagaaattacgctactaactggcttccacaacatggttataattggcaaagtctttgtgaaaaacatatactttgataagaagattatcgtaagatatacatgggatgcatggagaacttttcatgaatcagaatgcgtgtatttttctaatgccaatggcatcttaccaggaagcaatatggatatttttaagttctccattgatgatatacacaatccaaatgataaagatagcaatatatcacaattggagttttgtattcaatacttaacttggggcgttgatcgttctaggaaggaatattgggacaataatgattcggcaaactataaaattgacgtggtaacgaatgaaacgaggacagggcccacaacagacgtcaatgataactacgagatgaaacatagtcttttcagaaacccattccattaa

SEQ ID NO: 3782 - DNA, 1617 bp, Saccharomyces cerevisiae
atggtaaataaggtggttgatgaggttcagcggttggtgagcgcaataattctcacttcgtttatgacggggttattcattttgtcactatggaagaattacgtgacagttcatttccaacataaaaatgatccaagagatacaagaagttcgagaaccaagatccagccaaatgacaagaagaagaaacgaccagcacgtcactctagacctttgtcaatatcttccacaacgcccttagatttacagcgggatcaggaaaataatattgaatatgaccgtactgtgactagcaagctgtccatgactagtaatgcctctttatcagagaacggtgatggaaatgctaatattaaaatggaaacgaatgtgaaccaagccccatatgctgcagagaatcccttccaaaacattgcgcttgcggaggataccaagctggtacctgacttaaagtactattataaagagtatggtattgatattgaagaatttgaggtggagacagacgacggttttatcattgatttgtggcacttcaagtccaggttaaacgatggcgtagaggaagtgaaacgtgaacccattttgctattacacggtcttttgcaaagttgcggggccttcgcatcttcaggtagaaaatctctggcatacttcctttatgaatctggatttgatgtttggttggggaataacagatgtggcttaaatgccaagtggaacatgaaaaaattaggtaatgatcattccaaaaaatgggattgggatatgcaccagatggttcaatacgatttaaaagcacttataaattatgtacttgatagtaccggatatgctaaactatcgctcgtggcgcattcacaaggtacaacacaagggtttatggggcttgtcaacggtgagaaactatacgcaagtgattttaaattagtcgataagctggaaaactttgttgctttggcacctgcagtgtaccctggacctttattggatgaaaaagcatttgtgaggctaatggcaaaaggtattgattctccgtggtactttggtagaagatcgtttatacctcttatgatgacaatgagaaaactaatggttgggaccaagattttttcgttcctctcatacatcatgtttaactacctatttgattggaacgatgtcttatgggatagagttttaagggaccgaaatttcttattttcaccagtccatatttccgtcaaactaatgcaatggtggttgtcacctcttcctaataagctaagttttaagaagggtgcagagaaaatttttccagataaaaagacatggtttcctattgccaagaatgatgatgacagtggcaataatttggataacaacaaactacacttaaatccgaaaagacaaaatagtgaagaatttccacacattataatgtttattccaaagcaagatagattagtagatggtgaacgattaattaatcacttcattaatcatgaagcaaatgcagtgtacaaaatctggtatattgatgagtattcccatctggacgttttatgggcgcatgatgttatagatagaattggtaagccaatgatagaaaatttgaggtttcctaatgcaaggtga

SEQ ID NO: 3783 - DNA, 1617 bp, Saccharomyces cerevisiae
atgtccatgcccatagcaagtaccactctagcagttaacaacctcaccaatataaacggaaacgcaaattttaacgtacaagcaaacaaacaactccaccaccaggctgtcgactcgcccgcaagatcttcgatgaccgccacgaccgccgccaactccaacagcaactcttccagagatgactctactattgtcggcctacattacaagatcggcaaaaaaataggggaaggttcctttggtgtgctatttgaaggtactaatatgatcaatggcgtacccgtcgcgatcaaattcgagcccagaaaaacggaggcccctcaattaagagatgaatataaaacatataaaattctgaatggcactcccaatatcccctacgcgtactacttcggccaagaaggtttgcacaatatcttggtcattgatcttttgggtccctctttggaagatttatttgattggtgtggaagaaaattttctgtcaaaacggttgtgcaagttgctgtccaaatgattactttgattgaagacttgcacgcacatgacttgatataccgtgatatcaaaccagacaatttcttgattggaaggcccggccaacctgacgcaaacaacatccatttgatcgacttcggtatggccaaacagtatcgtgatccgaaaactaaacagcacatcccatatagagagaaaaaatcactcagcggcactgccagatatatgtccattaatactcaccttggaagagagcagtccagaagagatgatatggaggccttgggtcacgttttcttttatttcttgagaggccacttaccctggcagggtttaaaagctccaaacaataagcaaaaatacgaaaagattggtgaaaagaaaagatctactaacgtttacgatctagctcaaggcttacctgtgcaatttggcaggtatctagaaatcgtcagaagtctttcctttgaagagtgtcccgattatgaaggctatagaaaactattactatctgtactggatgatttaggtgaaaccgcggacggccaatatgattggatgaaactgaacgatggccgtggttgggatcttaacataaacaagaagccaaatctccacggatacggccatccaaatccaccaaacgaaaaatcgagaaaacatagaaacaaacagctccaaatgcaacagctccaaatgcaacagctccaacaacagcaacagcaacagcaatatgctcaaaaaactgaggcagatatgcgcaattctcaatataaaccaaagttagaccctacttcttatgaagcttaccagcatcaaacccagcagaaatacctgcaagaacaacaaaagagacagcagcaacaaaaacttcaggagcaacaacttcaagagcaacaattgcaacagcagcaacagcaacagcaacagctacgtgcaacaggccaacctccatctcagcctcaagcgcaaactcaatctcagcagtttggcgctcgttatcaaccacaacaacaaccttctgctgctttaagaactcctgaacagcacccaaatgacgataattcaagtctagctgcttctcataagggctttttccaaaaattaggttgttgctaa

SEQ ID NO: 3784 - DNA, 1617 bp, Saccharomyces cerevisiae
atgtcctctccagtgattggtatcacctttggtaacacctcttcttctattgcctacatcaacccaaagaacgatgttgatgtcattgccaacccagatggtgagcgtgccattccatccgctttatcctatgtcggtgaagatgaataccacggtggtcaagctttgcaacaattaatcagaaatcctaagaatactatcattaacttccgtgacttcattggtttgccatttgacaagtgtgatgtcagcaagtgcgctaacggtgccccagctgtcgaagttgatggcaaagttggatttgttatttcaagaggcgaaggtaaggaagaaaaacttactgtagatgaagtggtctccagacatttaaacagattaaagttagccgcggaagattacatcggttctgccgtaaaggaagctgtattgacagttccaacaaacttcagtgaagaacaaaagactgcactaaaggcttctgccgccaaaattggtctgcaaattgttcaattcatcaatgaaccttctgctgctttattagcccacgctgaacaattcccatttgaaaaagatgttaacgttgttgttgctgacttcggtggtattagatctgacgctgctgtcattgccgttcgtaacggtattttcactattttggccactgctcatgacctcagcttaggtggtgacaatttggatactgaattagtcgaatattttgctagtgagttccaaaagaagtatcaagccaatccaagaaagaacgctagatccttggccaagttaaaggctaactcttcaattaccaagaagactttgtccaacgcaacttctgccactatttccatcgattccttagctgatggtttcgactatcacgcttctatcaacagaatgaggtacgaattggtagctaacaaggtcttcgcccaattttcctctttcgttgattctgtcattgccaaggctgaattagacccattggacatcgatgctgttcttttgactggtggtgtatcatttactccaaaattaaccactaacttggaatacactttaccagaatcagtcgaaattcttggtccacagaacaagaacgcttctaacaatccaaacgaattagctgcatccggtgccgcattacaagcaagattgattagcgattacgatgctgacgaattggctgaagctttacaaccagttatcgtcaatactccacatttaaagaagcctattggtttgattggtgctaagggcgaattccacccagtattgttggctgaaacttcgttccctgtacaaaagaaattgactttgaaacaagccaagggtgatttcttgattggtgtttacgaaggtgaccatcacatcgaggaaaagactttggagccaattccaaaagaagaaaatgctgaagaggacgatgaaagtgaatggtccgacgatgaacctgaagtcgtcagagaaaaactatacactttgggtaccaagttgatggaattgggaattaaaaacgctaacggtgttgaaattatctttaacattaacaaagacggtgctttaagagtcaccgctagagatttgaaaactggtaatgctgtaaagggtgaattatag

SEQ ID NO: 3785 - DNA, 1620 bp, Saccharomyces cerevisiae
atgagtaccaataagttcgttgtacgaataacgaatgcgctcttcaagtcatcactggctagcaacagtccacctgtttaccctaagaggattaggcatttcgagattttacccaacgaaaaatgggttatatggggacctggaaagggcaagttcttggatgtactgaataacaagtatatttgtgagcccccattatctttgaggtttggatttttgaaggaaagttcgaacatcctgccgaggatagagcaagtggccttcaaaggggttatgccaacggctcatttaagtgctagatatgaatacttcaaagatgactacgatcaaacctgcaaacagtttatatttgataaggcaagcggatcaaatgctgtttcatataaagttgagacgaacaatcggcaaataaacatggagctgtacaatgcattagttgaaaatttaaacctctccagtttacaggataggtgggtaatgggattgagtaatggacaaatgaggagagcaaggttagctcgtagtatactcaaggaaccggatctactacttattgacgacccatttttagggttggatccagccgcaatagcaaccatttcacaatttttagccaaatatgatagtatagaagtcagtggcggatgtccaatcgtcattggtttgaggtatcaagataccattccagcatggtgtactcatatatgttgcgttgatgagaaaaacggtatattgtttgaaggcccaatcgaaaaacttcaaagtaaaatggatgaaaccagatcaagggcactaaaagaactagagcagctcaaaaaagcgtctaattccaaagaggacatttccattaacgatttgatttgtatacatcctatgtatggcaagaaagagcacgaaattatcaaaatgcctcatcttatagaattagacgggttgagcgtttcatacaaaggcgaagctgttttggaaaatctgcactggaaagttcagccgggttcgaaatggcatataagaggtgacaatgggtcaggtaagtcgaccttattatctttgcttacggcggaacatccccaatcgtggaattcgagggtgatagataatggcgtcccacgaagaacaggtaaaacaaactactttgacctaaacagcaaaataggtatgtcatcacccgaattacacgcaatttttttgaagaatgctggaggaaggctaaacattcgggaaagtgttgcaactggctatcatgaggcgtcctccaacaattacctacccatatggaagcgcttggacaaaaatagccaagaaatagtgaatatgtatctgaaatattttggcctggacaaagacgccgatagtgttttatttgaacagttgtccgtaagtgaccagaaactagtcctttttgtcaggtctttaattaagatgccgcaaatattgattctcgatgaggcattttctggaatggaggtagaacctatgatgcgttgtcatgaatttttagaggagtggcctggaacagtccttgtagtggcacacgttgccgaagagacaccaaaatgtgcccattacttaaggctcatatctcctggagagtatgaaataggcgatatggaaaattaa

SEQ ID NO: 3786 - DNA, 1620 bp, Saccharomyces cerevisiae
atgcaattcaagaacgctttgactgctactgctattctaagtgcctccgctctagctggtatgtacacattctccttttttttcatctttttttctttatttgcctctttcctcacaaatctcgagtagattcgtggtcctcttcattcttttcttttttctttgtcgattactgggctttttttcataggtctcgattgacgcggacggacaatgcgaaaaaaaaaaatttccaaaagaggaaacgggtttcgagatctcgtgaggatggttttggaatattcttcaatatttctgcctgtcataggattagggcgagtaatgaaacagaataatacatgtataaatcgatcgggaatactaacactacttttctttatctaagcagctaactcaactacttctattccatcttcatgtagtattggtacttctgccactgctactgctcaagctgatttggacaaaatctccggttgtagtaccattgttggtaacttgaccatcaccggtgacttgggttccgctgctttggctagtatccaagagattgatggttccttgactatcttcaactccagttctttatcttctttctccgctgactctatcaagaaaatcaccggtgatttgaacatgcaagaattgatcattttgaccagtgcttctttcggttctttgcaagaagtagactccattaacatggtgactttgcctgccatttctaccttctccaccgatttacaaaatgctaacaacattattgtttctgacaccactttggaaagtgtcgaaggtttctccactttgaagaaggttaatgtttttaacatcaacaacaacagatatctaaactctttccaatcttccttggaaagtgtctctgactctttacaattctcttccaacggtgacaacactactttggccttcgacaatttggtctgggctaacaacatcactttgagagatgttaactctatttctttcggtagtttgcaaactgttaacgcttccttaggtttcattaacaacactttgccaagtttgaacttgacccaattgagcaaggttggtcaatctttgtctatcgtctccaacgatgaattatccaaggccgctttcagtaacttgactactgttggtggtggtttcatcattgctaacaacacacaattgaaggtcattgacggttttaacaaggttcaaactgttggtggtgccattgaagttactggtaacttctcaaccttggacttatcttctttgaagtctgttagaggtggtgctaacttcgactcttcttccagtaacttctcctgtaacgctttgaagaagttgcaaagtaacggtgctattcaaggtgactcttttgtttgcaagaacggtgccacatctacctccgttaagctatcctctacttctactgaatcatccaagagctctgctacatcttccgcttcttctagtggtgatgcctccaatgctcaagctaacgtttcagcttccgctagctcttcttcctcttcttctaagaagtctaagggtgctgctccagaacttgttccagccacttcattcatgggtgtcgttgctgctgttggcgttgccttactataa

SEQ ID NO: 3787 - DNA, 1620 bp, Saccharomyces cerevisiae
atgcatcgtaaatcattgaggagggctagcgctactgtgccttccgctccctatcgaaagcagattattagcaatgcacacaataaaccaagccttttctctaaaattaaaactttctttacccaaaaagattcagccagagtgagtccaaggaataatgttgctaataaacaaccacgcaatgagtcttttaacagaagaatctcaagtatgcctggaggttatttccattctgagatatccccagattctactgtaaaccgttccgtagttgtttctgcagtgggtgaagccagaaacgacattgagaataaagaagaggagtatgatgaaacacatgaaactaacatctccaatgcaaagcttgcaaacttttttagtaaaaaaggtaatgagcctttatcagaaattgaaatagagggtgtgatgtcattgttacaaaaatcaagcaaatccatgataacttcggaaggagaacaaaaatcagccgaaggtaataatatcgaccagtcgcttatcttgaaggagtcaggaagtacaccaatcagcatatctaatgcgccgaccttcaacccaaaatatgatacttcaaatgcgtcaatgaatacgactttgggaagcattggttcaagaaaatacagtttcaattattctagcctgccctcaccatacaaaacaaccgtttatagatatagtgcagcgaaaaagatccccgatacatacacagccaacacatctgctcaaagtatagcatctgctaaatcggtaagaagtggtgtttcaaagtcagctcctagtaagaaaataagtaatacagctgcggcattggtctcactattagatgaaaatgacagtaagaagaataatgcagcttcagaacttgctaatccatactcctcatatgtaagccaaatacgcaaacataagagagtttctccaaatgctgcaccaaggcaagagatcagtgaagaagaaactactgttaagccattatttcaaaacgttcctgaacaaggcgaagaaccaatgaaacaactgaacgccaccaaaatttcaccatctgcgccaagcaaagattcttttactaaatacaaacctgcaaggtcctcatccttacgctcaaatgtcgtcgtagctgaaacctcacctgaaaagaaggatggtggagataaacctccatcctctgcttttaacttctcgtttaatacttcaagaaacgttgaacctactgagaatgcttataagagcgagaacgcaccatctgcatcatcaaaggaattcaattttaccaacctacaggcgaagccgttagttggaaagccaaaaaccgaacttacaaagggcgattctactcccgtccaaccagatctttcggttactcctcaaaaaagttcatcgaaaggctttgtttttaatagtgttcaaaagaaatcacggtccaatctttcacaagaaaacgataatgaaggtaaacatatcagcgcctcaattgataacgacttttcagaggaaaaggcggaagagtttgatttcaatgttcccgtggtgtctaagcagctaggaaatggcttggttgatgaaaataaagttgaggctttcaagtccctatataccttttga

SEQ ID NO: 3788 - DNA, 1620 bp, Saccharomyces cerevisiae
atgccattgaatgaaaaatacgagaggcctccgcaacctcctccagcatatgatcccaaccataggccgcccagttcttccgagaactctgccgcggcgaatgtcaacgatggccagacgccgtaccattttagacaggatcaatattacaatctaaattccaaaacgagtggggctcctatagggagcttcgacgaggcctttcctactgaaaatgacaacaagcccaggtggaacgattggccatttaccatttttttcctatgcacggtaggcggattcatcgccattgctgccataaccttaagagcgtggtcccaaacctatagcagtacgggttccggaatatacgatggtgtgaatactggtacgctgaacaccaatgctgccatcctgctagttttcgtgtgcattattgccctagtattctccgttttgggcctcacactttgtcgaatttttccgaagcagtttatatattgcggtatggtcatcaacctagtggcttctcttgggactgccatcatgtacatgtctttgaggtactggtctgcaggtattgtgtttttagtcttcacgttcatgaccgcgtggtgctactggggtatgaggtctagaattcccctttctgtggcggtattgaaagtcgtcgtcgatgccatgaagaaatgcccacagatcttctttgtttcatttgttggagcgctagttgctagtgcgtttgggtttctcttctcagcagtcattgtggctacgtacataaagtacgatcctaatagctcgaatggcggctgtgacgtttctggtggcagctgttcgcattccaaattgattggtgttttggttgtggtttttttctgcggctattatatctctgaagtaataagaaacgtcatacattgtgttatttctggcgtctttggcagctggtattatatgtcaaagtctgaccaaggaatgccaaggtggcccgcatttggagcattgaagagagccatgacttactcgttcggttccatttgctttgggtccttgctagtcgctttgatcgacctgttgagacaaatattgcaaatgatcagacacgatgttacctccagcggtggcggtcaaattgccatccagattttgtttatggtgtttgactggattatcggctttctgaagtggctcgccgagtatttcaatcattatgcatactcgttcatcgctctttatggtaaaccgtatttaagagcggccaaagaaacctggtatatgttaagagaaaagggaatggacgccctaatcaatgataatttaattaacattgcactgggtctattttcaatgtttgctagttatatgaccgctttgttcacgttcttgtatctaaggtttacctcgcctcaatacaattcgaacggcgcttacaacggcgccctaatggcattctcatttgttattgctttacagatttgcaacattgcaacagaagccattagatccggtactgcaactttctttgttgctcttggtaatgacccggaggtcttccatcattcttaccctcataggtttgatgagatttttagggcatatcctgatgtactcagaaaattgagtcaccagaatgtgtga

SEQ ID NO: 3789 - DNA, 1620 bp, Saccharomyces cerevisiae
atgtcttccaatccagaaaattctggtgttaatgcgaataataatacgggcactggtaacgctgatgcgatcacaggagctcagcaaaatatggtactgcaaccgagacagttgcaagaaatggccgctaagttcaggacattactgactgaagcaagaaatgtaggtgaaactactcctaggggcaaggaattgatgttccaagccgcaaagatcaaacaggtatatgatgcccttacactgaataggagaagacaacaggctgcgcaagcctacaataatacttcaaattcaaattcaagcaatccagcttctattcctactgaaaatgtccctaattcatcacagcaacaacaacaacaacaacaacagacaagaaacaacagtaacaaatttagcaatatgataaaacaggttctcaccccggaagagaaccaagaatatgaaaagctatggcagaatttccaagtccgtcatacgagtataaaggagaaagagacctacttgaaacaaaatattgataggttagaacaagaaataaataaacagacggacgaagggcccaagcagcagctacaagaaaagaaaattgaactgcttaacgattggaaggtgctaaaaattgagtataccaagctgttcaataattatcaaaacagtaaaaaaacattctatgtagagtgtgcaagacacaatccggctttacataaattcttgcaagaaagcactcaacagcaacgagtgcagcaacaaagggtacaacaacaacaacaacaacagcagcagcagcagcaacagcagcaacagcaacagcaacagcaacagcaacgccagggtcaaaaccaaagaaagatttctagttctaattctactgaaataccctctgtaaccggccctgatgcactgaaatcgcagcagcagcagcagaatacaataactgccaccaataatcccaggggcaatgttaacacttcacagactgaacaatcgaaagctaaggtaaccaatgtaaatgcaacggcatctatgttgaataatataagttcgagcaaatcggcaatattcaaacaaacagagcctgccatacccatatcggaaaatatatctaccaaaacaccagcaccggtagcttatagatccaacagacctacaataactggaggttctgctatgaatgccagtgctttgaatacaccagcaacaactaaattaccaccctatgaaatggatactcagagagttatgtcaaagcgtaaattaagagagttagtgaagactgtcggaattgatgagggtgacggtgaaactgtcattgacggtgatgttgaggaattactattggatcttgccgacgattttgttactaatgttacagctttttcttgtagattggcaaaacacagaaaatcggacaatttggaggcaagagacattcagttacatttggagagaaattggaatattaggattcctggttattccgcagacgaaataagaagtacaagaaaatggaatccctctcaaaattataaccagaaattgcagagtatcacatcagataaggtagcagctgcaaaaaacaatggaaacaatgttgcaagcttgaatacaaaaaaataa

SEQ ID NO: 3790 - DNA, 1620 bp, Saccharomyces cerevisiae
atgttattaccattaacaaagctaaaaccgagagcaaaagttgctgttgtagggggtggcgtttctggactatgttttacttattttttaagcaagttgagaccggatgttgaaatcacactgttcgaatcgcagaacagaactgggggttggatatattcttgtaacacaagagatatgagtgggaacccaattatgttggagaagggacccagaacattgaggggcgtatcagacgggaccgttctgattatggatacccttaaagacttgggcaaggaagcagttattcaaagcattgataaaggttgcattgcagacaaaaagtttctactagaccccagtgataaactcgtgcaggttcctaattcgatatctacaacagtaaaatttctgctgaatccgttgggaaaaggactcatcacgggtatgatgggagaatggttcagaaaaaaatctccacatcctggccaagacgaaagtgtcgaatccatttgtgacagaaggtttgggaataactacatatcaaacaatatgatcagtgccttactaagaggtatctatggggatgacgtttccctattaagtgccaagagaacgtttaagaaaatatactacaatgaactaaagcacggatctaacacacaagctatgattgataatatgcgcggaaagtcaagaagtaaaaaaactgagaacctgcaccaatctttaactggctgccttaacgactactcaaatgcgtttggaaaagacaggtcaaagttattagacttatccaacacgctaaagaaatatcccatgttgggtcttgctgggggactagaaacgtttcccaagatagtcagaaatgctttgaacgaatttaaaaacgtcaaaatagttactgggaacccggttacgcaaataatgaaacgccctgctaacgaaacgacaatcggattgaaagcgaaatctggcgaccaatacgaaacatttgaccatttaagacttacgataacacctcccaaaatcgctaaattgctaccgaaggatcaaaattcattatccaagttattagatgagatacaatcaaacacaataattttagttaattattatttgccaaacaaagatgtaatagatgccgatctacaaggctttggatacttggttcccaaatccaataagaatccagggaaattgcttggtgtaattttcgattctgttatcgaaaggaatttcaaaccactttttgacaaactctccacaaacccaaacgccctcaacaaatatacaaaagtgactgcgatgataggaggttgtatgctcaatgaacacggtgttcctgtagtgccatccagggaggtaaccattaatgcagtcaaagatgcgctgaacaaccacctcggcatcagtaacaaggatctggaagctggtcagtgggaattcactatcgccgatagatgtctgccaagatttcatgtaggttatgacgcatggcaagaaagagctgaaaggaagttgcaagaatcttacggccaaacagtttctgtggggggaatgggattttctagaagtcccggtgtccctgacgttattgtagacggctttaacgacgccttacagctaagcaaataa

SEQ ID NO: 3791 - DNA, 1623 bp, Saccharomyces cerevisiae
atgacagcaatgaaagctattgtctggagacttcccaagatgccgaaaatcaaaattacaaaaacttatgaagttacgaaaattacggcgatattgacactagtaggatttataatgggccttgaggtgccgtcattggcaacttttctcacaaacaaaacgtttaatgagtacttcaagtatccaactcctttacaacaaggtttactcatggggtccacccccctgggtggtatcatgggatgttttatttgctgcataatgaatgatagattcagtagaatatatcaatttcaatcgggaataataatatggaatattgttacgttattgaacttttgtatttgggatatattaggtttactaatttgccggatgatcaagggtatgatccttgggaacttttcaattttagtagcatcctacgcaaatgaagttatcccccgcggcaagcgtggaagtacgatgagctatattcaattgtgtttaaccattggaattcttgttatgcattatttgtgcattgcattaagtctatgggattctcattttgcgttccgtatagcgtggtgcataggaatcattcctggattactgttctggatggctagctacgctctacctgaatcttatcactggctagtactacatgggaagatgagtgaagctcaggaaattcagcacaatttagccaaaaagtttaatgaaagccagccaagggatgcagtccctgagatgagtaagatcgaattagcaggagatttttggattggagttaatgatttggacttctccaaaaaattacctcggggttcgtttaagcctttgattcttggaatgactttacagttattggttcaatttagcggtataaacattatccttggttatattacatacatttgcgagattgtagggcttgaaggcaatgtaaaactattcaccagttccattccatatttcatcaacatggttttgagcttgttaccgattacattcattgattacactagcagaaagctaattaccttgttgggtggctttcccattagtgggttgctcattacaatcggcgcattatttgtgaagtatggtcaagacaccaagcccatcgacggcaataggagtttagtttggtcaattggagaaaacccgtttgtgggaggatggattctaactttatgctttctaattgttggaatatttgccatgagcctttccagtataccttgggtttacacgaatgaaatgttgccctcacgagtgaaagttaagggatttgccatttgcgtaacgtttggatggttgggcaattttattttaacgtttctatgccctgtgatgattgaaagattaaaaggcacaacatttataatatttggatctttgacattcttgatatcactttcagttttgatttggttcccagaaacaaagggtatgagcatagaagatattgataaattcttcgaatttgagagtaaagagggcaccaatttacatggggaaaagggtatcaaaacgccggactcaaattctaatggcggttctacaagatcctcccaagaagggcaattgcataaacctataaaactgaaaagcgatgaagagatgatcatatga

SEQ ID NO: 3792 - DNA, 1623 bp, Saccharomyces cerevisiae
atgactgctcagattccgtatcaacatagctcgggatacatctctcattttcacaataatgagcttgatgcaggcaggggaagggattataatgtaaccattaagtatctagatgataaagaagaaaatatagaaggccaagcagcaaagattagtcacaatgcgagtctgcatattcccgttttattgtgcttggtaatctcgcttggtggctttatttttggatgggacattggaaccatcggtggaatgacaaatatggttagctttcaagaaaaatttggcacaactaatattatccatgacgatgaaacaatttttgtatctactaagaaacttactgatctgcaaataggcctaattatcagtatttttaacatcagttgtggcgtaggggctttaactctgtcaaaaatcggtgattggattggtaggaaaggtggtatatggtttgccttagtagtgtactgcatcggtataaccattcaaattctctcctatggaaggtggtattttttgacattgggaagagccgtaacgggaatcggtgtgggagtaaccactgtcttggtgccaatgtttctctccgagaattctccactaaaaatcagaggctccatggtatctacgtatcaattgattgtaacatttggcatactaatgggaaacattttaaatttcatatgcgaaagatgttataaagatcctacacaaaatatagcctggcaattgccattgttcttgggatacatttgggcaattataattggaatgtcacttgtttacgttcctgaatctccacagtacttggcaaaaatcaaaaatgatgtgccctctgctaaatactcttttgcgaggatgaatggcatccctgcgacggatagcatggtaattgaattcatcgatgatttgctggaaaataactataataatgaggaaactaacaacgaatcaaaaaagcaaagcttagttaaaagaaacacatttgaatttattatgggaaagccaaagttatggttgagactgattattggtatgatgataatggcatttcaacagctgtccggaataaattatttcttttattacggaacgtctgttttcaaaggtgtcgggattaaggatccttatattacttcaatcatactgtcaagtgttaacttcctttctacgatattaggcatatattacgtggagaaatggggccacaagacatgtttattatatggttcaacaaatttattattttatatgatgacatatgctactgtggggacatttggaagagaaacggacttctcaaatattgttttaattatcgtgacttgttgttttattttttggtttgcaataacattgggcccagttacatttgtactagtgtccgaattgttccctctaagaacgagggccatatcaatggctatttgcacatttatcaattggatgttcaatttcttaatatcacttttaacaccaatgattgtatccaaaattgatttcaaactaggatacatatttgctgcttgcctattagcgttgataatattcagttggatactagttcctgaaacgaggaaaaagaatgagcaagagatcaataaaatatttgaaccggagtag

SEQ ID NO: 3793 - DNA, 1623 bp, Saccharomyces cerevisiae
atgatgctaagaactactgcctcacgaaaaattgtgctaaggaggggtctagccagcataaacacagggactaccgttgcatcaaaaaaggcttcgcacaaatttcgcaataccctttggactattgctttgtcagcgacagctttctacgctggaggtatcatatattcgcaaaaaaatgacaaatttggtgactttttctctaataacgttccttttgccgaggatttactagaaacatatgaacactatcacgataggccaacattgtttttagaagattcttgggacggcttgaaggcaaagagcaatgatttattatctggattaactggtagttcacaaacgcgcagatctaatagggaaaatattgaagtaaaaaaaatcttatcattagaaccactaaatattgaaacagaaaattctgatccgcaactgaaagaaatcattggctctttgaatgatctcatcaacagtctaaatgactcaaacctctccatccccgaatcagaattcaattcaatcaaaaaatctaaccagaatatgcttacgaatctatcccaattaaatgaaacgttaaaagaggctttatccaattacatgatacaaagaacatcagaagtaatcacggaattgaacacacaatatgaaaactcgaaaagggagtttgaaaagaatcttcaaaaaaacctattacaagaagtagacgaattcaaagaaaacttgaccaagcaaaaggacaaagaactagaagaaaaattaaaggcgaacgaagaattgttacaagccaaacatgcaaatgaagtgggcttactatccatcactcaagtcaaagaatttaataaaattatcaaagacaaaattgagaaggaaagaaatggcagattagcccatttagaggaaataaattctgaagttaacgacctcagcaaatccatcgacagatcgagcaaaatcttaagtaaaaacgaggctctagtgcaattaactttccaagtagatgagatcaaatctaggattaacaacaataacttacccgatgtgaatatcgacaaggaactatccagattgaaacttctttccaatcttctctctaccttcaacaaaaaatcttgttgcgacgatggcgactgctgctcctgcaaaaagggtaataagaatgaaggcaaggaagggaagatatcatgcaaatgcaaaccaaagacaaaccctccatcgctattaagcgtagctttagatgaattagaatccacatgtagcggtaaaaaaatcttatcgaatgagcagatctataacaggtggaacttactggcagatgactttaagacagcctctttattgccaccaaattccggtattttggggcaattaaccgccaaagttttttcccttttcttattcacaaagacaggtaatccttcaaatgccacggatttcgattctgtttatgcaagagtcggcgataacttgagggtatccaacctcaacgatgctgtagaagaggttgtctccctaaagggttggcctcataaagtttgcgaaagctggatcgaagatgctagaagaaaattagaagtccagcgcctggtagagattcttgactgtgaaataaggacgttgtga

SEQ ID NO: 3794 - DNA, 1623 bp, Saccharomyces cerevisiae
atggtatttactaaggaagaagttgattactcattatatctggttacagattctaccatgcttccaccgggaactactttatgttctcaggttgaagctgggttgaaaaatggtgtaacgctagttcaaatccgtgaaaaggatattgaaacaaaaaatttcgttgcagaggctttagaagttcaaaaaatatgtaagaagtacaatgttccacttattatcaatgaccgtatagacgtcgctatggcaattgacgccgatggggttcatgtgggccaggacgatatgccaatcccaatggtaagaaaacttttgggcccttctaaaattcttggatggagtgttggtaaaccttcggaggtagagacattggctaaatgggggccagatatggtagattatattggtgttggtactcttttccctacatcaacaaagaaaaatcctaagaaatcacccatgggtcctcaaggcgccattgccattttggatgctttggaggaatttaaagctacatggtgtagaaccgttggtattggtggtcttcatcctgacaatattcaacgtgtgctttgtcaatgtgttgcttcaaatggaaagagatcgttggatggtatctctctagtcagcgatattatggccgctccagatgcatgtgcagcaaccaagaggttgagaggcttgttagatgctaccagataccaatttgttgagtgcgagttaaataatacatttccgaccacaacttcaattcaaaacgttatatctcaagtatcaaacaatcgtccattagtgcaacatatcaccaataaggttcatcaaaattttggtgccaatgtcactctagctttaggctcatctcctatcatgtctgaaattgaaagtgaagtatctgaactagcaagaatcccaaatgcttctttactgttaaataccggatcagtggcacctattgaaatgctaaaagccgcaattaatgcttataatgaagtaaatagacccatcacctttgacccggtcgggtacagcgccactgaaacaaggctctgtctaaacaacactttgctcacttacggccaatttgcttgtataaagggcaattgcagtgaaatactgtctctagccaagttaaataaccataaaatgaagggcgtcgactctagcagcggcaaaacgaacatcgacacacttgtgcgcgctacacaaattgtggcattccaatacaggactgttgctgtttgcacgggtgagtttgattgcgttgctgatggtacttttggaggcgaatacaaactttcatcaggaacagaaggaataaccgctgaagatcttccatgtgtaataattgaagatggcccaattcctatcatgggtgacatcactgcaagtggatgttcacttggttctacaattgcttcctttatcggtgggttagattccactggaaaactgtttgatgctgtggttggtgctgtcctattatacaaatcagctggtaagttggcttccacccgttgtcaaggaagtggttcattccatgtcgaattgattgacgcattatatcaattattccatgaaaataaaccagaaaagtggtccgcttctttgaagaaattcaaataa

SEQ ID NO: 3795 - DNA, 1623 bp, Saccharomyces cerevisiae
atgttttcaatcttcaaaaagaaaacgagcgtgcagggcacggactctgagatagatgagaaaattacagtgaaagcaaaagataaagtagtggtttccacagaagatgaagaggtgacaacaattgtttcttcaaccaaatcaactcaagtgaccaatgactcaccatggcaggaccccacttacttcagttcctttgggaaagaattaatgttcatagcgacatgcatgttggcacagttattgaatcaagcgggccaaacacacgctctctgtataatgaacgttctttcgaaatcctttaattcagaagcaaacaatcaggcatggttgatggcatcttttcccttggctgctgggtcgttcatccttattagtgggaggttaggagatatttatggattgaagaaaatgttgatcgttggttatgtcatcgtaatcgtttggtctataatttctggtctctccaaatactctaatagcgacgcgtttttcattacgagccgtgcgttccaaggagttggaattgcgtttattttaccaaatattatggggcttgttggtcatgtttataaggtcggttcattcaggaagaacattgttattagtttcatcggcgcatgtgctccaacaggcggcatgtttggtggattattcggggggttaattgtcactgaagaccccaatcagtggccttgggtattttatgcctttggtattgcaacgtttctaagtttattaatggcatggtactccatcccaaacaacgttcccacaaatattcatgggctttcgatggattggactgggtccgcgcttgccattatcgggctgattcttttcaactttgtctggaatcaagcaccaatagttggctgggacaaaccttatatcattgttcttttgataatatctgtgatattcttggttgctttttttgtttacgaaagtaaatacgcagaggttcctcttctaccacgtgcaatgacgaagaaccgtcatatgattatgatattattggcggtattcctgggatgggggtcgtttggtatttggacattctattatgtttccttccaactaaatttgaggcattacagtcctgtttggaccggaggtacgtatttcgttttcgtaattttcggatccatggctgcattcttcgttgccttttctatcaagagattaggaccagctctactactatgtttttcactaatggcatttgacgctggttccataatgtttagtgtattgccagtggaacaaagctattggaagttgaactttgcgatgcaggctatcttatgttttggtatggacctgtccttcccggcatcatccattatattgagtgacgggcttccaatgcagtatcaaggtatggctggatcattagtaaacaccgttattaattattcagcgtctctatgtttaggtatgggaggcactgttgaacaccaaattaataaaagcggcaatgatttgttgaaaggttaccgagcagctgtatatctgggagttgggctcgcttctcttggtgttgtgattagtgtgacttacatgcttgaaaacctttggaatcgacacagaaaatctgaagatagaagtttggaggcataa

SEQ ID NO: 3796 - DNA, 1626 bp, Saccharomyces cerevisiae
atgcctatcttatcactatcttcaacacggaacagcgtgttaacaaggatatatgactaccttaaagcattagtgcagcaagtgattgtgcccaatgtggaagacgacaaatcttcgaaaagtactcctttcgaaaagttagaacctgcgaaacagaaccatccacagaaagactgctgtgctaccgaaaaggacgatctggttgacgtgagcgaattatttcccaaacagaacaacaaacaattgagtctaacatcaaaatcttcagttgtaccctgtgctttaaatttggataacctagaaacacctttctcaattaaaattgataataatggtgcagtcactacacagttgaacttggacgaaccgattttacggggccctagccgcggcgagccagcaaagttacagaatgacttgataagttctcccccgctagaggaatcctatatcaataatgaccagtacaaagctcttttcccctctaatttccttccaatcacgcccgtaagtagcgtaatcactcctgcatcgaagaaaagtattgatgaatctcccctatccgatgaggttcaaggaattgctgatgagtcatccgaaactttaccatatatatgtcactattgcgatgctaggttccgaatcagaggttacttaacacgacacataaaaaagcatgcgaaaaggaaggcctatcactgtccattttttgataatagcatttcgcaagaattgcgatgccatacttctggggggtttagcagaagagatacctacaaaacacatttgaaatctagacatttcacttacccagaaggtgttaagcctcaggaccgtaataaatcacctggagtgtgcactcaatgtggggaacactttagcactagtgagagctgggtggaaaaccacattgaggctgggagttgcaaaggtttaccagaaggctattcagagggaatacgagagaagaaaaagacgtctaaaatgaaaatgataaagacttcggatggccaaacaaggttcatctcatccgacgaaagtgtttccgaaccagctttacaaaataagaattgtatagaagcgacagtaatgcagtccaaggaacgccctaatgacaagatcataccaaccaaaaccgaaaaaaacgattttggaataggcactcaatggtttgaacgcaaacaaatatcaagacctacacaaactacacaatcaagaggacctacagaagtccaaaatctcaaagagtggtcaataatatctcccccaattttgtcaccccaaaatgcatcttctgtaccacaagagtatcaatcatcaagatacacattgcatatggattctccagcattatcctctgcctcctcagcgctatctccactttcaggcgatccaataacaactacagaaacaaataagtcatacccattggattcagagcaatcgttgttggagccagacaaaaccgaggaggacgcaatcaatcagtcaaaggaaagcaatatgatttccattaatgagatgttacagaagcaaatggactttgaacttctgggtgagaatcatttgaaggagactcaagattatctggccctttacaaaaaagcttatgggatagaattttaa

SEQ ID NO: 3797 - DNA, 1626 bp, Saccharomyces cerevisiae
atggttttggctgatttggggaagcggattaattctgctgtgaataacgcgatttccaatacacaggatgactttactacatccgtagatgtaatgttaaagggcatcgtgactgcgttgttagaatcggatgtgaatattgccctggtttctaagttacgaaataatataaggtcacagctgctgagtgagaaccgtagtgagaagtccacaacaaacgcacaaactaagaagcttattcagaaaacggtgtttgatgaactgtgtaagttggtcacctgcgaaggtagtgaagagaaggcctttgtgcccaagaagagaaagacaaacatcatcatgtttgttgggctgcaaggttcaggtaaaactacttcctgtaccaagttagcagtttactactcgaagagaggtttcaaagtgggtttggtatgtgcggatactttccgtgctggtgcatttgaccaattgaaacaaaacgctataagagcaagaattccattttatgggtcatatacggagactgaccctgccaaagttgcagaagaaggtattaacaagtttaagaaagagaagtttgatatcatcatcgttgatacttcaggtaggcatcatcaagaagaagagttgttccaagaaatgattgaaatatccaatgtcatcaagcctaatcaaactatcatggttttagatgcttccattggtcaagctgcagagcaacaatccaaggctttcaaagaatcgtccgattttggtgccattatattaaccaagatggacggccacgctagagggggtggggcaatttcggccgttgcagccacaaacactccgattatctttattggtacaggtgagcacattcatgatttggaaaagttctcgcctaagtcattcatatctaaactgttgggtattggtgatatagagagtctctttgagcaattacaaaccgtttccaacaaggaagatgcaaaagccacaatggaaaacatccaaaagggtaagttcaccttgctagatttcaagaaacagatgcaaacaataatgaaaatgggtccattatcaaatatagcgcagatgattcctggtatgagtaatatgatgaatcaagtaggggaggaggaaacctctcaaaagatgaagaaaatggtttacgttttggattctatgactaaagaagaactagaatctgatggtagaatgttcattgaagagcctacaagaatggttcgtgtagctaaaggttcaggtacttctgtgttcgaggtagaaatgatattgatgcaacagcagatgatggcaagaatggcacaaaccgcaacccagcaacaaccaggagcccctggtgccaatgctaggatgcctggcatgccaaacatgccgggtatgccaaacatgcctggtatgccgaatatgcctggtatgccaaaagtgactccacaaatgatgcagcaggcacaacaaaagctgaagcaaaatccaggtctaatgcaaaatatgatgaacatgtttggtggcggaatgggcggaggaatgggcggaggaatgcctgatatgaacgaaatgatgaaaatgatgcaagatccacaaatgcaacaaatggcaaaacaattcggtatgggctaa

SEQ ID NO: 3798 - DNA, 1626 bp, Saccharomyces cerevisiae
atgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataa

SEQ ID NO: 3799 - DNA, 1626 bp, Saccharomyces cerevisiae
atgttgcggcttgcacgtttttattctttggccagaaccaaagccatacatagtcacggtgcacccttcaggccggaatatgcattgaagtgtggattggagattcatacgcaattgaacaccaaaaacaagcttttttcacaatcaacgaatagcgccacatctctagtggatgcaccaaaccatcatactagttattatgacatagctctaccgggaacgcagccggttttgaatctggaagcaatcttgtttgccatgaaactatccttggcactgggttctcaagtgaatagcatatctcagtttgataggaagcattatttttatggagatcaacctcaaggctatcaactgacgcagcactacaggccgtttgctcggggtgggaagatcaatctgtcgaaggaattggatgatatcgatgaatcagccaaggaaatcggtatcttacagttgcagatagagcaggacacggggaagtcacactatacagagacagataaagacgttattactttggttgatttaaataggtcgaacgtcccgcttatcgaattggtaactaaaccagatttcagtgatattaaacaggttagagcgtttattaaaaaatatcagaatttggtacgtcatttgcacatttcctctggggacctggaaacgggcgccatgcgagtggacgttaacctctcaattaatgaatatgcacgcgttgagttgaagaatttacccaatactagttccatcatcaatgcaatcaagtacgaatatcagcggcaagttgagttgatttctgtgggtgacactagctcactgatggagccagaaacaaggggctggacaggctcatcaacggtgaagttgagaagcaaagaaaccacgatcgattacaggtacatgcctgatccagaattgccgtatatcaacctcgcaccagacgttatcagtggtgtgagagggttgatgccccaattaccggacgatataatgagaattcttatgaagaaaccctatcaattatcattgaaggacgccaagattctgacttataatagtaaccaaaacgatatgtacaatcatgaggcgttgagatcgtactacttagacaccttccgtgaattttccaagcttgctggtgaacgtagtaacgcgaaattacctacgaattggataatccatgaattcttgggagatttgaacaagctacaaattccattggccaaagcaaaagaaattttgcctcctccggttttcgcccagtttttgaagttattgcatgaagaggttatatccgcaactagtggtaaaatgttactgtttcacatattggaaaatttcgagcagagtaactgccaagatttgtctattccagatttttcaaaactaatcgagaaatttgaattgcatgcgattaatcaggtcgaccctcaagaattgatggatctctgtaatgatgtcattgcacagcacacagatgacacttttatacggaacctggttactggtaaaaagaagtcctctttaaaattcctaattggacaaggaatgagacgaagccagggacgtataaaggcaaacgaattcgagaaaaaattcaaagagatcttaaatattcaatggtaa

SEQ ID NO: 3800 - DNA, 1626 bp, Saccharomyces cerevisiae
atgtttggtttcagcggtagtaataacgggttcggaaataaaccagctggttcgaccggtttttcatttggacaaaacaataacaatacaaatactcaaccttcggcttcaggatttggttttgggggcagccagccaaattctgggacggctactaccggagggtttggtgcaaatcaggccacaaatacttttggaagtaaccaacaaagtagtacaggtggaggccttttcggtaataagcctgctcttggcagcctaggaagttcaagcactaccgcttcaggaactacagctactggaacaggtttatttgggcaacaaacagcacaacctcaacaatccaccattggaggtgggttatttggaaacaagccaactaccacaacgggaggtcttttcggcaacagtgcacaaaacaatagtaccacaagtgggggtttatttggtaataaagtaggatccactggctcactgatgggcggcaatagcactcaaaacacatctaacatgaatgcaggcggactttttggtgcaaagcctcagaatactacagcgactacgggaggcctatttggcagtaagccacaaggatcaacaactaatggtggcctgtttggaagcggcacccagaataacaatacccttgggggaggtggcctttttggccaatcccagcagcctcaaacaaacactgcgcccggacttggaaacacggtatccacacaaccatcatttgcttggtctaagccttcaactggatctaatttacagcagcagcagcagcagcaaattcaagtaccgttgcaacaaacgcaagcaattgctcaacaacagcagctgtctaattatccgcagcaaattcaagaacaggtgttgaaatgtaaagaatcgtgggatccaaacacaacgaaaacaaaactcagggctttcgtgtacaataaagtgaacgaaacggaagccattttatatacaaaaccaggacatgtacttcaagaagagtgggatcaggcaatggaaaagaaaccttcccctcagacaattcccattcaaatatatggatttgagggtttgaatcaacgtaatcaagtacagactgaaaatgtagcccaagctagaataattttgaaccatattttagagaaatccacacaattgcaacaaaagcatgaattggacactgcgtccagaattttgaaggcacaatcaaggaatgttgaaattgaaaaaagaatcttaaaattgggcacacaattggcaaccctgaaaaatagaggactgccattgggtattgcagaagagaaaatgtggtcgcaattccaaactttactacagcggagcgaagatcctgcaggtttaggtaagactaacgaactttgggcacgtttggctatcttaaaagaacgtgctaaaaacatttctagtcaattagatagtaaattaatggttttcaacgacgatacaaaaaaccaagacagcatgtccaaaggcaccggtgaagaatctaatgatcgtattaataagatagtggaaattctgacgaatcaacaacgcggtataacatatttaaatgaggttttagagaaagatgctgcaattgtaaaaaaatataaaaataaaacgtaa

SEQ ID NO: 3801 - DNA, 1629 bp, Saccharomyces cerevisiae
atgaatagcagtctgcaagttggcatcggaattgatgtaggttcatcaagtgctagaataggtgtatataattactacaatgatgcgctgttagaaatggcgcaggaaccagtcccatactaccaggattcttcaaagaagtcatggaaattctggcaaaaatcaactgaaataattaaagcccttcaaaagtgtcttcagaaactgaacattagagaatatgaggtaaagtcatgtggtgtttctgcaacgtgttcattagctattttcgaaagggatcgcacaagtaacatgctgataccgtatccaaatgaagataatgtcatattttggatggactcttctgccgtaaacgaatgtcaatggctaaatatgcaatgtccacaacagcttttggattatttgggaggaaaatttgtacccgaaatgggcgtccccaaattgaagtactttttagatgaatactctcatttacgagacaaacattttcatatctttgatcttcatcaatacattgcttatgaactgagccgcttgtatgaatggaacattgaaggacttttgggaagagaaaatcttaatggtataggcaatgatggagaggtatctggctggtcatcttcattttacaaaaacattataaatttaccatctaatgtaagcattggaaccactagtcttgttgccaataagcacatttcgacaactgtagttcgcagttgtattgacagttatgcaagttggttcgcagttgcttctcctcatttggaaacatcattgtttatgatagccgggacttctagctgctacatgtatggtactaccatctctgatactagaattcctggagtatggggaccttttgatactatacttgacaacaggggtgatttttctgtttatgctgcgggccagtcgtgtactggtaaattaattgaacatttatttgagagtcatccatgtgccaggaaaattctgaaagatggtgctgatatctatcaagtactcgaacaaaccattcgtgacattgagaagaacaatggtctctcaattcatattcttacgaaagatatgtttttctacggtgattacgagggaaataggactccttttgcagatccacggataaagggttctttcattggcgagtccaccgatacatcaatgttgaatcttacatataaatatatttgtatcttggaatttttatcatttcagacaaaattgataattgatacatttcaaaatgaaaattcaaatatacatatcaaagagttaaggatatctggtagtcaagcgaaaaatgaaagactattatcattgatttccttggttaacaacggtgtagcaataattaaacctaaagagaatgtcgatatgatgggtatcaaaggtgcttacgtgcttgctaagtctgcaaaggaaaagaaacaactagctgacgttataacagagagagatattagtaatgatagcgaaaaattcgaatctcttgctgaataccgacttggaaacgatagcatattactaagaaaattgctttgcgttaaatatcatatacacttagatatggctaagcaacagaagcgttatcacaaactcgtcgacgaagtatttcagcacctctaa

SEQ ID NO: 3802 - DNA, 1629 bp, Saccharomyces cerevisiae
atgatttcacccataagctttctatcatcgctgctatgcttaacttatctaacctcagctttaccgattcttcctaagagagaagttgtaacgagagttcacacagcaagcacaactaatgttgtgactgatttttactccactactaccgaagttgttattgccccaactgtcgaattcctaataagcgatagtgttacctttacaacaaccttaattccacaaggtgtgaacccaacagctgaaccaactacgactatcactaaagttctcttaaaaaaggctgaaatgagtacatcttcgcagccaacctctactttgcagccaagcactattccacaatcaacctcctcttttcaagcagaatctactttgcaagccgtctctacgcaacaaactgctatgtctgtttctgcaggtactagtgaggatgtgcaacaattagctactacttctacctctatctcctcctctccttcccctaccactacgtctacttccacacaaaatatcgtgagtggtgtcggtgaagccaatgttgaaggcaacactcaaagtcagcatcattcttaccaagcagctgcgacttcaactttgaatcaacaaacgagtacctcaattgcttctcaggagtccaccgaatcaaccaatacacctacgtcgtcctctacgtcgtcctctacttcttcttctacttcttcttctacttcttcctctacttcttcttctacttcttcctctacttcgtcctctacttcgtcctctacttcatccacacaggaaacagccgctaccacctctgaaggttcctctagtagcagcgctgctataacttcttctccaaaggctattgcatattcaccatataatgatgatggctcttgtaagtctgcagacgctgtctcttctgacttaacgttgatcaaatctaaaggtatttccaaaatccgtgtttatggcaccgactgtaattcctttgaaaccgtccaaccagcagccgtaaaactaggtattaagattaaccaaggtttgtatatcaccagtagcggcgttgattccatagatgattctgttaccacattgattcaatatggtcaaactaacggttgggatgtctttgatttcattactgttggaaatgaagctatcaataatggttggtgttcagtttctgatttgattagtaaaatttcctctgtcaaatccaaattaagcgaagctggctattctggccaaattactaccagtgagccccctgtctcatttgaaaataaccctgatttgtgcaaaaaatctgatattgacttcgttggtatcaacccacatgcctactttgatactagcgccagtgctgaaactgccggtacatttgttaagggtcaagttgaattaattcaaggtgtttgtggtacttctaatgttttcgtcacggaaacaggttacccatcgtctggtattcaaaatggaggcaacattccatccactgctaaccaaattactgcagtccaaaacatcttgaatgaaatggacttggatgttacaatcttatcgacttacaatgattactggaaggctcccggtgattacggtatcgaacaatctttcggtgtgattgaatattttccataa

SEQ ID NO: 3803 - DNA, 1629 bp, Saccharomyces cerevisiae
atgcaagctaaaattatatatgctctgagcgcaatttctgcgttgattccgttaggatcatcactattagcacctatagaagaccccatagtatcgaataagtacctcatatcttacatcgatgaggacgactggagtgataggatattacaaaatcagtctgtcatgaactcgggatatatagtgaatatgggcgacgaccttgaatgctttattcaaaatgcaagcactcaattgaatgatgtattggaagactcaaatgagcatagcaatagtgaaaagacagcattattaactaaaaccctgaatcaaggtgttaagacaattttcgataaattaaatgaacggtgcatcttctaccaagccggattttggatttacgagtactgtcctggcatagaatttgttcagttccatggtagagtaaatacaaaaactggtgaaatagtaaatcgagatgaatctttggtctaccgcctgggaaaaccaaaagcaaatgtagaagagagagaatttgaactactttatgacgatgtaggatattacatcagcgaaattatagggtcaggtgatatttgcgatgtgacgggggctgaaagaatggttgaaatacaatatgtctgtggcggctcaaactctggaccatcgactattcaatgggtgagagaaacaaaaatttgtgtttatgaagcccaagttaccatacctgaattgtgcaatttagaattactagccaaaaatgaagaccaaaagaacgcctcacctatactttgcaggatgcccgcaaaatcaaaaattggtagtaactctattgatttaatcaccaaatatgaaccgatttttttaggttctggaatatactttctaaggccctttaacaccgacgaaagagacaaattaatggttactgacaatgccatgtcaaattgggatgagattacggaaacatattaccagaaatttggaaatgccataaacaaaatgcttagtttgagattagtatcgttacctaatggacatattctccagcctggtgactcatgtgtttggttggcggaagtggttgatatgaaagatcggtttcaaaccactttatcgttgaacatacttaattcacagagagcagagatatttttcaacaagacgtttacatttaatgaagataatggaaacttcctatcatacaaaattggggatcatggcgagtcaactgaacttggtcaaataacccactcaaacaaagcagatataaataccgcagaaattcggtcagatgaatacttaattaacactgataatgagctattcttgaggatttctaaggagatagcagaagtgaaagaattattaaacgaaatcgtaagtccacatgaaatggaagtaatatttgaaaacatgagaaatcaaccgaataatgattttgaactggcgttgatgaacaagttgaaatcctcattaaatgatgataacaaagttgagcagataaacaacgcaaggatggatgatgatgaaagcactagtcatacaaccagagacatcggggaagctggatcacaaacgacagggaatactgaatcggaggtaacaaacgtagcagctggtgttttcatcgaacatgatgagctttaa

SEQ ID NO: 3804 - DNA, 1629 bp, Saccharomyces cerevisiae
atggataatggtacagattcttccacgagcaagttcgttcccgaatatagacgaacaaactttaagaataaaggcagattctctgcagatgaacttcgtcgtcgtagagatacacaacaggtcgaattaagaaaagcaaaaagagatgaagctttggccaaaagaagaaactttattcccccaactgatggcgctgattctgatgaagaagatgagagctccgtttctgcggaccaacaattttacagccagttgcagcaagaactaccacaaatgactcagcaacttaactctgatgatatgcaagagcaattgagtgctactgttaagtttagacaaattttgtctagagaacaccgccctccaattgatgtcgtcattcaagccggtgttgttccaagattagtagaatttatgcgtgaaaaccaacctgaaatgttacaattggaggctgcttgggctttgactaacattgcatcaggtacatctgctcaaacaaaagtggttgttgatgctgacgctgtacctcttttcattcaactattatataccggctccgttgaagttaaagaacaagccatttgggccttaggtaacgttgcaggtgattcaactgactacagagactacgttttacaatgtaatgccatggagccaattttgggtctttttaactccaataaaccatctttgatcaggaccgctacgtggactttatccaatttatgcaggggtaaaaaaccacaaccagattggtcagtggtctcacaagcgttgccaaccttagcgaaattaatctattcgatggacactgaaactttagttgatgcttgttgggctatctcttatctatctgacggaccacaagaagctattcaagcagtgatcgatgttagaattcctaaaagacttgttgaattactgagccatgaatcgactttagtccagactcctgctttaagagctgtaggtaatatagtcactggtaatgacttacagactcaggtcgttataaatgctggtgtcttacctgcgttaagacttctgctaagctctccaaaagaaaatatcaagaaagaagcgtgttggaccatttccaatattacggctggtaatactgaacaaattcaagcggtaattgacgcgaacttgattcctccattagttaaacttttggaagttgcagaatataaaactaaaaaagaagcttgttgggctatttccaatgcctcttcaggtggtttacaaagaccagatatcataagatatttagtatctcaagggtgtataaaaccattgtgtgatttgctagaaattgctgacaacagaataattgaagttaccttagatgctcttgaaaatattttaaagatgggtgaagctgacaaagaagctcgtggtttgaatatcaatgaaaatgccgattttatcgaaaaggctggtggtatggaaaagattttcaactgtcaacaaaatgaaaatgacaagatttatgaaaaagcatacaaaatcattgaaacctactttggtgaagaagaagacgccgtagacgaaactatggctccacaaaatgccggtaatactttcggctttggttctaatgtcaaccaacaattcaattttaactaa

SEQ ID NO: 3805 - DNA, 1629 bp, Saccharomyces cerevisiae
atggcaggagcaacatcaagtataattcgggaaaatgattttgaggacgagcttgcggagagtatgcagtcatataatagagaaactgcagacaaattggctttgactaggaccgagagtgtaaagccagaaccggagataaccgctccgcctcactcacgcttttcccgttctttcaagacagttttaatagctcagtgcgctttcactgggtttttctccacaatagcaggtgccatctactatccagttctgagcgttatagaaagaaaattcgatattgacgaggaattggtgaatgtcactgttgtagtatattttgtatttcagggtcttgcccccacattcatgggcgggtttgccgattcactgggcaggagaccggtggtgcttgtcgcaatcgtcatttattttggtgcctgcatcggtcttgcttgtgctcaaacgtatgctcagatcattgtgctaagatgtctacaagccgccggtatttcacccgtgattgcgattaacagcggaataatgggagatgttactactagagccgagcgcggcgggtacgttggatatgttgctggatttcaagttctaggttctgcgttcggagcccttatcggtgccggattatcatctagatggggatggagagccatcttttggttcttagcaattggatctggcatttgcttcctagcctcgtttttaattttgccagaaacaaagaggaacatatccgggaatggttctgtcaccccaaaatcatacttaaatagagctcccattcttgttttgccaacagtaagaaaatcattgcatttggataatccagattacgaaacattggaactgcccacgcaactaaatctactggcgcccttcaagattttgaaagcttatgaaatttgtatacttatgctagtcgctggattacaatttgccatgtatactacgcaccttacggcgttatccacagctttgagtaaacaatatcacttgactgttgcaaaggtaggattatgctaccttccctccggtatctgcacattatgtagtattgtcattgctggaagatatttgaattggaattacaggcgcagattaaaatattaccaaaattggttgggcaagaagagatcaaagcttttagaagaacacgacaacgaccttaatttggtgcaacgtatcatagaaaatgatcccaaatacacctttaatatcttcaaggcgaggttgcaacccgcatttgttaccttgcttttaagcagtagcggattttgtgcgtacggatggtgcattactgtcaaagcccctttagcggccgttctttgcatgagtggatttgcgtcgctgttttccaattgcattttgactttttcaacaactctaatagttgatctttttcccacgaagacatctacggctacgggatgtttaaaccttttcagatgcattctatctgctgtgtttatagctgcattgagtaaaatggtagaaaaaatgaaattcggaggtgtttttacatttttgggggctttaacctcctcgtcatcgatcctcttatttattctcttgagaaaaggtaaagaattagcctttaagaggaaaaagcaagaactgggagtaaattaa

SEQ ID NO: 3806 - DNA, 1629 bp, Saccharomyces cerevisiae
atgggcaatcagtcattagttgtgcttacggaaagtaagggtgagtatgagaatgagacagaactacctgttaaaaaatcgtcacgagataataatatcggagaatctttaacagcaacagcttttacgcagtctgaagatgaaatggtagatagcaatcagaaatggcagaacccaaactattttaaatatgcatggcaagaatatctttttatattcacatgcatgataagtcagcttctaaatcaagcaggcactacacagactctttcgatcatgaatattctttcggacagttttggctcagaaggaaactcaaagtcatggctgatggcatcttttccgctagtttcaggctcatttattttgattagtggcagactaggtgacatatacggattaaaaaaaatgttgttagtaggatatgttctggttattatatggtctttgatttgtgggattaccaagtattctggtagcgatactttttttattattagtagagccttccaagggctagggattgcatttgttttacctaatgtgctgggaataattggtaatatatatgtaggtggtacttttcgtaaaaacatcgtgattagttttgttggtgcgatggcccctattggagcaactttaggttgtctttttgcaggactgatcggtaccgaggacccaaaacaatggccatgggcattctacgcgtatagcatagccgctttcattaattttgtgctctccatatatgccattccgagtactataccaacaaatattcatcatttttctatggattggattggttctgttttgggcgtgataggtctcattttattaaattttgtgtggaaccaagctcctatatcgggttggaaccaggcttacatcatcgtaattttaatcatttctgtgatttttcttgtcgttttcatcatttatgagattcgatttgccaagactccactattgccgcgcgcagttataaaggatcgtcatatgattcaaattatgctggctttattctttggatggggctcttttggcatctttacgttttattatttccaatttcaattaaatataaggcagtacacggcattatgggctggtggaacttactttatgtttttaatttggggtattattgccgccttactggtaggatttactatcaagaatgtgtctccatcagtgtttttgttcttttctatggtagcattcaatgtgggctcaataatggcaagtgttacaccggttcacgagacatactttcgtactcagttaggaacgatgataattttaagttttgggatggatctttcatttcctgcttcttccattatctttagtgataatttaccgatggagtaccaaggcatggctgggtcattggtgaatactgttgtcaattactccatgtccttgtgtctcggtatgggtgccacagtagagacacaggtcaattcagacggaaagcatcttttgaaaggctatagaggtgctcagtaccttgggataggattggcaagtttagcatgcatgattagcgggctttacatggtcgaaagcttcataaaaggccgcagggcaagagctgctgcagaatacgattgcactgtggcttag

SEQ ID NO: 3807 - DNA, 1629 bp, Saccharomyces cerevisiae
atgtccgtacaaaaagaagaatacgatattgtagaaaaggcccaattatctgtgtccgcagaaagcttaacatcagattcggagagtatttcacataacccatttgacgattttcataaagcagagcgttggagaaaagtctatgaatccagtggttatgaaggcttgtctaaattcgatcctgagtttacatggacaaaggatgaggaaaagaaattggtaagaaaaatggacttgaagatttttttgtgggtttttattatgtttgcctttttggatttaataaggaaaaatattgcaagggcagtttcagacaacttcattgttgacttgaaaatgaacacgaacgactacaaccttggccaaactgtttatctagttatatttctagcaagtgaactacccggcaatctgctgtccaaaagatttggtccagaaagggtcattccggttcaaattgtgttgtggagtgtaatttgtattactcaagctggtctgaaaaatcgaggtcaatttattgctactagatgcttattaggaatggtacagggcgggttcatcccggacaatattctatacttgtcatattattatactggagctgagctcacattccgcctaagtttcttttggtgtgctatacctcttttccaaattttaggctctcttttagcttccggaatcatagagatgaggggtattcataacttagctggctggcagtacctatttataattgaagggtttctgtccctttctgttggcgtggcatccttttatttaatgcgtagaggacctacgcaaactggtgagtctgcatttcacaaaggaaaatcgttattcactgagtatgaggagaaaattatggttaacagaattttaagggatgacccatcaaagggtgacatgagtaaccgacaaccagttaccttcaaggagattttgtacactctaacagaatttgatctatggccattgtttatccaaggtattacagcattcatatctcttcaaacagttggttcctatttatctttgatattaaagagtttaaattactctacatttctttcgaacattttagcaattccaggccaagccctgctgctaataaatttaccattagcggcactattatcgcgtaaattgaaagaaaaatcactttgtgtgggaattgccaacgtttgggtgctccctttcatagtttctctggtcgctttaccgactgacacaaacccctggatcaagtatatattactaaccggtatacttggtcttccctatacacattccattcttgctggttgggtctccgagatttcaaattcggtaagatcgcgtacagtgggcacagcgttatacaatatgagtgcccaagttggagcaatcattgcttctaacatgtatagaaatgatgataaaccttactatactagaggtaacaaaatacttctaggattcacttgcttcaacatttgtatggctgttgctactaagttttactatattagtaggaataaatacaaggaccgcaaatggaactctatgacaaaagaagagcagatcaattacttggacacaactaaagataagggaatgaagcgtcttgattataggtttattcactag

SEQ ID NO: 3808 - DNA, 1629 bp, Saccharomyces cerevisiae
atgtcgttactgagactgtggaacaaagaatcaagggcaccatcaaaaataaagagtcatggtattgttggcagttacggcaacagcatgctggcccataacaacgtgaagcaatttcgtatagacatagacgaaccgcatagagtatggaaaccgaatgaaagcataaccggagaagcggtcattgacataaagagagacataactaacgtagcgatcaaattatcgctagtatgtgaggttcgcgtgaaaacggggaacagtccaacctccaagaataagagaattgagaaaaccttagagaagtcgacgtttctttatggacaggactacgtaaagacagctttttcggctaaggaaaagaaaccgcatgttgacaaaaccaccattctcaatggtttaagcaagggggaacacaggtttccctttaggatacgaataccacgaggcagaggaatgttgagctctataaagttcgaaaggggctcgataacatacttcctctcttgcactttagaatccctcaacaacatcaacggattaaaaaaaccggaagcaagatgcgaacgtgagtttgcagtcatagttccgctggacgtctcgaggctgcccaagccgaaaactaagacagtggttttacaatcagcatctatggtccaaaacaaaaagaacaaatctacagaggacgaatcctcatcgtatacacaattaactcaaaagtctactacttctaattcttctagcagttcagtaaactccaagacgtcccccttaccaaataaaacggtgactatatccgtagacataccgcaggctggattcatgattggtgaaattatccctatagacgttaagattgaccactataagcctttctatgcccctgcgggtctcaccaccactttggtgaggatatgtagggtgggcggtgcaggcaaagatgatcctatggagactttcagaaaagatatatgtcagagtatctctcctatatatattaaccctgaaacgttgcagtttcaatctagagtttatctgaaagtgccccttgatgcattttcgacccttactactgtgggaaaatttttctccttccaatactatatcgaggttatggttaacttatcaaaaaaaaacgtggtttacacagaatctaatagaataataggaactcctattggagaacaaaatggcttgggcgtagagaataatatcaaccgtatccaaaggaaaatgctacgtatggtcaatccagaaacgttggagaacgattctgagggttatgaatccagtatatttttcaaagatatggtaaatgtggaaaagctaaagagactgaggaatgtaactggtatgtccatagaaaccgtcataggaacgacgagatccgaacagcagcaatctgatgcaagcatcccatcccaatcctcaatcacggctcctcaaaattctccatcgaatttaagagattggttggccccattaaatgcatatgatagtgacgatgttccagttccaaagtattcgccaaatgataaagtcagtgtaccgtcggaagacaaacaagaacttgaacaaaaaagactacaacagttagaaagcgatcctcccccttgtgatgactattaa

SEQ ID NO: 3809 - DNA, 1632 bp, Saccharomyces cerevisiae
atgaagagtactttgagtttaactttatgtgttatatcgcttctattaaccctttttctggcggccttggatattgttatagtggttactttatatgatacaattggcattaagttccatgacttcggcaatattggttggttagttactggatatgctctttctaatgctgttttcatgttattatggggtcgcttggccgaaatacttggtacaaaggagtgcttaatgatttctgttattgtatttgaaatagggtctttgatttctgctctttcgaattcaatggcgactctgattagcggaagagtcgttgctgggtttggaggaagtggaattgaatcacttgcttttgtagttggaacatccattgtccgagaaaaccatagaggaattatgataacggcactcgctatatcgtatgtcattgcagagggagtcgggccttttattggtggtgcatttaatgaacatttgtcttggagatggtgcttttatataaatcttccaatcggtgcgtttgcgttcataatattggcattttgtaacacatctggagaaccacatcaaaaaatgtggctaccatcaaaaatcaaaaaaattatgaactatgactatggcgaattattgaaagcaagtttttggaagaatacatttgaagtacttgtatttaaactagacatggttgggattattttatcttcagcaggctttacactactgatgttaggtctttcatttggtggaaacaacttcccatggaattcgggtatcattatttgcttttttaccgtgggccctatcttattgttactattttgtgcttacgactttcattttctgtcattatcggggcttcactatgacaacaagcggatcaaaccgttactgacatggaatattgcctcaaattgtggcatatttacaagctccataacaggattcctttcttgctttgcttatgaattacagtctgcttatttagtccagctttatcaactagtatttaaaaaaaagcctacattagcgagtatacatctttgggaactatcaattccagctatgattgcaactatggccatagcatatctaaattcaaaatatggcatcatcaaaccggcaattgtttttggtgtgctttgtgggattgttggatctggtttatttacgctaatcaatggcgaactctctcagtcaataggttattcaattctcccaggaatagcttttggtagtattttccaagcaacgttattaagctcccaggtgcagataacatcagacgatccagactttcaaaacaagtttattgaagtcacagctttcaactcgttcgccaaatccttgggctttgcgtttggagggaatatgggggcaatgatattcactgcatcactcaaaaaccagatgcgctcttcccaattaaacataccacaatttacgtctgtagaaacacttttagcgtatagcacagaacattatgatggcccccaatcttcactatcaaagttcataaacacagctatccatgacgttttttactgcgccttaggatgctatgctctttcattcttctttggaatattcacttcgagtaagaaaacaacaatatcagccaaaaagcaacaatga

SEQ ID NO: 3810 - DNA, 1632 bp, Saccharomyces cerevisiae
atgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtag

SEQ ID NO: 3811 - DNA, 1632 bp, Saccharomyces cerevisiae
atgacagcagaagatatactccttcgagaaagaacatctactacgacacaacgccctgtcaatagcgaacaataccttaatgtgcaattagccacagccccagtaaaaaattttcagactacaagcgagattagccggcaaactcttgtagacacatcaaatgatgacgtttattccatcaagaatttgaagggctcgaggaaccccattagccctagtgtttctaacgttggcttccaatccatattccatacagtagatcatcctcgatcgaaggtcagtgtggcctcaaatcattccttgaggagcaatgacaatgcctcagctgcaacatctaaatctggttcttctcagataggggaatctcatagcgttgacacggtggagtgctcgaacaatctatctaaaaagttatcttctgatgcaatatccattactcagaaaagtttacactccacgccctccggcaggtatatgaaaggaaaggcttctggcttttttaataggagaaacagagcacatacgaccatttcatcggatcctgcctcctttttgacagattcaagcaccttacataatagttcacattcatttcgaaacgtgattaagaactttttccaaaataaaagccacaggcacattggtcaagatgctatcgagcctgcaattccaaattccttgagtaaatttctgcattcctcttacggaagacataaatctccgtcacaatttattcatactaatgcggggcaacttgtggactcaggaacttctgtgtactcattgaatgttaatccatctggtgtcaatcccaacacaatcgttgaggatccgctttctggaactgatcctgcctcaccgaatccggtctcaatgttacacgaccttttaagaaatttaccatctctggaagctaactataaacacttcaactcccaagaactgacaaccctaacaaataatatttggaatatattttgtagtaacgtagcagaattattcagaactcaaagaatatggaaactcagggccaaaatagaaaattttaacgaagttttagaattctattgcattttaaaaacagatccaagagtcacacatagcggcatgaatagaattatcagcgatttgaaagaatttttggttagttccctatacaatttagaaaaccaaattgtttttaactattctaatgaagacacaataaataacgcattgaaaagattaggcgttatatggcggatattttatcaagaggtatattatgatttagccgctgtgttattaccgttggatcagagtatcagagaagatggtaattctacggttttaaagtcaggcaatgaaagtcggactcacattaatggtaattattctattgggtttcttttgcttatgtgctttagagattcaatagtcttaccttgttatgaaaacttcgtaaatagtaacgatggtatcagcaaaagttttcaactttacattttcaatcaagaagaagaaagtaatgtcacagaaacagataaattgacattactgcagtgttttggcatattgagtaccattcaaagtaatgatagaaatcaacgaattatcgaagagttattagcaggcattagaatgagtatatag

SEQ ID NO: 3812 - DNA, 1632 bp, Saccharomyces cerevisiae
atgatggactcgtcaagcaaaagcttaactcagtatataccctcacccatgggatctctatcaaggctaaagcagaagggtgtggacaattttcagaaggtgaaaaaatccggtaaatccatctataattacaactactcaaaattcgttcctcatccattttcaactattgatgaaagtgttaaacactctgaaagtgggcggtatgatgatttggagataattcgtccaacaaaagaaaaggaagtaacaagttctgtgtacaaaagaaacagtggcaagtctctgaatacagaatctcagttttcactgggagattcagatgcagccactttggtgaattcagtcgctactttcaagcttaacaatgcttctacatccacttcactggtgtcttcatcttcaactgtatgttctcaagcgaagtcctcgttacgttccccaacaagtcgtctcaatgatacaaaaatcaaagaggaaaacaattatatttccagcgtgaaagactattgcggtccaatgagaaaatccatggtaaagacggaaatcctcattgaagaacctttgaatcctactaccgatatcaagtcttttataaactcatacaaccatggcaaagcgtatagtctaggtgaaactcaacatttacattattatcagttgccattcccatggagggaaaacagatacataatccatggctataggttttacaatacccattccaaatctttgttgtctatctttaactggtacggctggcataatgaaacttcaaatatttggtctcatttgttaggagccatttatataatctacttggcaatttacgatttccctcagtctgaagtttggcggaattcccaggttccaccacaggctagatggattgttttcatgtttttggcagctgcgttgaaatgtatgctaagctccgtgttttggcatactttcaacggaacgtccttcttgaagctacgttctaaatttgcgtgtgtcgactatagcggtattacgatcttaattacagcttcgatattgacaacggagtttgttaccatgtattcatgttactgggcgatgtacacttacatgagtatttctctggcgctgggtgtatttggtgtgtttatgaattggtcgcctcgctttgatagacctgaagcaaggccattaagaattagattcttcattttgctggctactatgggtgtattgtcgtttttacatttgatatttttgactgatcttcattatgctgcaacgctatttagccccgtcacatacaaatctgttgtttggtatttggttggtgtggtattttacggttcgttcattcctgaacggttcagatctgacgttcaggttgataagaccattccaacaaactacgaattatctactgatttagaaatcatcacaaagcaaagggaaattcattttagagaggtgccaacagcccattccaaatgcagttcctgtccgtctcatgccaaatcatttaaatctctatggtgggttgactattttggttgttcgcacactttttggcatttcttcgtagtgttgggtgtcatcggccattatagagctattttagatatgtttgccaagaggtggattttgtcatga

SEQ ID NO: 3813 - DNA, 1632 bp, Saccharomyces cerevisiae
atgtcagcggatgctagtacaaattcgaatgcttccctagacgaaaaaaatttaaacatcacttcagaagctgaaatcaagaatgaagacgtaaccgcggagccagttctaagcacggtactatcacccaacggtaaaattgtctacatcagtgacaaggttgatgaggccatgaagttggctgaagaagccaaagaaatcgaagtgacaccagaagaagatagaaaacttcgttggaagatcgactattgtatgtttcctttgatgtgtatattgtatgctgttcaatttatggacaagatttccactagttcagcggcggtcatgggattaagaactgacttgaaaatgcatggtgaccagtattcatgggttacttccgccttttatttcggctatctatttatgaacctaggcccggtacagttcattttccaaaggaccagtcacatgtcaaaaatgcttgcggtttttattgtcatatggggaatgttattagctttacatgcagctccaacagttaagtatccttctttcattgttttgagagtacttttaggttgcgcagaaagtgttgtcacaccttgctttaccattatcactgctcaatactggaagacagaggaacaattcacaagagtatcaatttggtttggtatgaacggtcttggctccatcctgatcaacgcaattgcgtacggtgtttacattcaccaggattcttatgctattaaaggctggagaaccttatttgtcattactggtgtgataacaatcttcattggtatcttgatattcctgtggatccctgacgatccatcaaaagcaaggtttttatctaaaagagagaaattaatggttgtccaaagaattaggtctaaccaacaagggttcggtaatcacgagatcaaaaaataccaaattatagaggcgttgaaggatgttaggacgtggttatatttcctctttactgtgagctctaatattcctaatggtggtatttcaagttttatgagtattctattgaatagtgattttggatattcatcaaaggaaaccctattaatgggtttacctacaggtgctgttgaattggtaggttgtccactttttggtattctagcagtttatgcagccaataagaagataccattttggaaatataagttgagttgggctatttttgcagctgtcttagcattgattgctagctgcatgttagggtttgcaacaaactccaaaaaagcaagactggctggtgcttacctgtggtacatctcgcccgtctcatttatttgcgtactttccaatatcagtgcgaattcctcgggatatagtaaaaaatggactgtatcttcaataaacttagtagcatatgctgcagctaacttggcaggaccacaaacctttattgctaagcaggctcctaaatatcatggcgctaaggtcgctatggtcgtatgttatgctgttatgatcgtgcttctatctatactgctcatcgtcaatttaagggaaaacaagagacgtgataagatagctgccgagagagggttccctgaagaaacagagaatttagagttttctgatttgactgattttgaaaatccaaatttcagatacactttatga

SEQ ID NO: 3814 - DNA, 1635 bp, Saccharomyces cerevisiae
atggataaatatactgctttgattcacgatgagaatttttcaactcttacattgaatgtctcgagataccctaaaagtttggcatattgggagaagttactgaactatatagtaaaggcttcggcaccaatatgcaagtccactgagcctcaattattaaagttaatacgatgtacttattcttctatgctgaatgagtttccctatctagaaaactactatatcgacttcgcgctactggaatacaaactagggaatgtttctatgtctcataagatatttcagcgcggattgcaagcctttaaccaaagatctttactattatggacttcatatttaaagttttgtaataacgttatctcacaccagaagcagttgtttaaaaaatatgaaacagctgaagaatatgttggtttgcattttttcagtggggaattctgggatttatacctggaacaaattagctcaagatgtacgtcttctaagaaatattggaacgttttgaggaagatactcgaaattcctttacactctttttcgaaattttatgcattatggttacagcgcatagacgatataatggacctaaagcaattatcacaactaacaagtaaagatgaattattgaagaaactcaagatagacatcaattacagtggaagaaagggaccgtacctgcaggatgcaaagaaaaagttgaagaaaataacgaaggaaatgtacatggttgtacaatatcaagtacttgaaatctattccatttttgaatcaaaaatttatatcaactattatacatcgccagaaaccttggtttcttcagatgaaatagaaacatggataaaatacttggattataccatcaccttacaaacagattctttaacacatttaaattttcaaagagctttacttcctctggcccattatgatcttgtatggataaaatacagtaaatggttgataaattcaaaaaatgaccttttgggggcaaaaaacgttctattaatgggtcttaaattttctttgaagaagaccgaaataataaaactactgtattcagttatttgcaagttaaatgagtacgtacttttgcgaaatctattggaaaaaattgagtcctcatattccgacaatgttgaaaacgttgatgattttgagatattttgggactatcttcagttcaaaacgttctgccagaattctctgtattccagtcgatattctgattcacaatcaaacgggcttttgaataaggagctgtttgataaagtatggaaacgtttgagttgtaaagaaaaaaaaagtggtcaagaaattttattgaataacttagtacagttttattcgaaggataccgtagaatttgtagaaaagaacatatttcaaaagataatagaatttggttgggagtactacctacagaacggtatgttctggaactgttattgccgtttaatttatttcgacacttctaggtcatatttggacaagaggcaatatattgtcagaaaaatatggccccaaatagacaaaaaatttgcacagagcgtcttgccgtctttaacagaattctgtgagtcatacttcccagaggagatggatacattagaggaaatgtttactgaagaaccttag

SEQ ID NO: 3815 - DNA, 1635 bp, Saccharomyces cerevisiae
atggccattggcaaaaggttactggtgaacaaaccagcagaagaatcattttatgcttctccaatgtatgattttttgtatccgtttaggccagtggggaaccaatggctgccagaatatattatctttgtatgtgctgtaatactgaggtgcacaattggacttggtccatattctgggaaaggcagtccaccgctgtacggcgattttgaggctcagagacattggatggaaattacgcaacatttaccgctttctaagtggtactggtatgatttgcaatactggggattggactatccaccattaacagcatttcattcgtaccttctgggcctaattggatcttttttcaatccatcttggtttgcactagaaaagtcacgtggctttgaatcccccgataatggcctgaaaacatatatgcgttctactgtcatcattagcgacatattgttttactttcctgcagtaatatactttactaagtggcttggtagatatcgaaaccagtcgcccataggacaatctattgcggcatcagcgattttgttccaaccttcattaatgctcattgaccatgggcactttcaatataattcagtcatgcttggccttactgcttatgccataaataacttattagatgagtattatgctatggcggccgtttgttttgtcctatccatttgttttaaacaaatggcattgtattatgcaccgattttttttgcttatctattaagtcgatcattgctgttccccaaatttaacatagctagattgacggttattgcgtttgcaacactcgcaacttttgctataatatttgcgccattatatttcttgggaggaggattaaagaatattcaccaatgtattcacaggatattcccttttgccaggggcatcttcgaagacaaggttgctaacttctggtgcgttacgaacgtgtttgtaaaatacaaggaaagattcactatacaacaactccagctatattcattgattgccaccgtgattggtttcttaccagccatgataatgacattacttcatcccaaaaagcatcttctcccatacgtgttaatcgcatgttcgatgtccttttttctttttagctttcaagtacatgagaaaactatcctcatcccacttttgcctattacactactctactcctctactgattggaatgttctatctcttgtaagttggataaacaatgtggctttgtttacgctatggcctttgttgaaaaaggacggtcttcatttacagtatgccgtatctttcttactaagcaattggctgattggaaatttcagttttattacaccaaggttcttgccaaaatctttaactcctggcccttctatcagcagcatcaatagcgactatagaagaagaagcttactgccatataatgtggtttggaaaagttttatcataggaacgtatattgctatgggcttttatcatttcttagatcaatttgtagcacctccatcgaaatatccagacttgtgggtgttgttgaactgtgctgttgggttcatttgctttagcatattttggctatggtcttattacaagatattcacttccggtagcaaatccatgaaggacttgtag

SEQ ID NO: 3816 - DNA, 1635 bp, Saccharomyces cerevisiae
atgtcacgagaaacaaatttcaatggaactaagaggaagaggtcggatgttgccgagaaagtagcacaacggtggaagagcgtcaggtatagtgctgaaatggagaatatggctccggtcaacagtaacaatgatagcgacgactgcgtcatagtcagtgaatcgaaaatcattgatttgactaatcaggaacaagatttgagtgagagaatagaaacaaacgatacggcaaaaggtgccgtttttaaactaatgaaatcggacttctatgaaagagaggattttatgggagaagtagaggatatgattacattgaaagatatctttggcactgagacactaaaaagaagcatactcttcagtttccaatacgaacttgatttcttgttgagacaattccaccagaacgtagagaacataaccatcgtcggccaaaagggtactattatgcctatcgaagcccgtgctatggacgcgacactggcagtaatattaaaaaaggtcaaacttattgaaataacgatgcccccattcgcttcccaccatacgaagctgatcataaacttttacgataatggcgaatgcaaaatattcttgccatctaacaattttacgtcaatggagactaacctgcctcaacaggtgtgttggtgcagtccccttttgaaaataggtaaagaagggctaccagtaccgtttaagagaagcttgatagaatacctcaattcgtaccacctgaaagacattgacgaattgattacaaaaagcgtagaggaagttaactttgctcctttgagcgaattagaatttgtatattctacgccctccaaatttcagtcgtcgggtttactgtcgttttacaataaactagaaaaactttctgctggcacaagtgctagtgatactgcaaaacattatctatgtcaaacttcatccatagggacatctctatcaagagcgcgagacgaaaacttatggacacatctaatgattcctctgtttaccggaatcatgtcccctccagcaaaggacaccgctgggaggaagaaagcagaaatactgccaacgaattcattgattaatgaatattcgcagagaaaaatcaagccgtacattattttccccaccgaacaagagtttgtcaccagtcccttaaagtggtccagttccgggtggtttcattttcaatatcttcagaaaaagagctactacgaaatgctgcgaaacaagttcaaagtattttacaagcaagaccctgctatggttactagaagacgagggacgacgcccgcgcactctaagttttacatgcattgtgcaacaaactccgcagggccctgtgatgcatcgcaggtatttaaagaactagaatggtgcctttatacttcggcaaacctcagccaaacagcatggggcaccgtttcaagaaaaccacgcaattatgaagcaggagtgctttaccatagtcgcaggttagcaaataccaggaaggtcacgtgccgtacttttacacgtgaccgtagaggctgcgcgggtaatcccacccatgtggccgtgccattcacgctgccagtcataccatacgacttagctgaggacgagtgcttttgccttgctcgtcatgagaacgactaa

SEQ ID NO: 3817 - DNA, 1635 bp, Saccharomyces cerevisiae
atgtctgaagagaatttgaggcctgcctatgacgatcaagttaatgaggatgtctacaagagaggcgctcagagcaaattgaccaaagctcgtaaggcagacttcgacgatgaaaaggacaaaaaaaaggataatgacaaacacatagataaaagaccaaaaagcggtcctcgtttggatgaaaatggcaatccacttcccaaggagcctcgtctcccaaagagaaaggtggctgttatggttggttactgtggtactggctaccatggtatgcaatataatccaccaaatccaaccatcgagtctgccctattcaaagcatttgttgaagcaggtgctatttccaaggacaactccaacgatttgaaaaagaatggattcatgagagctgcaagaactgataagggtgtccatgctggaggtaatttaatatcattgaaaatgattattgaagatcctgatatcaagcagaagatcaacgaaaagttaccggaagggataagggtatgggatatcgagcgtgtgaacaaggcgtttgattgtagaaaaatgtgcagttcacgttggtacgaatacttattaccaacttattcactcattggccccaaacctggttctatactttatagagacatcgaagaaagtaaaacagaattacctggtgtattagatgaagatttggaatccaaagaattttgggaagagtttaaaaaagatgcgaatgaaaaattttcaacagaagaaatcgaagctatattagcatatgttccgcccgcaagagatgaatttgatataaatgaagaactataccagaaggtaaaaaagtacaagcaattagaaaatgctcaccgtagaagatatcgtatatccgcggcaaaactggccaaattccgtgcttctacaagtcaataccttggcgctcataacttccataattttacattaggcaaggacttcaaagaaccaagtgccattcgatttatgaaagatataaaagtatctgatccatttgttattggcgatgcccaaacagaatggatttccatcaagattcacggccagtctttcatgctacatcaaattcgtaagatggtatcaatggcaaccttaattacccgttgtggttgccccgtcgaacgcattagtcaggcttacggacagcagaagattaatattccgaaggcacctgcattaggattattgttagaagctccagtatttgaaggttataataaaagactagaacagtttggttacaaggcgatcgatttttccaaatatcaagacgaagtggataagttcaaaatgaagcatatctacgataagatctacaaggaagaggtggacgaaaatgtttttaatgcgttctttagttatattgatagtttcaacaaggttactggagcacagggagaagaaactgccgataaatcgggacctgctgtgcaaaagagtatcttcgaattcttgacagctaagggtatcccaggtcttactgatgcgcccgagagcaataagaagattaagcaaagaaaaagaatggaagaggaggaagctgctagtaaaaaggctgaaatatccagcaccactcagagcaacgaacctgaagtacaaccggaagcggcagctaattag

SEQ ID NO: 3818 - DNA, 1636 bp, Saccharomyces cerevisiae
atgagagaggtcattagtattaatggtatgtatgcgttcctttttttgttcaatattcgcaaccaatggcacctgtgggacagggaaagaagtttgatctgatctggtttgattcattcccaattggtcaccatctggttgatttacggcaaataatttgacttgtaccagcacagtttactaacagtttctttttctccattttttctgggcatactcggacgaaaaagctcataattgacctcattacatggggagtgatttttgtgtcttcttcttcggaggattgctggaacttttgttatttttcttttttacaacagttggtcaagcaggttgtcaaataggtaatgcatgctgggaattgtactccctagagcatggcatcaaggaagacggccatttggaggatggcttgtcaaaacctaagggaggtgaagaaggattttctacattcttccatgaaacggggtacggaaaattcgtcccaagagcaatctacgtggatttagagcccaatgttatcgatgaagtacgtacaggacgtttcaaggagcttttccatccagaacaattgattaacggtaaggaagatgccgccaataactacgcaagaggccattatacagtgggtagagaaatagtggatgaagttgaagaaagaattagaaagatggccgaccaatgtgacggtttacaagggttcttgttcacccactccctcggtggtggaactggttccggtttaggttccctgttattagaaaacttatcgtatgaatacgggaagaaatccaaattggaattcgccgtttatcctgcgcctcaattgtctacttccgtcgtggaaccttacaacacggttttaaccacgcataccaccctggaacacgcagactgtacgtttatggtcgataacgaagccatttacgatatatgcaagaggaacttgggaatttctagaccaagcttcagcaacttgaacgggttgattgcccaagtgatatcatctgttacagcctctttgaggttcgatggttcattaaacgtggatttgaacgaatttcagaccaacttggtaccatatccaagaattcatttccctttggtttcctacgcacccatcttgtccaagaagagggccacccatgaatccaactccgtgtcagaaatcacaaacgcttgtttcgaaccgggcaatcaaatggttaagtgtgacccaacaaaggggaagtacatggctaactgtttgttatacagaggtgacgtggtgaccagagatgtccaaagagccgtcgaacaggtgaagaataaaaaaacagtacaaatggtggattggtgtccaacaggatttaagattggtatttgttatgagccaccaagtgtgataccaagttccgaattagccaatgtggatagagctgtctgcatgctatccaacaccactgccatcgcggacgcttggaagagaatcgatcagaaattcgacctgatgtatgccaaacgtgctttcgtccattggtatgtcggtgaaggtatggaagaaggtgagttcaccgaagctagagaagatttagctgccttagaaagagattatattgaagtgggtgccgattcttacgctgaggagttctaa

SEQ ID NO: 3819 - DNA, 1638 bp, Saccharomyces cerevisiae
atgctgcccagacttggttttgcgaggactgctaggtccatacaccgtttcaagatgacccagatctctaaaccttttttccattccactgaagttggtaagcccggaccacagcagaagctatcgaaatcttacactgcggtattcaagaaatggtttgtcagaggtttaaagttaaccttttacacgacgttggccggcacattgtatgtgtcatacgagctgtacaaagaatcgaacccacccaaacaggttccccaatcgaccgcttttgctaatggtttgaaaaagaaggagctggttattttgggtacaggctggggcgccatatctcttttgaagaaattagacacgtctttgtataacgtgaccgtggtgtcgccaagaagcttctttttgttcacaccgttattaccctcaacgcctgtgggtacgatagagatgaagtctattgtcgaaccggttagatcgatcgctagaagaacgcctggagaagttcactacattgaggcggaagcgttggacgttgatccaaaggccaaaaaagtaatggtgcaatcggtgtcagaggacgaatatttcgtttcgagcttaagttacgattatcttgttgttagtgtaggcgctaaaaccactacttttaacattcccggggtctatggcaatgctaacttcttgaaagagattgaagatgctcaaaatattcgtatgaagttaatgaaaaccatagaacaggcaagttcatttcctgtgaacgatccggaaaggaagcgattattaacgttcgtggttgttggagggggccctacgggggttgaatttgccgccgaactgcaagattacatcaatcaagatttgaggaagtggatgcccgacttaagtaaagaaatgaaggttatcttaattgaagccctgcctaatatcctaaacatgttcgataagacgttgatcaagtatgccgaggacctttttgccagagatgaaattgacttgcaagtgaatactgccgtgaaagtcgtagagccaacctatatacgcactctgcaaaacggccaaacaaacacggatatcgaatacgggatgctggtttgggccacgggaaatgaaccaatcgatttttcaaagacactgatgagtagaataccggagcaaactaataggcgtggtctgttaattaatgacaagttggagcttctcggttctgagaattcgatttatgcaattggtgattgtaccgcacacacgggtttctttcccacggcacaagttgcacatcaggaaggcgaatacttggccaagatcttggataaaaaattacagatagaacaattggaatgggacatgctcaacagtaccgatgaaactgaggtatcacgtctacaaaaagaggttaatttgaggaaatctaagttggataagttcaactacaagcatatgggtgcccttgcgtacatcggctctgaaaccgcaattgcagatttgcatatgggcgactcatcataccagttgaaaggtatgtttgccttcttgttttggaaatccgcttatttggccatgtgtctctctatcaggaataggattttaattgccatggactggaccaaagtttactttcttggaagggattcctccgtgtag

SEQ ID NO: 3820 - DNA, 1638 bp, Saccharomyces cerevisiae
atggcaacagacctaaatcgtaaaagaagtgctacctcaggctcactgagcgtcacgaacccgaacataaaagcaactaatcgcaaaccagctagagtttatagtgtttcttctgatatagtaccgcaagcgctgacacatcccgacgaagatgtgcatctaaaaacatccaaatctcctcatgatgccgctcctagatggtcacaggtggggtttcaatctatattccatgatggttccaatgcaaggcgctcgacggattcgattgaagaggagtacagccaaggcacggagaataacgatggtcactccgaaataggttcatcaagtagtaaccgaatggaggggaacaccacgtctaatgatagtttattttcttccaactcaaggggcaataaaaggcgactgtccatcttcaccaattcaaaagataatatgagaaatcgaagcaggagcgggtcaaaaaactacggcactgttattaccggcacaagtagtaacaacataagtaggagtggctctaaattgtttcatacgaaatctaatatgagtgtgaacagtttacaatcttcactgtctacaggacattctcattcaaacaaaggcagtaatgtctttagcaaaatggcaaaaaagcttttaccctacaagccgcataattccattggtaaagacgacgttgaacccgtagttcccagcccattcagtaaatttctgcattcttcatatggtaaacataggtcacccgtacagtttatccatacttctactggaggccttattgactctggaaaatctgtatattcctttaaccctagcattaacaacaaccctaatgatacagctctatcgctgatccaagatgatgctttcgacgcgactaatgtttctttactacatgatttactgaaaaacttgccatccttgatagcaaactataaaagcttcaccgtacaggagttatttgttctggaggggaatatctggggtatatactgcagcatagttgtggagctatttaaaaacaagagggtatggcaattgccagcaaaaatagaagatattgaccggctgctggaattttatatcactttgaaaacacaaaccaaggctgccgtaacgcactcaaggtttttggccgaaatcgaggaattcattaccacttcactttacattttagagaaccagattgtgttcaattatgccaatgaggataccgtaaatacggctttgaaaagagtcggcataatctggaaggtgttttaccaacaggtttactacgacatgatggcagtgttactgcccttcgagaaaagcttccaaaaaaatagtaactactggcttgacggatatctatctgaaccttcaaggtacgcaccgtcaattgatgtccttttattaaagtgttttagagactccatcattcttccgtattacgaaagcttcctacatacaaatgacggtgccagtaagagttttcaaagatatattttcagcgaggaagaacagaacggcgtcacagaggaagataaactgacgctgctgcagtgttttgggatcctgaataccataaaaggtaacagcagaaaccaaagaattattggtgaacttcttgagggcatacgcatgagtatataa

SEQ ID NO: 3821 - DNA, 1638 bp, Saccharomyces cerevisiae
atggctagtgctgaaccaagaccccgtatgggactcgtcatcaatgctaaaccggactactatccgattgagctatctaatgcagaattactttctcacttcgaaatgctgcaagaataccaccaagaaatctccaccaatgttattgctcaatcatgtaagttcaaacctaatccaaaactaatagaccagcagcctgaaatgaaccccgtggaaacaaggtccaacattatcacttttttgttcgagctgtctgtggtcactcgagtgacaaatggtattttttttcattcagttagattatatgaccgctattgttccaagagaatcgtgttacgggaccaagccaaattggttgtcgctacttgtctctggttggctgctaaaacttggggcggttgtaatcacatcatcaataatgtagtcatccctactggcggaagattttatggtcccaacccaagggcacgtatacctcgactctctgaactagttcattactgtggtgatggtcaggtctttgatgaatcaatgtttttacaaatggaaagacatatactagacactttaaattggaacatttatgaaccaatgatcaatgattacgttttaaatgttgatgaaaattgtttgatgcaatacgaactttatgaaaatcaagttacttatgacaaacaatgctctgaaaaacgtcagtctcaattatcccaggatagtgatgccactgtagacgagaggccctaccaaaacgaagaagaagaagaagaagacttaaaactaaagatcaagttgattaatttgaaaaaattcttgattgatgtatccgcgtggcagtacgacttacttagatatgaacttttcgaagtatcgcacggcatattctccattatcaatcaattcaccaatcaagaccacggtccttttttaatgactccaatgacatcagaaagcaaaaatggtgaaattttgagtaccttaatgaacggcattgtttccattcctaactccttgatggaagtgtataaaacggtcaatggtgttctacccttcattaatcaagtgaaagaatatcacttggatctacaaagaaaactgcaaattgcatccaacttgaacatttcgagaaagcttaccatatcaaccccatcatgctctttcgaaaattcaaatagcacatccattccttcgcccgcttcctcatctcaaagccacactccaatgagaaacatgagctcactctctgataacagcgttttcagccggaatatggaacaatcatcaccaatcactccaagtatgtaccaatttggtcagcagcagtcaaacagtatatgtggtagcaccgttagtgtgaatagtctggtgaatacaaataacaaacaaaggatctacgaacaaatcacgggtcctaacagcaataacgcaaccaatgattatattgatttgctaaacctaaatgagtctaacaaggaaaaccaaaatcccgcaacggcgcattacctcaatgggggcccacccaagacaagcttcattaaccatggaatgttcccctcgccaactgggaccataaatagcggtaaatctagcagtgcctcatctttaatttcttttggtatgggcaatacccaagtaatatag

SEQ ID NO: 3822 - DNA, 1638 bp, Saccharomyces cerevisiae
atgttggctcgtactgctgctattcgttctctatcgagaactctaattaactctaccaaggccgcaagacctgccgctgctgctttggcttccaccagaagattggcttccaccaaggcacaacccacagaagtttcctccatcttagaggaaagaattaagggtgtgtccgacgaggccaatttgaacgaaactggtagagttcttgcagtcggtgatggtattgctcgtgtttttggtttgaacaacattcaggctgaagaattggtcgagttctcctctggtgttaaaggtatggctttgaacttggagcctggtcaagtcggtatcgttcttttcggttccgatagactggttaaagaaggtgaattggtcaagagaaccggtaatattgttgatgtcccagtcggtccaggccttttgggtagagttgtcgacgctttaggtaaccctattgatggtaaaggtcctattgacgctgccggtcgttcaagagctcaagtcaaagcaccaggtattttgccaagaagatctgtccatgaaccagttcaaaccggtttgaaagccgttgacgccttggtccctatcggtagaggtcaaagagagttgattattggtgatcgtcaaacaggtaagactgctgtcgccttagacaccatcttgaatcaaaagagatggaataacggtagtgacgaatccaagaaactttactgtgtttacgttgccgttggacaaaaaagatctaccgttgctcaattggtccaaactttggaacaacatgacgccatgaagtactctattattgttgcagctactgcatctgaagccgctcctctacaatacttggctccatttactgccgcatccattggtgaatggttcagagataatggaaagcacgctttgatcgtctatgacgatttgtccaagcaagccgtggcataccgtcaattatctttgttgttgagacgtcctcctggtcgtgaagcctaccctggtgatgtcttttacttgcattcaagattgctagaaagagccgctaagctttctgaaaaggaaggttctggttctttaactgctttgcctgttattgaaacccaaggtggtgatgtctccgcttatattccaaccaatgttatttccattaccgatggtcaaattttcttggaagctgaattattctacaagggtatcagacctgccattaacgttggtttgtccgtttctcgtgtcggttccgctgctcaagttaaggctttgaagcaagtcgctggttccttgaaattgtttttggctcaatacagagaagtcgctgcttttgctcaattcggttccgatttagatgcctccaccaagcaaactttggttagaggtgaaagattgactcaattgttgaagcaaaaccaatattctcctttggctacagaagaacaggttccattgatttatgccggtgttaatggtcatttggatggtattgaactatcaagaattggtgaatttgagtcctcctttttgtcctatctaaaatccaatcacaatgagcttttgaccgaaattagagaaaagggtgaattgtctaaagaattgttggcatctctaaagagtgctactgaatcatttgttgccactttttaa

SEQ ID NO: 3823 - DNA, 1641 bp, Saccharomyces cerevisiae
atgaaccactcagaagtgaaaactgggttaattgtcactgcaaagcagacatattacccaattgaattgtccaatgcagaactactaactcattacgaaaccatacaggaatatcacgaggaaatctctcaaaatgtgctggtccaatcttccaagacaaaaccagacataaaattgatcgatcagcaaccggagatgaatcctcatcaaactagagaagccatagtaacatttttgtatcaactttcagtgatgactagagtaagtaatggtatcttcttccacgctgtcaggttctacgatcgctattgctctaagagagtagtgttaaaggaccaagctaaactagttgtaggcacctgcctttggttagcggccaaaacttggggagggtgcaaccatattataaacaacgtctccatccccacaggtggtaggttttatggtcccaatcctagagctcgtattccacgcctttctgaattggttcattattgcggcgggtccgatttattcgatgaatcaatgttcattcaaatggaaagacatatcttggatactctgaactgggacgtttatgagcccatgattaatgactacattttaaacgttgacgaaaattgtttgatacaatatgaactttacaaaaaccagttacaaaataacaatagcaacggcaaagaatggtcctgtaagagaaagtcacaatcttctgacgacagtgatgccacagtggaagaacatatcagtagttcaccgcaaagtactggactagatggcgatacaactaccatggatgaagatgaagaactaaattccaaaattaaattgataaatttgaaaagattcttaattgatctgagctgttggcaatacaacttgcttaaattcgaattatacgaaatatgcaatggtatgttttctataataaacaaattcactaatcaagatcaaggcccttttctctctatgcccattggtaatgatataaactcaaacactcaaacgcaggtattcagcattatcatcaatggcatagtcaattctcccccatctttagtcgaagtttataaggagcaatatggtatagtacctttcatattacaagtaaaagattataacttggaattacaaaagaaactgcaactggcctctacaatagacctaaccagaaaaattgctgtcaattctcgttactttgaccaaaatgcctcttcatcatcagtttcttctccaagcacatattcttcgggaaccaattatactccaatgcgaaacttcagtgcacaatcagacaacagtgttttcagtactaccaacattgaccattcatcgccgatcacccctcacatgtacacttttaatcagtttaaaaacgaaagtgcttgtgacagtgccataagcgtaagcagtctacctaatcaaacccaaaatggtaacatgccattatcaagcaattatcagaatatgatgctagaagaaaggaataaagagaatagaattcccaactcatcatccgctgaaataccacaacgtgccaaatttatgacgactggtatattccagaacacaggagaacttactaatagagcgtcttcgatatcgctatcgttaaggaaccacaatagctctcaactgtga

SEQ ID NO: 3824 - DNA, 1641 bp, Saccharomyces cerevisiae
atgctacggtctactatatctctactgatgaatagtgctgctcagaaaacgatgacgaattctaattttgttctaaatgcacccaaaatcaccttaaccaaagtggaacagaacatctgtaacttgctgaacgattatacagacttgtacaatcaaaagtaccacaataagcctgagccattgactcttcggatcacgggcggatgggtgcgtgacaagcttctgggacaaggttctcacgacttggatattgccatcaatgtgatgtcaggtgagcaatttgctactggtttgaacgagtatttgcaacaacattacgccaaatatggagccaagcctcataatatccacaagattgacaagaatcccgagaaatccaagcatctggaaactgccactactaagctctttggcgttgaagtggattttgtcaatttaagatctgaaaagtatactgaactttccaggatacctaaagtgtgctttggcacacccgaggaagacgctttaagaagggatgctacattgaacgctcttttctataacattcataaaggtgaagtggaagatttcaccaagagaggtctgcaagatctaaaagatggcgttctccgtactccgcttcctgcaaaacaaacatttttggatgatcccttgagggttttgaggttgatccgttttgcttctagattcaactttaccatagatccggaagtgatggctgaaatgggcgatcctcagattaatgttgcattcaattcaaaaatttctagagagcgagttggtgtggagatggagaaaatattagtaggaccaacccctttattggctttgcagctgattcaaagggctcatcttgaaaatgttatctttttttggcataatgatagctccgtcgtaaaattcaacgaagagaattgtcaagatatggacaaaattaatcatgtatacaatgataacatactaaactcacacttgaaaagttttattgaattatatccaatgtttttagagaagcttcctatcttaagggaaaaaattggtcgttcgccaggatttcagcaaaattttatattgagtgcgatcctgtcccccatggctaatttacaaataatcgggaacccaaagaagaaaattaacaacctggtttcggtgacagaaagcattgtgaaggaaggattgaagctgagtaaaaatgatgcagcagttattgccaagaccgtagattcaatatgttcatatgaggaaatacttgctaagtttgcagatcgttcccagctaaaaaaatccgaaatcggtatatttctacggaactttaatggcgaatgggaaacagcacattttgcatctctatcagatgcatttttaaagattcccaagcttgaaactaaaaaaattgaattacttttccaaaattacaatgaattttattcttacatatttgacaataatttgaataattgtcatgaactaaaaccaatagtggacggaaaacaaatggcaaaactacttcaaatgaagccaggtccatggctgggtaaaattaataacgaagcgattaggtggcagtttgataatcctacagggactgatcaagaattaataactcatttaaaagccatactaccaaaatacctgtag

SEQ ID NO: 3825 - DNA, 1641 bp, Saccharomyces cerevisiae
atgcttagtagatcactaaataaagtagtcacatctataaagtcgtcttcgataatcaggatgtcatccgctaccgctgctgctacttctgctcctactgctaatgctgctaatgctctaaaagcttcaaaggctccaaagaaaggtaaactacaagtgtctttgaaaacacctaagggtacgaaggattgggctgatagtgatatggttatcagagaagccatttttagcactttatctggcctattcaagaagcatggtggtgtcactatcgacacacctgttttcgagttaagagaaattttagcaggcaagtatggtgaggactccaaactgatctacaacttggaggaccagggtggtgaattatgttctttacgttacgatttgaccgttccttttgccaggtacgttgccatgaacaatattcagagtatcaagaggtatcacattgcaaaagtctacagaagagaccaaccagccatgactaagggtcgtatgagagaattttaccagtgtgattttgacgttgcaggcacattcgaatctatggttcctgattccgaatgtttgtccattttagtggaaggtttgaccagtttgggaatcaaagatttcaaaatcaaattgaatcacaggaagattcttgatgggatcttccaaatcgctggtgttaaagatgaggatgtgaggaaaatctcttctgctgtcgataagttggacaaatctccatgggaagcagtcaagaaggaaatgaccgaagaaaaaggtcaatccgaagaaactgctgataaaatcggtgagtatgttaaattaaatggttctttgaaggaaattcacgctgttctatccgcagatgccaacattacttcaaacgaaaaggctaaacaaggtttggatgatattgctactttgatgaagtataccgaagcatttgacattgactcattcatctcttttgatctttctcttgcaagaggtttggattactatacaggtttgatctatgaagttgttacttctgcatctgctccaccagagaatgcttcagaattgaagaagaaggccaaatctgcagaagacgcgtcagaattcgttggtgtcggctctattgcagccggtggtcgatatgataatttggtcaacatgttctctgaagcttccggcaaaaaatctactcaaattccatgtgttggtatttcatttggtgttgaaagaatattttctttgatcaaacaaagaattaattcctctacaactataaagccaacggctacacaggtgttcgttatggcttttggtggtggtaaggactggactggttatttacccgaaagaatgaaggttactaagcaattatgggatgctggcattgaagctgaatatgtctataaggccaaggctaatcctaggaagcaattcgatgctgctgaaaaagcgggttgtcacattgccgtaatcctcggtaaggaggagtacttagaaggtaaattacgtgtcaaaagattgggccaagaatttgccgatgatgatggtgaattggttagtgcggctgacattgttcctattgttcaagaaaagttatcacaaattcatgaagatggtctaaatgaggtcactcgtttaattaaaggattataa

SEQ ID NO: 3826 - DNA, 1641 bp, Saccharomyces cerevisiae
atggaaccgctgctttttaatagtgggaaagcaaatccctctcaagatgttttcatagatgtggaagttggtgatattaccacaaaatatggttccacaaatactggatcattcagttcgatggatactgtggaagcgcaggcgataaaggcagagacggcaagattcatggaagttccacagggaagacatttaggtgtgttctccacggttgtgttatttgtttcgaggataatggggtcaggtatatttgcagtacccagtgtgattttactgaatacaggtggtaataagctgatatattttgcgatctgggtttttagcgctgcgatcgcttttgcaggattgtatctttttctagaatttggttcctggataccgaaatcaggtggacgtaaaaacttcctcgaacggagttttgaaagacccagactattaattagtgtggtgttttcgtgttacagtgttttaactggctatgcattgacgggatctatcgtcttcggtaaatacgtgttgagcgcatttggagtcacggatgattcgtggtccaagtacgtcagcatatcatttataatatttgccgttctcattcacggtgtctctgtaaggcacggagtgtttatacagaacgcacttggtggtttgaagttgatcatgattgtcttgatgtgctttgccgggctatacacgcttttcttttataaaagcaccggtcaagttgcctgggacctcccagtaacccaagttgagaaagattctctcctgtcggtgtcctctattgctactgcctttatcagctcattcttttgtttttctggatgggatacagttcacacagttacatcagaaattaagaatcccgttaagacgttgaaggtgtcaggtcccttatcgttgataatttgttttgtctgctacacaatgatgaatgtggcatacttgaaagttttgacatatgaggaaattgttagtgcaggccccctggttggttccgtgttgtttaccaaacttttcggacccagagttggtggcaaattcattgctttttctatcgccatttctgcagcatctaatattctggttgtcatttacagtatatcaagagttaaccaggaaatattcaaagaaggttatttaccattcagtattcatatgtccaaaaattggccatttgatgcacctctaccatctatttctttatgtggctttataaccattgcttggatattgattttacccaaagagggcgaatccttcaattatctggtatcgatggatggttatggtaatcagtttttcttattattggtcgctattgggctctttatttggaggttcaaacacaagaacgaagtcccagagattcgtgcatctacttttggagtattagccattattacattatcattatacatgttgatggcaccattctttgccgaccctagcctaaacagagttgggttcctgccgccctaccaaatcatgtcattactggtaatagttgcatgcttctttttctggttagttaaattcgttttactacctaaattcttccattataaacttttacccaaaatcacttatttgcatgatgggctcattgtcacagaatgggtgaaaaagccatgtctgtgttag

SEQ ID NO: 3827 - DNA, 1641 bp, Saccharomyces cerevisiae
atggcatccccaggatcgacagcattaccacacaagcgacaaagagtccgaaaggcttgcgtgccctgtagggaacgtaaaaggaaatgtaatggcaaatctccatgtgaaatgtgcgttgcctatggatatgtatgtcattatattgacggtcgtgtcccttcggcatcacctcaagtgcaacaagtaggtgaaacatctcctgatacggagagcagaccttttgttcttccgggtatacatagaaacgaacaaccgcagcctataaatacacagaacgttacaagtcaaaacattgtagatccaactaagtctaggtacacgatccagcactctgcagttgctttcccccgctgtcttggtctcgaactccgatcaactaatcctccacgcctacattccttcgcttggcattgcggaatcagaccggaagaaaatccaaactcacatgtccttctttctgatttagttacaaaggaagagtattaccgtatctcaaaagtttatttttcagttgttcacccgatatttgatgttgttaatccagagcaactggcaaagaatgttgaaaaatactgggatggcgacgtaaaaaccttagagtatggggctgttattgcaggggtgatagctttaggatcattttttatgggaagtcttggccatccccgagagatggatatagtacaatatgccaaagggatccttgatgacccgactttcagtcgcattcccacggtggagcaagtctccgcatgggttttgcgcaccatttacctgcgagccacttcgaggccccatgtagcatggttagctagctgcgtaaccatccatctttctgaggcaattggcctgcatcatgagattgacagagaggatatagcgatatcgaacaacgttccaccaaaaagaactactgtagtgagcgaacacactagaagattattttggtgtgcatggtcaatcaataccattctttcatatgactatgggcgctcaagtgttacgctgaatagaattacttgcaagccagttaaggagacggacggtaattttacagctcatttagtcgcgttagcacacctgattccccaagacagcgtgaacgcaaacgcagcgcaattgttgcaggccctggcggccgttcatgaatcaccaaacgcacatccgtttttgtcgttgaccaagggtgatatatgcctctctttgtatagaagacttcgtttgctgaatcatattcttgataaaaatgttgttttacaaataattgatatcggcaacactgcgctatcagcagcatacgctcttgtaaaactggatcaagcatggtggaatgtgttgagcacctcattccagtacgtctgtgtccttcttgccatcgacacaccggaaagtctttcacatgttgctactgccatgaaaacgttagataatattactcaaattctcggtacacgtattgcttttgaagcacaaaagaccgcaaaactgcttcttgaggattccatgaaaaaaaaaagacaagaaattcagcagcttgagcaggcaactcaccagagatctaatcttgaaactactcacctactcgatattgactgggatgctttgctagatccatcagacacgttaaactttatgtaa

SEQ ID NO: 3828 - DNA, 1641 bp, Saccharomyces cerevisiae
atggtggttttggctgcttctatcactacgcgtcaggggaaacctctcttgtccaggcaattcaaagatctgtccaaggatcgagtcctagagttgctgtccaatttccagaacctagtctccgagatctcgtcagaccacacatttgtcgaggacaagcacgtccgctacgtgtataggccctttgataactactacattattcttatcacaaaccgccagtccaatattatcaaggatttggccacattaaatctgttttcacagacgatcaactcctacttgtctagtttccaagaccaagagatttttcacaatgcctttgagatcttgtcctcgttcgacgaaatcgtgtcaatgggcgggtacaaagagaacttgtcctttactcaagtgcaaacatacttgtctatggagtcgcacgaagaaagaatccaggaaattattgagcgtaataaagagatcgaagctactgaggagaggaagcgccgtgctaaggaaattgctagaaaagaacatgaaaggaaacacgggtttatgtcttcaaatggcgattacgacggcgccaataggttcatgggaagtaaagatcctaacgttacaaacgccatcaacagttactactcccatgcttctcctgcagcacaacagtcttatctacaaagttcccatgccgctgctgctgaggtggccccagtggcctccccaatggctacgtctcagcgtgcgggacattctgctactggcggtatgaaattgggtggtggtgccggaagaagagcgggtgccgcaccacggccaagtgcaatttcttcagcctcttctggcactccacctcctccggaggaggatgtcccagagaacaatggtattttgatctctatcaaggaggtaatcaatgcagaattctccagagatggtaccattcactcttctgaattgaaaggtgttttagaactaagaattaatgaccatgacttatctcactcgaacctaaaactagctgattctattgacgttcgcgataaatccttccagtttaagacccatccaaacatagataaacaatcgttcctatccactaaacttatctccctgcgtgataaatctaaggctttcccagccaacgaccaaagcctgggtgttctaagatggcgtaaagtcgctcccgcagaagatgactcattaattccattaactctaactacatgggtttccccctccgaatcacaacagggctttgatgtcattattgagtatgagagcgtcctggaaacagaactcgctgatgtgatcttcaccattccagttttccctcaggagccagtagacataaatacagagtcttctacatgctctgacgctgaagttgtcaacatggaccaagaaatgggaacctccattaagattagcaaaattgctgccaacgatgcaggtgcgctagcattcactatcgaagctccatatgaagatgcattgtacccaatgaccgtttccttccaagagtccacgagggataaattagctaagagtttcaccggtatggccatacaatctgttgtcatggccaatgaccacgatcaagagctcccttacgacgtcatcacctctttgaaatcagatgaatatcttgtccaatag

SEQ ID NO: 3829 - DNA, 1641 bp, Saccharomyces cerevisiae
atggttagttcaagtgtttccattttggggactagcgccaaggcatccacttctctaagtagaaaggatgaaattaaactaacccctgaaacaagggaagctagcttggacattccatacaaacccattattgcatactggacggtgatgggtctctgtctgatgattgcctttggtggattcatttttggttgggatacaggaaccatttcagggtttattaaccaaacagatttcaagagaaggtttggtgagttacaaagggacggcagttttcaactatcagatgtcaggacagggctaattgtcggtatcttcaacataggttgtgctttaggtggcctaacgctgggacgcctgggcgatatttatgggcgtaaaatcggcttaatgtgtgttatactggtgtatgttgttggtatcgtgatccagattgcttcctctgacaaatggtatcaatattttattggtagaattgtttctggaatgggtgttggaggtgttgctgtgctgtcgccaactttgatctcagaaatttccccaaagcacctaagaggcacttgtgtctctttttaccagctaatgattacccttggaattttcttgggctactgtaccaattatggtacaaagaaatattcaaattcaatacagtggcgggttcccttgggtttgtgttttgcgtgggcaatctttatggtgattggaatggttatggttccggaatcgcccagatatttagtagaaaaaggtaagtatgaagaagctagaaggtctttggccaaatcaaacaaggtcacagttactgatccaggcgttgtttttgagtttgatactatagttgcaaatatggaattagaaagggctgttggaaatgccagttggcacgaactcttctcaaataaaggagcaattctaccaagggtaataatgggaatcgttatccagtcactgcaacagcttactggctgtaattattttttctactacggcacgaccattttcaatgctgttggaatgcaagactctttcgagacttccattgtccttggggctgttaattttgcttctacatttgttgcactatacattgtggataaatttgggcgtcgaaaatgtttattgtgggggtctgcctcgatggcaatttgtttcgtcatattcgccaccgttggcgtcactagattatggccacaagggaaagaccaaccttcttcgcaaagtgctggtaatgttatgatcgtttttacttgtttcttcattttctcttttgccattacttgggctcctatcgcctatgtcattgtggcagaaacttatccattaagagttaaaaatcgtgccatggccattgcggttggtgcgaactggatgtggggtttcttgattggatttttcacaccctttatcactagatccataggattttcttatggctatgttttcatgggttgcttaatcttttcgtacttctacgttttcttctttgtttgcgaaacaaagggattaactctggaggaagttaatgaaatgtacgaagaaagaataaagccatggaagtccggaggttggattcccagttctagaagaacaccacaaccaacaagcagtacaccattagttattgttgatagtaaataa

SEQ ID NO: 3830 - DNA, 1641 bp, Saccharomyces cerevisiae
atgtcattgcaattgttgaatccgaaggctgaatcgttgagaagggatgcggctttgaaggttaacgtcacatctgctgagggcttacaatccgtcctagagaccaacttgggccctaagggcacgctaaagatgcttgtggatggtgctggtaacatcaagctgaccaaggacggtaaagtgttgctgaccgagatgcagatccagtcgcctacagcggtactgattgctagggcagctgccgcgcaggatgaaatcacgggcgatgggaccacgacggttgtgtgtcttgtgggtgaattgcttagacaagcgcaccgtttcattcaagagggcgtgcatccgcggatcatcactgatgggtttgagattgcgcggaaggagtccatgaaatttttggacgaattcaagatcagtaagacgaacctttccaatgatagagagttccttctgcaagtggcccggtcgtcgctgctaaccaaggtggacgctgacttgacggaggtcttgacgcccattgtaacggatgcggtgctaagcgtgtacgacgcgcaggctgacaatttggatttacacatggttgagatcatgcagatgcagcacttgtctcctaaagataccacttttattaagggtttggtattggaccacggtggtaggcatcctgacatgcccacccgtgtgaagaacgcgtatgttttgattttgaacgtatctttggaatacgagaagactgaagttaactctgggttcttttacagttctgcggaccaaagggacaagttggccgctagtgagaggaagtttgtggatgccaagttgaagaagatcatcgacttgaaaaacgaagtttgtggcatggatccagacaagggttttgttatcattaaccaaaaaggcattgaccccatgtctttagacgtgtttgccaaacacaacatcttggctttgagaagggccaagagacgtaacatggaaagattgcaattggtcactggcggtgaagctcagaactctgtggaagacttgtcgcctcagattcttgggttttctggcttggtctaccaagaaaccataggcgaggaaaaattcacatacgttacagagaacactgaccccaagtcttgcaccatcttaatcaagggctccactcattatgccctcgctcaaacaaaggatgcggtgagagatggtctcagagctgtggcaaacgttctcaaggacaaaaacatcattccaggcgctggtgcgttctacatcgccctttcgagatacctaagatctgccaacatgaacaagttgggtgccaagggtaaaacaaagacaggtattgaggcgttcgcagaagcattgctggtaattccaaagactttggtgaagaactcaggattcgacccattggacgtgctcgcaatggtggaggacgagttggatgacgctcaggattctgacgaaacgagatatgttggtgtggacttgaacataggtgattcttgcgaccctaccatcgagggtatttgggattcctaccgcgtactaagaaatgctattaccggtgctacaggtattgccagcaacttgttattatgcgatgaattgttaagggcaggtagatccactttgaaagaaacaccacagtaa

SEQ ID NO: 3831 - DNA, 1641 bp, Saccharomyces cerevisiae
atgtctcaagtgcaaagtcctttgacagcaacgaactctggtttagctgtcaataataacacaatgaactcacaaatgcctaaccgtagcaatgttagattggtcaatggtactttacccccatccttacatgttagctctaacctaaatcacaacactggcaatagctctgcctcctattctggctcacaatcacgcgacgattccactatagtcgggctgcactataagataggtaagaaaatcggtgaaggttcatttggtgtactttttgaaggtacaaacatgatcaatggattaccagttgctatcaagtttgaaccaagaaaaacagaagccccacagctaaaggacgaatatcggacctataaaattttagcgggaacacctggtataccacaagaatactactttggtcaggaaggattacataacatattggttattgatctgcttggtccttctttagaagatttattcgattggtgtggaagaagattttcggtaaaaactgttgtacaagtcgcagtacaaatgataactttaattgaagatttgcacgctcatgatttgatataccgtgatattaaacctgataattttttgatcggaagaccgggtcaaccagatgctaacaaagttcatctaattgactttggtatggccaaacaatatcgtgatccaaaaactaaacaacatattccgtacagggaaaagaaatcattaagtggcacagcaagatacatgtcgataaatacacatttgggtagagaacaatcgagaagagacgatatggaagctatgggtcatgtcttcttttatttcttgagggggcagctaccatggcaaggtttgaaagcaccaaataacaagcaaaagtacgaaaaaattggcgaaaagaaaagactaacaaatgtttacgatttagctcagggtctcccaatccaatttggtaggtatttggaaatagtcagaaatttatcgtttgaggaaactcctgattatgagggctaccgcatgttacttttatctgtgttggatgatttaggtgaaacagcagatggacaatatgattggatgaagctgaatggtggccgtggttgggatttgtcgataaacaaaaagccgaacttacatggttatggtcacccaaatccaccaaatgaaaaatcaaaaaggcatagaagtaaaaaccatcaatattcatcacccgatcatcaccatcattacaatcaacagcaacaacaacagcaggctcaggctcaagcacaggctcaagcacaagccaaagtgcagcaacaacaattgcaacaagcccaggcccagcaacaggccaatcgttatcaattacaaccagatgactcgcactatgacgaagaaagagaggcgtcgaagcttgatccaacttcgtatgaagcatatcagcaacaaactcaacaaaaatatgctcagcaacaacaaaagcaaatgcaacagaaatccaaacagtttgccaatacaggtgccaatggtcaaactaacaagtatccatataatgcgcaaccaacggcgaacgacgaacaaaacgctaaaaacgcagcgcaagatagaaatagtaacaaatcatcgaaaggttttttcagtaagctaggatgctgttag

SEQ ID NO: 3832 - DNA, 1644 bp, Saccharomyces cerevisiae
atgacgaaaataaccagagatgtttcgataacgacagaaaattcaaaatccacatctggatcggcaacggcttcatccgcatctttacctgagaacgaccacccaatattccatcaaccgcgagcaagaataagatctggttcgctgttcatcgaaggatctgattcatttccatcatcagaagtgaagtcatacaatgtttatattgatgatagcaagtatagtgaaatcctcaaaggagatacaaattcaagtagtactgatggtaaacaagtctttgaagatgctagagatgacaatttccatcaggaatcacatagagatctagaggattcaattttagatttagtacgacgagatccagaagtagcagcattccctttacctccgccaaattcaaatgagaggaacagaaattcctcaaacgggtcttccgctgaaactaacctaaatggacacagcagcagcggtaccatctctacttcggtgctgttgaatatgggttcggcagaaaagcacgctgggacgaccagaggagatcatatggaatcatcttcaatgaaatccttcgagaaactgggaaccagaccttcttctttattctatccaccacccgaaggaactgcgccgtaccagggaccaagggctaccgtctccggaaataagtctacaaggcaaacacaaggtacatactcatttccttctatgcggtatggtgtagatcttgtttctcctgtggaaggggctgttgatgtagcaaaaagcagagttcctaacagcacgctaaatggtacttttcccgataaagcgtttatcccacatgaatttcaaattcctaaaaaggcctggaacagaataccagcgaataagtccactagcctcaaaaccccaagaaaccattccctattaattgacatattaaagccttttgaagcagctgaccttgctaatgaccagcgaagttcttccgctgttttaaaaaatacagtgcattctaatgggcagtataatccaactaatgaaacctctggaactcgaatgcaagatcaaaggcagaagaataccaacgaaattgatttagagaaaattcctaatcctcaagtccctcttggtatcgcaatggacaccatgcgtagtccaaaccaactacacgaaaaggaatacgaaagtaatatagaagctggtttagcttctggggtcggaaaaggtgacaatagtattaagcaacatcaatataaaaaaattcctcaagaaattgatcgagatcagcaattaagttttcaaatggaaacaatgcccattcaaagaatagattcctcctccatacgttcatttgattcccgaatatatggcttctccgagatttatagtattccaagggttataactacactgtgcatctgcctttttgttccgcccttattctttttcttttcaatcaatggaaataatggcgtttcaaattatagattaatgagaatgataatgaattatgaacatagaatcggcctcctcaaagggtttgaatgggacattgacgtacaatggttcaggacattgtgctttgtattaggatgtatagagatgttagctatctttgctagcataggaataggatttggtgtgggaataataagagagtaa

SEQ ID NO: 3833 - DNA, 1644 bp, Saccharomyces cerevisiae
atgactaaatcggttggtgatgaagagtcacagtacattgaggaccctagttttgcagcagcagctgcatttactggcggcagggacggggtttcgtacagtaatcagcgatttgctgagggttccggccattcttctgacttagcaaagtcattagaagactatcggcctcctgatgaaaagccgtcctcattgtcatctgtgggggaaggtggcgctaatgaggaagagaagggcggtaacgacggcggtcccttggcaagaattcaaacagggcttttttctccaagactgcgaaatcataggaaaaagattctctcgaagtttgttttgaacaacttcttcattgcttgtgtgtgtgtatcgctcatatcgatttactggggtgcctgttacggaacagatcgttactttttcaaagtgaaaaatattgttgtattgcaggatgcgccatctaatacttcagttcaatctatttccgcgatcataccctcattgttagcgtctgtccccgggacatggcatatatacaacgcaacatcatttcataggaaatttggtacgacgaactccaccgaaattgacagaaagatagtcgatttaatttacgatgagagatactggctggcgttaaacgttaaacctaatgctacagacactttgtataattctttgattagccaagacgcaaactcggagttcaattcatcaattttttttgaatccgtgtttgaaagtggtcgtgacccatcgagtgttaaatcgaccattctaccactcatgcaacaattggaggtccgccttcagaaatattacgtcaaggaatatcttccctcattgatgagcaacatcacttctaatgacagagatcttaatataaacatggagaactgggcgattgcaggacagttgttgttcacctacaacgattatcgtccctttgctgatcgtattctaatggcccctctgcaggtcggtctgatttattgtattttgttaaccgttttacaactgtcattatatggtaagttgcacggagaaatggccagagttctgaagccaaagcatattttaatctacaggcttctaatttcctgggcaacttattttcttctttccattggattctgtaccgtatctgcaatttttaggatcgatttcacccccgcctttggcagaggaggattcgtagtatattggatgtctacgtggttggtaatgatggctgttggtggtgccaatgaaaacgttctcagcttagttatagcttactgccctccatacctgagtatttggttgatgacgtggatcatattaaatatttctgcttcattctacccaatggttttgaacaacgaattttacaggtacggctacataatgccaatccataatgccgtggatatctataaagtgatttttttgaatttaaccaaaagaaaaatgggaagaaattacggtattctcgtggcatgggttgccctcaatacatccttgatgccattttgtatgaagtttgcaggtaaaaaaatgcaaaaaaatgctatgcaagcagcagaagccgctgtcgcagcagctacccagcgtgctagccgcccggcagaggccaatactgataaaaataacaacccgcccggaaattaa

SEQ ID NO: 3834 - DNA, 1644 bp, Saccharomyces cerevisiae
atggtaaagaaacaccaaaatagtaaaatgggtaatacaaatcactttggacatctcaaaagttttgtgggaggtaacgtggttgcccttggtgctggaacaccttatcttttctcattttatgctcctcagctactgagcaagtgccacatacctgtttctgcctcaagtaagctatccttctctttaacaataggaagctcactgatgggaattttagcaggaatagttgtcgatcgaagtcctaaactgtcctgtctaattggttcaatgtgtgttttcatcgcgtatttgattttgaatttatgctataagcacgaatggtctagtacttttctcatatcgttaagtttggtactcattggatatggttctgtctcaggtttttacgcttctgtgaaatgtgcaaatacaaattttcctcaacacaggggtacagctggggcatttcctgtgtccctatacggtttatcgggcatggtgttctcatatctttgctcaaagctttttggtgagaacatcgagcatgtcttcattttcttgatggttgcgtgtggttgcatgattttagtaggctatttctcattagatatattctctaatgcagaaggagatgatgctagcattaaggaatgggagcttcaaaaaagcagggaaacagacgataatatagtaccgttatatgagaacagtaatgactatataggttcacctgtgcgttcatcatcccctgctacctatgaaacttatgcattgtcagacaattttcaggaaacgtcagaattttttgcacttgaggatagacagttatcaaatcgaccattgttatcaccttcttccccacacacaaagtatgatttcgaggatgagaataccagcaaaaatacagtgggcgagaatagcgcacagaaaagtatgagattacatgtattccaaagcttaaaatcttcaacatttattggttactacatagtattgggtatactacaaggcgtgggtttaatgtacatatattctgtggggtttatggtacaagcccaggtttctactccacccttaaatcaattaccaattaatgcagaaaaaattcaatcattacaagtaactctcctgtctcttctttcattttgcggcagattatcatctgggcctatatcagattttttggtcaagaaattcaaagctcaaagactatggaatattgtcatagcatcgcttttggtatttcttgcatcgaataaaatatcccatgacttcagcagcattgaagatccttctttaagagcctccaaatcattcaagaatatttcggtatgctcagcgatcttcggttattcttttggcgttctatttggtactttcccctccatagtagcagatagatttggcacaaatgggtatagtacgctgtggggtgttttaacgactggtggtgtattttcagtgagtgtttttaccgatatattaggtagagatttcaaggcaaatacaggagatgatgatgggaactgtaaaaagggagtgctttgctacagctatacttttatggttacgaaatattgtgccgcttttaatcttttgttcgttttggggataattggatatacgtactatcgaagaagagcaactgcaaattccctgtag

SEQ ID NO: 3835 - DNA, 1644 bp, Saccharomyces cerevisiae
atggtccgattaaatcatgcagcatcatattttatgcctattttctgctccacaaggcctcacatagtgatactttctgcgctgtttagtatttcactgttttcactattctatgcgtcgtccgaattactgctacaccagtatgatgatccattgatgttcaaaccaaattcgcaggactatttcaggacctttcttttggggcttttttcaccatttctttattatttcctgaagacctttctattcaatataaatcaaaggtttttaatattgaacctgatagtggattttcctatcaacgacgtctttatgcttttgatactgattggtttagcgtaccctcaggtgcaagatcacgaaggcggtacgatcaagcataaggaatgttcttggcacatcattccaagacaagcctatatctttggtatatcatgggccctgggtgaattcaccatatgcataatagggaatttgtttaactaccaagaaatcgccgatccaaacattaatagtggcttcacacaccaggaaagcgccaacacttactgtaacaataatgatatgagccataacgatgactgcggttgtagtacagaatatcgccccaacgtcgtagacagaagtgatattacgttgtccaaatgtattgaagtaagaaatgactcatcttccatatcgaataacgtatactcgtctgagtaccatccaatcaaacctctacgttcatcgtcatcaacttatggcagcatacgacagcaacctcatgaaaataagaagcagctgcatgtaccagataattcgcaggacgatacaattatcatgatgaaccccatcgacaattcattaaagttgacaactctagatacgggtgatttgagtttccccatagacgaagaacagcccattttgaagaaatcttttggttatacatgggcagttcctaatgaaaatacacaaaatactactaaaagcttcacaccgataaagagatttattgcatttagcacggcataccagttggtcaccggtttattgttaatgatattggtagttggtagtaatatcatgttgacaattggggaatcattgattctgtcgatgtatttcgtctatgttcgcggccatgaaggattatttactcccgtggtgaactacttcggctcaagaaccatttcaaatttcatcttatgcgtaataattcctttcatatctctaaacttcctcatcaacacttcgatatatttaagaagagagctagacgattggtttaataattcacagggggagtttgaggacgacgacgaaaatactatcagtaagagagtagctacaaatcaagagtaccaacatccactgagtgctaattacatttcgatggatagtcctgatgtaataaatagcagcccgggtcacttcgggatgaattcaggccagttgttaggtaatacgacgttatattatggtagtttaaatggggatgatgatgatatgaccaacgactccgctttactaagattctgcaagaagctagtcaaaaattggagggctttggcaagaaatgattcttttgtacttggagtaatggtttcttggagtcttcttgtttttgtaacgggaatactttcaacagtttatatatag

SEQ ID NO: 3836 - DNA, 1647 bp, Saccharomyces cerevisiae
atgatagtgtggcaagcactattcgtggtttactgcctatttaccacttctattcacggtttattccaagacttcaatcctttcgcaaataagaatatttccttaaagtttcccagcctaaatagatgggagaaaaacgttatggctactggtcaacaaacaatcatcaattcggatagcatttatgaatggaccccgatcttatctaacataacagcgggcaaaaaagacagttttgtatttaccattgacgcagaagcctccggttatgggtttgctcccacgtatgaagtgttaatgtttattagcggcaatatatgccaaatgcccatgaatagatcagatgtggatttaacaatatactactcttttaatgaaacggttttagagaacccaaatataggtcaaagtgcagtttttcaggatggctacatccaagcattagccatcagtccagtgcagtcttctagctcgaacgctacctccacgtattcaaatctttatgtggtcgctgagctagtgaattccactacggagcaacctctgtccagttccgacgcctctgaaaattgggaatatagactgagtatctctgagaacgatttggtttttcagtgggatgtaaggccttgggtagaggtcctggacactgatatgaattctgcattactatcaacggggaatgtcaccgcagacgccaaagtttatcacaattattcaatatatgatccatccttgtacgatctgtatgtttactcgtacgaagattctgttcaactaaaccaaaactataatttatctctttgtgctgtgaaaaatggaccatatttagtgtcttcccaaaatacatcaaatgcaacagttacgtcaaatagtacaaatcctttagagcgtactgacttggcgattcaaaaaaaaattacagaatatggtggtagcgtgacagaaatgttttacgtgacaggactgaatgcctcaacaacttatgtagcgtacctgacaaagaaaatcagtaatggtgatgggttgtcaagtgtgggcggcattttattttcacatgtttattttaccacaagaagtaccgatgtctgctctttgatctttggtttggacttctgcagtgacgtcgcttactctgttcctacatcctcattttctgtgggtaataaaactctcatggcgcagacatatgaccacattgcagaggcactatatgcaaattttagcaaagctctacagttaatatcctgtgacgcagacaaagacgcaagatattctccggtcatgacttgtgacgattgtgccgaagcttatcgtgattgggtatgtgcagtatcaattccgagatgcaccacgacgtcttcccaatactacatccacagagataaaagtcacaaccgtaatgattatttgaataaatttattaaacctttggatgactattacgaaattctaccttgtattgacatgtgctatacattagtacgaaattgcccaagcgattttcaattttcctgtccgaatgatcttactacggaagatcttctttatcaaagttacaatttctatatggacactgactactcaacctgtaattatataggtaactcatccttgatggtaattcatccattggacgatacgtag

SEQ ID NO: 3837 - DNA, 1647 bp, Saccharomyces cerevisiae
atgcaacgctccatttttgcgaggttcggtaactcctctgccgctgtttccacactgaataggctgtccacgacagccgcaccacatgcgaaaaatggctatgccaccgctactggtgctggtgccgctgctgccactgccacagcgtcatcaacacatgcagcagcagcagcagccgctgctgccaaccattccacccaggagtcgggtttcgattacgaaggcctgatagattccgaactgcagaagaaaagacttgacaaatcgtacagatatttcaacaatatcaaccgattggccaaggagttccccctagctcatcgccagagagaggcggacaaggtcaccgtttggtgttccaacgactatttagcactttccaagcaccctgaggtattggacgccatgcataaaactatcgacaagtatggttgtggtgccggtggtacaagaaacattgctggccataacatccccactttgaatctggaagccgaattggccactttacacaagaaggaaggtgccttagttttttcgtcatgttacgtagccaacgatgccgtcttatccctactgggtcaaaagatgaaggacttggtgattttctccgacgaactcaaccatgcgtccatgattgtcggtattaagcatgctaacgtaaaaaaacacattttcaaacataatgacttgaacgaattggaacaactgctccagtcataccccaaatccgttcctaaactaattgctttcgaatcagtatattctatggccggttcagtggccgacatagaaaaaatttgcgacttggccgacaaatacggtgctttgaccttcttggatgaagtacatgcggtcggcctgtacggccctcacggtgcaggtgttgcagaacattgtgattttgaaagtcaccgtgcaagtggtattgctaccccaaagaccaatgacaagggcggcgcgaagactgtgatggaccgtgtcgacatgatcaccggcactttaggtaagtctttcggtagcgtaggtggctacgtcgcagcctctaggaaattgatcgattggttcagatcgtttgcacctggtttcattttcaccacgactttaccaccttcagttatggcaggcgctaccgcagcaattagataccaacgttgccacatcgacctaagaacctcgcaacagaaacataccatgtacgtaaagaaagctttccatgagttgggcattccagttattccaaatccttctcatatcgtcccagtgttgattggtaatgctgatttggctaagcaagcttctgacatcttaatcaataagcatcaaatctacgtacaagctatcaacttccctacggttgctcgcggtaccgaaagattgagaattaccccaacgccaggtcacaccaacgatttatctgacatcttaatcaatgcagttgatgatgtgttcaatgagctacagttaccacgtgtcagagactgggaaagccaaggtggcttattgggtgttggagagagcggatttgtggaagagtctaacttatggacatcaagccaactatctttaactaatgacgacttgaaccctaatgttagagaccccatcgttaaacaactagaggtttctagtggtatcaagcagtaa

SEQ ID NO: 3838 - DNA, 1647 bp, Saccharomyces cerevisiae
atgcataaaggaaaaaaaaattaccctaatttgattacttcgtttcggatgaatttgaaaaaaatcatattgaaccatgaccgatttagccatccagaaagatggaaaacaaacgcactcttaaggttcaccttcgtgtatataaaatttctcttcgacttgatgataatcaaaaatccattaaggatggttggaaaaacttatcgagacgctgttactgcgctaaactctttgcagtccaattatgccaacatcatggctatccgtcaaactggtgatcgtaaaaacactatgacattattggaaatgcatgaatggtctcgaagaattggttactctgcatcggatttcaataaattaaatattgttcatatcactggaacaaaaggtaaaggttctactgccgcatttacttcatcaattctaggacaatataaagaacaattaccacgtatcgggctatatacgtctccacatcttaagtcagtgagagaaagaataagaataaatggggagccaatttctgaagaaaaatttgcgaagtacttctttgaggtttgggaccgtctagatagtacaacctcttctttggataaattcccgcacatgatcccgggaagtaagcctggctatttcaagttcctcacattgctttcatttcacacttttatacaagaggactgcaaaagctgtgtctacgaagtcggcgtcggaggtgaattggatagcactaatataattgaaaagccaattgtctgcggtgttacactattaggaatagaccatactttcatgcttggtgatactattgaagaaattgcttggaataagggaggaattttcaaatctggagcaccagcattcaccgttgagaaacaacctcctcagggattaacaatattgaaagaaagagctgaggagcgcaaaacaacgctaacagaagtacccccatttaaacagttggaaaatgtcaagcttggaattgctggcgagtttcaaaaaagtaacgcctcccttgccgttatgctggcttctgagatcttgcatacgtccaatatattggaggagaagatcaaatgcagttcgaatgcatcgattccagaaaaattcataatcggtctacaaaatactaagtgggaaggcagatgtcaagtactagaaaagggaaaaaacgtttggtacattgatggtgctcacaccaaagatagtatggtagctgcatcaacatggttcagagatatggttcgattgtcgaagagaaagaagatcttgctcttcaaccaacaaagcagagatgccaacgctcttgtgaataacctgtactcatctgtttcgccagaaataacgttcgatgatgtgatatttactactaatgtcacttggaaatcaggctcatacagcgctgacctcgtttccatgaacacttctcaagaagatgtagaaaaattgaaagtccaggagtcattagtcaagaattggaacaaaatagacgataatcgtgctaaaacgcatgtaacggctagtatagaggaagcaaatgaattgattgaaacgctatacgatgaacctgctgatatatttgtaactggttcattacatcttgttggcggattattggtcgtttttgatagaatagatgtaaagtaa

SEQ ID NO: 3839 - DNA, 1647 bp, Saccharomyces cerevisiae
atgggcagtgcttggacaaactacaattttgaagaggttaagtctcattttgggttcaaaaaatatgttgtatcatctttagtactagtgtatggactaattaaggttctcacgtggatcttccgtcaatgggtgtattccagcttgaatccgttctccaaaaaatcttcattactgaacagagcagttgcctcctgtggtgagaagaatgtgaaagtttttggtttttttcatccgtattgtaatgctggtggtggtggggaaaaagtgctctggaaagctgtagatatcactttgagaaaagatgctaagaacgttattgtcatttattcaggggattttgtgaatggagagaatgttactccggagaatattctaaataatgtgaaagcgaagttcgattacgacttggattcggatagaatatttttcatttcattgaagctaagatacttggtggattcttcaacatggaagcatttcacgttgattggacaagcaattggatcaatgattctcgcatttgaatccattattcagtgtccacctgatatatggattgatacaatggggtaccctttcagctatcctattattgctaggtttttgaggagaattcctatcgtcacatatacgcattatccgataatgtcaaaagacatgttaaataagctgttcaaaatgcccaagaagggtatcaaagtttacggtaaaatattatactggaaagtttttatgttaatttatcaatccattggttctaaaattgatattgtaatcacaaactcaacatggacaaataaccacataaagcaaatttggcaatccaatacgtgtaaaattatatatcctccatgctctactgagaaattagtagattggaagcaaaagtttggtactgcaaagggtgagagattaaatcaagcaattgtgttggcacaatttcgtcctgagaaacgtcataagttaatcattgagtcctttgcaactttcttgaaaaatttaccggattctgtatcgccaattaaattgataatggcggggtccactagatccaagcaagatgaaaattatgttaaaagtttacaagactggtcagaaaatgtattaaaaattcctaaacatttgatatcattcgaaaaaaatctgcccttcgataagattgaaatattactaaacaaatctactttcggtgttaatgccatgtggaatgagcactttggaattgcagttgtagagtatatggcttccggtttgatccccatagttcatgcctcggcgggcccattgttagatatagttactccatgggatgccaacgggaatatcggaaaagctccaccacaatgggagttacaaaagaaatattttgcaaaactcgaagatgatggtgaaactactggatttttctttaaagagccgagtgatcctgattataacacaaccaaagatcctctgagataccctaatttgtccgaccttttcttacaaattacgaaactggactatgactgcctaagggtgatgggcgcaagaaaccagcagtattcattgtataaattctctgatttgaagtttgataaagattgggaaaactttgtactgaatcctatttgtaaattattagaagaggaggaaaggggctga

SEQ ID NO: 3840 - DNA, 1647 bp, Saccharomyces cerevisiae
atggtatacacttcaacgtacagacacactatcgttgttgaccttttagaatatttgggtatagtgtccaacttagaaactttacagagtgcccgtgaagatgaaacaagaaaacccgagaataccgataaaaaagaatgtaaacccgactatgatatagaatgcggtcctaatagatcgtgctctgaatcctctaccgattcagactctagtggttcacagatcgaaaaaaatgatcctttcagggtggattggaacggccccagtgatcctgagaacccacaaaactggcccctactgaaaaaatcattggtagtattccaaataatgttacttacttgcgtcacgtacatgggatcctccatttacacacctggccaggaatatattcaagaagagttccacgttggtcatgtagtggcaacattaaatctttctttatatgttcttggttatggtctaggtcccatcattttttcaccgctatcagaaactgcacgctatggccgtctaaatctgtacatggtgactttattttttttcatgatctttcaagttggttgtgctactgtgcataacatcggcggtttaatcgtcatgcgtttcatcagtggcatactgtgcagcccatcgttggccactggtggcggtacagtggctgatatcatttcaccagaaatggttcctctcgttttaggtatgtggtcagccggtgctgttgctgcgccagtcttggctcccttactaggcgctgctatggtcgatgctaaaaattggcgattcatattttggttattaatgtggttaagtgctgccacttttatcttgttggcatttttcttccctgaaacacaacaccataatattttgtaccgccgtgctttgaaattgagaaaagaaactggtgatgacaggtactatactgaacaggataaactcgatagagaagttgatgcaagaacttttttgatcaatactttgtataggcctctcaaaatgattatcaaagagcctgcaattttggcttttgatctctatatcgctgttgcttatggttgtttctacttattctttgaagcattccctattgtatttgtaggtatataccacttcagcttagttgaagttggcttggcctatatggggttttgcgtagggtgcgtacttgcttatggcttattcggtattttaaacatgaggattattgtaccacgttttagaaacggcacattcaccccggaagcttttttaatcgtggcaatgtgtgtctgctggtgcctgcctctgtctttgttcttatttggttggactgctcgagtgcattggattttgccagttatctcggaagttttttttgttttagctgtctttaacattttccaagcaacttttgcatatttggctacatgctacccaaagtatgttgcatccgtttttgcaggcaatggtttttgtcgggcttcgtttgcctgtgcttttccgttgtttggtagagcaatgtatgacaatttagctactaagaactatcctgtggcatggggttcgtccttagtggggttcctaactttaggtctagctattatcccgtttatactttataagtatgggccatcattacgtacaagatcttcgtacacagaggagtag

SEQ ID NO: 3841 - DNA, 1647 bp, Saccharomyces cerevisiae
atgtacttcccctttttaggcagattatcgataacagattacattatagtcgtcttggtatacatagaaagcattatttcatcagtccttaaacttataccacaaccaatgattaaccttttcgaatggctaataaatttctcaacgtcctccgatgacaataccatcgaagaaaagttaaggtcagctccaactatccatgaaatgtgtgcaatttttgatatatctgtcgaggatcatttggtaagaactgaagacaattatatcttgacactgcatagaatcccaccgatttctaaaaacagatttaacaataaagtggtatacttacatcacggtcttttgatgtgttctgatgtttggtgttgcaatattgaaagacataaaaacttaccgtttgtattgcatgatttaggttacgacgtctggatgggaaataatagaggtaataaatattcaactgcccacttgaacaaaccaccaaaatcgaacaagttttgggatttttctatcgacgaatttgcgttctttgacattccaaactcaattgaattcatcttagatataacaaaagtggacaaggtcatctgcatcggattctctcaaggctctgctcaaatgtttgctgcattttcgttgagtgaaaaattgaatcgaaaagtctcccattttatagccatagcacccgctatgactccaaaggggttgcacaacagaattgtcgataccttggccaaatcatcgcccggctttatgtatcttttctttggtaggaaaattgtgttaccttcagctgtcatttggcaaagaactttacatccaacacttttcaatttgtgtatcgatatcgcaaacaagatactgttcaattggaagtcgtttaacattctaccgagacaaaagattgcttcttacgcaaaactttattcaacgaccagtgtaaaatccattgttcactggttccaaatattaagatctcagaaatttcaaatgtttgaagagtctgataacatgctaaattccttaactaggccttaccaaattgctaattttcctactagaacaaatatcaagattcccattcttttaatttatggtggcatagattctttagttgatattgatgtgatgaaaaaaaatctacccttcaactccgtctttgatgttaaagttgacaattatgaacacctggatttgatttggggcaaagatgccgataccttggtcattgctaaagtcttgaggtttattgaattttttaaccctggtaatgtttcagtgaagactaaccagttactaccatcagcaagtctggttgaggaattaccaagcacgacatggaagacaactcatccaacgcatggtctcagttatagaactcactcggcagaccgttctccgttgtctgtacaagctgatgaagcggatgaggtccacaatgctgacaattcaaggttcttaagacgagtgttttctactagtgccatagacgaggacaacgaaaatgagcaccaggatgatacagaagatcaaatccataaggagcagcaaagacggttaagtgcctatctggaatcatccaaagatttacgacaactagatgccaactcttcgacaactgcgctggatgctctaaataaagaatga

SEQ ID NO: 3842 - DNA, 1647 bp, Saccharomyces cerevisiae
atgtatataaaggcagaacagaaaccccaacagtttgagaggaagaatgaaaaactagacagaaataaaaaccagcagctaccagatcttgaaacagatttcaagggttacagagtgaattcggacctatacaacaaagaacgagatggaagtacggaagagactttaaactctttgaagtttttacataaacctcagagagtaactcaaatgagagcgaacaggttcccagaggaagaagtgcaaagaaacactgatttaaacaaaagaattttctccgcagggaatgatgaaaacgttgataatgagagcggctggtcaaaaattgccgctgccaagaatcacacttccgtagaatcattaaatggcagtacgagacccccattcaaaatagagctgcctcccctttcccccaaatccaccgtaccaaaatcttttcaagcagaatatcccgaagctaagtcacctggcaatgatatgaattttgaatatgatgaagaaattctaattccatttgcgccacctgtatataaaaagtcaggtgaactattgaagagctcattgaagagaagatcaaaatcattacctacaaccccaggtataaggagcgggaatggtgtccaagcaagagacggtagtccgatgttgattaggagtaagagtgttcactttgatcaggcggcacctgtaaaatattttgctgaggatgaaagccctataaacgttaataaaactgaacaacacgataattgtctaagctttaagcataagccagtgaatttaatggtggacccggaagaagagacaaaaatgctatcatctggattagaaacgacatccatagatgatgacttgacgacagttgcgccaaaaggcttcgcacatcctgctaaaatttcgaatccaaacaatggtaaaggcaccaacaatacaaaattaagaaaaagtaaaagatttcagaacctcctaaagaacaggaccgacatgccaccatcaaaatcaaataaaaaattcgttaatggtggcggtgctcatgaaatttcagatcgtaattcaaaaaattaccatgttgttggattatacagcaagaacttccccattttaagcaacaagaatcctaaaagtttaaagctgaacatttttatcaatttatcacaaaataagaaagtttttctacaagaattgtcattatacatccatagagacaacaattacttttcaaattcctcctcattttataatattcccaatagccacaatggtaatgactgtaatggtgtggccaagggttataacgctggctgtacaagattaattgctggaaggatactagtgaaaaacattttctatgataaaagagtggtggtacgatatacgtgggatagttggagaacaacacatgaagtggaatgcgtttacatcagtgatggcgatggaatattgccgggcactaacatggacattttccacttcattatcgatgatgtcagcaaagtggatcctcgcggcaagttagaattttgcattcattattctacacgtaacgactatgagcgcgaagagtactgggacaacaacaacgggaataattataaggtggatgttgtaatggatggctttaacgatcccttcgcggcggcagcatga

SEQ ID NO: 3843 - DNA, 1647 bp, Saccharomyces cerevisiae
atgttggaatgtctaagcgctctgctggttctctttgccggtggtggtgggagcgttctcgcagcggttcaaagcaaaactgtggcagatcctaacttatgtccaggttacaattcacaactgatttcccccttcctctccagttgcgtatgtacaacaaatttaccgaggtactaatattctctagattttattactgacaagatccatgtgaagaaacgaaatttaagtgaatgcgtgtcccgttattttgatgaacaatatgcattttgtcggtcatgcgttactgtgaataatgaaacaatggaggacttggataactgcaaatgtttacagtgtgccttgagttcccttaataatagctgctttcacgattactgtacctccaaagatgagtatgacaagttgcagatcgttgttgaacaatttcaattgacaaatggagttttagatgacggagagattttgaaacctagaggcaacaaattttctagtagaaaattgtcttatttcgttggtcaaaacaatactctttttaggaaccctttgcagttcgaaaaaaaccaattaatttctgcactattaacctctttaaccaataatcaaaagactatatcatcagttgacatgttcgaagtggttgacgctaataatgaagttcaatatttgcgcgaaagaacgataagtggtaaaactctgtctccagctactggttatgaagaagaaaacgacggtgactgtagtgtgaaagataagaagtgggaaggtaaaatcgaataccatgagaacaagaaagttagttctgaaaactgtagtaaggataccgatgataaaagtggcagtaaaaaagaacgaaatacgaaggccccattatttcacactgccaccgaaattcatatgacaaggtggagttcttggaggccaaagaaaatttttactcgttacttagtgaatgaataccaaagtcctaaaataataaccacagtgaacaggttttacaggaccaagactgatactgaaacagggacgactttaatcacgtcgacaaaagccaaaagaagatggtttccaagaactaaaatcgtaacaagtaccgcaacttcgacgtttttgagtatcacgactactacgacaacaaatgctatcgcaacgaagtcgttagtagcagtacttaatccggatggattgaataaaaaagcgggaataaattttggtctctttagcgctaatggtgagctcgcttcaccagatgaaggaggtacaccaacagtagtaagaagagataagatttctgatccaggcgctgctaatgagcaggccacactgttctctacaaccttttcgcaagtgccgcacttaccagaactagattctggtgaattcatatcggcggcatctcaattagacaaaaggattttcatattcactgccatcacagtatcaattactacattgatgatgttggggttttcttaccggtcgcgggtatcttttagagatcatagtatcgatgactcagatgatgataacgattggtcagatgacgaagttgaatttgacgaagagtatttctattctcttcctgtaagcataccagaaaaggggatcagcttagataaaatggcgcaacaacttggtgtagaatag

SEQ ID NO: 3844 - DNA, 1650 bp, Saccharomyces cerevisiae
atgaaactagaacgcgtaagcagcaatggctccttcaaaagaggtagagatatccagtcacttgaatctccgtgtactagaccgctgaaaaaaatgtcacctagtccatctttcacatctcttaaaatggagaagcctttcaaagatattgtaaggaagtatggaggtcatcttcatcaaagtagttacaatcccggctcaagcaaagtggagttagtaagaccagatttgtctttaaaaacagatcaaagttttcttcaaagtagtgtgcaaactacgcctaataagaaaagctgcaatgagtatctttcaactccagaggccacaccattaaaaaatacggctacagaaaatgcatgggcaacctctcgagttgtttctgcatccagtctttctatagtgacaccaacggaaattaaaaacattcttgttgatgaattctctgaattgaagttagggcaacctttgactgctcaacatcagcgaagtcatgcggtctttgaaattcctgagattgtggaaaatatcataaaaatgatagtttctctagaatctgcaaatataccaaaggaaagaccatgcttaagaagaaatccacaatcttatgagcactctctgcttatgtacaaagacgaagagagagcaaaaaaagcatggtcagcagcccagcagctacgagacccaccattagtcggacacaaggagaagaagcaaggggccttatttagttgtatgatggttaacaggttatggcttaacgtaacaaggccttttcttttcaaaagcttgcactttaagagcgtccataattttaaggagtttttacgaacttcccaggagacgacacaagtaatgagaccgtctcattttatattgcacaaattacatcaagtaacacaaccagatatagaaaggctttccagaatggagtgtcaaaatttgaaatggttagaattttacgtttgccctagaataactcccccattaagctggtttgataacctccataaacttgaaaagcttattattccaggcaataaaaacatagatgataactttttactcagactatcacagagcataccaaatttaaagcacttagttttaagagcatgtgataatgtcagtgattcaggtgttgtttgcattgctttgaattgcccgaaattaaaaacatttaacattggcagacataggcgtggaaatttaattacgagtgtctcactggtcgcgctaggcaaatacacacaggtggaaactgtggggtttgccggttgtgatgttgatgatgccggtatttgggaatttgctcgattaaatggcaaaaatgttgaaagattgtctttaaattcctgtcgtcttttgactgattactctctacccattctttttgctttaaactcatttccaaatctggctgttttagagatcagaaatttagataaaataactgatgtgaggcatttcgtgaagtacaacttgtggaaaaaatcattggatgcccccattctaatcgaagcatgtgaacgtattacgaaactaatcgatcaagaagaaaatagagttaagaggattaactccttggttgccttaaaagatatgacagcttgggttaatgcagacgacgaaatagagaataatgtggactag

SEQ ID NO: 3845 - DNA, 1650 bp, Saccharomyces cerevisiae
atgaagaactctgtcggtatttcaattgcaaccattgttgctatcatagcagctatatactatgtgccatggtacgaacactttgagagaaagtcaccgggggccggagaaatgagagatcggattgaaagcatgttcttggaatcgtggagagactattccaagcatggctggggatacgatgtgtatggacctattgagcacacttcccataatatgcctcgtggcaaccagccgttaggctggattatcgtagattcagtggataccttgatgttaatgtataactcctccacactatacaaaagtgagttcgaggcagaaattcagagatcggagcattggataaacgatgttttggattttgatattgatgccgaagtgaatgtttttgaaactactattagaatgctaggtggtttattatccgcatatcatctatctgatgttttagaagtaggtaataagactgtctacttgaacaaagcaatagatttgggggataggcttgctttggcgttcttatccactcagaccggaattccatactcaagtataaaccttcatagtggccaagcggttaagaaccatgcagatgggggggcatcttctaccgcagaattcactacgctacaaatggaattcaaatatctggcgtatttgacaggaaatcgtacttattgggagctggtggagcgtgtttacgagccattatacaaaaataacgatcttctaaatacctacgatggattggttccaatttatacatttccagatactgggaagtttggtgcttcgactatccggttcggatcaagaggtgattctttttatgagtatttactaaaacaatatttattgacgcacgaaacactttattatgatctgtacagaaaatccatggaaggtatgaaaaagcatttattagcacaatccaaaccctcttctctgtggtacattggggaaagagaacaaggtctacatggacaactttctcctaagatggaccacctcgtgtgctttatggggggattgttagcatcaggctctactgagggcctttctattcatgaagcccgaagacgtccgtttttctctctttcccttgaaagaaaaagtgactgggatttggctaaagggataactgacacatgttatcaaatgtacaagcagtcttcctcggggcttgcgcctgaaatcgttgtcttcaatgatggaaacataaaacaggatggttggtggcggtcgtctgtgggtgatttttttgttaaaccactcgataggcacaacctacaaagaccagaaacggtggaatcgattatgttcatgtatcatttatctcatgatcacaaatatcgtgaatggggggcggaaatcgcaactagcttctttgaaaatacctgtgttgattgtaatgacccaaaattaaggcggttcaccagtttaagtgattgtatcacgttacctacaaagaaatctaacaatatggaaagtttctggttggcagagactttaaagtatttatatatattgtttttagacgagtttgatttgaccaaagttgttttcaacacagaagctcatccttttccagtattagacgaagaaatattaaaatcgcagtctctgaccacaggttggtcgttgtag

SEQ ID NO: 3846 - DNA, 1650 bp, Saccharomyces cerevisiae
atgacgtcccaagaatatgaacctattcaatggagcgatgaatcccaaacaaataatgatagtgtcaacgatgcgtatgccgacgtgaataccactcatgagtcgcgtcgaagaacaactttgcagccaaactcaacatcccagagcatgatcggaacattgagaaaatatgctaggttcatcggtcctggtttgatggtatctgtatcgtacatggatcctggtaactatagtacagctgtagcagcgggttctgctcatcggtacaagcttttattttctgtcttagtttctaatttcatggctgctttttggcagtacctctgcgccagattgggtgctgtcactggcctagatctggcacaaaattgtaagaaacatttgccctttggacttaacattactctttatattctggcggagatggcaattattgccacagatctggcagaagtggtaggaaccgctatttctttgaatatccttttccatatacctctcgccctaggtgtgatacttactgtggtagacgttttaattgttctgctagcttacaaacctaacggttccatgaagggtatcagaatatttgaagcttttgtttctttattggtggttcttaccgtagtttgctttactgttgaactgttttatgccaaactgggacctgccaaagaaatattttctgggttcttacccagtaaagccgtttttgaaggtgatgggttatacttaagtctggcaattctgggcgccacggtaatgcctcattcattatatttggggtcaggtgtggttcaaccaagattaagagagtatgatatcaaaaacggacattacttgccagacgcgaatgatatggataacaatcacgataattacaggccatcctatgaggccatcagtgaaactctgcactttactataacggaattactgatctcgctgttcacggtggcattatttgtcaattgtgccattcttatcgtgtctggcgctacactatacgggtccactcaaaatgctgaggaagctgacttattttctatttacaacttactctgtagtactctttccaagggagcgggaacggtattcgtgctggcattgttgttttcaggacagagtgccggtatcgtgtgtacgttgagtggacaaatggttagtgaagggttcttaaattggactgtttctccggcattgagaagatccgccacaagagcggtagccatcacgccttgtttgattttagtgcttgtagctggacgtagcggcctctctggtgcactaaatgcttcccaagtggtactttctctcttgctgccttttgtttctgcacctttactttacttcacttcaagcaagaagattatgcgtgtacagcttaaccgtaccaaagaactttcaagaactacagacaaaaaacccgtggccgaccgaaccgaagatgatgagaccattgagctcgaagaaatgggcataggcagcagctcacaggagcgcagcttagtttctcctgctccagaatacaaagacatgagcaatggaatgatcgtcaccgtgctcgcaatcatagtatggttgattatctccggactgaacttttatatgttactgggctttactacgggcaaagaagtacacctctaa

SEQ ID NO: 3847 - DNA, 1650 bp, Saccharomyces cerevisiae
atgactgtgcactcaacgtggaaggaaaaagttcaattaaaaaaagatcaactgaacagtaagataaaagacgaatggaaattaaacagcacaactataacgaggttgaagaacgataaaaaaaatttaatcaagaatatcgatgatttatgctcatcttcagaaaatcagatcacccactccacgattatggccttgagacaggcactggaagcaaaagagttaagctgccatgaaataacagctgcattttgtcatagggctgctttaattcatcaagtagtgaattgtctatccgaaatcatgttttcagaggcattgagattggctgactattacgacagcaatagaccagccatattgccacccttgtacggtataccgatatctctcaaagaccaatgtaacgttgagggtgtagacacctcactgggttatttatgtcgaactttcaaaccaaaaaccaagaatgaagaatcattgattgtcagttttctgagagatttaggagctattatatttgtaaaaaccaccgtaccttcatcgatgatggctacagatacacaatctaacacctttgggtacacatataatagtattaatttaagcttctccagtggtggatcttctggtggagagggttcgttaattggtgctcatggttccttgctgggactaggaactgatataggcggaagcatcagaattcctagtagttaccaaggattatttggtttgaaaccaacttttggacgcgtcccttacttgagggtggataattcatttgagggaagggaaacaattcccagtgtaattgggccgttggcaagagatctttcggatttgagatacttcatgagttgcgttatcaacatctgtcaaccatgggtacaagacgtcaagtgtattccataccattttgattcctctacaagtaaattacacgataattatgttgttggaatatggtatggtgacggcgttattgatcctccgcccagtgacatcagggctttaaagacgtgcgaagacctagttaataaaactaaaggaatgaaggcagttaaatgggagccttccagtgaactgagcagggaattgtttgatctcgcaaatgaagcagatgttgctgactcaggtaacgagataaaaaacgaattcgaaatttccggagaaccactcctagatattttaaaaccaatggttttggaaaacggaaggcccccatatactgttaatgaatggtgggatttgaccaaaagagtttataatgcacaacaattaatgagagattattacctttctttcccggaatcagaaaggcctgatgttatcatatctcctacaacgctgatgccatttaggcctggtgacatgctaaagacaactttacgatacattttactattcaacgttttaaatttcccatcattatctatacctgtaggtagtgtcgattgccaaattgatgggctaatggataccacttctgcgctcaatccagaagataaaatgatcaaaacatattggaatgatttaatacaatctggtgagatagatgggtttccaataggcctacaagtagttagcccgactttcaatgacaatgaagtttgtaaatttgcgtcttggctttttagcaaaatatag

SEQ ID NO: 3848 - DNA, 1650 bp, Saccharomyces cerevisiae
atgagaagaagcccgtccagatcaaataataactttgcagtaccgaattgctcaactaattcaaactctagtcagcaacaattaactacaccttcagatgatctcaacagtaacgaacctaatgacccagatgatagtaggtctctacctactatcaagaaattcaataataaacattctataaacaattacaacactttagcatcggccgggaaaaacaacaacaataaacgagctagcaatgataatttgctcattcctggtgagaatgcccataaacagaaaatatacactaaggatgaaaacttgaagagcttgtacctagatatcgatgtttctgtcgctaaagccctatcctcatcagcaactgctccgaagctgatcaataccgcaagaacttcctctactaccactgccactacctcaaataatatcctgacatcaccctcttatcgtgaatcaaattattcttctccatcctcatattctttttcctcctactactcatccgctacgtctgcttcctcatcaacctcatcatttttaaaatcttcagggttatcgtccagagttaagtctccttcatcttcggttaaggcaggttcttttggtgcgccttcgtccccaacatctgggatacctaatcctaaaagtagcaagaagcctatatttttgagacggtattctcatgatacctcttcaaatgaaggtcttgatatcgatgttgcgatcgaaaaattactacaagtgggtgagtcaagagaaattacaaaaacgtccaaaaaaaagaactttccattccattcttgggaaattcaactcatttgctatcatgcaagagaaatttttttgaatcaacctactcttttgagattacaagcgcctatcaaagttgtcggtgatgttcatggacaatttaatgatttattgagaattttgaagttgtctggtgtgccatctgatactaattatctgttcttgggtgattatgtggaccgtggtaagaactcattggaaacaatactattgttattatgttacaaaataaagtacaaagacaacttttttatgttaaggggtaatcacgaatctgctaatgtcacaaagatgtacggtttctatgatgaatgcaaaaggcgattgagctcgaaagtatggaaaatgttcgttgacgtatttaatactttgccattagcagcaattattcaagataagatcttttgcgttcatggaggtatatcgcccgatttacatgacatgaagcaaatcgaaaaagtcgcaagaccaacggatattcctgaaagcgggctggttacagacttactgtggagtgacccagaccctcaagtaactgattggtcagaaaatgatcgtggtgtttcatacacattttctaagaggaacgttcttgatttttgtgctaagtttaaattcgatttaatacttaggggacatatggtcgtagaagatggttatgaattctttgccaggaaaaagtttgtcacaatcttttcagcaccaaattattgtggagaatttcataattggggggcagtaatgagcgttacaacgggtatgatgtgtagctttgaactgttaaagccgcgtgcattgaaaaataaaaagaagttatacaaaaccaaagtgtag

SEQ ID NO: 3849 - DNA, 1650 bp, Saccharomyces cerevisiae
atgagttacactgacaaccctcctcaaacaaaaagagctttatcgttagacgatctggtgaatcacgatgaaaatgaaaaggttaaattacaaaaattaagtgaggcggctaatggcagcagaccttttgccgaaaatttagaatctgatataaatcaaacggaaacgggccaagctgctccgattgacaattacaaggagagtactggtcatggctcgcactcacaaaaacctaaatcacgcaagtcatctaatgatgatgaagaaaccgatacggatgacgaaatgggtgcaagtggagaaattaattttgattcagaaatggactttgactatgataaacaacatagaaatttactatccaacggatcacctcctatgaatgatggtagtgatgccaatgcgaagttagaaaagccttctgatgattcaattcatcagaatagcaagagtgatgaagaacagagaataccgaaacaaggtaatgaagggaacattgccagcaactatataacccaagtacctctgcaaaagcagaagcaaactgagaagaagatagcgggaaatgcagtaggaagcgtggtcaagaaggaagaagaagcgaatgcagctgtagataatatttttgaagagaaagctactttacaatcaaaaaagaataatatcaagagagatttggaggttctgaatgaaatatctgcgtcttccaagcccagtaagtacaggaatgttccaatttgggcacaaaaatggaaacctactatcaaagctcttcaaagtataaatgtgaaagatctcaaaattgacccatcttttttaaacattattcccgatgatgacttaacaaagtcagtacaggactgggtttatgctacaatatactcaattgctcctgaactaagatccttcattgagttagaaatgaaatttggtgttattattgatgcgaaaggcccagatcgtgtaaatccaccagtttcttcacaatgtgttttcactgagcttgatgcccatctaacgcctaatattgatgcatctttgttcaaagagttgagcaaatatattcgtggtattagcgaagtcactgaaaatacaggtaaattcagtattattgaatcccagacaagagattccgtctatagagtcggactatccacgcaaagaccaaggtttttgagaatgagtacagatattaagactgggagggtaggacaatttatagagaaaagacatgtagcccaactactattatattcaccaaaagatagttacgacgttaaaatctccctaaacttggaattacctgtacctgacaacgatccgccagaaaaatataaatctcaaagcccaattagtgaaaggacgaaagaccgtgttagttacattcataatgattcctgtaccagaattgatattacaaaagtcgaaaatcataaccaaaattcaaaaagtagacaatcagagaccactcacgaagtggaactagaaatcaacacgcctgcactgttaaacgcctttgataacataacgaacgatagtaaagaatatgcatctcttattagaacgtttctgaataatggtacaattattagaagaaagttatcgtctttatcatatgaaatttttgaaggttcaaagaaagtcatgtaa

SEQ ID NO: 3850 - DNA, 1650 bp, Saccharomyces cerevisiae
atggattatatgaaattggggcttaagtcccgtaaaactggtattgatgttaagcaagatatacccaaagatgaatacagcatggaaaatattgatgattttttcaaagatgatgaaactagtcttatcagtatgagaaggaaaagcagaagaaaatcatcgcttttcttaccatcaacgttaaatggcgatactaagaacgtattaccgccatttctacagtcatataaatctcaagatgatgaagttgtccaaagcccatctgggaaaggcgatggatcaagacgatcatctttgttaagccatcaatcaaacttcctgagtccagccaatgatttcgagcctattgaggaagaaccagaacaagaagaaaatgatatcagaggcaatgattttgccacaccaatcacacagaaattgagtaaacctacatataaaagaaagtactccactcggtatagccttgacacttcagaaagcccttctgtaaggttgacacctgatagaatcactaataagaatgtttattcagatgtacctgatttggttgctgatgaggatgacgatgatagagtaaacacttctttaaacacatctgataacgcattattagaagacgaattagaagatgacgggtttatacctgaaagtgaagaggacggtgattacattgaaagtgactcatctttggattcaggctcggattcagccagtgattcagatggagataacacctatcaagaagtagaagaggaggctgaggtgaacacaaatgacaatgaagatgattatataagacgacaagcgagtgatgtggttcgtacagattcaataattgatagaaacgggcttcggaaatctacaagagtcaaggtggcgcctttgcagtattggaggaacgaaaaaatagtatataagaggaagtccaataaacccgttcttgacatagacaaaattgtcacatatgatgaatctgaagacgaagaggagatattggcagcacaaagaaggaagaaacaaaaaaaaaaacctacaccaaccagaccttacaactacgtacctacggggagaccaagaggaaggccaaagaaggatccaaatgcaaaggaaaatttgattccagaagatcccaacgaggatattatagaaaggatagaatctggaggcatagaaaatggcgagtggctgaaacatggaatactggaagctaatgtgaaaattagcgacactaaggaggaaactaaggatgaaattattgcattcgcgcccaatttgtcgcaaactgaacaagtaaaagacacgaaggacgagaattttgcccttgagataatgttcgataagcataaagaatattttgctagcggcatattaaaactaccagctatttctggacaaaagaaattaagcaactcatttaggacatatattacgttccacgtgatacagggaatagtcgaagtaactgtatgtaagaacaagttcttgagcgttaaaggttccactttccaaataccggcattcaacgagtacgcgattgccaatagagggaatgatgaagccaaaatgttcttcgttcaagtgaccgtttcagaagacgctaacgatgacaacgacaaagaattagacagtacgtttgacacttttgggtaa

SEQ ID NO: 3851 - DNA, 1650 bp, Saccharomyces cerevisiae
atggcaagacaaaagatgttttataacaaattactcggcatgctcagcgtaggattcgggtttgcttgggcgctcgagaacattactatatacgaatttgactttggcaagggcattctcgatcaaagctacggcggtgtattttcaaacaacggcccttcgcaagtgcagctgcgggatgcagtcttgatgaatgggacagtggtatacgattcaaacggcgcttgggacagtagtgcgctggaggaatggctccagggacagaaaaaagtttccatcgaaaaaatatttgaaaatattgggcccagcgccgtgtatccgtctatttcgcctggggtcgtgattgcgtcaccatcgcaaacgcatccagactacttctaccaatggataagggacagcgcgttgacgataaacagtattgtctctcattctgcgggcccggcaatagagacgttattgcagtacctgaacgtttcattccacttgcaaagaagcaacaacacattgggcgctggcattggttacactaacgatacagtggctttgggagaccctaagtggaacgtcgacaacacggctttcacggaagattggggtcgtcctcaaaacgatgggcctgctcttcgaagcattgccatcttaaaaatcatcgactacatcaagcaatctggcactgatctgggggccaagtacccattccagtccaccgcagatatctttgatgatattgtacgttgggacctgaggttcattattgaccactggaattcttccggatttgatctatgggaggaagtcaatggcatgcatttctttactttactggtacaactgtctgcagtggacaagtcgctgtcgtattttaacgcctcagaacggtcgtctccctttgttgaagaattgcgtcagacacgccgggacatctccaagtttttagtggaccctgcgaatgggtttatcaacggcaagtacaattatattgttgggacacccatgattgccgacacattgagatccggactggacatatccactttattagctgcgaacaccgtccacgatgcgccatctgcttcccatcttccgttcgatatcaatgaccctgccgtcctgaacacgttgcaccatttgatgttgcacatgcgttcgatataccccatcaacgatagctccaaaaatgcaacgggtattgccctgggccggtatcctgaggacgtatatgatggatatggctttggcgagggaaatccctgggtcctggccacgtgtaccgcttcaacaacgctttatcagctcatttacagacacatctctgagcagcatgacttggttgtcccaatgaacaacgattgttcgaacgcattttggagcgagctggtattctccaacctcacgactttgggaaatgacgaaggctatttgattttggagttcaatacacctgccttcaatcaaaccatacaaaaaatcttccaactagctgattcattcttggtcaagctgaaagctcacgtgggaacagacggggaactaagtgaacaatttaacaaatacacagggtttatgcagggtgcccaacaccttacctggtcctatacttcattctgggatgcctatcaaataagacaagaagttttacagagtttgtag

SEQ ID NO: 3852 - DNA, 1650 bp, Saccharomyces cerevisiae
atgtccccttctaaaatgaatgctacagtaggatctacttccgaagttgaacaaaaaatcagacaagaattggctcttagtgacgaagtcaccaccatcagacgcaatgctccagctgccgttttgtatgaagatggtctaaaagaaaataaaactgtcatttcatcaagcggtgcattgatcgcttattccggtgttaaaaccggaagatctccaaaggacaaacgtattgttgaagaacctacctcgaaagacgaaatttggtggggtccggtcaataaaccatgttctgaaagaacatggtctatcaaccgtgaaagagctgcagattacttgagaacaagagaccacatttatattgtcgatgcatttgcaggatgggatccaaaatacagaatcaaagtccgcgttgtttgtgccagggcttaccacgctttattcatgacaaatatgcttattagacctacagaagaagaattagcccattttggagaacctgattttactgtctggaacgctggtcagttcccagccaatttacacacccaggatatgtcttcaaagagtactatagaaattaacttcaaagcaatggaaatgatcattttaggtaccgaatacgccggtgaaatgaaaaaaggtattttcacagttatgttttacttgatgcctgtgcaccataacgttttaactttgcactcttccgccaaccagggtattcaaaacggtgacgttactttattctttggcctaagtggtaccgggaaaaccactttatccgcagacccacatagattgttgatcggcgatgatgaacattgttggtccgaccatggtgtcttcaatatcgaaggtggttgttacgccaagtgtattaatttatctgccgaaaaggagcctgaaattttcgacgctatcaagtttggttctgtattagaaaacgttatctatgacgagaagtcgcatgtagtcgactatgacgactcttctattactgaaaatactagatgtgcctacccaattgactacattccaagtgccaagattccatgtttggcggactctcatccaaagaacattatcctgctaacttgtgatgcttcgggtgttttaccaccagtatctaaattgactcctgaacaagtcatgtaccatttcatctctggttacacttctaaaatggctggtactgagcaaggtgtcactgaacctgaaccaacattttcatcttgtttcggacaacccttcctagccttgcaccctattagatacgcaaccatgttagctacaaagatgtctcaacataaagctaatgcgtacttaatcaacaccggctggactggttcttcctacgtatctggtggtaaacgttgcccattgaagtacacaagggccattctggattctattcatgatggttcgttagccaatgaaacgtacgaaactttaccgattttcaatcttcaagtacctaccaaggttaacggtgttccagctgagcttttgaatcctgctaaaaactggtctcaaggtgaatccaaatacagaggtgcagttaccaacttggccaacttgtttgttcaaaatttcaagatttatcaagacagagccacaccagatgtattagccgctggtcctcaattcgagtaa

SEQ ID NO: 3853 - DNA, 1653 bp, Saccharomyces cerevisiae
atgaactttggaagccaaacacctacaattgtggttctaaaagagggaacagacgcatctcaaggtaaaggtcaaatcatctctaatatcaatgcctgtgttgcagtccaagaggcattgaaaccaactttaggtcccttaggttctgatattttaattgtgacatcgaatcaaaagactactatttctaacgatggtgccacgatcctaaaattattagatgtagtacatcctgctgccaaaactttagtggatatttctagagctcaggatgccgaggtgggtgatggtacaactagtgtaaccattttagctggtgagttaatgaaagaagccaagccctttttggaagaaggcatttcatctcatttgattatgaagggctacagaaaggccgtttctttagctgtggagaagattaacgaattagctgtggatattacttcagagaaaagcagtggcagagaattacttgaacgctgtgctagaactgcaatgtcgtcgaaattgattcataataatgcagatttttttgttaaaatgtgtgttgacgccgtgctatcccttgatagaaacgatttggatgacaaattaataggtattaaaaaaattccaggtggtgctatggaagaatctcttttcatcaacggtgtcgcctttaagaagacattttcgtatgctggatttgaacagcaacccaaaaagttcaacaatcctaaaattttaagtttgaatgtagaactggagttgaaagcagagaaagacaatgctgaagtacgtgtagaacatgttgaagattaccaagctattgtagatgcggagtggcaattaatctttgaaaagctaagacaagtggaagaaacaggtgccaatattgtactatcaaagttacctatcggcgatttggctactcaattttttgctgatagaaatattttctgcgctggtagagtgagcgcagatgatatgaatcgtgtcatccaagctgttggaggctctatacaatctactacttcagatataaaaccagagcatttgggtacttgtgctttgtttgaggaaatgcaaatcgggtcagaacgctacaatttattccaaggttgcccacaagctaaaacatgtacattattattaagaggaggtgctgagcaagttattgccgaggttgagagatcattgcacgatgcaatcatgatagttaagagagcgttacaaaataaactgatcgttgctggtggtggtgctacagaaatggaagtatcaaaatgcttgagagattattcaaaaaccatagctggtaagcaacaaatgataatcaatgccttcgctaaggctttagaagttattccaaggcaactctgtgaaaatgctgggtttgatgctatagaaatattaaacaaactaagattggctcacagcaaaggtgagaaatggtatggtgttgtctttgaaacagaaaatattggcgataattttgccaaattcgtatgggaacctgctttagtaaaaatcaatgctttgaacagtgccacagaggctactaacttgattttatctgttgacgagacgatcactaataaaggtagtgaaagtgccaatgctggcatgatgcctccccaaggggctggaagagggagaggtatgccaatgtaa

SEQ ID NO: 3854 - DNA, 1653 bp, Saccharomyces cerevisiae
atgtcattcaagtttctgatagaatcgctgcttctcggttcgataagcggacaaatacggtgtggtagatcttcggtgatcccccgtggcgatgtatcttatgggggagacgatactgacgaacttaacatggatataatgttgtttgcgtttggaaccttaatcgtggtctacatcgtcatctgtatcgtttatttttttacaaaacagatagctacgcggcttataactgcatattataatgagcatggccctggccaaagaatatctttattcagcgattatgacgaaaataatgcacacgttcatagcagaagattaatggaaaacatgagtttaaggtggcccaacaatcttgacgatgctgatgaagtaagagataagctggcacagttgtcacctgaagagcagttttattataagcaaggtgaggagtatatcaagcagaacccaccatttctgcttaaccagggacttttacaacagtccgaagatagcaatccagacaccacccgtgaagaccctattatgaacgagcaaacaaggcaatatattcaagaagagggggcttatgcatgggagtttagcccaaatcctgatatgccaaaccatactgtcatagtggaaaataaaacagaggtttcttttctaaattataattatgatgcttctatatccacaaatctacccattccgtgtataaataaagtatattattgtgaattcaagatatttgaaacggatggcccactaaacagtgatgaaaatgtatcgaaaggtgtcatctcatttggtctttccacacagccttatccatatttcaggttaccgggaagacaccaccattcgatagcatacgattctaacggcgccagaagatttaatgactccttcaaactaaatgagcaattaagaacgttatttccacagtgtgaaaagggagacattgttggcattggctataggtcacgtagtggaacagtatttttcaccaggaacggaaaaaaactaaatgaaaaatctgttggtggtcatatccgcggctggaaattccaatacctatacccgatcattggctccaacgtaccttgtcaaattcatgtgaatttcggcacttatggctttgtttatatagaagcaaacgttaaaaaatggggatacgcaaagtcaaacggcattaaattacctcctccttcttacgaagactacggtaaagataccctattagaaagcggtggtgaagacaatgatttcgacgaagatttttcagacggtgatagcgacaatattgcggctggtagtactacaaatctcaatgatgatataattataagaaacggtgaaatattaccgccaccacctggatttgaattcactatgtcccctcccactggaaagaagatcatcaatgaggaaattaatctagattccttacctatgctaccaccaagttactcggacgatgaacatcattcgaaaaatgataaatcagcaataagcggacgaattattggaacgagcagaaatttaattactgatgaagcatctttcgatagtgttgataatgataacgaagatgaaaatgatcacgagagagatcccgaacaattttcagaatttgatgattacgaaagcaggatgcatggcatataa

SEQ ID NO: 3855 - DNA, 1656 bp, Saccharomyces cerevisiae
atgaagaaaaattcttcggtagttttcttccttgtgggtctatcacaattcgtcactatggcgtttctcattatcggatccattacggctccaattttcaaacaaataggctattctaaatatgatgagatcacatacggtacattcggctactgtaaagagggctcctgctcaaaagcaagttataattatcaccccgatgagctatcagacagtgatagcaactggaaactcaatagcaacgctaggtctatattggggaaaatcatctttatcacacccattgctgctggtcttaattttttgggatttctttgtaccatcatgagcgttttattaattaacgtgctatccagtgatagagttggtagtgcgtctgccatcatgttttttgttaatttgacattttccactctaggctttctttctgcttctttgatatgtatcgtggtatttttactgttttacccacatgtaacctggtgttcatgggtcctgataccaggagctgctttatctctactagtaattcctttgatattctcagcttattcaagaagctcaggctcaagggatgatgacgaaaccgaggaactggaagaaaagggcatgctgctgaatgacccatatctaagttcgaagtccgggagattcgatatcgacgctgatagtgaggccaacctccgtggtgattcaagaacgaatttattgggtgacaattttaagaacggtactaatatcactgttgtcccagatattatttcacacaatcaagatccgaaattatcaaacataaccacttctaccacgtctgatatttctactttcgataaagaagcaaaggacatggaaaattcaaatggttccggacttaatgaagaagaggacgatggcatggcctatgacaaaaggaggtcaacttcaacgtattctgtcattgaaagtgaaagtggcttgaaaaatgggagtgtttctaataattatgtgagaaacaatggtagtaacaccagcaacaatataaactataaagttccgctaggaaaaacggaaatatcatccagtgcatcattagcgtcctcagactactctcaaagagaggtcataccgcacagaaatccttcgagactactaaacgacatcatggagacctccttcaatgaaccaaacgatagccacatcaacagcatgtcctcctacaacgataaagattcaacgttgacttcaatatcacagagaggtgtcaatccggaagtatacaatcaaatgcctcgagaaacagccgctggtcctgcaaatataaggccgtacgctggtcagccacacccggcgccattagtgtatccccaacaacgactacaaccacaacaacagcaaccacagcagcaatatcatcaatacaatttatatcaaagaactactcctgctggtccagatccttctaatgttattttacaaagcaatccttatttcaacgttgccccaaaccaagtgccacagcacagaaatccggtaccaggcgtcggttttgctccgaatcctttaccaaaccaaagcccgataacacaaggatataagcctgcctataagaggagaatgcaaaacaaaaacttgccccgagctactacttcactgaacaatccttacggatttaggtaa

SEQ ID NO: 3856 - DNA, 1656 bp, Saccharomyces cerevisiae
atgacctattctacagttaatattaatacacctccaccatatctcgctttggccagcaatgaaaaattacccacagttttgtctattgctggaacagatccaagcggtggtgctggtgttgaagcagatgtgaaaactatcactgcacacagatgctatgctatgacatgcatcactgctttgaatgctcaaactccagttaaagtatacagcattaataacacgccaaaggaagtagtttcccaaattttggacgccaatttacaagacatgaaatgtgacgtcatcaagactggcatgcttacgacagctgctatcgaggttttgcacgaaaaactgctgcagctcggcgaaaatagacctaagctagtagttgacccagtccttgttgctacttcaggctcttctttagctggaaaggatatagccagtttaattacggagaaaatcgcaccttttgctgacattttgactcctaacattccggagtgtttcaaactgttaggtgaagacagagaaataagcaaattgcgagacattttcgaagtcgcaaaagaccttgccaaaatcaccaagtgttccaatattttggttaaaggtggtcacattccatggaatgatgaagaaggaaagtacatcactgatgtcctttacttaggggccgaacaaaggtttataaccttcaagggtaattttgttaatacaacccacactcatggtaccgggtgcaccctagcttccgccattgcatcaaatttggctcgcggttattcccttccccaatccgtttatggcggtattgagtacgtccaaaatgcggtggccattggctgcgatgtcacgaaagagactgttaaggacaacgggccaattaatcatgtctacgccatcgaaattccattagaaaaaatgctcagtgacgaatgtttcactgcatcagatgccgtacacaaaaagccagtcaaaagttctcttaacaaaatccctggaggaagtttctataaatatctgataaatcaccctaaagttaagccccactgggactcctatgtgaaccatgattttgttagaaaagtagcagacggttccttagagcctaagaagttccaattttttatcgaacaagattacctgtacttagtcaattatgccaggatttcctgcatcgcgggtagtaaatccccgtgtcttgaagacctggagaaagagctagttattgtcgaatgcgttcgtaatgggctttgccaacatgaaaggagattaagggaggaatttggaattaaggatcccgactacttacaaaagattcaaagaggtcctgcattaagggcttactgtcgttactttaatgatgtttccagaagaggtaactggcaggagttagttatagctcttaatccttgcttaatgggctatgttcacgctttgaccaagatcaaggatgaagtaactgcagcagaaggctccgtttaccgtgaatggtgtgaaacttactcatcgtcatggtgccacgaagctatgcttgaaggcgaaaagctgttgaatcacatcttggaaacataccctccagaaaaacttgatacactggtcacaatatatgctgaagtttgtgaattggaagctaacttctggaccgccgctctagaatatgaatga

SEQ ID NO: 3857 - DNA, 1656 bp, Saccharomyces cerevisiae
atgacctattctacagttagcatcaacacgcctccaccatatcttactttagcctgcaacgaaaagttgccaacagttttatccattgctggaacagatccaagtggtggagccggtatcgaagctgatgtcaaaactatcacagcacacagatgttatgccatgacatgtatcactgctttaaatgctcaaactccagttaaagtctacagcataaataacacaccaaaagaagtggttttccaaactttggaatccaatttaaaggatatgaaatgtaatgttatcaaaaccggtatgcttaccgcagctgctatcgaagtcttgcacgaaaaactgctgcaactcggcgaaaatagacctaagttggttgttgatccagttcttgtcgctacttctggttcttctttagctggaaaggatatagttagtttgattacggagaaggttgcaccttttgctgatattttgactcctaacatcccagagtgttacaaattgttaggtgaggaaagaaaggttaacggattacaggatattttccaaatcgcaaaagaccttgctaaaataaccaagtgttcgaatatactagtgaagggtggccatattccatggaatgatgaaaaggaaaagtacattaccgacgttcttttcttgggtgctgaacaaaaattcattatctttaaaggcaatttcgttaacaccacgcatacacatggtactgggtgcacactagcttctgccattgcatcaaacttggctcgtggttattctcttcctcagtctgtttatggtggtattgaatacgtccaaaatgccgtggcaattggttgtgatgtcacaaaagaaactgtcaaggataatggaccaattaatcatgtttacgccgtggaaattccattggagaaaatgctcagtgatgaatgttttactgcatcggatgttatacctaaaaagccgctcaaaagtgctgctgacaaaatcccaggcggtaatttctatgaatacctgatcaatcaccctaaagttaagccacactgggattcctatattaaccatgagtttgttaaaaaggttgcggacggtacattagaacgtaagaagtttcagttctttattgaacaagattatgcatacttggttgattatgctagagttcattgtatcgcgggtagtaaagctccatgcctagaagatatggaaaaggagctagtcattgttggaggtgttcgtactgaaatgggtcaacatgaaaagagattaaaagaagtatttggtgttaaagatcctgattactttcaaaagattaagagaggacctgcattaagagcttactctcgttactttaacgatgtttccagaagaggtaactggcaagaattggttgcatcccttactccttgtttgatgggttatggtgaagctttaactaaaatgaagggtaaagtcaccgcacctgaagggtccgtttaccacgaatggtgtgaaacttacgcatcttcatggtatcgtgaagccatggatgaaggtgaaaaacttttgaaccacatcttagaaacataccctccagagcaacttgacactttagtaacaatctacgctgaagtttgtgaattagaaacaaatttttggaccgctgcgctagaatacgagtag

SEQ ID NO: 3858 - DNA, 1656 bp, Saccharomyces cerevisiae
atgacttcggctgtaccttatgatccatatgatgatctggataacaatccatttgctgagccccaggaggaagattctgaacctgctgcaacaaccacagatggatcatcttctatgtcagaggagcgtgtaggtactgagcaaactgcagcttccgttcaggacaacggaactgcaaataacattcaaaatggtcttggtgaagaaggaaacgcaacacgatcaaaaacttcaaacgaacacaatgaaaaccaacaaccatctcaaccatcagaacgtgttatacttcctgaaagaagtgatgagaaaaaaaaatacactctacttgcaaaagtaacaggattggaacgatttggatctgcaaccggtaagaaagagaatccgactattatatttgattgctccacaaatttgccaacatttcgcaaacaacaatacaagaatgtcaaaaaatcatacgaagaattccaccaattgttcaaatatctgaatgttgccattcaggaatcttttgttcctactcttccctctgcgtatactacattcggaattaatagcgaagaagataggatgaaagtaacgcgaaatttccaactttggtttaacaggctatcgcaagaccccttaattattcggaatgaagaagtggcctttttcattgaaagtgactttaatacgtacacacccatcaacaagtccaaatcactcgcatctgggttgaaaagaaaaacattgaaacaattagcacctccatatgatgaaatcacagaattagcagaattccggccattagtcaagtctatatatgttgtttctcagagcttgcaagaaaaactgctaagagtttccagaaatcgcaagatgatggttcaagaagaaaatgccttcggccaggatttcgttaatctagatgagcacaataaactttacagaagatacggtaaaatattgactgctgtgggtgatattgatagcattatagcaaccatggacatggcgacattgtacgatggtttagagtggattgtcagagatgcttatgccgtgaaggaagcattgaccaacaggcattttatcatgcgaaatctagtacaggcacagcagaattcaaaggcgaaacaggaacaagcacgcaggttccggtcaagaagagatattaaccctatgaaaatcgatgaagcactacgtcagttgaaagctgcagctaaaaacgaacaagttttgacccttaagcttcaacgaatcacgtccaacatgattatcgagagaaaacagtggattagctggtatgaagaatggataagaagctcgatcaaagaatttacactaagaaagatagagtatgaaagaaagaagctgacgttactagaacgagtacgttctgatatcagaaaagctgatgaaaacggaggtttgtcacgtctaggacgccatgctgtctcaaacaacaactccgatacttctcaaacccttaaaggggacagttggacgggagagagcaaccgcaaaagtcaaatccccatcaacaagatcgctcataccgaatttgatgatgaactattcactgaagacgatgggtacaactctcaggactcagacactacatcactgaatgcgcgccatgctgcttcacttttgggcatgtccactaaataa

SEQ ID NO: 3859 - DNA, 1656 bp, Saccharomyces cerevisiae
atgagcactgcttcaacaccgccaattaacttatttcgtagaaagaaagaacataaacgtgggatcacatacacaatgttactatgtgggccagcaggtacaggaaagaccgcctttgctaacaatctattggaaactaagatctttccgcataagtatcaatacggtaaatcaaatgctagtattagctctaacccagaagtaaaagttattgctccgacaaaagttgtttcatttaattcgaaaaatgggattccatcttatgtttctgaattcgatccaatgagagccaatttggaaccaggtattaccatcacctccacttcattagaacttgggggcaacaaagatcaaggaaagccagaaatgaacgaggatgataccgtgtttttcaacttgattatgacgcatggtataggcgaaaacttggacgattcgttgtgttctgaggaagttatgtcgtatttagaacaacaatttgacattgttttagctgaggaaaccagaattaaaaggaatccgaggtttgaggacaccagggttcacgtagcattatattttattgaacccactggacacggtctgagagaagtcgatgtagagctcatgaaaagcatctccaaatacacaaatgtactgccaataataacaagagctgactcattcaccaaggaggagctaactcaattcaggaaaaatattatgtttgatgtggaaagatacaacgtcccaatttacaaatttgaggttgaccctgaagatgatgatttggaatccatggaagagaatcaagccttggcatccttgcaaccatttgctattataacttcagataccagagatagtgaaggtagatacgttagggagtatccgtgggggataatatcaatcgacgacgacaaaatttcggatttgaaagttttaaaaaacgtcctgtttggttctcacttacaagaattcaaagacaccacgcaaaatttgctttacgagaattaccgttccgaaaaactatcgtccgtggccaacgctgaagaaattggtcctaattctacaaagagacagtcaaatgctccaagtttaagcaactttgcctctttgataagcactggtcaattcaattcttctcaaactcttgcaaacaatttgagagcggacacaccaagaaaccaagtaagtggaaactttaaggaaaacgaatacgaagacaatggcgaacatgattcagcagaaaatgaacaggaaatgtctcccgtgagacagttgggtagagaaataaaacaagaaaatgaaaatttgataagatctatcaaaacagaatcttcaccaaaattcttgaactctccggacttaccagagcgtaccaagttaagaaatatttcagaaaccgttccatatgtcttgagacatgaaagaattttagcaagacaacaaaaactggaagagttagaggcccagtcagctaaagaattacaaaaaagaattcaagaattagaaagaaaagcacacgaattgaaattgagggaaaaactaataaatcagaataaactaaacggttcatcatcttcaatcaattctctacaacagagcacaaggagccaaattaaaaaaaatgacacgtatactgatttagcctctattgcatcgggtagagattga

SEQ ID NO: 3860 - DNA, 1656 bp, Saccharomyces cerevisiae
atgagtagtggtaccgaaaatgatcaattttatagttttgatgaaagtgattccagctctattgaactttatgaatctcacaatacatctgaatttactatacatggactagttttcccgaagttaattagtgtaacaagccaagattcagaatttgacatcaatgaagatgaagatggagtcgataccatatatgaggggatgctagatgctcctcttacgaaaaacaacaaaagaatactgtgtgaagggagtgtaccgaatctcagttatgaatgcttaaccaccaagggtatatttgaaagaatgcttcaaagggttgaccatttacaacctatttttgcaattccatctgcggatatattgatattactacagcattatgattggaacgaggaacgtttgctagaagtttggaccgaaaaaatggacgaattgcttgtggagcttggcttaagtaccacagcaaatatcaagaaagataatgattataattcacatttcagagaagttgaattcaaaaatgactttacatgtattatttgttgtgataaaaaggatacggaaacatttgcgttggaatgtggccatgaatattgtatcaattgctaccgtcattacatcaaggataagttgcatgaggggaacatcattacatgcatggactgttccctggcattgaaaaatgaagatatagataaagtgatgggacatccttcgagtagtaagttgatggattcttcaatcaaaagttttgttcaaaaacataatcgtaactataaatggtgcccgtttgctgactgtaaatccatcgtgcacttgcgagatacgtcatcattaccagaatatacccgtttgcattattcacctttcgttaagtgtaattcatttcatagattctgtttcaattgcggattcgaagttcattccccagcagattgtaaaataaccactgcttgggttaaaaaagccagaaaagaatcagaaattttgaattgggtcttgtcccacactaaagaatgtccaaaatgttctgttaatattgaaaaaaatggtggctgcaaccacatggtttgctcaagttgtaaatacgaattctgttggatttgtgagggcccctgggcgccccacggtaagaacttttttcaatgtacaatgtataagaataatgaggataataaaagtaagaaccctcaagacgctaataaaaccttgaagaaatacactttctactatagattgtttaacgaacatgaagtttcagccaagcttgattggaacctggggcaaactttgggcacgaaagttcatgcactacaagaaagaataggtatctcatggattgatggacagttcctatcagaaagtttaaaagtgttgaatgagggacgaaccgtattaaaatggtcatttgccgtggcatattactcggatgcatctcataatttgacgaagattttcgttgataaccaaatgctcttagccaacgcagtggaatcgctatcggagctattgcaaataaaaacccccgaagtgatcatgaaacgaagaccagagttttataataaggccggatatgtggaaaatagaaccactgcattaatggaatgcggtagagaactgctatgtaagggaatttgcaaagctgcagaatga

SEQ ID NO: 3861 - DNA, 1656 bp, Saccharomyces cerevisiae
atgcgtaggagtgtatacctcgacaacacgatcgagttcctgcgaggcagagtatatctcggtgcatatgattacacgccggaagatactgatgagctggtgttttttaccgtggaggacgcaatcttttacaacagtttccatttggatttcggtcccatgaacattggacatctatatcgttttgccgttattttccatgaaatcttgaatgacccagaaaatgccaataaagccgttgttttctattcatctgcatcgaccagacaacgtgctaacgccgcatgtatgctttgctgttatatgatcctcgttcaggcatggactccgcatcaagtgcttcagccgttggcgcaagtagaccctcccttcatgccatttagagatgccggttattctaatgcggatttcgaaatcacaattcaagatgtggtttatggcgtttggagggctaaggaaaaaggccttattgatttgcattccttcaatttggagagttacgagaaatacgaacacgtggagtttggagacttcaatgtactcaccccagattttattgcatttgcgtcaccacaagaggaccatccaaagggctatctcgctaccaaatcttcacatttgaaccagccgtttaagtcagttctgaattttttcgccaacaataacgtccaattagtggtaaggttgaattctcatttatataataaaaagcattttgaagacattggcattcaacatttggatctaattttcgaagatggtacatgtcctgatctttccattgtaaaaaactttgttggtgctgctgaaacgataattaaaaggggaggtaaaattgctgtgcactgtaaggctgggctaggtagaactggttgtttaattggtgctcacttaatatacacgtatggatttaccgctaacgagtgtattggcttcttaaggtttataaggccgggaatggtcgttggccctcaacagcattggttatatttacaccagaatgattttagagaatggaagtacacaaccagaatttctttgaagcctagtgaggccattggcggcttatatcccttaataagtttagaagaataccgcttacaaaaaaagaaacttaaagacgacaagagggttgcgcaaaataacattgaaggtgaattaagagatttaaccatgacgccgccatccaacggtcatggggcgcttagtgccagaaattcgagccaaccttctacggcgaataatggaagtaattcattcaagagctcagccgtcccacagacttcgcctggtcagccgagaaagggccaaaacggttctaatactatagaagatatcaacaataatcgtaatccaacttcccatgcgaataggaaggtagtaatagaaagcaacaactcagatgacgaatccatgcaggataccaacggcacaagtaatcattatcccaaagtttcgcgcaagaaaaatgatatctcctctgcttcatcgtcccgaatggaagataacgaacccagcgcaacgaacatcaataatgccgcagatgataccatactaagacaactattgcccaagaataggagagtaacgtcagggagaaggactacaagcgccgccggtggtataagaaaaataagtggctccatcaagaaataa

SEQ ID NO: 3862 - DNA, 1656 bp, Saccharomyces cerevisiae
atgcgttggtctgtccttgatacagtgctattgaccgtgatttcctttcatctaatccaagctccattcaccaaggtggaagagagttttaatattcaagccattcatgatattttaacctacagcgtatttgatatctcccaatatgaccacttgaaatttcctggagtagtccctagaacattcgttggtgctgtgattattgcaatgctttcgagaccttatctttacttgagttctttgatccaaacttccaggcctacgtctatagatgttcaattggtcgttagggggattgttggcctcaccaatgggctttcttttatctatttaaagaattgtttgcaagatatgtttgatgaaatcactgaaaagaaaaaggaagaaaatgaagacaaggatatatacatttacgatagcgctggtacatggtttcttttatttttaattggcagtttccacctcatgttctacagcactaggactctgcctaattttgtcatgactctgcctctaaccaacgtcgcattggggtgggttttattgggtcgttataatgcagctatattcctatctgcgctcgtggcaattgtatttagactggaagtgtcagctctcagtgctggtattgctctatttagcgtcatcttcaagaagatttctttattcgatgctatcaaattcggtatctttggcttgggacttggttccgccatcagtatcaccgttgattcatatttctggcaagaatggtgtctacctgaggtagatggtttcttgttcaacgtggttgcgggttacgcttccaagtggggtgtggagccagttactgcttatttcacgcattacttgagaatgatgtttatgccaccaactgttttactattgaattacttcggctataaattagcacctgcaaaattaaaaattgtctcactagcatctcttttccacattatcgtcttatcctttcaacctcacaaagaatggagattcatcatctacgctgttccatctatcatgttgctaggtgccacaggagcagcacatctatgggagaatatgaaagtaaaaaagattaccaatgttttatgtttggctatattgcccttatctataatgacctcctttttcatttcaatggcgttcttgtatatatcaagaatgaattatccaggcggcgaggctttaacttcttttaatgacatgattgtggaaaaaaatattacaaacgctacagttcatatcagcatacctccttgcatgacaggtgtcactttatttggtgaattgaactacggtgtgtacggcatcaattacgataagactgaaaatacgactttactgcaggaaatgtggccctcctttgatttcttgatcacccacgagccaaccgcctctcaattgccattcgagaataagactaccaaccattgggagctagttaacacaacaaagatgtttactggatttgacccaacctacattaagaactttgttttccaagagagagtgaatgttttgtctctactcaaacagatcattttcgacaagacccctaccgtttttttgaaagaattgacggccaattcgattgttaaaagcgatgtcttcttcacctataagagaatcaaacaagatgaaaaaactgattga

SEQ ID NO: 3863 - DNA, 1656 bp, Saccharomyces cerevisiae
atgctgaaaaacttcaaactctcaaaaagagatagtaatgggtcgaagggcagaattacatccgcagatatttccacaccttctcatgataatgggagtgttataaagcatattaagacagtaccagtgaggtacctttcttcatcttccaccccagtgaaaagccaacgggactcttcaccaaaaaacagacataattctaaagatattacttctccagagaaagttataaaagccaaatacagttatcaggcacaaacttcaaaggaactatctttcatggaaggtgaatttttttatgtatctggagatgagaaggattggtataaagcttcaaatccttctactggaaaagagggtgttgtccccaaaacctattttgaagtgtttgatagaactaaaccttcctctgtgaatggatccaatagttcaagtcggaaggttacaaatgattcattaaacatgggatcgttatacgccattgttttatatgactttaaggcagaaaaagctgatgagttgacaacttatgtgggagagaatttgtttatttgcgcccaccataactgtgaatggttcattgctaagccaattggtcgacttggagggcccggccttgttcctgttgggtttgttagcatcatagatattgccacggggtacgcaacaggtaacgacgtaatagaagacatcaagtcagttaacctaccaactgttcaagaatggaaaagcaacattgcaagatacaaagctagtaatattagccttggttctgtggagcagcagcagcagcaatccattacaaaacctcagaacaaaagcgcaaagctggttgacggtgaattattagtgaaagcatccgttgaatcctttgggttagaagatgagaagtattggtttttggtttgctgtgaattatctaacggtaagacgaggcaactgaaaagatactatcaagatttctacgatctgcaggttcaacttttggatgcgttcccagcagaggccggtaagttgagggatgcaggtggacaatggtccaaacgtataatgccctatatccctggacccgttccatacgttaccaatagcataacaaaaaaaagaaaggaggacttgaatatatatgtggcagacctagtgaatcttcccgattatatatctcgctcagaaatggtgcattccttattcgttgttttgaataatggtttcgacagagaatttgaaagagacgaaaatcaaaacaatattaaaacattacaagaaaacgatacagcaacctttgcaacagcatctcaaacttctaattttgcctcaactaaccaagacaacactttaactggcgaagacttgaagttaaacaagaaactctcagatttatctttatcgggctccaagcaggctccagcccaatcaacttctggattgaaaactactaaaattaaattttattacaaagacgatatttttgctttaatgctgaagggtgacacaacctataaagaacttcgtagtaaaatcgctccaaggattgatacagataattttaaattacaaaccaaattatttgatggtagcggggaggaaattaagactgattcacaagtcagtaacataatccaagccaaactgaaaatttccgttcacgatatttga

SEQ ID NO: 3864 - DNA, 1656 bp, Saccharomyces cerevisiae
atggcaagctgcaatccgaccaggaagaagagctctgcttcaagcctatctatgtggagaacgattctcatggcgttaacaacactaccgctaagtgttctttcgcaggagttggttccagctaatagcacaacatcgagcacagctccttccatcacttcgctttccgcagttgagtcatttacgtccagtaccgatgcaacgagcagcgcaagtttatcaacgccgagtatagcttcagtatcctttacttccttcccacaaagttcttcactgcttactctttcgtcaacattatcctcagaactttcctcttcgtccatgcaagtttcgtcgtcttcaacatcgtcgtcttcttcggaggttacgtcatcatcgtcatcatcatcaatatctccttcctcttcatcatcaacaataatatcatcgtcatcatcactgccgacattcactgtggcatcaacatcttcgacagttgcctcctccacactttccactagctcatcgttggttatctctacgtcttcgtcaacgtttacgtttagttcggaaagttcaagctctttgatttcctcttcaatttcaacatccgtttcgacttcttcagtgtacgttccctcctcttcaacttcatctccaccttcgtcctcatccgaattgacatcatcctcgtactcatcatcctcatcctcatccaccctcttttcctactcctcctcattttcatcatcctcatcctcatcatcctcatcatcatcctcatcctcatcatcatcatcatcatcatcatcatatttcaccctctccacatcttcctcttcatccatatactcgtcttcgtcatatccttcattttcatcttcatcttcctcaaaccctacctcatcaatcacttctacatccgcctcatcttctattactcccgcttccgaatattccaatttggcaaaaaccataactagtataatagaaggccagaccatcctctctaactactataccacaataacgtattcaccgacagcatccgcatcttcaggaaaaaattcacatcactcaggcttatcaaaaaagaatcgtaatattatcatcggttgtgtggttggcataggtgcccccctcatcctaattctactaatattgatttacatgttttgtgttcagcctaaaaaaacggatttcattgactctgacggtaaaattgtcacagcttatcgtagtaacattttcaccaaaatatggtatttcttgctgggtaaaaaaattggtgaaacagaaagattcagctcagattcccccatcggcagcaataatattcagaattttggtgatatcgatccagaagatatacttaacaatgacaacccctacacccctaaacacactaatgttgaaggctacgacgacgacgacgacgacgacgctaatgatgaaaacctatcatccaacttccataacagaggcatagatgatcaatactcacctactaaatctgcatcatattcaatgtcgaatagtaatagtcaagattacaacgacgcagatgaagtaatgcacgatgaaaacattcatcgtgtttatgatgacagcgaagctagcatcgacgagaactattacacgaaaccaaacaacggcttaaatatcacgaactattaa

SEQ ID NO: 3865 - DNA, 1656 bp, Saccharomyces cerevisiae
atggcatcgcaggctacaactcttcgaggctataacattagaaaacgagataatgtatttgaaccaaaatcaagtgaaaacctcaacagcttaaatcaaagcgaagaagaagggcatattgggagatggccacctttaggttatgaagcagtatctgccgagcaaaaatcggcagttcaattgcgtgaatcgcaagcaggagcgtcaataagcaacaatatgaattttaaggcgaatgacaagtctttttccacatctactgctggaagaatgagtccggatacgaattcattacaccatatattacctaaaaatcaagttaagaataatggacaaacaatggatgccaattgcaataataacgtatccaatgatgctaatgttcctgtttgtaagaactgtttaacctctacaacaccattatggagaagagatgagcatggagctatgctttgtaatgcgtgtggtctctttttaaagcttcatgggaaacccaggccaattagtttgaaaactgatgtaataaagtctcgaaataggaaaagtaatacaaatcatgcacataatctggacaactttcggaatcagacgctgattgcagagcttaagggtgattgtaatatagaatcaagcggtcgcaaagctaacagagtaacatctgaagataaaaagaaaaaaagttcgcaacttttaatgggaacatcatctactgcgaagatatccaagaagccaaaaacggagtctaaggaaagaagcgattctcacctatcagcaacaaaattagaggtactgatgtcgggagattgttcgagaccaaacttaaagcctaaactgcccaaacaagatactgctatataccaagagaagttacttacgttcccaagttatacggacgttaaagagtattcaaattctgcacaccaatctgcttttatcaaagaacggtcgcaattcaacgcagcctctttccccctcaatgcttcacattcagtaacatcaaaaacaggcgcagattctcctcaattacctcacttatcaatgctgcttggaagcttgagcagtacttcaatatcaaataacggaagtgaaatagtgtccaattgcaataatggtattgcctctaccgccgcaactctggcacccacttcttcacggacgactgactctaatccatccgaggtaccgaatcaaattagatcgacgatgtcttccccagatataatatctgctaagcgtaacgacccagcccctttatctttccacatggcttctattaacgacatgcttgagacgagagatcgtgcgattagcaacgtgaaaaccgagacgacaccgcctcatttcataccgtttctacaatcttctaaagctccctgtatatccaaagcaaattcacaatccatctcaaatagtgtttctagttctgatgtttctggacgaaaatttgaaaatcacccagctaaagatttaggtgatcagttatccactaaattgcacaaagaagaagaaattataaagctcaaaactagaataaatgagttagaacttgttacagatttatataggagacatatcaatgaattagacgggaaatgtcgagctcttgaggaacgtttgcaaaggacagtaaaacaagaagggaataaaggaggatag

SEQ ID NO: 3866 - DNA, 1656 bp, Saccharomyces cerevisiae
atggtgccagaaaatagaaggaaacagttggcaatttttgtagttgtcacatatttgctcacattttattgcgtgtattcagccaccaagacaagcgtttcctttttgcaagtaacactgaagctaaatgaaggcttcaatctaatggttttgtcgatattcatcttattaaattctaccttactatggcaactcctaacgaaactattatttggtgaactgaggcttattgagcatgagcacatttttgaaaggttaccatttaccattataaacaccttgtttatgtcctcactgttccacgaacggtattttttcacagtggcattttttggactattactactctatctgaaagttttccattggattttaaaggataggctggaggccttattacagtcaataaatgattccaccacaatgaaaacccttatctttagtagattctcatttaacctcgtactattggcggttgtagactaccagataataacacgatgcatctcctccatatatacaaaccaaaagagtgatattgaatccacatccctttacctgatacaagtaatggagtttaccatgcttttgattgatttgctaaatttattcctacagacttgtttgaatttctgggaattttatcgctcacaacaaagtctgtctaatgagaacaaccatattgtccatggcgatcctacagatgaaaacacggttgagtctgatcaatctcagccagtgctgaatgacgacgacgatgacgacgatgatgatagacaatttaccggcctggagggtaaattcatgtatgaaaaagcaattgacgtattcacaagattcttaaaaacggcacttcatttgtctatgctaataccatttaggatgcctatgatgcttttgaaagatgtggtgtgggatatcttggcactatatcaaagtggcacaagtttgtggaaaatctggagaaataacaaacagctcgacgacactcttgtcactgtcaccgtagaacagctacaaaattctgcaaatgatgacaatatttgtatcatttgtatggatgagttaatacattctccaaaccagcagacgtggaagaataaaaacaagaaacccaaaaggttaccttgtggccacatacttcatttgtcgtgtttaaagaattggatggaacgttctcagacttgtcctatttgtagattgcctgtctttgatgaaaaaggtaatgttgtgcaaacgactttcacttccaatagtgatatcacgacacagaccaccgtaacagatagcactgggatagcgacagatcaacaaggtttcgcaaacgaagtagatctacttcccacaagaacaacttcccctgatataaggatagtgcctactcaaaatatagacacattagcaatgagaacaaggtcaacctctacaccatctcctacgtggtatacgttcccattacataaaactggtgataattctgttgggtcaagccgatcagcctacgaatttttgatcacaaattcagatgagaaagaaaatggtattcctgtcaaattaacaatagaaaatcacgaagtaaattctctgcatggagacgggggcgagcaaattgccaagaaaattgtcataccagataaatttatccagcatatctag

SEQ ID NO: 3867 - DNA, 1656 bp, Saccharomyces cerevisiae
atgtcacaatttgttggtttcggagtacaagtggagctaaaagatgggaagctcattcaggggaaaattgccaaagcaacctcaaaaggattgactttaaatgacgttcaattcggcgatggtggtaaatctcaagctttcaaagtgagggcgtcaaggctaaaggacttaaaggttctaactgttgcctctcaatccgggaaaaggaagcagcaaagacaacagcagcaacaaaacgattataatcaaaatcgcggtgaacatattgattggcaagatgatgatgttagtaagataaaacaacaggaagatttcgatttccaaagaaatttgggcatgtttaacaaaaaagacgtcttcgcacaattaaagcaaaatgacgatatattaccggagaatagattacagggacataacagaaagcaaacccaattgcagcaaaataattatcaaaatgatgaattggttattccagatgcaaagaaagattcatggaacaagatttcttcaagaaatgagcaaagcacacaccaatctcagccgcaacaagatgctcaagatgatctggttttggaagatgatgaacatgaatacgatgtcgatgatatcgatgatcccaaatacctaccaataactcagtctttgaatattacacatttaattcactctgcaactaactctccatccataaatgataaaacgaaaggtacagttataaatgataaggatcaggtactagctaaattaggccagatgatcatcagccagtcaagatccaactcaacatccttgccagctgcaaataaacaaacaaccatcagatcaaagaacactaagcagaacattcctatggctacaccagtacaactactagaaatggagagcatcacgtccgaatttttcagtattaactcggcagggctactagaaaattttgctgtaaacgcatcgttcttcttaaagcagaaactaggtggccgtgcacgtttacgtttacaaaattctaatccggaacctttagtagtaatactagcctcagattccaacagatctggtgcgaaagctctggcgttgggtagacatctttgccaaacggggcatatccgtgtcataacattatttacatgttctcaaaatgaactacaggattccatggtcaaaaagcaaacagatatttacaagaagtgtggcggaaaaattgttaatagtgtatcgtcgctggaatctgctatggaaacattaaatagccctgtagaaatagtcatcgatgccatgcagggatatgactgtacattgagcgatctggcggggacgtcggaagttattgaaagcagaattaaaagcatgatatcatggtgtaacaaacagcgaggatctactaaagtgtggtctttggatattccaaatgggtttgatgcgggatccggcatgccagatattttcttttcagacaggattgaagcaacaggaattatttgttctggctggcctttgattgccatcaacaacttaattgcaaatttgccaagtctagaagatgctgttttgattgatataggtataccacagggcgcctattcacagagaacttctttgcgtaagttccaaaactgtgatcttttcgtcactgacgggtccctgctattagatttgtaa

SEQ ID NO: 3868 - DNA, 1656 bp, Saccharomyces cerevisiae
atgtttgcatccgctggacaacaacaccctcaaattgttcctaaggaagaggaatccatattaaactacctccttgaagtgagatcctccttggctaaactcaagcaaaataggacccagtatttgaactctaaggatgtccaaactacttaccaacacgtcttgaccaaagtcagagagttggacgatattaggaagaatagtcatgagacgcccgctaagagcgccgccaccctgattcatagtactgaattgcataatagagttgactccgtactggatgatgtctttcaattgctctcgttgtgttttttaactgttgggctaaaaaattctgcacctgcgacttatgcatcgttatctactgtggagagtcttttggaacatttaaatgaatcaaacgtcttcacccatcacgatttgagtcctattaaggaaaggctggaagaaatcagcaagattgtcgaacaaaaaaactctagtcctgcgtacgatgaggatggaaatgatgaccgattaagggaaatcgacaacgaaaggaaaaagaataaaattgaggaagacctattactacgtgctaaattaaagcattgcaaggacgaatatgatatattggaaggcaaattggaggaaattgatccgtctttgtctactgtaatggaaaagttattccgaattagaagaggtttattgtcattagttgcatctgctaaaaaaacaatgtctaaatctgatattaataccaactctttattgcaggaacaaaatgatttgcaaacgaacaatgaaagcttaacggatgacaaacatttagtatctcaagagtatgtccatgagaaattatcagttttgaagaacgaattaagtgaattagaatctaatcgtgacgattctggtaaattcaagtccttggagtctcatcaggtggcagaaaaaggccaaagtgtccttaatggtttattggatgattgccatgatttagttaacgatttatcacaccaaaaaaatggcgggttgactttagatccatatttacagccaatatatgaacagctgattgatataaagactaccttagaaaatttaatgatcacaagaagatggactttgagagaaaccgatttattttcttaccaaaaaaaattgaacgaaattgataacaaaagaatcaatggtaagtttccaacaaaatctcaggactcaaaggggcaatcaatacttttatacctgttgcgtagatgttatgccataatttataaactgttggaaagttcagagcccgtatctgaagcgttgcagccaattcacaatcaactatctacagttcgtcgttgcctattagaattgaaaagaatgggaggtgtgaataatgaaagagagttatacccttatcaaatgaaattggcttcattggacaacctgagaactgaaggtatattctatgactctgatggcaatatacctgaaggccaaggtatattgaatgctttattagcagaatgttttgatatcttgcatgaattaaaagtggaagccgaggaaaaagcacagaactctacttcaagtgatggttctgacgacgatgacaacggagaatcaggcatagactcgaactcaaacgacagcgagcctgaatctgaatatcaacaggaatag

SEQ ID NO: 3869 - DNA, 1659 bp, Saccharomyces cerevisiae
atgagtaccgactttgatagaatttacttgaaccaatctaaatttagcggtagattccgtattgctgattctgggttagggtggaaaattagtaccagtggtggctctgcagcaaatcaggcaagaaaaccatttttattaccagccacagaattatctaccgtccaatggagtaggggctgcaggggttacgacttgaagataaataccaaaaatcaaggtgttatccaactagatggattttctcaggatgactataacttaatcaagaatgatttccatcgccgttttaatattcaggtagagcaaagagaacattccttacgtggttggaactggggtaagacagaccttgccaggaatgaaatggtttttgctttaaatggtaaaccaacttttgaaattccttatgctagaataaataatacaaatttgacctctaaaaatgaagtaggaatagaatttaatattcaagatgaagagtaccaaccagccggtgacgaattggtagagatgaggttctatattcctggtgttattcaaacaaacgtcgatgaaaacatgaccaaaaaggaagagtcaagcaacgaggtcgtaccaaagaaagaagatggtgctgaaggagaagatgtacaaatggcagtagaggaaaagagtatggcagaagcattctatgaagaactaaaggaaaaggcagacatcggggaagtcgctggtgatgcaatagtttccttccaagacgtcttttttaccacgccaagaggtcgttatgatatcgatatttacaagaactccattagactcaggggtaagacctatgaatacaaattgcaacatcgtcaaatacaaagaattgtttcgttaccaaaggcagatgatatccatcacttattggttttggcaattgaacctcctttacgtcaaggacagaccacctacccctttcttgtcttacaatttcagaaagatgaggaaacagaagtgcaattgaatctagaagatgaagattatgaggaaaattataaggataaattgaaaaaacaatatgatgctaaaactcatatagttttaagtcatgtattaaaaggtctgactgaccgtagagtcattgttcctggagaatataaatccaaatatgatcagtgtgcagtttcatgttctttcaaagcaaacgaaggttatttgtatccattagataacgctttcttctttttaactaagccaactttgtacataccattcagtgatgttagcatggtaaacatttcaagagcaggacaaacttctacgtcatcgaggacgtttgatttggaagtggtactgcgttcaaatagaggttctaccacttttgccaacatcagtaaggaagagcagcaattattggaacaattcctaaagtctaaaaacctaagggtgaagaatgaagatagagaggtacaagaaaggttacaaaccgctttaggttcagacagtgacgaagaggatattaatatgggttccgctggtgaagatgatgaatcagtagatgaggattttcaggtcagctctgataatgacgcagacgaagttgcagaagagtttgattcagatgcggctttaagtgatgctgaggggggtagcgacgaagaaaggccttcgaagaagcctaaggtagaatag

SEQ ID NO: 3870 - DNA, 1659 bp, Saccharomyces cerevisiae
atgccggtcgttcacgtgattgacgttgaaagtggtaacctacagtcactaaccaatgcaattgagcatttaggttacgaagtacaactggtgaaatcaccaaaggattttaacatatcaggcacgtcaagattgattttgcctggtgtcggaaattatggccatttcgtcgacaatttatttaatagaggattcgaaaagccgataagagaatacattgaatctggaaaaccaataatgggaatttgcgtcgggctacaagcgctctttgccggttccgtggaaagccctaagagtacgggtctgaactacattgattttaagttgtccaggttcgatgattcagaaaagccagtaccagaaataggttggaattcttgcattccctcggaaaacctattctttggattggatccatacaagaggtactatttcgtccattcttttgctgccattctgaattcagaaaagaaaaaaaacctagaaaatgacggttggaaaattgcaaaagctaagtacggttcagaggaatttattgcggcagtcaacaagaataatatattcgctactcagttccatcctgaaaaatcaggtaaagctggtttgaacgtcattgagaattttttgaagcaacaaagtcctccgattccaaactatagtgcggaagagaaggaactcttaatgaatgactattcaaattatggtctaacacgcagaattattgcttgtcttgatgtacgtactaatgaccaaggtgatttggtggttactaaaggtgatcaatacgatgtacgtgaaaaaagtgatggtaaaggtgttagaaaccttggtaagcctgttcagttggcacagaaatattaccaacagggtgcggatgaagtaacatttttgaatataacttcttttagagattgtcctttgaaggatactccgatgctagaggttctgaaacaagccgcaaagacagtctttgttccattgacagtcggtggggggatcaaggatattgtcgatgttgatggaaccaaaatacctgctttagaagttgcaagtctatacttcagatctggtgctgataaagtatcgatcggtacggatgcagtctatgcagccgaaaaatactacgagttgggtaacagaggagatggaacgtcaccaatagagacaatctcgaaagcatacggtgctcaggcagttgttatttctgtcgaccctaagagagtatatgtaaattcacaagcagatacgaagaacaaagtcttcgagacagaatatccgggccccaatggagagaaatactgctggtaccaatgtacaatcaaaggtggaagagaatctagagaccttggtgtgtgggaattaacaagggcatgtgaagctctaggtgctggggagattttattgaactgcatagacaaggatggctctaattctggttatgatctggaattgatagaacatgttaaagatgcggtcaagattcccgtcattgcatccagtggcgccggtgtacccgaacatttcgaagaggccttcctaaagacccgcgcagatgcttgcttgggtgcaggtatgttccacagaggtgaattcactgttaacgatgtaaaggagtatttactagagcacggattaaaggttagaatggatgaagagtaa

SEQ ID NO: 3871 - DNA, 1659 bp, Saccharomyces cerevisiae
atggaggcacttatcgtatttatagtgctttccgtatccggagcatttgcttacaaatgctcctatgaaaggctctggtttaaagtagggtctttgtttgacattatatcaacttcctcgaagaaaaatgtcattccgttggcaagcaaaatggaagttggctcgaatgaggatgtgtctagtatgggtaatttcataaataaattctacacagagtattctttaccctcacataaggtactgcaatcactgcgagtccttttttcattagcaatgatgacgtatacagtaaccatagagattattctatggcagattaaggttgctggaatggacaaggaagttactttcataacgacttgggtgtggcctctgactgcaatcatgctatccttcatactaattttatttcagccctttttcattataatatcgttactgaataaattctacaatgacaagttcgatatcgataggttgataatagtgacatgcataatcttgtccacacttattgcgctgttaagttacataaatattggaccgttccagtacacaaaaaatattctaactagattgtccatcggaggcgtcacagtcatggcttccctatctgggttagccactgtttctagtttatactacaactttttagtcatctggcacaagtttcgtaatacaccaatgtcagaccccagttttagaaacatcaacaacagcaacaataacagtaaatctctcttatggacaacagacgcctatatagaggaaaaaatccaagattatgaacacaacattgaacaaaatgtacaaatattaagaagtttagaagaagaggtcggagaaaactcaacttttaaagcagagttgatggaaaaaatcgcctggtatcaactggagcttgggaaattggaagcattattacaacagtcccctcaggtacgcacttttaagaaagcttttgaagtcgggtttatcatatactgtcttcataaactaataataactttcctgaaaagaatcccctatatcatataccactcgctcaaatatccagatgactacgattatgaaaattttagtgaaaatgcagcatccgatcctttagccattacgatagcaaatattttggatttttcgtttttcaggttcaattaccagcacgatctcgattcgttaacaaaacagatatcgttatttttgtcaatttctctctttctttgctgtctttctgctgtcaataccaccatctcctacgttgtgacccttttgcccataaagttccagattcttgcacttttcgccatgcagaatgatgacactgctaatgtacttccagagtacaccaataactcttcctataagggaaaaaagagaaactattctcaggaacaaaaaggaatatctttgataaaaaatctggtggtgtcagagttgactggcgtctacgttttggctacaacgctaatggttaggtcccatctcccttttgaagtatcacaaagattaaaggagctattgggtggaaagtttaccgtcccaaacattgtcatagattcttggtttgatgaagtctacgcttttgcatgtgtgtttacctttatttgcataagaattgcagaacgaaagctttccaccaaaaaagtcagtgttgaataa

SEQ ID NO: 3872 - DNA, 1659 bp, Saccharomyces cerevisiae
atgggtaaaattgcagagtttctcgggaatccaggtgctaggcctgacgttcatcatagagcacctactgttgactgcaaacagtacgaagaattcggtgattctaacgattacaaaaatgatgatgtggtcagagtagtcagccatagcgatgagagtactgatgacgaactttgtaatgtgaatttaacagaaacaggggcaatcttcacgagtaaaggttttaccgggttaagcaaaggtttcacagataagaccctggatttcctggtacgagtggccggttcgcaggcggttttttttattgtttggatcatcctcataatttgggtggttattggtattgtttataacgcacctttcaattggcaagttgttatgcaggacggacagtctattcaaagttatgtttgggacacactgttgatgagacaacagttgatgagtacgcatgaacaaattttgatctgcggtagattgaagtcgagattggcttccttcaaaaactatctaacaagaagcaccccagaggaagaaaaagcagactgcacagttgaagctaatgaagtcagctctgttgaaaatcatatagacccatctgccattaacggagaactgcctgtggaaaattggtacgaccgtttatctaacgtagcaagtaggtatatgggttcaattgcagcaatggtgatattttggataggtattttcgtttggattggttgcggtgctatcccaaaagatgcgggcaacactccaccttacaccggagaaactacaggtagtaatccaagattgaaaaagttcagtgacgcttggcagatgtatattaacactgcagttgcagtttcccttctaatttgcactactttcttacaaaatataagggctagacatgattatttcacggggaggtttttagttgatatctttgatatggacgagaaaatcgactatcgtataagaaagcattttaacgattttgaaacacctcacccagttgttactattgaatctaaaaaaaggtcgacagggagaaagatgattgattggtatgctgatattattggtactggtattggtgtcctgattggtgtggcagtgttcgccacatggattggtattggttcgccaatgaagtgggatgataattggtggttgattatcggtacatacacaggtttaattgggtttttggacggtttcgttttgagagaagtgtacttccgaatcgttcaacatgaagagaaaaattattctgatgtggctaaagaagaccttgaattattccaagaattaggtattgaatgtcccgaagaatttagtggtaaagctcctgaaattaacactattggttacagaacatcccaatatattaataggatctgctcaactccatggagtgttcttgtatccgtcatcatcatcattggtttaatttgtattgcttccggtttgcgttggagtacaacaggtcaattgattgctaacacgccaactatgattatcgaagaatttttcttgctagttttgttgcaagcacataattgggccgatcgtcaaagaagagtggaggttaccgctttgtacgcacgtaggcgcatacttctatcatacgtagaaaagcgtttcccagaggttatgatgttggaaaaatag

SEQ ID NO: 3873 - DNA, 1659 bp, Saccharomyces cerevisiae
atggtattgcttatatcagaaattaaagatattgccaagaggctgactgctgcgggtgacagaaagcagtacaactccattatcaagttaatcaatgaactagtgattccagaaaatgttactcaattggaagaagatgagacagaaaaaaatttgagatttctggttatgtcgctattccagatatttagaaagctgttttcccgcggcgacttgacccttccttcgtccaaaaagagcacattagagaaggaacagtttgttaattggtgtagaaaggtgtatgaagcgttcaagacgaagctgttagctatcatttcggacatacctttcgaaacatcacttgggttagattcgcttgatgtctatcttcaacttgcagagctggaatcaactcattttgcatctgaaaagggcgcaccatttttccccaataaaacattcagaaagttaatcatcgccctatggtcctcgaacatgggtgaaatagaggatgtcaaaagctcgggtgcgtctgaaaatttaatcatagtagaattcacggaaaaatattatacgaaatttgcagatattcaatactactttcaatcagaatttaaccaactattagaggatccagcctaccaggacttgcttttgaaaaacgttggtaaatggttagctttagtaaatcatgacaaacattgctctagtgttgatgcagatttagagatctttgtaccaaatcccccacaagccatagagaacgagtccaaattcaagtccaatttcgagaaaaattggttatcccttttaaacggccaattgtctttacagcagtataagtctattctgttaattttgcataagagaataatacctcatttccacactccaactaaactaatggatttccttactgattcctacaatttgcaaagctctaataaaaacgccggtgttgttccgatcttggctctgaatggcctttttgaattgatgaaaagattcaacttggaatatccaaatttttatatgaaactttatcaaattataaatccagacttaatgcatgttaaatacagagcaagatttttcaggttaatggacgtatttttgtcatcaacacatttatccgcccatttagtagcatctttcatcaaaaagctagccagactcaccctagaatcaccaccctctgctattgtcaccgtgattcccttcatctataatttaatcaggaaacatccgaattgtatgattatgctgcacaacccagccttcatttccaacccattccagacacctgaccaagtggcgaacttgaaaactctgaaagaaaactatgtagatcccttcgatgttcatgaatcggaccctgagttaactcatgcactggattcctctctgtgggagctggcgtcattgatggaacattatcatcctaatgtagccacgttggcgaagatatttgctcaaccatttaagaagctaagttataacatggaagatttcttagactggaactatgattctttgctcaatgcagaatcttcaagaaagttgaagacacttcctacgttagaatttgaggctttcacaaacgtttttgataatgaagacggcgatagcgaagcgtcatcccaaggtaacgtctacttgcctggggtagcatggtga

SEQ ID NO: 3874 - DNA, 1659 bp, Saccharomyces cerevisiae
atgtccgtaacttttaaggacgatgttcatcggattctgaagtttgttgctaattgcaatggcaggtttgaagattccaaatgtgatataagagaatcgcctctcggtggattgggtgtctttgcaaagactgatattgcagaaggtgagtcaatattgacgttgaacaaatcctcgattttttctgcatctaacagctccattgccaatttgttatgtgacagtagcatcgatggaatgttagctctaaacatcgcattcatttacgaaactacagttttcagaaattctagtcattggtacccatttctgcgaactatccgaattcgtgatgacgaagggcacttaaacctgccgccaagcttttggcatgcggatgctaagcgacttttaaaaggaaccagtttcgataccttattcgattcgttggcaccagaagaagaaatcatggaaggatttgaaattgctgtggatttggcacacaaatggaacgacgagtttgggttggaaattccaaaaggcttcctagacgttagtgaggagaatcatgaagaagattacaatttgaaattagaaaagtttatatcggtggcatatactttatcatcaagaggatttgaaattgacgcgtaccatgagacagctttggtgcccatcgcagacctgttcaatcatcatgtttccgacccggatttaaagtttgtatcgctatatgatgtgtgcgataaatgtggtgaaccagacatgtgtaaacatctcatagcagaggaatacttggaagcagaaaatctagacaaaaatatgcccaaagtcgcaagtatggagactcgtgtcatcgatgaagacttaatcaaaagtttagaaaatgatttagagaaagaatactctaatgttacggcaaacatcgaggatgatgatggcggtattgaaaaccctgacgaatgtgtcgatttagtgttaaagaatgacgtcgcacaaggccaagaaatatttaattcctatggtgagctctcaaacgtctttttgttggccagatatggtttcaccgtacctgagaatcagtatgatattgttcatttaggacctgattttatgaaaatcttaaagaaagaagaaaaatatcaagaaaaagtcaagtggtggagccaagtcggtcatggcttgttttcagcatggtatgctcaaatgcgccaagaagatgaagaagacgaagacggtcaagcaaaatcagacaatctgtctgacgatatagagagcgaagaggaagaggaagaggaagagggtgatgatagcttggaatcatggctttcccagctttacatagactcaagtggcgagccttcaccctcaacgtgggccttagctaaccttttgactttaacggccgttcaatgggaatcattgttttccaaaaaggccactcctcacatcagtgattctatagttaacgaagaaaagctgcccttcctggccaaaaaagacaatccccattccaagaaactgctttccaacttacttaaggaaaagcaactaccttgcataaaaggcgacaactcgtcaaagataacaagtgctactaaaagcatgctccaaaatgctcgaacacttgtacaatcggagcataatatcttagatagatgtctcaagagactatcctaa

SEQ ID NO: 3875 - DNA, 1662 bp, Saccharomyces cerevisiae
atgcaagtagaagggcctgacactaacttcgtgagtgatttggctttgggatcaaagaaaagaaggttatccaagacttctgtacaagaggatgatcatacaaatgtggtatcggaagtgaataagaataagaagaaaaaaaaggcaaagcctatgacatgcacattgctaaagtctgtggttgaaaaaggtattggtataaaggatgtaagagacatgactcaatacttgttgcaggctgaaaacaactctcccaaatggattgatatttgtaacaggtcaagtttacagaaaatgatagttctgttcattccaggtttacaaccagatgattttgagaacggaaaaaatacctttaatgaaatcagtgatgataacttcaaatatattcctggagaaattgcctccacgtttcatacatttcccgtgatggcacctggttccaagatgacgctcttttcgccctacaattcatttattaatgttggattgtccaaaatggagaaaataaataaattgaaagagttacaaaagaagaagaaaattactattaacgatttggttctatccgaacaacagttagtggcaaacgattacccactggattctggagacaccaattttgatacagactgggtacaaactgttgactttacccatggtggctcccacatctttgcactagactgtgaaatgtgtctttccgaacaaggtttagttctaactaggatttctctagtgaattttgacaatgaagttatctatgaagagttggtgaaacctgatgtccccatagtggactatttgacacgttacagtggtataactgaagagaaactaactgttggtgccaagaaaacattgcgagaagtacaaaaagatttactaaagataataagtcgttcagatattttgataggacattcgctacagaatgatttgaaagtcatgaaattgaaacatccattggtcgtggatacagctattatataccatcataaagctggcgatcctttcaagccaagtttaaaatacttgagcgaaacctttctgaataaaagcattcaaaacggagaacacgattctgtcgaagatgcaagggcttgtcttgaattgacgaaattaaaaatcttaaatgggttagcatttgggataggtatcaatacggagaacttgttcaccaaattacatcgttttgaagtgaaaaccgttcttctcaacgatatgattattaaaaatcatactgaggacgattctaagggccagttaatccgttgcgtcgaagatgatgagacatggacccatattcacgagaatctaaataaagatgtcaaacttattgtggggagaatcaagaacttagagaggtcacgcaactataataaaaagccacggaaggaaactccttcgttcgatgcgtccatggttcttcatgatatagggcaacatctaacacaattatacgagaatgctacaccaggtactatgattttgatcatgtcgggtacaggcgacacaagaccatggaacaatctttcaactgagttagagtttattcaagacaaaaaggaaagattagataaaagacgcgaaagggaacctgaaatagtagaagccataaagttagcccggggtggtgtagcatcctttactgtaaaataa

SEQ ID NO: 3876 - DNA, 1662 bp, Saccharomyces cerevisiae
atggcattccaagatcaagatatattcatagtgttctcgcatgcctccttatttcttaatcaaaatgatttattaagcctaagtctaacatccaaaaaaatgcatgacatgattgcaatccctcgtctttatagcaatattcacataactaagaatcctgttttaagaacaaacaaatggtttttggacgggggaaaaacttatgtaagtggttatagatctgttctgaaaaccggtgacaagaatgacatatttttatatgatagaattgaaaggttgttggagacatcgcatttaaaatgtataaaacagctgactattgacgaggatttgtttcacaacagggaagaaggattgcaactgttacaaagattggtcaatgaaatcactgacttggacgtgattgaaagtcttgacatcaaggatcctaccttgtttgagttatgttcagcaaagtattatcgcctgtcaagtttaaagaagagagtagtatatggcgaaactggatttgatggtatcaaattatggcaaaacttcaaaagcttaaaatggcaattacctgaatcgttggatttgcaaaacgtaataatccctgaagtgggtgtaatgttaatgaagcaacttaatggaggagagttagaaataaaggacgaagcgtactcaagcctaagggtctttgaatactttgattccctgaacctccgcttcaagaatctgcgccgtttgaagcttaatcatgttcacaaacaaggtgatgggagtgctacttctatgagattatcttcacgcgcgtttaaggatgtagttaatttatccaatcttaaagcccttgaattagaattttcttgtgaggtggacgactgtgaatgtgatgatgactttcttcaagatataacaggaaaccttgtttccttaacaagtctggggttcattgaaaagacattcaccaaaaaagggtaccattacatggacgagaaatgggacttggtcgttaataagtttattttaaatttaccaaacgtgagtaaagatttgcgtttgttaagcatacgacatgacccacctttaaatggcaagggcattgatactgttgatgggaacttgcttcgccgtaaaaaactttatgaaaaggttttaccaaagctaacttcgttggaaacaataatagctccaactgtattgcagtccatcacctcatatgaaatgtatgcgtgtgaccttttgtggaacggctgcaaatgtgcgttctgctccaaatacttaccattatttgataagtacatcatgaatcatcaatacttttcgaccccggatgcaagatacttggatattataccgatagtgtttgcagcatatactggaaaatctctagctaagaggtttgatcctcagaagaactgggatttggatttactacagtatgcccctgaggatacgacgtggaatttccatggctttgagagaattcatcactttgcaagttatgaatgttattttgacgaatcctcatttgagcccttagccactattatatcgcattttttttatccttacatgaactacttgataaagatattgccaaaccttcgccaaactatgttgtcaggaatatactttagcgtgagcccagaattacacacttatgaaactatttatgattaa

SEQ ID NO: 3877 - DNA, 1662 bp, Saccharomyces cerevisiae
atggccgctgagtatgtatacgaaatcgtctattttattactatttcctaaagtatccagagaagtatactagtttccgcaagttacgttgagaaaaaggagcaattctgctctaatagcatttgcactcacacttacatttatcttcaacttgtgactattcacaagatgattttccgtaggggattaccttcacagggtcaaagacaattttagttgatgaatttgaggaaaaatttgaaatatcttgattgttgccaaaaatttcatcgccgaccttgattagaatattttctcaaattttcatttcctaagtgtctctgtttcactcccttcattcgaatgaaaagtggtgttttcaattcgatgtaacttcgtagaaaaaagttttacttgatggtcatacaaacctaattcattctattttcggttatgctaacaaaaatattttattatttgtattattacagaaaaatcttgaccccagaatctcagttgaagaagtctaaggctcaacaaaagactgctgaacaagtcgctgctgaaagagctgctcgtaaggctgtatgttaaacttttgcttacatttatattttatgctgcaacacattttcttactgggatatatgtgagttcacgtgcgtcgccaattttgataagtatcattcgaacagttgcaatattctcaacacctgtggtatcattaggctaatggactatttgttacgttctgtttgttttctcattttatgatgaaaatccattgtatcccaatacatattcgactagtcattgacgatgctgtcgtaacttatcaccatctttcgactgattataagaaaagaaatagaaagtaaaatagaccagagagttaaggtattaaggttacaattattgccgtgtttccagtgtcagaaaaaccattgagtgataatgccgtgtaacaatttttagcataaaatactgtgttttccatctggtatttttttactaacatcaatttactgttttttactttttattttcatttaggctaacaaggaaaagagagccattattttggaaagaaacgccgcttaccaaaaggaatacgaaactgctgaaagaaacatcattcaagctaagcgtgatgccaaggctgctggttcctactacgtcgaagctcaacacaagttggtcttcgttgtcagaatcaagggtattaacaagatcccacctaagccaagaaaggttctacaattgctaagattgacaagaatcaactctggtacattcgtcaaagttaccaaggctactttggaactattgaagttgattgaaccatacgttgcttacggttacccatcgtactctactattagacaattggtctacaagagaggtttcggtaagatcaacaagcaaagagttccattgtccgacaatgctatcatcgaagccaacttgggtaagtatggtatcttgtccattgacgatttgattcacgaaatcatcactgttggtccacacttcaagcaagctaacaactttttgtggccattcaagttgtccaacccatctggtggttggggtgtcccaagaaagttcaagcactttatccaaggtggttctttcggtaaccgtgaagaattcatcaacaaattggttaagtccatgaactaa

SEQ ID NO: 3878 - DNA, 1662 bp, Saccharomyces cerevisiae
atgtcgaaagacttgaattcttcacgcatcaaaatcattaaacctaatgactcttacataaaggttgaccggaaaaaagatttaacaaaatacgaattagaaaacggtaaagtaatttctactaaggaccgacctatcgcttctgtacctgccataacaggaaagataccaagtgatgaggaagtattcgactccaagacgggattacctaatcattcctttttaagagagcatttctttcatgagggtcgactttctaaggaacaggccataaaaatcttaaatatgtcaactgtagcattgagtaaagaacccaatctactaaaactcaaagcgccaattactatatgtggtgatattcacgggcagtattatgatttattgaaactgtttgaagttggcggtgaccccgccgaaatcgactatttattcttgggggattatgttgatagaggtgcattctcttttgagtgtctgatttatttgtactccttgaagttgaataatttagggagattttggatgctaagaggtaaccatgagtgtaagcacttgacctcttattttacttttaagaatgagatgttgcacaaatacgatatggaagtttacgatgcttgctgcagatcattcaatgtcttaccattagcagctttaatgaacggacaatatttttgtgtgcatggtggtatctctccagagttaaaatcagtagaggatgttaataaaattaatagatttcgagaaatcccatctcgtggtctcatgtgtgacctactatgggccgatcctgtcgaaaattatgatgatgcaagagatggtagcgaatttgatcagagcgaggatgaattcgtacctaacagtttgaggggttgctctttcgccttcacttttaaagcatcatgcaagtttttgaaggcaaatggtttgttatctattattagagcacacgaagcacaggatgctgggtacagaatgtataaaaacaataaagtaacaggcttcccgagcttaataaccatgttcagtgcgccaaactacctggacacatatcataataaagctgctgtgttaaaatatgaagaaaacgtcatgaacatcaggcagtttcacatgtctccgcacccttactggttgcctgattttatggatgttttcacctggtcactaccttttgttggcgaaaaagttactagcatgttagtgtctatattaaacatatgtagtgagcaggaacttgacccagaatcggaacccaaagctgcggaggagactgtaaaggcaagagcaaacgcaactaaggagaccggcaccccatctgatgaaaaggcgtcatcagcgatattagaagatgaaacccgaagaaaggctttgagaaataagatattagctattgctaaagtttcaagaatgttttcggtgctaagagaagagagcgaaaaagtggaatatttgaaaactatgaatgccggtgtcttacctcgtggtgctctagctcgtgggactgaaggtttgaatgaaacgctaagcacttttgaaaaggctagaaaggaagaccttattaatgaaaaattaccaccatctttatcggaggttgaacaagagaagattaaatactacgaaaaaatattaaagggagcggagaaaaagccacaactgtga

SEQ ID NO: 3879 - DNA, 1665 bp, Saccharomyces cerevisiae
atgaacaatatatttcatggaactgaagatgaatgtgccaatgaagacgttcttagtttccaaaaaatttccttgaaaagtccctttggtaagaagaagaacatatttagaaatgttcagaccttctttaagtcaaaaagcaaacattcgaatgtcgacgatgatttaatcaataaagagaatcttgcctttgataaatctccattgttaacaaatcacaggagtaaggaaattgatggtccttcaccgaatataaagcagcttggccatcgcgatgagttagatgaaaatgaaaatgaaaatgatgatatagtcttaagcatgcattttgcttctcaaaccttacaaagtccaacaagaaactcatcaagaagatctttgaccaataatagggataatgatcttttaagtagaatcaagtatcctggcagtccccagaggtcgagctctttttcaaggtcaaggtccttgtcgagaaagccaagcatgaatagcagtagcaattcaagcaggagggtgcaacggcaagatgggaaaattccgaggtcatcgagaaaaagttcacagaaattttctaacattactcagaatactttgaacttcacgtctgcgtcatccagtccactagctcctaattcggtaggggtgaaatgttttgaatcatgcctagccaaaacacagataccatattattatgacgatcgtaactcaaatgactttttccctcgaatttctccagaaacgttgaaaaatattctgcagaataatatgtgcgagtcattttataattcatgtcgtattatagattgtcggtttgaatacgaatatactggcggccacataataaactccgttaacatacactcgagagatgagttagagtacgaatttatccataaagttttgcatagcgatactagcaacaacaacactctaccaactcttttaattatccattgcgaatttagttcccaccggggaccttcattggcctctcatttgagaaattgtgatcgtataataaatcaggatcattatcccaaattattctatcccgacatattgatattggatggcggatacaaagctgtttttgacaattttcctgaactatgttatccacgtcagtacgtgggaatgaactcacaagaaaatttgctgaattgtgaacaagaaatggataagtttaggagagaatctaaaagatttgctactaaaaataattcttttagaaaactagcttccccttcaaatcctaacttcttttatagagatagccatcaatcttcaacaacaatggcatcttctgcactatcgttcaggtttgagccgcctccgaagctgtcattaaaccacagaagagtctctagtggttcatcattaaattcaagtgagagtacaggcgacgaaaatttcttccccatcttaagtaagtcgtctatgagtagtaacagtaacctaagcacttcacatatgctactaatggacggactggataccccatcatattttagtttcgaagatgagagaggcaatcatcagcaagtaagtggagatgaagagcaagacggagattttactttcgttggttccgaccgagaagatttacccaggcccgcaagaagatcgttattcccttctctagagactgaagataaaaaatga

SEQ ID NO: 3880 - DNA, 1665 bp, Saccharomyces cerevisiae
atgacacctaacttaccagggttttattatgatagagaacgtcgacgttattttcgcatatctgaaaatcaaagcatttctaccacgggaacgacgaaccagtacagaaaagataatataaagcgacaatgtgttgaggaaaattacgataaaaaattttctatgattaaaaaaaaacgtcagcaaacattacaaaagtacaagcttagtcttctgaatccgttggaaagggcttttcgccctttatcatatgaaaagtacatgattggtttaaatatgcagtatgcatcgcattctctcactgaaggtcatcactcacatagttctgctaacgtaaaatcactcaattttccacacaggatacagataggagtattagcaaattgtattttattggtaactcaagaaggatgttttcatagtaaattagtatttgcaacaaacaagggctatgtcgcaggattttcatccctggataatttttctgaagaaaatttctttacggggttttccatggctgaattaaatcctatgttgaaatataagtccgagccaactgatgtgttcaaaacaatgaaacttgagagaacagttgccatcaaggaagggccgagccattatttttatcacaacgttaataccagatctaacgtgcatacttttgccatctttttacaagacttttcttccttaaaactgctcaaaattcgtcaggtcaaactcaaagaaaattgccaagtccatgattctcttgttgttggagacacgttgattattaccgtaaattatcgttgtcatttttatgatttgattccagaaacctttccaaatccctatatcttttctcctgccaaaagctcaagaaaacacaaaagtaggagtgacattacttccctatcattttgtctacaagaagatgctttatcacctttaaaaaaaacgaacaccggtgtgttttatttaggttacagaaatggtgattcaatggcaatagtcttcactaatattacaaacatgacattacagtactccaagaccaacggtatgacatcagaaagtcgaaatcaacctatcagaaattccctaaaatctgttgtttccataaaagcattgaataataaaggcctaatacttatatctggaatggcagacaaagagaatgtgcaacaactggttatagcagatacgttcctggaggacattctgaccgaaatcccggttgtatcttttaaaactaagttcttaaacgtgactaaggatacagaaatactcgagatatcggatgacgggcgctacttcatttatggttcaactagcgctagggacggaaagggtgattttgaagtattttgtaccactttatctggaaatcttgactacgaaaaatccgaaggtggaaatatcaccctctatccaataggaggtatgaagaactactgtaggttagaaaacttccagtttgaatctatccacctacattcggctttcatacccccaaggtacgtaaatccgtttgatgctgtggaacctctaggtgaagagagcagtacttcaccttacgatatacctgaagaagcactttctcaaaaaatatgcatcttaattcggagagaagatgatccctacaatggggccaatatcttcataacatctgctttgacctag

SEQ ID NO: 3881 - DNA, 1665 bp, Saccharomyces cerevisiae
atgaccgcaaagacttttctactacaggcctccgctagtcgccctcgtagtaaccattttaaaaatgagcataataatattccattggcgcctgtaccgatcgccccaaataccaaccatcataacaatagttcgctggaattcgaaaacgatggcagtaaaaagaagaagaagtctagcttggtggttagaacttcaaaacattgggttttgcccccaagaccaagacctggtagaagatcatcttctcacaacactctacctgccaacaacaccaataatattttaaatgttggccctaacagcaggaacagtagtaataataataataataataacatcatttcgaataggaaacaagcttccaaagaaaagaggaaaataccaagacatatccagacaatcgatgaaaagctaataaacgactcgaattacctcgcatttttgaagttcgatgacttggaaaatgaaaagtttcattcttctgcctcctccatttcatctccatcttattcatctccatctttttcaagttatagaaatagaaaaaaatcagaattcatggacgatgaaagctgcaccgatgtggaaaccattgctgctcacaacagtctgctaacaaaaaaccatcatatagattcttcttcaaatgttcacgcaccacccacgaaaaaatcaaagttgaacgactttgatttattgtccttatcttccacatcttcatcggccactccggtcccacagttgacaaaagatttgaacatgaacctaaattttcataagatccctcataaggcttcattccctgattctccagcagatttctctccagcagattcagtctcgttgattagaaaccactccttgcctactaatttgcaagttaaggacaaaattgaggatttgaacgagattaaattctttaacgatttcgagaaacttgagtttttcaataagtatgccaaagtcaacacgaataacgacgttaacgaaaataatgatctctggaattcttacttacagtctatggacgatacaacaggtaagaacagtggcaattaccaacaagtggacaatgacgataatatgtctttattgaatctgccaattttggaggaaaccgtatcttcagggcaagatgataaggttgagccagatgaagaagacatttggaattatttaccaagttcaagttcacaacaagaagattcatcacgtgctttgaaaaaaaatactaattctgagaaggcgaacatccaagcaaagaacgatgaaacctatctgtttcttcaggatcaggatgaaagcgctgattcgcatcaccatgacgagttaggttcagaaatcactttggctgacaataagttttcttatttgcccccaactctagaagagttgatggaagagcaggactgtaacaatggcagatcttttaaaaatttcatgttttccaacgataccggtattgacggtagtgccggtactgatgacgactacaccaaagttctgaaatccaaaaaaatttctacgtcgaagtcgaacgctaacctttatgacttaaacgataacaacaatgatgcaactgccaccaatgaacttgatcaaagcagtttcatcgacgaccttgacgaagatgtcgattttttaaaggtacaagtattttga

SEQ ID NO: 3882 - DNA, 1665 bp, Saccharomyces cerevisiae
atggacagagatataagctaccagcaaaattatacctcaactggggcaactgcaacttcctcaagacagccctctacggacaataatgcagatacaaattttttgaaggtaatgtcagaattcaaatataattttaacagtccgttacctacaacgactcaattccccacgccctattcttctaatcagtatcaacagactcaagatcattttgccaatacagacgctcacaacagttcgagcaacgaatcgtcgttggtagagaacagtatattaccgcatcatcagcagatacaacagcaacaacaacaacaacaacaacaacaacaacaacagcaagctctaggttcacttgtacctcctgctgtcacaaggacagatacaagtgagactttggacgatatcaacgttcaaccttcttctgttttgcagttcggcaactctttacccagcgaatttttggttgcatccccagagcaattcaaagaatttttgttggactctccgtccaccaatttcaatttctttcacaaaactccggcaaagacaccacttcgatttgtaacagattctaacggtgctcagcaaagcaccacagagaacccaggtcaacaacagaatgtttttagcaatgtcgatttgaacaatcttttgaagagtaatggaaaaacaccctcatcttcatgcaccggcgcattttcacgcactcctctgagtaagattgacatgaatctcatgttcaatcaaccgctgccgacatctccatcaaaaaggttctcctccctgtcgttgacaccatatggaagaaaaattctgaatgacgtcggtacaccttatgcaaaagcattgatatcgtctaacagcgcgttagtggattttcagaaggcaagaaaggatattaccactaatgcaacatccatagggctggaaaatgccaacaacatcttacagagaacgccgctaagatctaacaataaaaaattatttattaaaaccccccaggataccatcaatagcactagcacactaactaaggacaacgaaaataaacaggacatatacggctcttcaccgactaccatccaattaaattcatcaataactaaatctatctccaaattggataactctagaattcccttgttagcttcgagatcagataacattctggattccaatgtggatgaccaattgtttgatttggggttgacaagattacctttatcaccaacaccaaattgtaattctttgcatagtacaaccacaggtacatctgccttacaaattcctgagctacccaagatggggtcttttagaagtgatacgggaatcaatccaatttcaagttcaaacacagtttcttttaagagcaaatcaggcaataataattcaaagggtcgaatcaaaaaaaatgggaagaaaccttccaaatttcaaattattgtggcaaatattgatcaatttaaccaggatacatcatcgtcatctttatcatcatcattgaatgcaagttcgagtgcagggaattcaaattcaaacgtaacaaagaaaagagcaagtaaactcaaaagatcacagtctttactttctgattccggatcgaaatcacaagcaaggaaaagctgtaattctaaatctaatggaaatttattcaattcacagtaa

SEQ ID NO: 3883 - DNA, 1665 bp, Saccharomyces cerevisiae
atggactcggtgacaaattttttctggaatgacacctataatgctggtactccaactagatcaactctcaaggggaagaaagtgcaaaatggcatagatggaaaaagtcaggcaaagaaagagagcatatctagtggttctagaactagtgatcctacacgtggtagtctgccatcttccagtggacagccaactagtggtggcggttttccctcgacatcaaacatccaaaagatgatggcagataccctggtagagaagataatcaaaatggcattaccaccatcttccaaaacggctgttgatacaattcaccatcgtatggttgctggtaaagaaaggcctaagctgtctgtgcagatcacgagtaggaattttatacagatgaactcgagactaggggtaccattcatgattatggatgaattaataaagatattaaactggactaacccagcgtatacagtatctatcatgttcttatacacgctcattatattgaaaccttttcaaatgctttcttcgctccctatattctatttgttattctgcgtaatggtcccgcaatacctttacattcataagccaaaccctacaagctatctagataataatcaaacaccagcacaaggcccacctttgcgaagacctgaggttcctaaaccagtccctgaactgagccaagaatttgtcttaaacctcacggatttacaaaaccatatgctgctatatgttaaattctacgattttactttactcatattacaaaagtttgcattcttcaccaacgaggctatttcgtcgttttattttattgtattgttaataatagcaacattaaattttctgtacatggataaatttatcaagctcattccaatgagacccgtactgatactgctaggttggggtttttttattgcctcgcatccgtccaatcgtgaatatttgttgactaaattgaattcggaggagacaagattaaaaactttgactataagtactaatctggaatctaagattttgcagcatttgaaactcattgaggctagggagcaccgacttgttatgatctttgagatccaaaagtatcttcctgaatacaaagaatggcgcccagttggattctctgatgacgattattctcttttctctagtttgagaatataccagaggcgtattgaggaaaattcagtgaagtcattagaagaaattgagccacctaaggattgggaatgggaagccaattctcattgggtgcttgatttggatccaaaagaatgggtagaggacgaatttattcagtatgtcgagatagattcagaaacaaaatgggtctatgacctcaatcttgatggacaaaggggctcatatagaaggcgaatgtggaccaacagttgcgtgcggaaaaaactggattctggtatttcttcaaaccttggtgaggaggaagtagttaatccattgagggaagaaacatataggcaaggcgtacatggcgtgacgaagggttcaatgagtggcggtctaactcacagtagtgatgatgaccgcgctgatgaggaaagtataaacggtactattcctaatctcaacaatatcgacgcggatgcatcttatccgtcaatcgaagagctaacagacactctcaattcaactatataa

SEQ ID NO: 3884 - DNA, 1665 bp, Saccharomyces cerevisiae
atgggtcacaagaagaacggtcacagacgccagataaaagaaagagaaaaccagaataaatttgaacgttccacatatactaataatgctaaaaataatcatactcaaacaaaggataaaaaactaagagcaggcttgaaaaaaatagacgagcaatataaaaaggcggtatcttctgctgcggcaacagattaccttttacccgagtccaatggttatttggaacctgagaatgagctagaaaagactttcaaagtgcaacaatcggaaatcaaatcgagtgtggatgtcagtactgcaaacaaagctttggatttatctttgaaggaattcggcccttatcatataaaatatgcaaaaaacggtacgcatcttttgattactggccgcaaaggtcacgtagcatctatggactggagaaagggacaacttcgtgctgagctgtttttgaatgaaacctgtcactcagcgacatatttgcaaaacgaacaatactttgctgtagcgcaaaaaaaatatacatttatttatgatcacgaaggtacagaattacatcgtttgaaacaacatattgaggcaagacatttagattttctaccatatcattacctgctcgtaactgccggtgagacaggttggttgaagtaccacgatgtttccactggccagttggtctcggaattgaggaccaaagctgggccaactatggcaatggcacaaaacccatggaatgctgtgatgcatctaggtcattcaaacggtacagtatccctctggtcaccatccatgcctgaaccattagtaaaattactttctgccagaggaccagtgaacagcattgctatcgatagaagcgggtattacatggcaaccacaggggctgataggtcgatgaaaatttgggatatcagaaacttcaagcaactacattctgtggaaagcttaccgacgccaggaacaaacgtttccatttcagatactggtctattggcattatctaggggccctcacgttacgttgtggaaggacgctttaaaattaagtggagacagtaaaccgtgcttcgggtccatgggagggaacccacatagaaacaccccttacatgtcacatttgtttgccggaaacaaagtagaaaatttgggattcgtaccatttgaagatttactaggtgtaggccatcaaacgggtattacgaatttgattgtacctggtgcaggtgaagccaattacgatgccttagaattaaacccattcgaaaccaaaaaacaaagacaggaacaggaagtcagaaccctattgaacaaactgccagcagatacaattactttagatccgaattccatcggttcagtggataaaaggtcttctaccataaggttaaacgctaaggatttggcgcaaactacaatggatgctaataataaagccaaaaccaacagcgacattccagatgtaaaacctgatgtgaaaggtaagaattcgggtttgcgttcctttttgcgtaaaaagactcaaaacgttattgatgaaagaaaattaagagtacagaaacaactggataaggagaaaaatattcgtaaaagaaaccaccaaatcaaacaaggcctaatttcagaagaccacaaggatgtcatcgaagaggcattgagcagattcggctaa

SEQ ID NO: 3885 - DNA, 1665 bp, Saccharomyces cerevisiae
atggtgaagataagcttggacaacactgctctatacgcagacatcgacacgactcctcaatttgaaccttccaaaactactgtagctgatattttaacaaaagatgccttagagttcattgttttgctgcatagaactttcaattcaacacggaaacagcttttagccaacagaagcaatttacaatcaaagttagactctggtgaataccgatttgatttcttgccggaaaccgaacaaatcaggaacgatcctacatggcaaggtgctatcccagcccctggtttgatcaacagatccagcgagattactgggccaccattgagaaatatgttagtcaacgctttgaatgctgaagtaacgacatatatgactgatttcgaggactcttcatctccaacttgggagaacatgatttacggacaagttaatctttatgatgccattagaaatcaaatcgatttcaagacaccaagaaaggagtacaggttgaaggatgacatttcaagactgcccactttaattgtcagacctcgtggctggcacatggtggagaagcacctttacatagatgatgaaccgattagtgcttccatcttcgattttggtttatatttttaccataacgctaaagagttagttaaaattggtaaaggaccttatttttacttaccaaagatggagcaccatatggaggtaaaactatggaatgacatattctgtgttgcacaagattttattggaatgccccgcggtaccattagggccactgttctgattgaaactttgccagcggccttccaaatggaggagattatctatcaaataagagaacattcaagcggtttgaactgtggtcgttgggactacatattttcgaccattaaaaaactgagaaacttgcctgaacacgttttgccaaatagggatctagtgactatgacttcaccttttatggatgcttatgtgaaaagattgatcaatacatgtcaccgtagaggggtccatgcgatgggtggtatggctgcccaaatccccataaaagatgatccaaaggctaatgaagctgcaatgaacaaagttcgtaatgacaaaattagagaaatgaagaatgggcatgatgggtcatgggtagcacacccagcattggcaccgatttgtaatgaagttttcagtaacatgggtacagcaaatcaaatatattttgtcccggatgtacatgttacatcatctgatttattgaatacgaagattcaagatgctcaagtcactactgagggaatcagagtaaacttggatattggcctacaatatatggaggcttggttaaggggatctggttgtgtcccaattaatcatttgatggaagatgccgctactgcggaagtatcacgttgtcaattgtaccagtgggttaaacatggtgttgtcttaagtgataccggtgacaaagtaactccagaattgaccgctaagatattaaatgaagagactgcaaaattggcttcagcaagtccgctgggtgaaaagaacaagtttgccttggcagccaagtattttttgcctgaagtcactggtaaaatctttagcgacttcttgaccactttattgtatgatgaaattattaagccaagtgccaaaccagttgacttaagtaaattatag

SEQ ID NO: 3886 - DNA, 1665 bp, Saccharomyces cerevisiae
atggttaaggtcagtttggataacgtcaaattactggtggatgttgataaggagcctttctttaaaccatctagtactacagtgggagatattcttaccaaggatgctctagagttcattgttcttttacacagaactttcaacaacaagagaaaacaattattggaaaacagacaagttgttcagaagaaattagactcgggctcctatcatctggatttcctgcctgaaactgcaaatattagaaatgatcccacttggcaaggtccaattttggcaccggggttaattaataggtcaacggaaatcacagggcctccattgagaaatatgctgatcaacgctttgaatgctcctgtgaacacctatatgactgattttgaagattcagcttcacctacttggaacaacatggtttacggtcaagttaatctctacgacgcgatcagaaatcaaatcgattttgacacaccaagaaaatcgtacaaattgaatggaaatgtggccaacttgcccactattatcgtgagaccccgtggttggcacatggtggaaaagcacctttatgtagatgatgaaccaatcagcgcttccatctttgattttggtttatatttctaccataatgccaaagaattaatcaaattgggcaaaggtccttacttctatttgccaaagatggagcaccacttggaagctaaactatggaacgacgtcttctgtgtagctcaagattacattgggatcccaaggggtacaatcagagctactgtgttgattgaaactttgcctgctgctttccaaatggaagagatcatctatcaattaagacaacattctagtgggttgaattgcggacgttgggactatattttctctacaatcaagagattaagaaatgatcctaatcacattttgcccaatagaaatcaagtgactatgacttccccattcatggatgcatacgtgaaaagattaatcaatacctgtcatcggaggggtgttcatgccatgggtggtatggctgcgcaaatccctatcaaagacgacccggcagccaatgaaaaggccatgactaaagtccgtaatgataagattagagagctgacaaatggacatgatgggtcatgggttgcacacccagcactggcccctatttgtaatgaagttttcattaatatgggaacaccaaaccaaatctatttcattcctgaaaacgttgtaacggctgctaatctgctggaaaccaaaattccaaatggtgagattactaccgagggaattgtacaaaacttggatatcgggttgcagtacatggaagcttggctcagaggctctggatgtgtgcccatcaacaacttgatggaagacgccgccactgctgaagtgtctcgttgtcaattgtatcaatgggtgaaacacggtgttactctaaaggacacgggagaaaaggtcaccccagaattaaccgaaaagattctaaaagaacaagtggaaagactgtctaaggcaagtccattgggtgacaagaacaaattcgcgctggccgctaagtatttcttgccagaaatcagaggcgagaaattcagtgaatttttgactacattgttgtacgacgaaattgtgtccactaaggcgacgcccactgatttgagcaaattgtga

SEQ ID NO: 3887 - DNA, 1665 bp, Saccharomyces cerevisiae
atgtcatctttgtacattaaggaggctaccggtgtagacgaattgaccacagccggttcacaagaccatccattcaaaaccccagcatatgctttgttcgcatctcaacagaagagcgatgccacggaacctaagcttttcgtgtttaagacagaagacaacgagtaccaggaaatcagtgcttctgctttgaagaaggctcgtaagggctgtgatggtttgaagaaaaaggcagtcaagcaaaaggaacaggagttgaagaaacaacaaaaagaggcagaaaatgctgccaagcaattgtctgctttgaatatcaccattaaggaggacgaatcgctaccagctgccattaagactagaatttatgactcttattccaaggtcggacaaagagttaaggtttccggttggatccatagattacgttctaacaagaaggttattttcgtcgtcctcagagacggatctggtttcattcaatgtgtcttgtccggtgatttggcattggctcaacaaactttggacctgactttggaatccaccgttactctgtacggtaccatagtcaaattgcctgagggtaaaaccgctccaggtggtgttgaattgaatgtcgactattacgaagttgtaggtttggcccccggtggtgaagactcctttacaaacaaaatcgcagagggctcagacccttctttactgttggaccaacgtcatttggccttgagaggagatgccttgtctgcagtcatgaaagtccgtgctgctctactgaaaagcgttagacgtgtttatgatgaagaacatttgacagaagttaccccaccatgtatggtgcaaactcaagtcgaaggtggttccactttgttcaagatgaactattacggcgaggaagcttacttgacccaaagttcccaattatatttagaaacctgtttggcctccctaggtgatgtttataccatccaagaatctttcagagctgaaaagtcccacacaagaagacatttgtccgaatatacccatatcgaagctgaattggccttcttgactttcgacgatctattacaacatattgaaactttgatcgtcaaatccgtgcaatacgttttggaagacccaattgctggcccactcgtaaaacaattgaatccaaactttaaggctccaaaggctccattcatgagattacagtacaaggatgccattacctggttgaacgaacacgacatcaagaacgaagagggcgaagactttaaatttggtgacgatattgcagaagctgctgaaagaaagatgaccgataccatcggcgtcccaatctttttgacgagattcccagtagaaatcaagtctttctacatgaagcgttgttctgacgacccccgcgtcactgaatccgtcgacgttttgatgccaaacgttggtgaaatcactggtggttctatgagaatcgacgacatggacgaactaatggcagggtttaagcgtgagggtattgataccgacgcctactactggttcattgaccaaagaaaatacggtacttgcccacatggtggttacggtatcggtaccgaacgtattttagcctggttgtgtgacagattcactgtcagagactgttccttgtatccacgtttcagcggtagatgtaagccatga

SEQ ID NO: 3888 - DNA, 1665 bp, Saccharomyces cerevisiae
atgtccaataactcattcactaacttcaaactggccactgaattgccagcctggtctaagttgcaaaaaatttatgaatctcaaggtaagactttgtctgtcaagcaagaattccaaaaagatgccaagcgttttgaaaaattgaacaagactttcaccaactatgatggttccaaaatcttgttcgactactcaaagaacttggtcaacgatgaaatcattgctgcattgattgaactggccaaggaggctaacgtcaccggtttgagagatgctatgttcaaaggtgaacacatcaactccactgaagatcgtgctgtctaccacgtcgcattgagaaacagagctaacaagccaatgtacgttgatggtgtcaacgttgctccagaagtcgactctgtcttgaagcacatgaaggagttctctgaacaagttcgttctggtgaatggaagggttataccggtaagaagatcaccgatgttgttaacatcggtattggtggttccgatttgggtccagtcatggtcactgaggctttgaagcactacgctggtgtcttggatgtccacttcgtttccaacattgacggtactcacattgctgaaaccttgaaggttgttgacccagaaactactttgtttttgattgcttccaagactttcactaccgctgaaactatcactaacgctaacactgccaagaactggttcttgtcgaagacaggtaatgatccatctcacattgctaagcatttcgctgctttgtccactaacgaaaccgaagttgccaagttcggtattgacaccaaaaacatgtttggtttcgaaagttgggtcggtggtcgttactctgtctggtcggctattggtttgtctgttgccttgtacattggctatgacaactttgaggctttcttgaagggtgctgaagccgtcgacaaccacttcacccaaaccccattggaagacaacattccattgttgggtggtttgttgtctgtctggtacaacaacttctttggtgctcaaacccatttggttgctccattcgaccaatacttgcacagattcccagcctacttgcaacaattgtcaatggaatctaacggtaagtctgttaccagaggtaacgtgtttactgactactctactggttctatcttgtttggtgaaccagctaccaacgctcaacactctttcttccaattggttcaccaaggtaccaagttgattccatctgatttcatcttagctgctcaatctcataacccaattgagaacaaattacatcaaaagatgttggcttcaaacttctttgctcaagctgaagctttaatggttggtaaggatgaagaacaagttaaggctgaaggtgccactggtggtttggtcccacacaaggtcttctcaggtaacagaccaactacctctatcttggctcaaaagattactccagctactttgggtgctttgattgcctactacgaacatgttactttcactgaaggtgccatttggaatatcaactctttcgaccaatggggtgttgaattgggtaaagtcttggctaaagtcatcggcaaggaattggacaactcctccaccatttctacccacgatgcttctaccaacggtttaatcaatcaattcaaggaatggatgtga

SEQ ID NO: 3889 - DNA, 1668 bp, Saccharomyces cerevisiae
atgaacaagaaacaaaatttttacgcagccattattgtggctatttttctttgtttgcaattgtctcatggctcttcaggtgtcagctttgaaaaaacccctgctattaaaattgtaggaaacaaattctttgactctgagagtggggaacagttcttcatcaagggcattgcttaccaattgcagagaagtgaagaggagcttagcaatgcaaatggggcttttgagacaagttatattgatgccttagcggacccaaaaatatgcttaagagatattccatttttgaaaatgctaggagtgaacacactgcgtgtttatgcaatagatccgacaaaatcacatgatatatgtatggaagctctatctgccgaaggaatgtacgtcctattagatctttcagagcctgatatttcaataaatagagaaaatccatcttgggatgtacatatttttgaaaggtacaaatctgtaattgatgcaatgtcatcctttccaaatttgttggggtattttgcagggaatgaagtgacaaatgaccatacaaatacctttgcatcacccttcgtgaaggccgcaatccgagatgccaaggagtatatttcgcattctaatcatagaaaaatccctgtcggctattcaactaatgacgatgctatgacaagagacaatttagcaaggtacttcgtttgcggagacgttaaagctgatttctatgggataaatatgtacgaatggtgtgggtattccacgtatggtactagtggatatagggaaagaacgaaagaatttgaaggttatccaattcccgtgtttttttcggaattcggctgcaatcttgtaagaccaaggccattcactgaagttagtgccctttatggcaataaaatgtcctctgtttggtctggtggccttgcatacatgtattttgaagaagaaaatgaatacggagttgttaagataaatgataatgatggagtggatattcttcctgatttcaagaatttgaagaaagaatttgcaaaggcagatcctaaaggcattacagaggaagaatacttaacggcaaaagaaccaactgaagtagaaagtgttgaatgtccacatattgctgtcggagtttgggaggcaaacgaaaaactacctgaaacacctgatagaagcaagtgcgcctgtttggatgagattttgccctgtgaaatagtcccttttggtgctgaatctggaaaatatgaagaatattttagttatttgtgctctaaggttgactgttccgatattcttgcaaatggcaaaaccggtgagtacggtgaattctcagattgttctgtcgaacaaaaactttcccttcagctgagtaaattgtattgcaaaatcggcgcaaatgatcgccattgtcctctaaatgataagaacgtttacttcaacttagaaagcctgcagccccttacaagcgagtcgatctgtaagaatgtttttgattctataaggaacatcacatacaatcatggcgattattcaaaatcaaatccatcgcgtagcaaggaaagtttgaacgtaaagtacccatcgagtgaagagagagaaaatgacggcaccatcgcatttaaaacttcagggtttgttatacttctaatttctatgatagctgctggaattcttctataa

SEQ ID NO: 3890 - DNA, 1668 bp, Saccharomyces cerevisiae
atgaattgcaaggcggtaaccattagtttattactgttgttatttttaacaagagtatatattcagccgacattctcgttaatttcagattgcgatgaaacttttaattattgggaaccattaaatttattggtacgtggatttggtaaacaaacctgggaatattcacccgagtattctattagatcatgggctttcttattacctttttactgtattctttatccagtaaacaaatttactgacctagaaagtcattggaactttttcatcacaagagcatgcttaggcttttttagttttatcatggaatttaaactacatcgtgaaattgcaggcagcttggcattgcaaatcgcaaatatttggattattttccaattgtttaatccgggctggttccatgcatctgtggaattattgccttctgccgttgccatgttgttgtatgtaggtgccaccagacactctctacgctatctgtccactgggtctacttctaactttacgaaaagtttagcgtacaatttcctggctagtatactaggctggccatttgttttaattttaagcttgccattatgtttacattaccttttcaaccatagaattatttctaccatcagaaccgcattcgactgctgtttgatattttcattgactgcatttgctgtgattgtcactgacagtatattttacgggaagcttgctcctgtatcatggaacatcttattttacaatgtcattaatgcaagtgaggaatctggcccaaatattttcggggttgagccatggtactactatccactaaatttgttactgaatttcccactgcctgtgctagttttagctattttgggaattttccatttgagattatggccattatgggcatcattattcacatggattgccgttttcactcaacaacctcacaaagaggaaagatttctctatccaatttacgggttaataactttgagtgcaagtatcgccttttacaaagtgttgaatctattcaatagaaagccgattcttaaaaaaggtataaagttgtcagttttattaattgttgcaggccaggcaatgtcacggatagtggctttggtgaacaattacacagctcctatagccgtctacgagcaattttcttcactaaatcaaggtggtgtgaaggcaccggtagtgaatgtatgtacgggacgtgaatggtatcacttcccaagttctttcctgctgccagataatcataggctaaaatttgttaaatctggatttgatggtcttcttccaggtgattttccagagagtggttctattttcaaaaagattagaactttacctaagggaatgaataacaagaatatatatgataccggtaaagagtggccgatcactagatgtgattattttattgacatcgtcgccccaataaatttaacaaaagacgttttcaaccctctacatctgatggataactggaataagctggcatgtgctgcattcatcgacggtgaaaattctaagattttgggtagagcattttacgtaccggagccaatcaaccgaatcatgcaaatagttttaccaaaacaatggaatcaagtgtacggtgttcgttacattgattactgtttgtttgaaaaaccaactgagactactaattga

SEQ ID NO: 3891 - DNA, 1668 bp, Saccharomyces cerevisiae
atggatgagcaagttatttttacaacaaatacctcaggaacaatagcttctgtacactcatttgaacagataaatttgaggcaatgctccactcaatcaagaaatagctgtgttcaagtaggaaataaatacctttttattgctcaagcacaaaaagcattaatcaatgtctacaatctgtcaggttctttcaaaagagaatctgttgaacagcgcttaccattacctgaaatcctaaaatgtctggaagtagttgaaaatgatggtgtgcagtatgatagaattcaaggtgtcaatcataatttaccagacttcaatcttccgtaccttttacttggctccaccgaatcgggtaaattgtacatatgggagttaaattcagggattttattgaacgtgaagcctatggctcattaccaaagtatcaccaagattaagtccattttaaacggcaagtatattattacttctggtaacgattcgagagttattatatggcaaactgttgacttggtatcagcgtccaatgatgatcctaagcctttatgtatccttcacgatcatactctacccgtgacagatttccaagtttcttctagtcaaggaaaatttttatcatgtactgatacgaaactcttcacagtatctcaagatgctaccattagatgctatgatttgagtttaataggcagcaaaaagaagcagaaggcaaacgaaaatgacgttagtattggtaagaccccagtattgcttgcgacatttacaactccttattctatcaaatccattgtactggatcctgctgacagagcatgctatattggtactgcggaaggttgtttttcattgaatttattttataaactaaagggtaatgctatcgttaatctgctacagtccgccggagtaaacacagttcaaaaaggtagggttttttccctagtgcaacgtaactcactaactggcggcgaaaatgaagatttggatgcactatatgcaatgggccaacttgtctgtgagaatgtcctaaattcaaatgtgtcatgcctagaaatatcaatggatggtacattattattgatcggtgatacggaggggaaagtttctattgcggaaatttactcaaaacaaatcattagaactatccaaactttaactacatcacaggattcagttggagaagtgaccaatctcttaaccaacccttacagactcgaacgtggaaatttactttttgaaggagaatccaaaggcaaacaacctagtaataataatggtcacaattttatgaagataccaaacttacaaagagttatctttgatggtaaaaacaaaggccatttacacgatatttggtatcagataggagaaccagaagcagagacagatcctaacctcgcattaccacttaacgactttaatgcctatttggagcaggtcaaaacgcaagaatcgatattttcacatatcggtaaggtgtcaagcaatgtaaaagtgattgacaataaaatcgacgccacttcatctttagacagcaatgccgctaaagatgaggaaattacagaacttaagaccaacatagaagcattaactcatgcctacaaggagttacgtgacatgcacgaaaagctgtacgaggaacaccaacagatgcttgacaagcaataa

SEQ ID NO: 3892 - DNA, 1668 bp, Saccharomyces cerevisiae
atgtataatggcaaggatagagcacaaaactcctatcagccaatgtaccaaaggcctatgcaggtacaaggacaacagcaagctcaatcgttcgttggaaagaaaaacacaatcggaagtgtgcatggaaaagccccgatgctaatggccaataatgatgtttttactattggaccttatagggcaagaaaagatagaatgcgggtatctgtcttagaaaagtacgaagttattggctacattgctgcgggcacatatggtaaagtttacaaagcgaaaagacaaatcaactccggtaccaattccgctaatggttctagtctgaatggtaccaatgcgaaaattccgcagtttgacagcacgcaaccaaaatcaagctcttcaatggacatgcaggcaaatacaaacgcattaagaagaaacttgttaaaggatgaaggagtgacccccggaagaatacgaactacgagggaagatgtatccccgcactataattcccaaaaacaaaccctcattaaaaaaccgctgacggtattttatgccattaaaaagttcaagacagagaaggatggcgtcgaacaattgcattatacgggaatatctcagagtgcctgtagagaaatggcattatgtcgagaattgcacaacaagcatttaaccacattagtggaaatttttttggaaaggaaatgtgtccatatggtatacgaatatgcggagcatgatctgctacaaattatccacttccattcccatcccgaaaaaaggatgataccaccaagaatggttcggtctattatgtggcagcttttagacggcgtatcgtatcttcatcaaaattgggtgcttcatcgagatttgaaacccgcaaatataatggtgaccatagatggatgtgttaaaattggtgatttaggtttggccagaaaatttcataatatgctgcaaaccctctatactggggataaagtggttgtcactatatggtaccgtgcacctgagttgctattgggagcacggcactatacccctgcggttgatttatggtccgttggctgcatttttgcagaactgataggattacagcccatatttaaaggtgaagaagctaaactagactctaaaaagactgttccatttcaagtgaatcaactacagagaattttggaagttcttggcactcccgatcaaaaaatttggccttatttggagaagtatccagaatatgatcaaattacgaagtttccaaagtatagggataaccttgctacatggtatcattccgcgggaggaagggacaagcatgctttaagcttactttaccacttgttaaattatgatccaattaaaagaatagatgcatttaatgcgttggaacataagtacttcacagaaagtgatattcctgttagtgaaaatgtatttgaaggtctaacttacaaatacccggcaagaagaattcacacgaacgataatgacatcatgaatcttggatcaagaacgaaaaacaatacacaagcttcaggaatcaccgcaggtgccgctgcaaatgcgttaggtgggcttggtgttaaccgtagaattctggccgcggcagcagcagccgctgctgcggtgtcaggaaacaatgcatcagatgagccatctcgaaagaaaaacagaagatag

SEQ ID NO: 3893 - DNA, 1668 bp, Saccharomyces cerevisiae
atgtcaaacgaggatgaaacaactcgtttaatgtcttcagatgagatggactatttattggaaacggctgggatcaacgccttggaagaaatcattagtcaaaatgacagtactggaataaatttggatactaatgaaacagctcaggacagtagctatgactctatccggcgctcccccagtattttgagtgttgccaaaagcgttgagggagagcatggacgtagaaaactattatgcctttacggccttgttatgattatctgtattgcggagtctatttctatgactgctacaataccgttggtgatggacaaggtagcggaaggaatttcagatgagaatggacattatgattccgtggctgtacagacaatagtttccagcatttcttcatccactatgatgatagcaggggcaatcagtattttcatggctggtaagtggggagaattatccgatagaataggaagagtgcgtgttttcaaatacatgagcggcatcagggtcatagggcttcttacgcacgtctttaccctatcatcgaaaatgaagtatcacaaatgggctattgttcttactgcgtgtatcgtaccatcattcggtggcttgtttgcgctagtggcgaatggaaatagttacgtttcagatatagtgaaaactgagcacagaatggtgacaataggaataatgatgagttgtatatatgccactatgggcgtaggcccaatgtttgggtcctttctggtgaagtggactcatggaaacgggttcattcctatttacacatcaatagcgtttgttatactggcgcttataatatgtgagacaatcatggtggaaccgcgccatgaaacccaaatggcccattcacaatcaacttatacaaagaggagagagaaactaagatcacaatcgggttctgacgatgcaagaaattaccaatccgttacttatggaaaatttcaaataatgaggttaatggacctgctcgctccagtaaaaaagttatggctgaagcccgacagtgcagggtctttagtaccccggcataccgtaatattactcattgtactcgatatactatttgtctgtggaacgacatcgtgtatgccagcattgattttgttttctacatatgagtacaaatggcatgcagtagagctaggttatttcatatcgatactgggtatcggaagaggtgttgtgttactggtcgtatcacctacattactgtacacgctaaagaggatttatcaacacttgaaccattcgatagacaagatagacatcttttgcatacagttttctatgattgttataacactgagtctctttgtcatgatacgatttggcgagaaaactcccacatccatgataatattcgctcttttacaggcattgagcgcgttttgttcaccaactttgcagtctggtatcataaagtacacctctaagaaacatacaggcgagatgttcggagcaatggctttggtaaggtcctgtgttatgcttgtcatccctcccatcctccttaagctatatggaagtactgtctccgttaatcctagtctgtttatgtatataccgttctcaacaagtattgttgccatcttgttgacattcttcctaagaatttacaagaaccctccgctggacgggccttaa

SEQ ID NO: 3894 - DNA, 1668 bp, Saccharomyces cerevisiae
atgtctacagatgaaagtgaagacgtttattctgatctgtattccattatctcccaggtaacatccaatactgccaatgacatcgagcaactcccatatgctttaacgttcaaaacgtcgttaatcttcgttggtgctaccattggtgggcttttattcggctatgatactggtgttatatcaggtgttctgctttctttaaagcccgaagatctatctttggtagttttaacggatgttcagaaggagctgataacttccagtacaagcgtcggatcattttttggctctattctggcatttcctttagcagataggtatggaagaagaattactctcgcaatctgctgttcaatttttatcctagctgcaattggaatggctatagcaagaacattgacgtttttgatttgtgggagattgctggttgggatcgctgttggagtgtctgcccagtgcgtccctctatttctgagtgaaatttcaccttccagaatcaggggttttatgttgacattgaacattattgccatcactggaggtcaattggtttcctatgtgattgcgtcccttatgaaagagattgataattcatggagatatttgttcgcactttctgctattccagctattctgttcctttcaatactggattttatccctgaatcgccacgatggtccatttccaagggagacattctatataccagggattctctaagaatgctatatcctactgcatctacatatcatgtgaatagtaaaattaagcagctgataattgaactcgataagttacgactatacgaagatgcaagtgaacctttactagtacagtcccaatcggttattcgatacatggatagttcaacctcaggaactcttagcccacctaacattaaaagactttcctcgaacacagaaagaactagcaacacaatgtcctcctcatcagcatatctatcggcgttgcgaggcccagctccaaacggtgccctggcatctaacaaaaagaaaagacacagaatggagccacgcacaataagagcgttaatagtaggttgcatgttaatgtttttccagcaaatcactggctttaatgcttttatgtactatgcggcaataatattttccaaatttaatataaaaaaccctctactgcctccaattttgattgcctcaacgaacttcatattcacttttttcgccatgtacaccatggactctttgggaagaagagccattcttttgagaacaattttgattatgactgttgggttacttctttgcagtgtaggtttcggtcatgaccaagtcaatttacttttaatttctgttgtaatttatgttgcagcatatgcttctgcgatgggcagcgttccatggacctgtgtggaatttctccccttgaacaggagatcatttggggcatcatgtatagcctgcacaaattggttgaccaatgcatttgtttcaatgacatatctgagcactattaacaccattggtgatgaaaatacaatgctcatttttgcttttttcacagtttgtgcctggtttttcgtatatttttggtatccagaagtcaaaggtttgtcactggaagaggttggaagggtttttgataatggaattgatgttcattatgtctttcgtacctaccattga

SEQ ID NO: 3895 - DNA, 1671 bp, Saccharomyces cerevisiae
atgcaacacaaggatacggcagtagcgaaggacacagctaaaaaacgtttactgagaagaaatagtgcgccgtcagctatacatataatttcacgattagacaaaaagtggtccttcctatggaatactatagatagacacaatattgttgaagagcaagatgaaagtagcgctgcaaaaagcgaagaagaacatgaggatgattatgaattggaacaattactcaacatgataagaataccaatgttcctggaaaagttcatgctctttgcacttttaacaagcttggactgttttttgtattactttactgtattaccgatacgactgataaagggatatgtaaagcaattcaagagttatcgtcagcattatcgcctgcaacaacggtctgggcataagaataaaataccctttcgatatagaataacttcaagagaatataaagagagatgtatgatttttatcatcgtgatttcatccattttgttgagcaaactagacacctcaaaactatatcacaggataaaacggcaaagtacgatgaaattgtacatgctattcagtgtactggaaatggcggacaaaatgttggcaagtttgggccagagcttattaacggttatgctttctaggaaaaactcggaacggatattactgcataaatgtttgttagtgtcaatgagcttgacatatgtgactatacacggctatgtattggtttaccaggccatttcattaaacatagccgtgaattcgtattccaatgccttgctaactttattactatccatgcaatttgcagaaatcaaatcatcggttttaaagaaatttgataaggagggatttttccaaataaccattgcagacgtagtggaaagatttaagttgaccttattattgtcaataactggccttaggaacctccagtcgtggtcatcttcattatcgaacacaagcatcaatttctggagtccacgttccacattatcaatcgtcattaacatactttgtgggccgatggtaagcgtggtagggagtgaagtgttagtggattgggcaaagcatgcttacatcacaaaattcaatcggatccgcccacagatatatgataagttctattatataatatacaaggattattctacgagaacgcacaaattagaagatagattgggattgcctttacctgcattcgttgtcctttttattgtaatggtgaggccaacactttttaaatcatcggaaccttcttaccttccttcgctatttaggatcctcttcatgggggcatccgtgtttttactagcattgttggcaaaatttacactagatcttattttaatcaaatggagcaaacggatagagcaacggttcagagaccaagctttcaataccgttgtaactgaagaagaatacgtcccaggtttactctcgggcggtatgggtaaagtcgacgtgtctacaagaattgcattacattctgattacaataaagagaatcgtatagagaccgaaagtgtatcgccaatgcggaaaagaaaaactactttaactgctgaatgtactcctcctagcctaaatgatattagaagacagaaagattccaagaatccacgatcgcttgaaaatgtcgctcgctataaaatggtttctaaaagaatatggtaa

SEQ ID NO: 3896 - DNA, 1671 bp, Saccharomyces cerevisiae
atggaaagagtatggtttgcaaaattaacaaataaaggaactattaaaatcgggtatatctcatttatacttctaagtttgctatgtcaatctctgattgggctggttaatgctgattttaattatgaaggctgttacagtgccgcggatatccagtctgctggactgtctctgaaaaactcatacatatatcaatcagtgtcatactgtcaaaaccagtgccctgagtcagcagtagtagcattatttaacgggtcagattgttactgcggtaattcggtaagttttctgacttctttgacgaaatcaacagattcaaactgtggaactaaatgctctggctggccttaccaaatgtgtggagggtcatcgtacatgaacgtgtatgtaaatgctgaaacttttgtttcatcggttgaatcttcctcttccaaagaagggtctagcacttcctatatgccctcaacaacttcttcattgtcctccgcccaaatttcttcaactactaggagaacgtcaacagatatgaaaagttctgaaatgatagccacgacagtttctaccacttcaacaacctcttcctcgacttcctctactacctcttctaccacctcttctaccacctcttctaccacctcttctactacctcttcctcgacttcctctactacctcttctaccacctcttctaccacctcttctaccacctcttctaccacctcttctactacctcttctactacctcctctactacctcctctactacctctatcttttctgttacgtctagctcctcatccattacattgtcctcatctgagcataccacagtcgatagccgtacttcttcaccctcttccaccttggtgccagtgtcctcgagtagcagcacactatcaactccaaaagtgacctcaatgacccctagtacgtcatcaacgataccaatagttacctcagtggaactagtgactagtgtggttacaaaagcgatcgtgagtacttctgatcaacatcaggaaacaatatttgttacgaggacatccgtggttgaacgatcttctgaggtagctactgctactgctgccgcctcaaataatagatctaattcgacttcgaagcagcgtctgagtggtggagccattgccggtattgttattggtgttgtgtttggcgtaatttttattattttgattctattgttcctgatatggaggagacggaaatcgcacgaccaattagacttggaggaaacgaaacattatcagccctattcgttcggtgatgaggatgcaaatccaataggaccgcctccctcctctggtacgacaaattggatgagacattcaaggggtaatacagcgggttctatcggtacaagtaatatgtatggtttttctatgagtaatggtgcaaattatagtagtcctagttcaaacaccagtggaagcatcataaacaacttggctggcttacaagatgctacggttcagaaacagaaccttccatcgacagtttttgaagaggcaaatactttgaatagtgcaaatgaaaggttcagtgccaattctttacccgacatgatgatgagcggaccattgcaagtggtaaaccctgataatcctgataatcctgaattatctagtaccgtatctcataatcgagcctga

SEQ ID NO: 3897 - DNA, 1671 bp, Saccharomyces cerevisiae
atggatggtgcgttgataaattccgttttatacgtgagtccacgcaatggtgcacattattttgttgaactcactgagaaacatctattggcgtttgagatgctcaattccatgtgtctcttagaaaattatgatcatgtgctgttgtttctggagtgccagttcggcaaatctcacaatttggctgttatcccgttcgatatcatattagttcttttcacgttatcgactttatctgaatattataaggagccgatattgagggcaaatgatccatataacacgtccagggaaactttaagtaggagagctttgaaactattgcagaaatatctggcgattctgaaagagtttgattctgagcaatacaatttgtatgacttggagttgttgcgatgccagtttttcttggcaatcgatacgttgacaccaaaaaagcaaaagtggggtttcgatagatttaggagaacgaaatctgaaagtggtgtaacatataggcaaaatgctagtgtagatcccgagttggatcaggctaaaacttttaaaaatccttacaggtcgtatattagttgtcttgagcaaagaaataccatattgggcaatcgcttattgaatttgaaactgaatgaacctggagaatttattaacatgattttatggacattgtctaactcgctgcaagaaagcacacctctgttcctatcaagccatgagatttggatgcccttacttgaaatactcattgatctgtttagttgtagacaagattatttcatacagcatgaagtcgcccaaaatgtaagcaaatccttgttcgttcaacgcttatctgagagtccgttagcagttttttttgaatctttaaatacaaggaattttgcgaataggttttccgaatatgtatttctcaattgtgattacaaactgccatccgacaattatgcaacgccggttcatcccgtatataatggtgaaaacacaattgttgatacgtatattcccacaattaaatgtagtcctttgtacaaatcacaaaaatcattagctttgcggaggaaactgattgggtcatgtttcaaactattactaagagttccagatggacatagattgattactccgagaatagttgcagatgatgttatccaggggatctcacggacgttggcttcttttaatgatatcctgcagttcaaaaagttttttatgactgaaaatctgtcgcaagagtcttattttatacccctattagctgaaggtaccctttctgagatactcaaagacacacaggaatgtgtcgttattttaacgctagtcgaaaatttatcagatggcgtttcattttgcaacgaagttatcggtttggttaaatcaaaatgttttgcttttaccgagcaatgtagccaagcttcgtatgaagaagccgttttgaatattgaaaagtgtgacgtctgcctactggtcctactacgatatcttctgcatttgatcgggaccgaagcgatattagacgctaaggaacagttagaaatgttacatgcgattgagaaaaatgattcagggaggcgacagtgggccaaggcgcttaacttaggaaatgatccgcctttattgtatcccatagtctcccaaatgtttggcgttcatgataaaagtgtaattatagaataa

SEQ ID NO: 3898 - DNA, 1671 bp, Saccharomyces cerevisiae
atgttgaatctgtgtcatgctcttcgaggcgtacgtcagttttcctgttctgtgattgtgaaagtgaaatgtgcgtcatgttccataaaactacaggatcaggatcctagtaaaccaggatattatacgaagccaaaaagtctacccgactcaaaactaaatcctgacctccaagatctgaagtatttgctattcagtcaagacatacagctctcgaaacaggcaactcaaaatgatcctgacctcaaaaccaaaagagatttactattgagagtgatttgcaaaaggtgcagtaatgcccttcatcataacaattataacccggaagagtttcccgaaagcacattaaatgatattctgaactacgtccccagaggctcaaatgttatgcatattgtcccctttgtagaatttcccttacatttagaccccaatgttttgaaacgaaatgatttagatactacattagtgttaacgaaaagcgatcaagtttttaaagataaaaatgctgtcagcaaaaaggttcctatattcatgaagcaatttttaaagaacactttaagaattgactcaaataaaacattcgccatatctgcgctgaaaaactggaacatatccatgttttacaactactttaaaaactacacatatttgctaggcaaccctaatgttggtaaatcaactttgatcaatactctactacagaaatatcttggatataaggttaaaattgattctactgggaaaattaactccccctctgaagaagtgatgcaagaagcttttacgaacccgaagaattttttcaagattcaagctgctggtgtatcacatattcccaatttaactagatccgtacaagcctaccaagttggaggtaaaatactttttgatcttccaggctattcaacttccacctccagattacgcctagaagaactaatcgacgagcgttggcttcaaaggctgcgaaaaaccgatttattcaatcggaagcatataaaacagaagacttatgagtctatgaagggcacatcacagggaggctgttataccgtgggagggattttctacctggtacctccgaaaggatccataaatcagattgtgaaatacataccaggaccatcaaaaacattcaagaacattgaaaaaggtattgatgtattcaactcgtgcaattcatcatctggcacacatccgttatcacggtattgtggaattaaaagcgttatatgcgaaaaaagccagtacaaaaggtacgcaatacctccatttattggaagtatagagatcgttctgaaagatataggatatattttattaaggacaactgggaggtatgagttcaaaggactacatgagatatggatacctaggggtatccaagtaggtataagggaaccgctagaaaacttgattgagtctggctaccagcgttacattgaaacaaatggtaaagagtcaagctgtcccagagatagaccgatcatcagttccctgtatgagatggccccggatgaagctgatactttgaacgcagtgaagaagtcgtatttagaaaaaaccgagaaagatttatctgctagaagatttgtcgacgatgatccttatgatttggttcaacacctagaaaaaaaaaagaatccctattggtactaccaatggtaa

SEQ ID NO: 3899 - DNA, 1671 bp, Saccharomyces cerevisiae
atgtttgataagttaccttatgagatttttaaacaaattgcctggagaattccgcaggaagataaaatttcgttaacatatgtatgcaaaagatcctatgaatcaattatacctttcatctaccagaatttatttcttaatgaaacctatcacatcaatggtgactatgataactcatttggaacctgttattggtctgtcctaaactttcactacatagatgaagatgattccaatactaaaaacgacatgtcgaatagaagactagctaaagtgaaatttagttatttcgaaagaacattagcagagtcaccgaaaagattatgtcccttaattaatcgaatacgttgtacatggcatttaaatgaagatgtgatgacaaatgtacttaaattgctatccgagtatggatccaatttgaaatttgtcgatcaatttgttcgctcatcagttaacaaggggctagaacctttatcaaagcaattaaaaactctaacattaacgccaccaacgttaatgcccacccataacagtgtaagcggttcttatttgaataaaattgatcggttgctcttgaagtgcgatctatctcgattagaaaaactttccattcatataaacgcattgaagtacttcaaaaataccgggtctcctatgaagatcaaagcattggtattaaatttgcgacccgacacacttaaccttgcggagtacgacgcttccgatgacttcttaaaagagctagaatacatcgacatatttgatgcttccaccttaaggcagctagagattttgtcttggtacagtcgcgacgattttccctctggcgaagaaggtggttttgacaggttatatgtcaaatgggggctagaaggattttggaaatttccgaacattgagaaactatcattagcgtcattggtttacagcgaattttttctaatgaattgtttggctgtgtttcacaatttaaagatactgaaacttgattacatgggtaaatttgacttcgatgtgtcgttgattaacttcttatctaaacaagtgtgtggcaaaaaattacagcgttttgacatacactgccaactaaatcacaggcttttttttcccatgacagataacccactaactcgcttgaatttcgatggtttctgcccttgttcaacttgcaaaaatacaattcacgaggtcattctaaaaaaaatctttcctgaaacccggtcaaaacttttaaagaacccaaataagttccaagcccataatttcttttaccaaatgtttttcgagaacaagatcatgccctatacaaacattattgacaacgaatcacctgcgatgggatgggattctgtacctattgaaacgtttgtacgaaagttcaatgaaaatctgcaaagcaccatagaaaatactgagaatattacagtgaataaaattactagagaagatgccattagtttgtaccacttataccttcattatctaaaagacgtatttaaagtttttgagcaaagtttgccgaacttagaatatctaaccatcaacggtatacctacaaaaataatacaagtggacgagttacaacgatgcgcggttcccctcttctataataatggctataaaagcaactctgtttatgaattggtggacgcagaagctctatttagttga

SEQ ID NO: 3900 - DNA, 1674 bp, Saccharomyces cerevisiae
atgaaggttgattacgagcaattgtgcaaactctacgatgacacgtgccgcacaaagaatgtgcagttcagttacggtacggccggattcagaacgctggccaagaatttggatacggtgatgttcagtactggtatactggcggttctcaggtcgctgaagcttcagggtcagtatgtgggggtgatgatcacggcgtcgcacaacccataccaggacaacggggtcaagatcgtggaaccagacggatcgatgcttttggccacatgggagccatatgccatgcagttggccaatgcggcctcttttgccactaattttgaagaatttcgtgttgagttggccaagctgattgaacacgaaaagattgatttgaatacaaccgtcgtgcctcacatcgtggttgggagagactctagggaaagtagtccatacttgctgcgctgcttgacttcctccatggccagcgtcttccacgcgcaagttttggacctaggctgtgtcactacgcctcaattgcattacattactgatttgtccaacaggcggaaactggaaggagacacagcgccagttgccacagaacaggactactattcgttctttataggagccttcaacgagctcttcgccacgtatcagctggagaagaggctgtctgtcccaaaattgttcatagacacagccaatggtatcggtggtccacagttgaaaaaactactggcctccgaagattgggacgtgccagcggagcaagttgaggtaatcaacgacaggtccgatgttccagaactgttgaattttgaatgcggtgcggattatgtgaagactaaccagagattacccaagggtctttctccatcctcgtttgattcgctatattgctcctttgatggtgacgcagacagggttgtgttctactatgtcgactcaggatcaaaatttcatttgttggatggtgacaaaatttccactttgtttgcaaagttcttgtctaaacaactagaattggcacacctagaacattctttgaagattggtgttgtgcaaactgcctatgcaaacggcagttccaccgcttacataaaaaatacgttgcactgtcccgtgtcttgcactaagacaggtgttaaacacttgcatcatgaagctgccactcagtacgatattggcatttatttcgaagcaaatggacatggtacgattatattcagcgaaaaatttcatcgaactatcaaatctgaattatccaagtccaagttaaatggtgatacgttagctttgagaactttgaagtgtttctctgaattgattaatcagaccgtgggagatgctatttcagacatgcttgctgtccttgctactttggcgattttgaaaatgtcgccaatggattgggatgaagagtatactgatttgcccaacaagctggttaagtgcatcgttcctgataggtcaattttccaaaccacggaccaggaaagaaaattgctcaatccagtggggttgcaagacaagatagatcttgtggtagccaagtatcccatgggaagaagctttgtcagagccagtggtacggaggatgcggtgagggtttatgcggaatgtaaggactcctctaagttaggtcaattttgtgacgaagtggtggagcacgttaaggcatctgcttga

SEQ ID NO: 3901 - DNA, 1674 bp, Saccharomyces cerevisiae
atgaagtgccaaacatgtcacttacccctgcaactagacccatctttagaaggtcttagtttaacccaaagaaatttgctactttcaaataattcaattatcactgcaacgaatgaaaatgtcatcagcaacaagggcatcgaagccgcagataattgtgggcctcaaataccgaaggagaggctgaggcgattaggggagattcagaacataaaagacttgaatttaaaagatgataaattaatcactgattcgtttgtttttcttaatcacgatgatgatgataatgctaatattacgagtaatagcagagaggaccagcgttatggaaatgccaacggaaatgataataaaaaagctaatagtgatacttccgatggaaccagtacctttcgagatcatgacgaagaggaacaagaagctacggatgaggacgaaaaccaacaaatacaattgaattccaagactttgtccacacaagtcaacgcaatgactaatgtatttaacattctatcttctcaaacaaacatagactttcctatctgtcaggactgctgtaacatcttgataaacagactaaaaagtgagtatgatgatgcaataaaagagagagatacttacgctcaatttttatcgaagttagagagtcaaaacaaagaaatatcagaaagcaataaagaaaagcagtattcccataatctttcggaaaaagaaaatttgaaaaaggaagaggaaagactcttggatcaattattacgtttggaaatgacagatgatgacttagatggagaactagttcgtttacaagaaaagaaagttcaactggaaaatgagaaactccaaaaactgagtgatcagaatttaatggatttaaataacattcaattcaacaaaaatttacagtcattaaaactgcaatacgaattatccttgaatcaattagataagttgaggaaaatcaatattttcaatgctacattcaaaatctcacatagcggcccctttgccactataaatggattgagattaggcagtataccagaatcagtggtaccttggaaggaaatcaatgcagcactgggccaattgattcttttactggctaccataaacaaaaacctgaagataaatttagtagactacgaattacaaccgatgggttcattttccaaaatcaagaaaagaatggttaacagtgtcgaatataataattccactacgaacgctcccggtgattggttgattctgcctgtctactatgatgagaatttcaatttggggagaatcttccgcaaggaaacgaagtttgataaatcattagaaacaacattagaaataataagcgaaatcactcggcagctttctacgatagcgtcatcatattcatctcaaacactcacaacaagccaagatgaatcttcaatgaataacgcaaatgacgttgaaaatagtacttccattctcgagctaccctatatcatgaataaggacaagattaatggattatccgtcaaattgcatggtagcagtcccaaccttgaatggacaacggctatgaaatttttattaaccaatgtaaagtggttgttagcgttttcttccaatttactatccaagtcaattaccttaagccctacagtgaattacaatgataagaccatcagcggaaactaa

SEQ ID NO: 3902 - DNA, 1674 bp, Saccharomyces cerevisiae
atgagcgacactgaaaaggataaggatgtccctatggtagactcgcacgaagcgaccgaggagccacccaccacaagcaccaacacgccatctttccctcacttagcacaggaacaggcgaaggaggaatctgccacattgggagcagaagtagctcataagaaaatcaattacgagcaagaagcacagaaactggaggagaaggcccttaggttcctggcaaagcaaactcacccggtgattattccgtcgtttgcctcttggtttgatatttcgaagatccacgagatcgaaaaaagatccaatcccgactttttcaacgattcatcaaggttcaagacaccaaaggcatataaggacacaagaaattttatcatcaacacgtaccgtctttcgccgtacgaatatttgaccattaccgctgtgagaagaaatgttgccatggatgttgcctcgatagtgaagattcacgcgttcttggaaaaatggggcttaatcaattatcagattgaccccaggaccaagcccagtcttattgggccaagttttacgggccacttccaagtggttctggacactccgcaggggttaaagccatttttaccagagaatgtgatcaagcaagaagtggaaggaggagatggagcggaaccacaagtcaagaaggaatttcccgttaatctcacaatcaagaagaacgtttacgattctgcacaagacttcaatgcattacaagacgaaagtagaaactccaggcagattcacaaagtttacatttgccatacatgcggtaacgagtcaatcaatgtgcgctaccacaatttgcgtgcacgggacaccaacctgtgctcccgttgtttccaagagggtcatttcggtgccaactttcaatcttcagatttcatcagattagaaaacaacggaaactcggttaaaaaaaactggtcagaccaggagatgctactattgctggagggtattgaaatgtatgaagaccagtgggagaagattgctgaccacgtgggtgggcacaagcgtgtagaagactgcattgaaaaattcctaagcttaccgatcgaggacaactacatccgagaagttgttggttcaacgctgaatggtaagggtggcgacagccgcgatggtagtgtgtccggttcgaagttgatggaatgcgtgaatgatgctgtccagacgctactgcaaggcgacgacaaattgggtaaggtctctgataagtcgagagagatctccgaaaagtacattgaagaaagccaagcgataatccaagagttagtcaagctgaccatggagaaattagagagcaagtttacaaagctgtgcgatctagaaacgcaactggagatggaaaaactgaaatatgtgaaggaatctgaaaagatgctgaacgaccgattatcactgagtaaacagattcttgacctgaacaagtcgctggaggagttgaatgtgtcgaagaaactggtactgatctcggagcaagtagactcgggcatacaactagtggagaaggaccaggagggcgatgacgaagacggcaatacggccacaggacatggcgtgaaacgtgtaggcaaggaaggcgaggaagtaggcgaaggcgactccattgcaaaattgcagccccaggtgtacaaaccgtggtcattgtaa

SEQ ID NO: 3903 - DNA, 1674 bp, Saccharomyces cerevisiae
atgccacaaagaattgagcttacctccgaaccagtcagaaaaccgcggtctactgagagctcactactcagaaagatacaaagagcgtgtagatccacattgcctgaaccagatttgggcttgaacttagatgtagctgactatatcaactcaaagcaaggagcaacccctagagaggctgtgttagcaattgaaaaattggtcaataatggggacacgcaagcagctgtttttgcactttcactactagacgtgctggtaaaaaattgtggttactctatacatttgcaaatctccaggaaggaattcttaaatgatctagtgaaaagatttccagagcaaccaccattgagatattccaaggtgcaacaaatgattcttgaagccatcgaggaatggtaccaaaccatctgcaaacatgccagctacaaagatgatcttcaatatatcaacgacatgcataaattactgaaatacaagggttatactttcccaaaagttgggagtgaaaacttggcggtgttgagaccgaatgaccaactgaggacacctagtgagctacaggaagaacaggaaagagctcaagctgcaaaactagaagagctgctaagaagcggcaagcccgatgatttgaaagaagctaataaactgatgaaaattatggcgggatttaaggatgacactaaagtagcagtcaaacaagcaattaacaatgaactaaataaactcaaaagaaaagctgatttattcaacgaaatgttgacttcagccgatgagcctgatcttgaaaatgaagctattcaagaattgtatggcgacttaaaatcagcgcagccgaaattcaaaaagcttattgaggaagaacgcgatgacgatgcgcttgttagtaatctatcaaaatttaacgatctagtgatccaattgttaaaaaggtacaagtcaataaaaggtatgaaggaagaagaactaaatgtccccgatacgaatgaaccggcaaaagagcttaatttgatagattttgatgacgatacaacagcaaacactccatctgtgacatctccaagcaaatctttgcaaccttttgacgatcttttaggggattttaataaggtaagtttatcatccccaaagtctcctcaagaaaacgacactgttgttgatatacttggtgacgctcactcaaagtcatctggtatagatttattagattttgattcgcaacctggagaaagtaaaaccgctctgtccgcatattctaactcgattgttctacctaatggtttactaaatagttcaagtaactccaaggaaatcacagctcaatcgcaaagacatatacttaaccaatcggatcacttacgcattgattacgaattaactcgtgagtcgatgacaaaactacgattagttatcttctattcaaacataagcagtgatccaataactaattttgcacttttagtggcatcacctaaaggcacgacattgtctctgcaaccgcaatcgggcaatatgctccaaagtaactccagagatggtatcaaacagattgcttccgtagagggtatatctgttaatttaggtaagcccataaaattgaaatggaaggctaattactgcaccaagggtgattcgaaggaagaatcgggcacgaccagtttgcccacaatataa

SEQ ID NO: 3904 - DNA, 1674 bp, Saccharomyces cerevisiae
atgcctatccccgttggaaatacgaagaacgattttgcagctttacaagcaaaactagatgcagatgctgccgaaattgagaaatggtggtctgactcacgttggagtaagactaagagaaattattcagccagagatattgctgttagacgcgggacattcccaccaatcgaatacccatcttcggtcatggccagaaaattattcaaggtattagagaagcatcacaatgagggtacagtctctaaaactttcggtgccctagatcctgtccagatttctcaaatggcaaaatacttagacacaatctatatttctggttggcagtgttcatcaactgcttccacctcaaatgaacctggtccagacttagctgattatccaatggacaccgttccaaacaaagtggaacatttgttcaaggcccaattgtttcacgacagaaaacaactagaggcacggtcaaaggctaaatctcaggaagaactcgatgagatgggtgccccaattgactacctaacaccaattgtcgctgatgcagacgcaggccacggcggtttaaccgcagtcttcaaattgaccaagatgttcattgagcgtggtgctgctgggatccacatggaagaccagacatctacaaataagaaatgtgggcatatggcaggaagatgtgttatacccgttcaggaacatgttaacagattggtgactattagaatgtgtgctgatatcatgcattctgacttaattgtcgttgctaggactgattcagaagcagccactttgattagctcaaccatcgataccagagatcattatttcattgtcggtgccaccaatccaaatatcgagccatttgccgaagttttaaatgatgccatcatgagtggtgcatcaggacaagaactagctgacattgaacaaaaatggtgtagagacgctggactcaagttattccatgaagccgtcattgatgaaattgaaagatcagccctgtcaaataagcaagaattgattaagaaattcacctctaaagtgggtccattgactgaaacatcccacagagaagccaagaagctcgctaaagaaattcttggccacgaaattttcttcgactgggagctaccacgcgtaagggaagggttgtaccgttacagaggtgggacgcaatgttctatcatgagggcccgtgcatttgctccatatgctgatttggtatggatggaatctaactacccagacttccaacaggccaaggagtttgcagaaggtgttaaagagaaattccctgaccaatggctagcttacaacttgtctccatcctttaactggccaaaagccatgtccgttgatgaacaacacaccttcatccaaaggctgggtgatctaggttacatctggcaatttatcacattggccggtttacacactaacgctttagctgtccataacttctctcgtgactttgccaaggatgggatgaaagcttatgcccagaatgttcagcagagggaaatggacgatggtgttgatgtgttgaaacatcaaaaatggtctggtgcggagtacatcgatgggttattgaagttagctcaaggtggtgttagcgcaacagctgctatgggaaccggtgtcacagaagatcaattcaaagaaaatggcgtaaagaaatag

SEQ ID NO: 3905 - DNA, 1674 bp, Saccharomyces cerevisiae
atggctcgtcatggaaaaggcccaaaaactaacaaaaaaaagctagcacctgaaaaggaaaggtttatacaatgttgtgctgatatcacattagagttaacagattctttaacctcgggaacaacaagagaaattaatctgaatggtttgattactaaatattcaaagaaatataaactaaagcaacaaccaaggttaaccgatatcattaattctattccagaccaatacaaaaaatatttattacccaaattgaaggctaagccagtaagaacagcatcgggtattgcagtggtagccgttatgtgtaaaccacatcgttgtcctcacattgcatatacaggtaatatttgtgtttattgtccaggtggtccagattcagattttgagtattctacacaatcttacacaggctatgaaccaacttcaatgcgtgccatcagagctcgttatgacccttatgaacaagcacgtggtagggtggaacaattgaaacagttaggtcactccatcgataaagtcgaatatgttctgatgggtggtacatttatgtcattaccaaaagaatatcgtgaagattttattgtgaaattgcataatgcactttctgggttcaatggtaatgatattgatgaagctattctttattcgcaacaaagtttaacgaagtgtgttggtataacaatcgaaactaggcctgattattgtacgcaaacacatttggacgatatgttaaaatatggctgtaccagattagaaattggtgttcagtccttgtacgaagacgttgctcgtgatactaatagaggacacaccgttaggtctgtttgtgaaacttttgctgtgtctaaagatgctggttataaggttgtttctcacatgatgccagatttaccaaatgttgggatggaaagagatattgaacagttcaaagagtattttgaaaatcctgattttaggactgatgggttgaaaatctatccaactttagtcattaggggtacaggtttatacgaactttggaaaacgggcaggtataagtcttatagtgccaacgccttagtggacttagttgctagaatcttggccctagtgcccccatggacaagaatctaccgtgtccaaagagacattccaatgcccttggttacctcaggtgttgacaatggtaacttgagagaattggcattagctagaatgaaggacttgggtacaacttgtagggatgttcgtactagggaagtgggtatccaagaagtgcatcataaagttcaaccagatcaggtcgagcttatcagaagggattactatgcaaatggtggttgggaaacctttttatcatatgaagatccaaagaaagatatactgattggtttgctgagattgagaaaggcttcaaagaaatatacatatagaaaagaattcacctcccagaggacttctattgttagagaattgcatgtttatggttctgtggttccacttcattcaagagatcctcgtaaattccagcatcaagggtttggtactctattgatggaagaagcggaaagaatcgccaaggaagagcatggttcagagaaaatttctgttatttctggtgttggtgtaagaaattactatggtaaactaggatatgaactagacggtccatacatgtcgaaaagaatttaa

SEQ ID NO: 3906 - DNA, 1674 bp, Saccharomyces cerevisiae
atgtctcaagacgaaaatattgtcaaagctgttgaagaatccgcagaacctgctcaagttattcttggggaagatggtaagccattgtccaagaaggccttgaagaaattgcagaaagagcaagagaaacagagaaagaaggaggaaagagctctccagttggaagctgaaagagaagcccgtgaaaagaaagccgctgccgaagacaccgcaaaggacaactacggtaagttgccattgatccagtctcgtgactctgacagaactggtcagaagcgtgtcaagtttgttgacttggatgaggctaaggatagcgacaaagaagtcctcttcagggcaagagtccacaacaccagacaacaaggtgcaacattggcctttttaactttaaggcaacaagcttccttgatccaaggtctagtaaaggccaacaaggaaggtaccatcagcaaaaacatggtcaaatgggctggttcattgaatttggagtccattgtccttgtcagaggtattgtcaagaaggtagatgagccaatcaagtctgctactgtgcaaaacctggaaattcacattaccaagatttataccatttccgagactccagaagcattgccaatccttttggaagatgcctcccgttccgaagctgaagctgaagctgcaggtttgcccgtggtcaacttggacaccagattagactaccgtgtcattgacttgagaaccgtcaccaaccaagctattttcaggattcaagctggtgtttgtgagttgttcagagaatatttggccacaaagaaatttaccgaagtacacacaccaaaactgttgggtgcaccaagtgaaggtggttccagtgtgtttgaggtgacatacttcaaagggaaggcctacctagctcaatctccacaatttaacaagcaacaattgattgtggccgactttgaaagagtttacgaaatcgggcctgtgttcagggctgaaaactccaacacccaccgtcacatgaccgagtttactggtttggacatggaaatggctttcgaagaacattaccacgaagttttggacacgttgagtgagttgtttgtgtttattttcagtgaattgcccaagagatttgctcatgaaattgagttggtacgtaagcaataccctgttgaagaattcaagttacctaaagatggtaagatggttcgtctaacatacaaagaaggtattgaaatgctaagagctgccggtaaggaaattggtgattttgaagacttgagtaccgaaaatgaaaagttcttgggtaagttggttcgcgacaaatacgacaccgacttttacatcctagacaagttccccttggagatccgtcccttctacacaatgcccgacccagccaaccctaagtattctaactcgtatgatttcttcatgaggggtgaagaaatcttgtccggtgcacaacgtatccacgaccatgctctattacaagaaaggatgaaagcccatggtttgtctcctgaggacccaggtctaaaggactactgtgacggcttcagctatgggtgtcctccacacgccggtggtggtatcggtttggaaagagttgttatgttctatttggatttgaaaaatatcagaagagcttcattgttcccaagagatccaaagagattaagaccatga

SEQ ID NO: 3907 - DNA, 1677 bp, Saccharomyces cerevisiae
atgagaagaaaaaatcgactgtttatattagttgtactactgggaattgtgttagtagtatattactctcagttgaattcgttagatttggtagaaccagttcaaagtagcagcagtggcaatggtggctgctggagttactatgaaggtcttacgcctgggtggttgaatgacttctacgacgtaaatcaaataaccccgaatcctgcaaaagatgtgattgaactggttacgaggattaagattttttttaattgcttgcagcaggttgatgggcataatattcagcgtttgagggatattgaaaagaagctctttccgtatattaactttgaaaaattagaaactgatgaaagtgccttctggcacacaactacgagatggaatggcgaggtttaccatgcgtctatgttggaatttgaccccaaaaaccatcaattccttcgttctaagcccatcaatttcgatacagggctatctttttgggagaattggttgcacactgtgactcaaagtggttcgaaaggcatagttattagtgcttctgacgtgcagttgaatgaaaccatacgcttattgaaagtgttgaggttcatcaaaaatgattatcctatacagattgttcataatgcagatctgagtcaagattccatgaaatctattatcaaatatgcgagaagtctagacaccgctgaatatcctgctcaagaattatggtttttaaatgtacatagtctgctaaacccgaaatattcgaaaaaatttaccacctattccaacaagtggttagcattgaccttctcatcctttgaaattcctattctaatggactcagatacagtgccctttgtttcaatagaaaaattttatgaattagaggaatttcaaaagactggagttctattctttaaagatcgggtaatatcagatgatctatttgaatcctctgaattaaaaattctaagggaaattgtctatgggtgtattgggcttgatttagaggatgaatccaagatacatgagcaagtagaggatccagtggttgcacaggttctggaaaacatgtttataaagaaatataaacatcatttggaaagcggcctggtaatattgcataaaggaaagcatctcttcagtatgcttacttcaatagctttacaattttctccaattgcagaatattttcatggtgataaggactttttttggctgggcgaattactttcgaacaatcgctttacgttccatcctgtggatgcatcaaacattggtcagttgggcaatgtagtttcaaaagagagtaccggtgagttttaccagatttgttctgtgcaactatctcatacagacagggacgggtccttgctatggctaaacgggggccttaatatttgtaaaaaaacttcatgggaatacgattatgagcatagacagagactaaatgatatgttccaaaatgcagatgaattacgtgaatattatgcatcaccagtaaaacttgaagggattataataccagatactagtatatcaggatggattaactcaggagagtgttttttgttcaattattgcacattattcaaggaaggtgagtttggaaagttgatcaaatttaaagaagacgaaaagctccggctttcacaaatagtcgacatatggaataaagatatttga

SEQ ID NO: 3908 - DNA, 1677 bp, Saccharomyces cerevisiae
atggcacacatcccagaggttttacccaaatcaataccgattccggcatttattgttaccacctcatcgtacctatggtactacttcaatctggtgttgactcaaatcccgggaggccaattcatcgtttcgtacatcaagaaatcgcatcatgacgatccatacaggaccacggttgagatagggcttattttatacgggatcatctattacttgtccaagccacaacagaaaaagagtcttcaagcacagaagcccaacctatcgccccaggagattgacgcgctaattgaggactgggagcccgagcctctagtcgacccttctgccaccgatgagcaatcgtggagggtggccaaaacacccgtcaccatggaaatgcccattcagaaccatattactatcaccagaaacaacctgcaggagaagtataccaatgttttcaatttggcctcgaacaactttttgcaattgtccgctacggagcccgtgaaagaagtggtcaagaccactatcaagaattacggtgtgggcgcctgtggtcccgccgggttctacggtaaccaggacgttcattacacgttggaatatgatttagcacagttctttggcacccaaggttccgttctgtacgggcaagacttttgtgccgcaccctctgttctgcctgctttcacaaagcgtggtgatgttatcgtggcagacgaccaggtgtcattaccagtgcaaaatgctctgcaactaagcagatccacagtctactacttcaaccacaacgatatgaattcgctagaatgtttattaaacgagttgaccgaacaggagaaacttgagaaactgcccgccattccaagaaaatttatcgtcactgagggtattttccacaactcgggcgatttagctccgttgcctgagttgactaagctgaagaacaagtacaagttcagactatttgttgacgaaaccttctccattggtgttcttggcgctacgggccgtgggttgtcagagcacttcaacatggatcgcgcaactgccattgacattaccgttgggtccatggccaccgcgttggggtccaccggtggttttgtcctgggtgacagtgttatgtgtttgcaccagcgtattggttccaatgcatattgtttttctgcctgtttgccggcttacaccgtcacatccgtctccaaagtcttgaaattgatggactccaacaacgacgccgtccagacgctgcaaaaactatccaaatctttgcatgattcctttgcatctgacgactccttgcgttcatacgtaatcgtcacgtcctctccagtgtctgctgtcctacatctgcaactgactcccgcatataggtctcgcaagttcggatacacctgcgaacagctattcgaaaccatgtcagctttgcaaaagaagtcccagacaaacaaattcattgagccatacgaagaggaggaaaaatttctgcagtccatagtagatcatgctcttattaactacaacgttctcatcacaagaaacactattgttttaaaacaggagacgctaccaattgtccctagcttgaaaatctgctgtaacgccgccatgtccccagaggaactcaaaaatgcttgcgaaagtgtcaagcagtccatccttgcctgttgccaagaatctaataaataa

SEQ ID NO: 3909 - DNA, 1677 bp, Saccharomyces cerevisiae
atggcagtccttaacttgaaacgtgaaactgtcgacattgaagagacagcgaagaaagatatcaaaccttattttgcttcgaatgttgaagcggttgatattgatgaagatcccgatgtttcaagatacgatccccagacaggagtgaaaagggcgctcaaaaataggcatatctcattgctagctttgggtggtgttattggcccaggttgtcttgttggtgcaggaaacgcactcaacaaaggtgggccacttgctttacttttaggctttagtattattgggatcattgctttctcagtgatggaatctataggtgaaatgatcactttatatccctcgggcggtggatttaccactttggctcgaagatttcatagcgatgcactgcctgcagtttgcggttatgcttacgttgttgtgttcttcgcagttttggcaaatgagtacaacactctctcctccatactacagttttggggcccacaagtccctctatatggttacatcttgatattctggtttgcatttgaaatttttcaactagttggcgttggtctttttggtgaaacggagtactggcttgcttggttgaaaatagtaggattagtagcctattatattttctcgattgtttacatatctggggatattaggaatagaccagctttcggctttcattattggaatagtccaggtgcattatcacatgggtttaagggaattgcgatagtgtttgtgttttgttcgaccttctattctggaacggaatcagttgccttggctgcaacggaatcaaaaaaccctgggaaggctgtgccacttgctgttcgacaaactctgtggagaattttagttgtttatattggaattgctgttttctatggagcaactgttccgtttgacgacccaaacctctctgcttctaccaaagtcctaaaatctcccattgctatcgccatatctcgtgctggttgggccggcggagctcatctggttaatgccttcattttgataacttgcatctccgccattaatgggtcactttatatagggagcagaaccttgacgcatttagcacatgaaggcctagctccaaaaattctggcttggaccgatcgaagaggcgttcccatccccgccatcactgttttcaacgccttgggcctaatatcattgatgaatgtgagcgttggagctgcaaatgcgtactcttatatcgttaatctttctggtgttggcgtctttattgtctggggtgtaataagttatacgcacctgagaataaggaaggcgtgggttgctcaaggaagatccatagaagagctaccttatgaagcgctattttatccgtggacgccagtacttagtctggccgctaacatttttctagcactcatccaaggatggagctatttcgtaccttttgatgcgggcaattttgttgatgcttatatccttctgcctgttggaattttattgtatattggcatatgtgtttttaagagcaatcattttagaactgttgatttgcggtcaatcaacctagacgaaggacgaagaaaagacatggaggctgatctttctgatcaagagagtagcttagcatcttcggaaacgatgaaggattataaaagtgcaacttttttcagatacctcagcaacattttcacctga

SEQ ID NO: 3910 - DNA, 1677 bp, Saccharomyces cerevisiae
atgggacctccgaaaaatttcaagcatttcagtaagagtaataaacacaaaaaggagcagaaagccctgattactcaagaagatttctacctggcagcgatcgactgtgaagaacaagcagaccgttggttgctatcggacataaagaaatgtttgcggttctatctaaaggctctagagcactacgaaaatggtctgactgctttagattccacgcaggaagggaaatataatatctattataatgaaacaaggctttttttgcaaatttatacagattatctggccaataacggctacattaatatcttgcaatacgtgaaaatggatgatatgcctgatctttccaatttggtgttatctctgccacagattatccaacggtttgaaattgtttatgagactttcccagaacagagaacttgggatcttcaattcaatctattgacatgttatttgactctcatagagtccctagacgacaccgtttcgcccaccgttgcaatggaaggtgcagacattttaactttgacaaacaagtatattgaaatctttcaacacctggttaattatctgttacaagaactacaaaactggagtgaaaatgcagaacaagattccgatgacacagatacggaattgcaaagagatactttggatgaagacgcgatgcaagttaccagggacggaagtggtatccgaaccaatggacctgtacaacctccagcagaagttatggacgtttctgaacaagtgactccgtcttcacttaccgaagtactcgccaactctttaaagttcaaccatgctttgatggaattggttattgagtcgaaaatatctattgaaaaaaatgtcgaaacgaaaatcttgaatcctattcagattaatttcttggaagatacaaccaataaattctatttacaactacgcgacattatagactccatttccgccgccattccattagatttgaaggaaatcggtttagccaagactttaattgaaggtttgaacatcattagctccggaaccttcgagtcattgcaagattttgttctgcaaaccgtctcctttaccgatctgcttgatgaaaaagatgtacagggtaagattgatctttcgttgattagagttgatatcgttgaatttgccattctatgtttaaacgattattcttcagatgcatcttggaaactctctgggttattgaccaaagttcttacagaggctagaactttattaacagactatagaaatcaaatcttgtttctgaaaaatcagacattgaacgaacaattgagtcacgtagtttttcaactttgtgatgtcttagtaaattcctccgataatgaactgagaaggtacgctataaaagaatcaactgaaaagtcacaaaaaacccccgggggagcgcatactttaaacatattgatgaaaaacgctaacgtttttctgaataatgctgtcgctatctcatcaaaacagtgcgggttacaagaaacgattattgataaactgaagaggaactatatccataatcaagccaaggaaagactacttttcttacagaggctggaacagaagtcaaatgaggatgacggtacttctgcttcgcctaccgcaatgacgttcgatatgccaccagaacaccctttttatagccactatcggtag

SEQ ID NO: 3911 - DNA, 1677 bp, Saccharomyces cerevisiae
atgtctgatttagatgaggatttattagccttggctggtgccgatgaatccgaagaagaagatcaagttttgacaactacatctgccaaaagggcaaaaaacaacgaccaatctctttccaagaaaaggagaattgaagtcggcagtgtagaggatgatgatgaggaggacgattataacccttactctgtaggaaatgcagactacggttccgaagaagaagaagaagctaatccttttcccttggaaggaaagtacaaggatgagagcgacagagagcacctggaatccttacctgaaatggaacgtgagactctattatttgaaagatctcaaatcatgcagaagtaccaggagaggaaactttttagagcacgtggaagagatatgaaggaacaacaacagagagccaagaacgacgaagattccagaaagaccagagcttccactagatcaacccatgctactgggcattctgatatcaaggcttcaaaactttcgcaattaaagaaacaaagagcgaggaaaaaccgtcactacagcgataatgaagacgaagacgatgaggaagattacagggaagaagactacaaggacgatgaagggagtgaatacggggatgatgaagaatacaatccttttgatagaagggatacatacgacaaaagagaagaagtggagtgggctgaagaggaggacgagcaagacagagagcctgagatttctgatttcaacaaactaaggatcggtcgttcatttgtcgcaaaattttgtttttatcccgggtttgaagatgcagtcaaaggttgttatgggagagtcaatgttggcacagataaacgtaccggcaaaacttcttaccgtatggtgagaattgagagagttttcttgcaaaaaccttacaatatgggtaagttctatactaaccagtatttcggtgttacccaaggtaaagacagaaaggtttttcaaatgaattattttagtgatggtttgtttgccgaagacgaataccaaaggtatctcagggcattggataattcgcaaatgattaaaccttctttacattctttgagtaacaaaacgaaagaggttatggattttgtcaatacaccattgactgataaaactacagatgaggttgttcgccataggatgcaattcaataaaaaactatctggtacgaatgcagtcttggagaaaactgtattgagagaaaaattgcaatatgccaaggagactaataatgaaaaggacattgcaaaatactctgctcagttaagaaactttgagaaacgaatgtctgtatacgagaagcatcatgaaaatgaccaatctgacattaaaaaactaggcgagttgacctctaagaatagaaaattgaatatgagtaacatcagaaatgcagagcatgtgaaaaaagaagacagtaataactttgattcaaagagcgatcctttcagcaggctaaaaaccaggaccaaagtttactatcaggagatacaaaaggaagaaaacgcaaaagctaaagaaattgcacaacaagagaagctacaagaagataaagatgctaaagataagcgtgagaaagagctacttgtggcacaattcaggcgccttggtgggttggagcgcatggttggtgaattggatatcaaatttgaccttaagttttag

SEQ ID NO: 3912 - DNA, 1680 bp, Saccharomyces cerevisiae
atgatggaagaattctcgtacgatcacgattttaacacacattttgctacagatttggattatttgcaacatgaccaacaacaacaacaacagcaacaacatgatcaacaacataatcaacagcaacaaccacaaccacaaccaattcaaactcaaaacctggagcacgaccacgaccaacatactaatgatatgagtgcttcatcgaatgcatcagatagtggacctcaaaggcccaagaggactcgcgcaaagggtgaagcactagatgtgctaaagcgtaaatttgaaataaatccaacaccctctttggtagaaagaaagaaaatatcagatctgataggaatgcctgaaaaaaacgtcagaatttggtttcagaacagaagagctaaattgaggaaaaagcagcatggaagtaataaggacacaatcccctcgtcacaatcccgtgatattgccaacgattacgatcgtgggagtacagacaacaatttggtcactacaacaagtacttcatccatatttcacgatgaagacctgacttttttcgaccgtattccgctgaacagcaacaacaactattatttttttgacatttgctcaattactgtgggaagttggaatagaatgaaaagcggcgcactgcaaagaaggaactttcagtctataaaggagttgagaaacctatcgccaataaagattaataacataatgtcgaatgccacagatttaatggttttgatatccaagaaaaactcagaaataaactatttttttagtgccatggcaaataatactaaaattctcttcaggatctttttcccattaagttcagtcacgaattgctctctaactttagaaactgacgacgatataataaatagtaacaacacaagcgataaaaacaatagtaatactaataatgatgatgataacgacgataacagtaatgaagacaatgataatagtagtgaggataagaggaatgctaaggataactttggagaattgaagctaacagtcaccagatcacccacttttgctgtttactttttaaataatgctcctgatgaagatccaaatttgaacaatcagtggtccatatgtgatgatttctcagaaggtagacaggtaaatgacgcatttgttggtggttcgaatattcctcacactttgaaaggtttacagaaatcattaagattcatgaattctctaattctagactataaatcatcgaatgaaatattacctacgatcaatacagcgatccccactgctgcagttccacaacagaatattgcccctccctttctgaatacaaattcaagtgcaacagactcaaatccaaatacaaatttagaagattctctcttcttcgatcatgatctgttatcgagttcgataaccaacaccaacaacggacaaggctctaataatggacgtcaagctagcaaggatgatacgctcaatttactggatactaccgtcaacagcaataacaatcataatgctaataatgaggagaatcatctagcgcaagaacatttatccaacgatgctgatattgttgcaaatccaaatgatcatttgttgtctttaccgactgatagtgaactcccaaatactccagattttttgaagaacactaacgaactaactgacgagcatagatggatatga

SEQ ID NO: 3913 - DNA, 1680 bp, Saccharomyces cerevisiae
atgtcccaattattcaataactcgcgctcagatacccttttcctaggaggtgaaaaaataagtggtgatgatattcgtaatcagaatgttttggctactatggctgtggctaacgtcgtcaagtcatctttaggccccgttggactggacaaaatgcttgttgatgacattggtgattttaccgtcaccaacgatggtgccactattttgtctttgttagatgttcaacatccagctggaaaaattttagtagaattggctcaacaacaggacagagaaattggtgacggtactactagtgttgttattattgcttctgagttgttgaaaagagctaatgaattagtcaaaaataagattcatccaactaccatcataactggtttcagggttgcattaagagaggctattcgttttataaatgaagttctttccacaagtgttgacactttagggaaagagacgttaattaatatagccaagactagtatgtcctctaagatcattggtgctgactctgattttttcagcaatatggttgtagatgctcttttggctgttaagacgcaaaattccaaaggagaaatcaagtatcccgtaaaggctgtcaatgtgttgaaagctcatggtaaatctgccactgaatcactgttggtgccaggttatgctttgaattgtacagttgcttctcaagcaatgcctaaacgtatcgccggtggcaatgtgaaaatcgcatgtttggatttgaacttgcagaaagctcgtatggcaatgggtgttcaaatcaacattgatgatccggaacaattggagcaaatccgtaaacgtgaagctggtattgttttggaaagagtgaagaagatcattgatgctggtgctcaagttgtgttaaccaccaaaggtattgatgatttatgcttaaaggagttcgttgaagctaagataatgggtgtaagacgctgtaagaaggaagatttgagaagaattgcacgcgctacaggcgccactttggttagttctatgtctaacttagaaggtgaggaaactttcgaaagcagttatttaggtctttgtgatgaagtagttcaagccaaattttctgatgatgagtgtatcttaattaagggtacttctaaacattcatcttcttcgatcattttaagaggtgccaacgattattctttagatgagatggaacgttctttgcacgattctctttctgttgtcaaaagaacgcttgaaagtggaaatgttgtccccggtggaggttgcgttgaagccgcattgaatatctatttggacaattttgccaccacagttggttctcgtgaacagttagctattgctgagtttgcagctgcattattaatcattccaaaaactttagctgttaacgctgccaaggattctagtgaattagttgcaaaattaaggtcctaccatgccgctagtcaaatggccaagccagaggacgttaagaggagaagctacagaaattacggcctagatttgattagaggtaaaattgtggacgagattcacgctggtgttcttgagccaaccataagcaaagtcaaatccttgaaatcagcattggaggcttgtgtagcaattctaagaattgatacaatgattacagtggatccagaaccacccaaagaagatccgcacgatcattga

SEQ ID NO: 3914 - DNA, 1680 bp, Saccharomyces cerevisiae
atgttgtttaaatccctttcaaagttagcaaccgctgctgctttttttgctggcgtcgcaactgcggacgatgttccagcgattgaagttgttggtaataagtttttctactccaacaacggtagtcagttctacataagaggtgttgcttatcaggctgataccgctaatgaaactagcggatctactgtcaacgatcctttggccaattatgagagttgttccagagatattccatacctcaaaaaattgaacacaaatgttatccgtgtctacgctatcaataccactctagatcactccgaatgtatgaaggctttgaatgatgctgacatctatgtcatcgctgatttagcagctccagccacctctatcaatagagacgatccaacttggactgttgacttgttcaacagctacaaaaccgttgttgacacttttgctaattacaccaacgttttgggtttcttcgccggtaatgaagttactaacaattacaccaacacagatgcatctgctttcgtgaaggcagctattagagacgtcagacaatacatcagcgacaagaactacagaaaaattccagttggctactcttccaatgatgacgaagataccagagttaagatgactgattatttcgcttgtggtgatgatgatgttaaggctgatttttacggtattaatatgtatgaatggtgtggtaaatctgacttcaaaacttctggttatgctgatagaactgcagaattcaaaaacttatctattcctgttttcttctctgaatacggttgtaacgaagtaacaccaagactatttactgaggttgaagccttgtacggttctaatatgacagatgtctggtctggtggtatcgtatacatgtacttcgaagagactaacaaatacggtttagttagcatcgatggtaatgatgttaaaactttggatgacttcaacaactattcttctgaaatcaacaaaatatcaccaacttccgccaacacaaagtcttacagtgcaacaacaagtgatgttgcttgtccagctactggtaagtactggtccgctgcaacagaattaccaccaactccaaacggaggcttgtgttcatgtatgaatgcagccaatagttgtgttgtttccgatgacgttgattctgatgattacgaaaccttatttaactggatctgtaatgaagtcgactgtagcggtatttcagcaaacggtaccgccggtaagtatggtgcttactctttctgtacaccaaaggaacagctatctttcgttatgaatttgtactacgagaagagtggtggtagcaaatctgactgtagcttcagcggttctgccactctacaaactgccaccacgcaagctagttgctcctccgctttgaaagagattggtagtatgggtaccaactctgcatcaggtagtgttgatttgggttccggaactgaatccagtactgcctcttctaacgcttcggggtcttcttccaagtctaactccggctcttctggttcttccagttcttcttcttcttcttcagcttcatcttcatcttctagcaagaagaatgctgccaccaacgttaaagctaacttagcacaagtggtctttacctccatcatttccttatccattgccgctggtgtcggttttgctttggtttaa

SEQ ID NO: 3915 - DNA, 1683 bp, Saccharomyces cerevisiae
atgaattggtcttttctactacagctggtaataacaatattgttaattgtgctgggcgccaactggttgctaagctcttttctacttgattttaagagagatttaacaggggtggctttgtcacagcaatctagcatatccagtgttcgtaaagaaaatgaaacagcatattatcgaagcattttagtgcccacaggattcccattgacgacaggattagggctatctttaaaatacaaaataagaaatggcaatttcggtgatgtttggaatgccataatggaagtttccaagggaaaaaacataattaaatttacaggaagagaaaaaagttattcgttgagtgaacttaatggtatggccaagcgcatatttccgaaactttccaataagaatttcaaaaatatcggtatagctaattctattgctaccgtagagggttttactctctccttggcttccatgatgacctctataagaacaggttcaatacctcatttcttgccagctgttcctagacaacgactagaagatgttgatgtcctgatcatcgactcatggaagtcttttaagatgctaaacggcagcgaggattggtacaagcttattgttgtttgcgatgatcctatcgaatcactacaatttgatgcgaactgtgatgttatcacttggaaagaacttatcgacggttttaccaaggatacagagtaccaatacaccccgccagatgacaactctgatgataagaaactttttgcatacgtaacttcaccatggaatggaactaatagttttaatcaaatctgtctggtgagtaatatagcggaattcatcaaagggttccccttgggaaatgaattgaatagtaatgaatacctaaccatttcgacaaaattggcaaattctagtgcaagcctacaaatttggggaaagctttttgcagttttgctgcatggtgggtctgcatctttcatcaatcctacaacgatagattgcgagtcgttgcaagaaactacgttactgtttaccgaaacaaaggatgttgtcaaattaattgattctaattctagaagtgggctgctgaataaaatctacttatcctgggccacgaacttactgagcgagggtatttttacgaaaattgccagaatcgagccacattctcttgaaaaattaagatgtgtttatttggcagataatgtgaaagatgctgaggttatttcgacatttcctgaaaaaattcctcagctaaaaaagactaaccgaagaatcaccccaagcactgaacaattgaataaaataagagctcaattaggatcccgtgtagtcctcgagttatattgtccctacgctatcatgggacctgtggcacataccaatttttatgactatagggtttttggaaaatctgtggacgataacgttgtatgttatggaacactaagtacaacattagaaggaaaaatggtagaaacggaaacaaaccctcatttgaacatagagaagaagcagggtatgttatgtattcgtggttttagcataggtaaaccagtagagtccgatcgtttagagaaagctttgcatttagctgaaaggtttggaggaggtgaaggatggatgcctctagttggcgtttttggactatttggccaagacggttgcttatacatctataatcaatga

SEQ ID NO: 3916 - DNA, 1683 bp, Saccharomyces cerevisiae
atgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatag

SEQ ID NO: 3917 - DNA, 1683 bp, Saccharomyces cerevisiae
atgacttcaccggaatcactatcttctcgtcatatcaggcaaggaaggacatacacaaccacagacaaggtcatatcgcggtcgtcgtcgtactcatctaatagttcaatgtctaaagattacggcgatcacacacccttgtccgtcagcagtgcagcttcagagacattaccctcacctcagtatatgccgataaggacattcaatacaatgcctacagctggcccaacgcctttacatttatttcaaaatgacaggggcattttcaaccatcattcttcatcaggctcatcaaaaacggcatcaacaaataaaagaggaatagcagcagcagtagcattggcaactgctgccaccataccatttccactgaaaaaacagaatcaagatgataattccaaggtctcggtaacacacaatgaatcatcgaaagaaaataaaattacaccctccatgagagcagaagataacaaacctaaaaatggttgcatctgcggttcaagtgactccaaggatgagttgtttatacagtgtaacaaatgtaaaacgtggcagcacaagttatgttatgctttcaaaaaatcagatccaataaaaagagattttgtttgcaaaagatgtgacagtgatacgaaagtgcaggttaatcaagtaaaaccaatgatattccctagaaaaatgggagatgagcgattatttcaattttcatccatagtgacaacttcagcatcgaacacaaatcagcatcaacagtctgtgaataacatagaggaacagcccaagaaacgtcaacttcattataccgccccaacaactgaaaatagcaatagtatacggaaaaaattgaggcaagaaaaactggtagtatcaagccactttctgaagccactactgaatgaggtaagttcttccaatgacacggaattcaaagcaataacaatatcagagtataaggacaaatatgttaagatgtttattgataaccattatgatgacgattgggttgtttgttctaactgggaaagctcaaggtcagctgacatcgaggtaagaaaatcatcaaatgaaagagattttggagtcttcgctgcagattcttgtgttaaaggtgagctaattcaagaatatttgggcaaaattgattttcaaaaaaattatcagacagatccaaataatgactatcgtttgatgggaacgacaaaacctaaagtactttttcatccacattggcctttatatatagactctcgagaaacaggcggattaacaagatacataagacggagttgtgagcccaatgtggaactagtaacggtaagaccgcttgacgaaaaaccaagaggagataatgattgtagagttaaatttgttttaagggctataagagatattcgtaagggagaagagataagcgtagaatggcaatgggatttgagaaatcctatttgggagataataaatgcatctaaagatttggattccctaccggatcccgacaagttctggttgatggggtcaataaagactattttaacaaattgtgattgtgcatgtgggtacttgggccataattgtccaataactaaaatcaaaaacttttctgaagaattcatgaggaatacgaaggaatccctatctaataaatcttactttaatacaataatgcacaactgtaagccataa

SEQ ID NO: 3918 - DNA, 1683 bp, Saccharomyces cerevisiae
atgattagacaatcattaatgaaaacagtgtgggctaactcctccaggtttagcctacagagcaagtcggggcttgtgaaatatgccaaaaatagatcgttccatgcagcaagaaatttgctagaggacaagaaagtcattttgcaaaaagtggcgcccactactggcgttgttgcgaagcagtcctttttcaagagaactgggaaatttactttgaaggctttattgtattctgccctcgcgggtacggcttacgtttcatactcactttaccgagaagctaacccttctacccaagttcctcaatcggacacttttccaaacggttcaaagaggaagactttggtaattctgggctccggttggggttctgtgtcgcttttgaaaaatttggacaccacgttgtataatgttgttgttgtttctccaagaaattattttctttttactccgctattgccatctaccccagttggtaccatcgaattgaaatctattgttgaacctgtcaggactattgctagaagatcgcacggtgaagtccattactatgaagctgaagcgtacgacgttgatcctgaaaacaaaacaattaaggtcaaatcttccgctaagaataacgactacgacttggacttgaaatacgactatctggttgtcggtgtgggtgctcaaccaaacacttttggtactccgggagtttatgaatattcttctttcttgaaggaaatatccgacgctcaagagatcagattaaaaattatgtccagtattgagaaagctgcctccctatctccaaaagatcctgagagagcaagattgttgagctttgttgtcgttggtggtggtcccaccggtgtcgaatttgccgctgaattgagagattatgttgaccaggacttgagaaaatggatgcccgaattgagtaaagaaattaaagtcactttggtggaggctttgccaaacattttgaacatgtttgacaagtatctcgttgactatgctcaagatttattcaaagaggaaaaaatcgatttaagattgaaaacaatggttaagaaagttgacgctaccactataactgccaaaactggcgatggtgacattgaaaatataccgtatggtgtattagtttgggctacaggtaatgcgccaagagaagtgtctaagaacctaatgactaaattagaggaacaggactcaagacgtggtttgttgatagataacaaacttcaacttttgggtgctaagggatctatttttgctatcggcgattgtaccttccaccctggcttgttccctaccgctcaagttgcccaccaagaaggtgaatacttggctcagtatttcaagaaagcttataaaatcgatcaattgaactggaaaatgacccatgctaaagacgattcagaagtcgctagattaaagaaccaaatagtcaaaacgcaatcgcaaattgaagacttcaagtacaaccataagggtgctctggcttatattggttcagataaagccattgctgatcttgccgttggtgaagccaaatataggttagccggctcattcaccttcctattctggaaatctgcttatttggcaatgtgtctatcctttagaaacagagttcttgtcgctatggattgggctaaagtttatttcttgggtagagattcatctatctag

SEQ ID NO: 3919 - DNA, 1683 bp, Saccharomyces cerevisiae
atgcaagcccccaatatctaccccttctctcaaacacagccacaagcactgcccgggttcacatacggtcctccacaacttgtttttgaccattctgctccgagagtagatcctttgcattctactgtaactataaattctccattacccttgcagcattataatggaccgaatgcccatataaacagcgcaaacaacaactacgcatactactatcatcatcccaacaataatgataacaacaaccatagtaacaacactataaaaaataacaacattaattctgttcttcccgccgttaatattcaaatatccaacaactcacattatagaaatacacaccaaattccttctgctcctcagcggctggtcagcatcataccggatccccacatgccgcccaatatttctcactttcagctaaataatattcaccctcaaatgcatgctcctgttgctactgatattcatttccaacaagtaccagtttacaataaaaccaataatggcattggtactgataacattaataacgataaacccgtaaactcgaatcagaatgaagtgctggacaatattgatgaacgttcctgtcatgaaattaacagggtagtttcattttctaaacattttgaaaacaacgaacttaccactacagcaaatgatctaaacattcaatctactatggatgaattagctaaactgaaatctttatcaaattctacccatttcaggcagagtattgctactcagaatttccattctttacaaaatcatatcacaaccatcgaaaaccgtctggcttctttacttactgacagacaacaagagcagcaacagttgaagcagcaagagtctgaaaaggagagctcttcaccgttttccaataagataaagttaccttccttacaggaattaactgactccatctccacccaacatcttccaacattctatgacaataaaaggcatgcttcggataccgatttaaagagtagcaccttacatggtccattatatcaccgtcacgcttttctttcaacctcttcttcctcaccctcccccacggccggttccgcgcctcttcaaaagttacaggttccaagacaagacgatccaaacgataagaaaatgaatatttcatcatctcccttcaattcaataacctacattccaaacactacgttatctccaatggtgcaaacgcagttaaagaacttaaccacttctaacctcaacacgaaaaagaagaataacagaggcagaccaagagctattcagagacaacccacgctgaccacttccagccatttcatcaataattccaatcctggtgctgctgcagtttcaacgacaactcccgccgctaatagcgatgaaaagaatcctaatgcaaaaaaaatcatcgagttttgtttccattgcggggagaccgagactccagaatggagaaagggaccatatggcacaagaactttgtgtaatgcctgtgggttattttataggaaagtcaccaagaaatttggctcaaaaagcagtaatttgttgttaagatatagaagatctattgatttagccaacgatcgtagaattcctgattttatcactattccaaacaggtttattcatgatatggataatgatcaaacgttggactctgagtataatacgatattgcaataa

SEQ ID NO: 3920 - DNA, 1683 bp, Saccharomyces cerevisiae
atggaacctaagcgaaagagcgggtcactagccaagcatgatttgccgcaattttatcttttaattatgttatatttggctcaaggcatacctgtaggattggccttcggtaccgtaccgtttctactgaaatctttagcaaaggagacctcgtttacatcactgggaattttctctatggctacatatccatattctttaaagatcatatggtcaccaatagtagactcactgtacaacaagcgcatcggtagaagaagatcatggatcattccagtacaatttgttagtggatttgtgctatgggcattagggtggtgcatatcacaaggcataatcttcgatggtgtcgacgatgcgttccataatcgcggtaatggcactttacacagtgtcagtataaaaaatttgacgtggtggtttggcctgttagtttttctgtgtgccactcaagacatcgcagttgatggttgggcgttgacgattttgtccaaagaatccctatcatatgcatctaccgcgcaaacaataggtttgaatattggttattttatgtcatttaccattttcctgtcgttgaattcctctgatttcgccaataagtatttcagaaacatcccactggatcacgggttcattagtcttggtgggtacatgaaattctcgggcatgctttacattgtaataaccatatatatcatcttttgcaccaaggaaaaaccctacgtagagtatttgcccaaagtggagcccataaatacaagtgacggagggtcaaagccgataagtattgagtatgacgacggtgatgtggtgtcaactcagaatacaagcagtataaagtacatttaccgctgctttataaaagtgttgaaattgaagtccgtaagaagcctagccttcattcacatgatttcgaaatttgcctttcaatgcaacgaagccgccacaaacctgaaactactagagcaaggcttcaaaagagaagacttggctgtgacagtactcatagacctgccgttcgaaatcatatttgggtactatgttgttaaatggagctccgacaaggaccccatgattcgtgacaatagaagattaagaaacagcacgggcaccaacaaggtcatcaagttcttagttggggatgccggcgttttaacaccatggttgtggggctttttgggccgtctggcagccgcggtcttgggaagttacgtggtgaagcaattccccaaggatggtgaaatatccacgggttatttttgtctcgtgatattccagcacctcttaggttccttcatgaatactgtccagttcattggaatatcggccttccatacaagagttgcagaccccgtgctgggtggcacatatatgacattgttaaataccctcagcaacttcggtgggacatggccgcggttaatcattatgtccatgatcaactacttcaccgtgtatcagtgcactattcctggcacaaataaagtatacgtaactcacggcggcagcatgcaagcgtgcaccgagcttttgaatggcaccgtgaccatcctgcgtgacggctattacatcaccaatctcatatgtattgtagtcggacttttcctatattttggatatttgaaaaggaaaatcctccatttacaaagtctgccaatcagttcctggagatgtacgtaa

SEQ ID NO: 3921 - DNA, 1683 bp, Saccharomyces cerevisiae
atggaatgttttgtaccgctgcgttgcgacttagatggaagtaatatagaacagttacgtcaatcacacttaagccgtaaatttattatatttgatgagcaactgaatctttggctgtggtttcaaggtaattcgcaagagaacaagagatttgtactacagaatatgataatattaataaatgaagcgcaagttaccagaacaagcactatcgatgattattttacccaagttgagaacaatgaaaatctatggaggttgaaaaacgactgctgttcgaagattcttttcaaatcaaatgttgttatgaataatggttataataatcagatcaaatttgtctttgaatataaatctgtggatgcaaatttcaataaccaggattcattacaagatccacaggcaaagtatacattagataagtactctagcgaggagattttgccaagttttgagccagtttattcctggtcttctgcagccaccaaatcatccaaaaatactaataatcatctggagaaaaataacagggcgactcatcgagttagttctaaaaatagcgaagtccacgaagcggacgtttctagaaatccgaatacatttactcttaagctccaatacccaatattctcacttttgaatatgagattgagaaacatctccttgaaatctgagcattgcatattatcatcgttagactttcaaacttctaaagcatccgaacaactgaccaaaaaatttatttatccgcaagaacacaattcttttctcaaactgaactttcaagaaatatcgtataaactaatcgacggaacctctcaaattgaactagatccaatctgtcctttgaaagtgccactcactgcattttcatacgatagcattagcgctacttttaaactggttctgttacccaaatcaactcaaccacatcgtgtgaaaatcaccttagcgtacgaactcgagctgcatcccaatctgaagttacctgtgagaacatcatgggaaacagaagtcacattgaagcgttctatgccaatttcctcgacatcttctcaatactcgagtaacaacaataataccaatcatagcgcttcttttaatggtgcggccaacaacgttaattctggtggtttggccaatctaagattaggtggggtttcctcctcaagatttagtcttggagctgcttcgactacatcattggtgaatagcaaattaagcaatgtaaaattcaagtttattaatagcaatataaaagttattaagggcgaaaagtttactatgaggcttcagatcattaactcgtcatcatcccccctggatcttgttgtgtattataacaatacaataaacccaatcccttcagctaataacgtacgtaacagcaatggtataaacaactgtggcatgaataatgggactatccccaattcgcccttgacactggaaaatcagtaccaactgcataataaatatagaaaaattgcggaggggattatactattatccaacgattacaaaattccagttgtacctccgagagaaacatacttcgcggatttacgatttattggtattatgtccggatattatggcactctctccggacttaaggtattggatttaaatacaaatgaacttatagaagttggaaatggcgcatctgtgttaatccagtaa

SEQ ID NO: 3922 - DNA, 1683 bp, Saccharomyces cerevisiae
atggtactacttaaagaacctgttcagccgctgcctcgatcatctctgttatataataatgcgagcaatagtagtagtcgtataaaagagacaagaaaagtcaaactattatataatcccttaactaagagacaaatccttaacaactttgaaattttagccactttgggtaatggacagtacggcaaagtgaaattagcaagagatctcgggacaggtgcgttggttgcaataaaaattcttaatagattcgaaaaaagaagcgggtattctcttcaattgaaagtagaaaatccaagggttaatcaagaaattgaagtaatgaaaagatgtcatcatgaaaacgttgtggaattgtatgaaattttgaatgaccctgagagcacaaaggtttatcttgtattagaatattgctcaaggggacccgttaaatggtgtccagaaaacaaaatggagataaaagcagtgggaccatcaatactcactttccaacagtcgaggaaggtagtgttggatgtagtatcgggtctggagtatttacattcccaagggataacgcatcgagatatcaaaccatcgaacctgttaatttcatcaaacggaacggtgaaaatatccgattttggcgttgctatgtcaactgccaccggaagtactaatatacaatcatcgcatgaacaacttttaaaatctagagccttagggacccctgctttttttgcacctgagctttgctccactgaaaaagagtattcctgctcatctgccatcgatatctggtcattgggggtcactatatactgcttgttgtttggaaagttgcctttcaacgccaattcaggattagaacttttcgacagtattatcaataaacccttagaatttccatcttatgaggaaatgttgaatggtgccacttcgggaatcacaatggaagaatacactgatgccaaagatttattgaagaagctgttacaaaaagatcctgacaaacggataaaactagcagacatcaaggtacatccgtttatgtgccattatggtaaaagcgatgcagcatccgtattgaccaatttggagacgtttcatgagttgaaagtttcaccgccctcttcatgcaaaagggtagaattggtcagcctaccagtgaattcatcattcgcctctttagatagcgtttatatggaaaattttgaccacaataaccttaggactggtgctgacagaaattcaacatattctccatcaatatacgacgcaaataccttatcaccctcagcatatcacaacatcggttctagagagtcatcctattcgtccttttcctctttcacatcatccaccgcttttgcatctcagatcagtattcaggatgccccagcaatcggtgatcaacaatgcttgataggtgagagtggaagttcattaagagtgaattcttgtgagtttccacaatatacaactatgtctcctgtaggagaatatccctttgagagtacggaagcaagtttgagctctactcttacgcctgtcggtaatgtacctcaacgtataaaagcccacctggtagaagggaaatctaacagcaaggatgaccttagaatagaagcagacgcatcacttgtatttgaggctagcgacgcccagcgcacgagaagaagaatgtctctttataagctttag

SEQ ID NO: 3923 - DNA, 1683 bp, Saccharomyces cerevisiae
atgtcgctgatcagcatcctgtctcccctaattacttccgagggcttagattcaagaatcaaaccttcaccaaaaaaggatgcctctactaccactaagccatcactatggaaaactactgagttcaaattctactacattgcatttctggtcgtggttcccttgatgttctatgctgggttacaagctagttcgcccgaaaatccaaactatgcaagatacgaacgtctcctatctcaaggttggttatttggcagaaaagtagacaatagtgattctcaatataggtttttcagggacaattttgcgctattgtcagttttaatgctagtccacacttctataaaacgcattgtactttattcaacaaatatcactaaattgaggtttgatctgatatttggtttgatctttttagtggccgctcatggtgtcaattcgataagaattttagcccatatgctaattttatatgccatcgcccatgtactaaagaactttagaagaatagccaccatcagcatttggatttatggtatttctacgctttttattaacgacaacttcagagcatatccatttggtaatatttgctcttttttaagcccattggaccattggtatagaggtatcattccaagatgggatgtctttttcaattttactcttttgagagtcttaagttacaacttggacttcttagagaggtgggagaatttacaaaagaagaaaagtccatcctatgaatcaaaagaagctaaatcagccattttgctcaatgaacgtgctagattaactgctgcacaccccatacaggactacagcttaatgaattatattgcatatgttacttacacgccacttttcattgccggccccattataacattcaatgattatgtttaccaatcgaaacataccttgccatcaataaatttcaaattcattttttactatgcggtgagattcgttattgctctcttatctatggagttcattttacactttctccacgttgtggcaatctcaaaaaccaaagcgtgggaaaatgacacacctttccagatttccatgattggcttatttaatttgaatattatttggctaaaactactgattccgtggaggctgtttaggctgtgggctttgctagacggaatcgatacacctgaaaatatgatcaggtgtgttgataacaattacagttcactagcattctggagagcttggcatagaagctacaataagtgggttgtccgttacatatatattcctctaggtggttcaaaaaatagagttttgacatcactagcagtcttttccttcgtagctatatggcatgacatcgaactaaagttattattatggggttggctaatagttttgttcctcttaccagaaatttttgctacccaaattttctctcattataccgacgcagtctggtacagacacgtttgcgctgtcggtgctgttttcaacatatgggttatgatgatcgctaatctttttggattctgcttgggctctgacggtactaaaaaattactaagcgatatgttctgtaccgtatctggtttcaaatttgtaattttggcaagcgttagtttattcatcgcagtacaaataatgtttgaaatcagagaagaagaaaagaggcacggaatttacctaaaatgctga

SEQ ID NO: 3924 - DNA, 1683 bp, Saccharomyces cerevisiae
atgtctcaaagaaagctacaacaggatatcgataagcttttgaagaaggtgaaggaaggtattgaagacttcgatgacatatacgaaaaatttcagtcaacagacccctccaattcttcgcatagagaaaaactggaatctgacttaaaaagagaaatcaagaagctgcaaaaacatagggatcaaataaaaacatggctcagcaaagaagatgtaaaggataagcaaagtgttctgatgactaataggaggttgattgaaaatggcatggaaagatttaagtccgtggagaagctaatgaagacaaaacagttttcaaaggaggctttaacaaatccagatataatcaaagaccctaaagaactcaaaaaaagagatcaggtcttatttattcacgattgtttagatgagctacaaaagcaattggaacagtatgaggctcaagaaaatgaagaacaaacagaaagacacgaatttcacatcgccaacctagagaatatcttgaaaaaacttcagaataatgaaatggacccagagcccgtagaagaattccaagacgatataaagtactatgtagaaaataacgatgatcccgatttcattgaatacgatacaatttatgaggacatgggttgcgaaatacaaccttcatcaagtaataatgaggctccaaaagaaggaaacaatcaaacttctttatctagcattcgctcatcaaaaaaacaagaacgttctccaaagaaaaaagctccgcagagggatgtttctatatcagacagggcgacgactccaatcgcgccaggtgtagaatcagcctcgcaatctatatcttctacgccaacacctgtgtcaactgatacgccattgcatacagtgaaagatgattcaataaaattcgataattctacccttggtacaccaactacacatgtgtctatgaaaaagaaggaatcggaaaacgactcggagcaacaactaaatttcccaccggatagaactgatgaaattcgaaaaaccatccagcacgatgtagagacgaatgcagcttttcaaaatcccttattcaacgacgaattaaaatactggttagactcgaaaaggtacttaatgcaacctcttcaagaaatgtcaccaaagatggtatcgcaattagaatcttcgctattgaattgtccagattctctagatgccgattcgccatgtctatacaccaaaccattatctttgcctcacccaacgtcaatcttttttcccaatgaaccaattcgatttgtttatccgtacgatgtacctttaaatttaacgaataatgaaaatgatactgacaataagttcggtaaagatagtaaagcaaaatctaagaaagatgatgatatctattccagaacctcactagccagaatatttatgaaatttgatcttgatactttatttttcatattctatcattaccaaggatcatatgaacagtttttagctgctagagaactttttaaaaatagaaactggctattcaacaaggtagatcgctgctggtattataaagaaatcgaaaagttaccaccaggaatgggcaaatctgaggaggaatcatggagatactttgattataaaaaaagttggttagcgagacgttgcggtaacgacttcgtatataatgaagaagatttcgaaaaactgtaa

SEQ ID NO: 3925 - DNA, 1686 bp, Saccharomyces cerevisiae
atgaacagagtaggggcagtgttcctatttgtatatgaaagaaatttttttttgtctattgttccagatcgtcacaggacggaaataagaatgtctagttcagaaaggtcagaagtcaagtttgacaagcactttaattggtggtccctattaggtatcgcgttctcattaagttgctcatgggtcggtatctcagcgtcgatggccgttggtattgccagtggagggccactgcttatcatctatgggttgataattgctgcttttttcagtctcatgtgtggtatatctctgggagattttgctgctatcctgccaaacagcagcggtggttcattttgggttcttaaaatgttggaacaagaatcagtcactttgaaaacccctgagtacgaggacccttctgacgatgatgaagaagtgttcctcgagaattattgtcaaactttcaacgtggaagtttcttctaaatttcaaaaggtttcttccatggttgtagggttgctgaactatttcggtgccatttttactaccgcaagtatctgctcatctttgtcaatgagctgtatcggtattcataagttgttgcatccggactacgagttaaagcactggcatgtttttgtgggttacgagtgtatcaatgccgttttgacacttttcaacatttattcaactccgttgccctatatctctcagtttgggctctatacgtctctattgtctttcgccatgactttcattatttgtattgtttcaagatctgacaacaccgtagacccatggcccaaagcttctaatatatttgggagctttgataatcaaacaggctggaattcgtctggaatggcgtttgttgtcggtttggtcaatccgatctgggcatttgttggcattgactctgctacgcacatgattgatgaagtgggttatagtaagtcacgtttcttagttcccaaagttattatcactaccatcattgtgggctttgtaactagttttatttattgcgttggtttgtttttctgcatcactgaccaaacggcagtcgttgagtctattttacctatcgtagaaatattttaccaggccactggtaataggaatctcagtgtcttcctgcaatgtatgtgtatcacaacaggttttgtttcaggcattgcaagtggaacctggcaaagtcgaatcctccaatcattcgggaaaagttacgcaccattttataaagagggttccttgggaaacaaatccttgaagaagctagcagtgttgacacctgggtttaagtctccattatatgcccattttttgtcacaaatatgtgtaacgataattggctgtatatttatgggatctagtaccgctttcaacgcaattatcactgcatgcatcaccctgttactaatgtcgtacgcagttccttcttttatattcctgttcgttattaaaaaggaaaaattcattcatagaatcgagagtgacgtaaattgtgtcagcaggcctaaccgtcgtcgtatgtctatgattcctcatattatatgtattctatggaccttgttctgcctggtatttttatctttcccatatacactaccggttactgcaggaaacatgaattacacctcagtagtgtatgcagtagttttctgcattatcagcatcgttgttttccctacatgcatctaa

SEQ ID NO: 3926 - DNA, 1686 bp, Saccharomyces cerevisiae
atgagtactcctgcaaactatacccgtgtgcccctgtgcgaaccagaggagctgccagacgacatacaaaaagaaaatgaatatggtacactagattctccggggcatttgtatcaagtcaagtcacgtcatgggaagccactacctgagcccgttgtcgacacccctccttattacatttctttgttaacatatctaaattatttgattctgattatattaggtcatgttcacgacttcttaggtatgaccttccaaaaaaacaaacatctggatcttttagagcatgatgggttagcaccttggttttcaaatttcgagagtttttatgtcaggagaattaaaatgagaattgatgattgcttttctagaccaactactggtgttcctggtagatttattcgttgtattgatagaatttctcataatataaatgagtattttacctactcaggcgcagtgtatccatgcatgaacttatcatcatataactatttaggcttcgcacaaagtaagggtcaatgtaccgatgccgccttggaatctgtcgataaatattctattcaatctggtggtccaagagctcaaatcggtaccacagatttgcacattaaagcagagaaattagttgctagatttatcggtaaggaggatgccctcgttttttcgatgggttatggtacaaatgcaaacttgttcaacgctttcctcgataaaaagtgtttagttatctctgacgaattgaaccacacctctattagaacaggtgttaggctttctggtgctgctgtgcgaactttcaagcatggtgatatggtgggtttagaaaagcttatcagagaacagatagtacttggtcaaccaaaaacaaatcgtccatggaagaaaattttaatttgcgcagaagggttgttttccatggaaggtactttgtgtaacttgccaaaattggttgaattgaagaagaaatataaatgttacttgtttatcgatgaagcccattctataggcgctatgggcccaactggtcgcggtgtttgtgaaatatttggcgttgatcccaaggacgtcgacattctaatgggtactttcactaagtcgtttggtgctgctggtggttacattgctgctgatcaatggattatcgatagactgaggttggatttaaccactgtgagttatagtgagtcaatgccggctcctgttttagctcaaactatttcctcattacaaaccattagtggtgaaatatgtcccggacaaggtactgaaagattgcaacgtatagcctttaattcccgttatctacgtttagctttgcaaaggttaggatttattgtctacggtgtggctgactcaccagttattcccttactactgtattgtccctcaaagatgcccgcattttcgagaatgatgttacaaagacggattgctgttgttgttgttgcttatcctgctactccgctgatcgaatcaagagtaagattctgtatgtctgcatctttaacaaaggaagatatcgattatttactgcgtcatgttagtgaagttggtgacaaattgaatttgaaatcaaattccggcaaatccagttacgacggtaaacgtcaaagatgggacatcgaggaagttatcaggagaacacctgaagattgtaaggacgacaagtattttgttaattga

SEQ ID NO: 3927 - DNA, 1686 bp, Saccharomyces cerevisiae
atgggcattttggactcgctgaaaaaacctgttaatatcaagagttcgctccccaaattctcccgcagtgctaccagcatcaatttaagtagccacccagtaagttcacggtccttcctcgaattaccaccagagcttttcagcatcactaaacctatatttaagcttctgcaagcacacgcaaataagatttacttccaatcttccgacgctgaggctgtatggaatgttaaggattcttctggacatgtttttgaagcagagtcaatttctttgctcggctctcatataattatcacaaattcctctgtacaagtcgcagacgtggccatcatagattccccttccaacataaaccaatgtgaaatttcaagcgttggagagttcctgcaattcaataatggccaactatctatcacatgtaacgattttggtttactggagaagttcaaaaggttgtgtatgatttctatttttgagttcatttctatatataaggccttgacaggcacagtgatttcctcttatgggctgagaatgtctgatatgcatatcattttgaactcgccgttcaattttaaggattggtgtgaagtttatcttgatggtcaaggttgggtgaaagtgtggtgtcatattgataaagtgtctaaaaccaataattctaaaagtagtagtgacaatgatgctaaaggaaagtatcaaatacggttttatagagatgacaaatccacatctagcaagaactgcgttttttttattcctgacaatgagtacgttcaagatattttcttttataacatcaatgcggcagaaccttctaaaaatatgaacgacttttttcaagggttgcaaatgataaagctcgttggtaatgtacgcttttgcagtgatacggactttaatgatgtggtggatagtggatccatctatagtagtgcaaacaacggcagtggtgacagcagctcgacagcattgaataatgaaagtcctaacactacaccaaaaagtagaactttcttttcacctaaagggcacagaagaaatagctcccatgtaagttcgttaacttctagatcaacaaaaaagcctataactaacttcactacacgtacaaatgggcttttgattaggccattgccccatcatggcgtacatcacctggaagcaatgatcaggttcattattcctttgatggattgtgcaagactttatgggcgtccagttcaattcaagacagaaagaaccgatataaattcgttaatgtttggattacctaaattgccctcagtggattattttgctgaagaggagattgcccatttgatgacccaggaatttaatcctttgaaagaaaaagatactgacgatactatggctttaactatgtcaagattttctagctacctgcaagaaagaatgacaaaagtctccaagagaaacacagaactcaacttcaggacctttagtgatgtaatgggcatgtataatactacgagggatcactctaaacttaattgcatgagtgacaaggataattctgtgaaggaattttcattgagtgataaaagcaatgttagttctgaaacgactaatatgatgaatcaattgcaagtaaacgcccatgaatacaaaagttctatgtgcgaacgtcctatcgtcgcaagtacttcgcccattgcatag

SEQ ID NO: 3928 - DNA, 1686 bp, Saccharomyces cerevisiae
atgtcgctttttttcaagccagtaatttcaccacagtggtctttccccgtgcttctcaagataggagtgcgttcttatgcgggaggcccaagaacaaagcataaaggaaactctccattagcttcagtgcctacaggcagtagtaataaaaaccgaaaacagaaggccaaaggcaaaaaaggtaacaaaaagaatgaccctgaccaagcattcaactttggagagtatggtggattgaaaaaagacgtcgagatgaatatggacagtacgaataaactcattcaaaaaatatcgaatttcgaccaattgcttatacttccacctgtcagagacgctgtgaaagaaatcatttccaaagagtccctgaagctacaagatagtaggaaaaaaaccagtgaaaatataataccgagtcccattcaaacagtggccattaagagaatatccaaaaatttaatggatccaaagttacaaatacatgcgattgccgctgagacaggttcaggtaagaccatggcctacttgatacctttaatagactatttgaaaagacaggagttggaaactcccgaattatgggaaacattaagaaaaaacgttctgattcggtccatcatactggtgcctacgcatgaattggttgaccaagtatacgaaactgtttccaagacgaaaaccttgttaggcttaaactctttcaagtgggacaaggccacatcatatcgtgatttattagagaacattaaaaatagaatagatattttagtcactactccgggaaaactactgaacctgttctccataagaatgataactagacctgataaagtcttgtccaaagtgggtttcgtagtactagatgaagctgacacacttctagataggtcatggcttgaagaaacgcactccgcaataaagagaattcctaacattaatcaccttattttctgttccgctactattcctcaagagtttaataaaacaatgcaaagactatttcctacagtggttcctataatgacacccagactgcataagttaccattcgctttggactttaaagttataaattctgccttaagtcctttcaagggatccaagatcaaagcattggcacaaactttatatgctatttcaaatgatgacacggaaccagggttcgagaaaagatgcattatctttgttaacgaaaaaaagaatgttcctgaaattgttaacctattgaataagaaattcggtcataatgccatcggtttaactggtgaagatacatttgaagaaagatccgagaaaattatgccctttttatcaccaccgcgaccactttcggaggtggttgctcagagtacttcacctcccacttccttgaagaaatttgaaattcctgattccaacatcgtcatcggcaaattgaaaaacacaaattctaatggtaccgcacccagtaacaagtctttgcatgtactcgtaaccaccgacctcatggcaagagggctcaatttcaaaggtgtacggaatgttgttctctacgatgtacccaaaacgtcaatagacctgatacaccgagtgggcagaactgctagaatgaaacagggcggccgcgtatttatgctaactgacagtaaaacaaaatcttgggctaaagctcttccaaagatcatcaaaaagcaccagagattatcatga

SEQ ID NO: 3929 - DNA, 1689 bp, Saccharomyces cerevisiae
atgaacgtgttcggtaaaaaagaagaaaagcaagaaaaagtttactctctacaaaacggttttccgtactctcatcacccatacgcttctcaatactcaagaccagacggccctatcttactgcaagacttccatctgctggaaaatattgcaagtttcgatagagaaagagttccggagcgtgtagtccatgccaaaggtggtggttgtagactggagttcgaactaacagattctttgagtgatattacatacgccgctccataccagaatgtgggttacaaatgtcctggtcttgttcgtttttccaccgttggtggtgaaagtggtacaccagacactgcaagagacccaagaggtgtttcttttaaattctataccgagtgggggaaccatgactgggtcttcaacaatactcccgtcttcttcctcagagacgctattaagtttcccgtatttattcattcgcaaaagagagaccctcagtctcatctgaatcagtttcaggacactaccatatactgggattatctaacattgaatccggaatcaatccatcaaataacttacatgtttggtgatagaggtactcctgcttcgtgggctagtatgaacgcgtactctggtcattccttcatcatggtcaacaaagaaggtaaggacacatatgtgcaattccacgtcttgtcggatactggttttgaaaccttgactggagataaggctgctgaactgtcaggctcccaccctgattataatcaggcaaagctgttcactcaattgcaaaatggcgaaaagccaaaatttaactgttatgtgcaaacaatgacacccgaacaagcaactaagttcaggtattcggtaaatgacctaacgaaaatatggccacacaaggaattccctttgagaaaatttggtaccatcaccctaacggagaatgttgacaattatttccaagaaattgaacaagttgcattcagtccaacgaacacttgtatcccaggtattaagccttctaatgattccgttctacaagccagacttttctcctatccagacactcaacgtcatagattgggagccaactatcagcaattgcccgtcaacagaccaagaaacttgggatgtccatactccaaaggtgattcccaatacactgccgaacagtgtccatttaaagcagtgaacttccaaagggacggcccaatgagttactacaatttcggtcctgagccaaattatatttccagtttaccaaatcaaactctgaaattcaaaaatgaagacaacgacgaagtatctgataagttcaaagggatagttcttgacgaagtaacagaagtttctgtgagaaaacaggaacaagaccaaatcagaaacgagcatattgttgatgccaaaattaatcaatattactacgtttatggtattagtccactagacttcgaacagccaagagctctatatgaaaaggtatacaacgatgaacagaagaaattattcgttcataacgttgtttgccacgcttgtaagatcaaagatcctaaagtcaaaaagagagttacgcaatactttggtttgctaaacgaagatttgggtaaagtcattgcagaatgcttgggagttccttgggaacctgttgaccttgaaggttatgccaagacttggtccattgcaagtgccaattaa

SEQ ID NO: 3930 - DNA, 1689 bp, Saccharomyces cerevisiae
atgaccatcccacatatgaaatacgccgtatcaaagactagcgaaaataaggtttcaaatacagtaagccccacacaagataaagacgcgatcagaaaacaacccgatgacattataaataatgatgaaccttcacataagaagataaaagtagcacagccggattccttgagggaaaccaacacaacagatccacttgggcacactaaagctgcgctcggagaagtggcatcgatggagctcaaaccaactaatgacatggatcccttggcagtgtcagcagcttcagtagtgtcaatgtccaatgacgttttgaaaccagagacgcccaaggggccaatcataatcagtaaaaacccatcaaatggtattttctatggtccctccttcactaaacgagagtctctcaatgctcgaatgtttctgaaatactatggtgcacacaaatttttagacacttacctccccgaggatttgaactcgttatacatttactatcttatcaagttgctaggctttgaagttaaagatcaagcgcttatcggcaccatcaacagtattgtccatatcaactcgcaagagcgtgttcaagatttgggaagtgcaatatctgtcacaaatgttgaagacccattggcaaaaaagcaaacagttcgtctaatcaaagatttgcaaagagcaattaacaaagttctatgtacaagattaagattatccaattttttcactattgatcattttattcaaaaattacataccgctagaaaaattttggtcctgactggtgcaggtgtttcaacttcattagggatcccggacttcagatcttctgaggggttctattcaaagatcaaacatttggggctcgatgatccccaagacgttttcaattacaatatatttatgcacgacccctctgttttctataatattgccaatatggttttacctccagaaaaaatttattctccattgcatagtttcattaagatgctacaaatgaaagggaaattattgagaaattatactcaaaacattgataatttggaatcttatgcgggaataagcacagataaactggtgcagtgccatggctcttttgctactgccacctgcgttacctgccattggaacctacccggtgagaggatatttaataaaattagaaacctcgaacttccactatgcccgtactgttacaaaaaaagaagagaatatttcccagagggatataataataaagtaggtgttgctgcatcacagggttcaatgtcggaaaggcctccatatatccttaactcatatggcgttctcaaaccagatatcacattctttggcgaagcactgccaaataaatttcataagagcattcgcgaagatatcttagaatgtgatttgttgatttgcattgggacaagtttaaaagtagcgccagtgtctgaaatcgtaaacatggttccttcccacgttccccaagtcctgattaatcgtgatcccgtcaagcacgcagaatttgatttatctcttttggggtactgtgatgacattgcagctatggtagcccaaaaatgtggctggacgattccgcataagaaatggaacgatttgaagaacaagaactttaaatgccaagagaaggataagggcgtgtatgtcgttacatcagatgaacatcccaaaaccctctaa

SEQ ID NO: 3931 - DNA, 1689 bp, Saccharomyces cerevisiae
atgactgccgtcgcctctactagcgggaagcaagatgctgaccataaccagtctatagagtgtccaaggttttcgcgtggacagaaagagattttgttggaccatgaggatgcgaaggggaaggattcaataatcaactcccccgtgtcagggaggcaatcaataagccctactttgtcgaatgctactaccacgactacgaaatctattatgaatgccaccggcacctccggcgcagtagtaagtaatactccggagcctggtttgaagagagtccccgccgtcactttcagtgatctaaagcaacagcaaaagcaggatagtctgactcagctgaagaacgactcagaaaggaccaagtctccaaatagtaatcctgctcctgtctcaaattccattcctggcaatcatgcagttataccgaaccacaccaacacttcaagaacaacgcaattatctgggtctccactcgtcaacgaaatgaaagattatgatcctaagaaaaaagacagtgctcttaaaatagttgataccatgaagcctgacaaaatcatggccacttcaacgccaataagtagagaaaataataaggtaaccgccaaagcccccaccagtattacacttcgaaaggaagatgcacaagatcaagctaacaatgtttcaggccaaattaatgtgcgttctaccccggaagaaacgccagtgaagcagtccgtcattccttccatcatccccaaaagagagaactccaagaatttggatcccagactacctcaagatgatggaaaattgcacgtgttgtttggcgctacaggttcgttatcggtatttaagatcaagccaatgattaaaaaactagaagaaatatatggacgtgatagaataagcattcaagttatcctcactcaatcagcaacacagtttttcgaacaaagatataccaagaaaattatcaaatcttcagaaaaactaaataaaatgtcgcagtacgaatccactccggcaactccagtgacaccaacaccaggacaatgcaacatggctcaagtagtcgagttacccccacatattcaactatggaccgaccaagatgaatgggacgcatggaaacaacgaactgatcctgtacttcatatagaactacgtcgctgggcggatatactggtagtagctccattaactgcaaacacattatcaaaaattgctttgggcctgtgcgacaatcttctgacaagtgtcattagagcttggaatccgagttatcccattcttttggcaccttctatggtgagtagcacttttaattctatgatgacaaagaagcaactacaaacgataaaggaggaaatgtcctgggtcactgttttcaagccgtctgagaaagttatggatataaatggtgatattggtctcgggggtatgatggactggaatgagattgttaacaaaatcgttatgaaattgggtgggtacccaaaaaataacgaggaagaggacgatgatgaggatgaggaagaagacgacgacgaagaagaagatacagaagataagaacgaaaacaacaacgatgatgatgacgatgacgacgatgacgacgacgacgacgacgacgacgacgacgacgacgacgatgatgacgaggacgaggacgaagcagaaaccccaggtataatagataagcatcaataa

SEQ ID NO: 3932 - DNA, 1689 bp, Saccharomyces cerevisiae
atgcaaacactagacgagacttcaaatctactccctccacctgaggaagctgaagcccctcccttggaacaaaaatttcatgaatataatttggccttacctaagtttcccattttgttttcgctatggttgggtagttttttgagttccttggatagcactattgtcgcaaatataatgaatagagttgctgaggaattctctgaatcaagtaaaaagcaatggattgcgacgagttttcttttgacaaatacggctttccaaccactatatgggaagctttctgatataacagggcggaagtcagcattattaaccgctcaatttttttttggccttgggtgcttattaacatgttttgccagaaacgtcacggaattctcaatagcaagagccatatgtggtattggtgcaggaggattgaatgctattagtagcattgctgttagtgacatatgtacagcaagagaaaggggcgtttaccagggatatgcgaatattgttttcgggtttggtcaattactaggtgctccgttgggtggtgtatttatagaaaccattggatggagggctctttttggtatccaagtacccgtgataatgttgtgctcggtattagcaatcaaaaacattaatattaagctattccatgttcctcctatgaaagaaagatataccttaaagaatctgtcacggatagatatatttggctcattaagcctggtggcgaccattagtggagttttatttttgtgctctagccagttgaacaagttgtatttagcattgtttaccattggtagctttattgtttttatcctggttgaacgttattacgcgactgagaaaattttaccattcgaactattgactcgctcattctgtttgagctcagcggtaacggttatatcttcatttgttgtatttggtgaaatctttaggtcaccaatctatttacaattgcttcaaaatattagtgtaacaaagactggcctctttttgattttcccctctatatcagttgcagtcggatcattggtaacaggatgggtattgcggaatacgaaaattaacctagcacactgtgcatatcaaatcatttttggtggtatgataatgcagctattgggtttgggattgggctatttcctactttcacacttgaatcctgactacaccatatatgatatgcttgagtctattacattcagatctaactcaatatggtggaaattgatatatgtgtttgcatcagtccttgtgtcctttggttacgcttgtctattagtggccacgttagtaagcatcgtattcaccgtcgaaaaatcacagcaaggaaccatgactggtgttttctatttgtggagatccattggtaacgttcttggtgcctctttaactttagtgtcctatgagaatagcctgtcgtccatgttatggaattatatgttcaaaaccaagcgtgatgacgaatatcacttcaccaaaaagcagtactactcccttatcaatgattcgagttacttgagagggcccaattttccaacggatatatttgttcgcattcttgatgtctacaaaaaggcattcctgatttcctatattccaaatatagccctggcagcagtgggaattgttttatcgttatatctggtgaaacatacttacaaacgtagttcaagttcttga

SEQ ID NO: 3933 - DNA, 1689 bp, Saccharomyces cerevisiae
atgcctttgaagtcgttttttttttcagcatttctagttttatgcctgtctaaattcacgcaaggcgttggcaccacagagaaggaagaatcgttatcgcctttggaactaaatattttacaaaacaaattcgcctcctactatgcaaacgacactatcaccgtgaaaggtattactattggcggctggctagtaacagaaccttatatcacgccatcattatatcgtaatgctacgtcactggcaaaacagcaaaactcttccagcaatatctccattgtcgacgaatttactctttgtaaaaccttaggatataacacctctctaactttattggataatcacttcaaaacttggattacagaggatgattttgaacaaatcaaaaccaacggtttcaatttagttaggatccccatcggatattgggcgtggaaacaaaatactgataaaaacttgtacatcgataacataactttcaatgatccatacgtaagtgatggattacaactgaaatatttaaataatgctctcgaatgggcgcaaaagtacgaactaaatgtatggttagatctacatggtgctcctggatcccagaatggattcgataattccggtgaaagaatactctatggcgatttaggctggttaaggttgaataatactaaagaactgactctggctatttggagagatatgttccagacatttttaaataaaggtgacaaaagtcctgtggtgggtattcaaatcgtcaacgaaccgcttggtggcaaaatcgatgtttcagacataacggagatgtattacgaagcatttgacttgctcaagaaaaatcagaattcgagtgacaacactacgtttgttattcatgacggttttcaaggaatcggtcactggaacttggagctaaacccaacctaccagaatgtatcgcatcattatttcaatttgactggtgcaaattacagctctcaagatatattggtcgaccatcatcattatgaagtgtttactgatgcgcaattggccgaaactcagtttgcacgtattgaaaacattatcaattatggggactctatccacaaagaactttcttttcacccagcagtagtcggagaatggtcaggcgctattactgattgtgcaacctggctaaatggtgttggggtgggtgcacgttacgatggatcatactacaatacaacgttgtttaccaccaacgacaagccagttggaacatgtatatcccaaaatagcttagctgattggacgcaagattaccgtgaccgtgtgagacaattcattgaggcacagctagccacttattcgtcaaaaacaacgggatggattttttggaattggaagaccgaagacgccgtagaatgggattatttgaagctaaaagaagctaaccttttcccttcccctttcgacaactacacgtacttcaaagcagatggatctatcgaagaaaaattctcatcctctttatcagcacaggcatttccaagaacaacgtcatcggttttgtcctccactacgacttccaggaagagtaagaatgctgcaatttctaataaactaacaacttcgcagctattaccaatcaaaaatatgagtttgacctggaaagcgagcgtatgcgcactcgctatcaccattgccgctctttgcgcttctctttaa

SEQ ID NO: 3934 - DNA, 1689 bp, Saccharomyces cerevisiae
atggattcgcaagtgcccaataataacgaaagcttaaaccgcttcaatgacatcatccaaagcctgcctgcaagaactaggttgaccatatgctcattatgtctgctggacaatatctccactcaactactgaggtttcttatccttaatgccaactctcccaatattatagcggttttgacggaccagacggctttcctaagctcaggcgaaacagaaatttttcaaacgttagtcaagctctttaagcagatcagaatgatttaccacaccagatctccgttactgtctgttcacgacgtggcgcctggtttatggtttcccaactcccctcccccccttatattgagaggccacgaagcgtttattattactgccataagaaaggcgaatctgctaacatttctattgacgtcgctgaactgccttaattacgggtttgagctgctacagtcgatatttctcgatattttctgtccaaatacaaacactgtcggtaacaactccctggaacaaagcggaaagtttttgaaatcgcaggctatcctatatcttgatctgaaaacacaggcttacattgccggcttgaaagagtttcaggacgagacgaacgaaatttctttagaaaagaaacaagagctactagacttaatcttcccatccaatctggctgatattctcgtgcagagaagaaccggcgattctggagacattacacttttgactccatcggagaaggacttcgtcgaaaggtgcgatcgtcggagagaaaatttaaagatcgtccaagattttaactctctgacccagagctacgaatgggctcaatttatcagagagttgctggattattgtaataaaaatatgggtctcatcatatggggcagaaagggtcgcggaaaatcaccattatatgactttgatgtcaacgagtttgatcctcaagtactcttttctacagggaccaggaccgtagaattcatggacgaccaaaatcagccaagcagtgcgtctgcttttttgtcaactgctcgtccgaatcattacagcacacatacacctaccacagatgtgtcttccaaaaaccccgctatcacacaatccattgtggatgccgctgttgcggcctcgatgagcaacagcagctctggtcctcattcctctcataacaacagcagtaacagcaacaataatggtagtatcggattaagaaaaccaaaggcgaaaagaacttggtccaaagaggaagaagaagcattagtggaaggcctgaaagaggttggcccatcgtggtctaagattctagatttatatggtcccggtggtaaaatcacggaaaatttgaagaacaggacgcaggtacaactgaaagataaagcccgtaattggaaattacaatacttgaagagtggcaaaccattgcctgactatttgataaaagtgaccggtaacttggagaaaatctacaaggcaaagaaaaaattctctcaatctccaaattcgtcaactattatggaacaaaatttatctcagcatccttcatcagctgcatctgctactgaagacactcaaactcatcaagaggattcacatgggcaaaatagtgataatatgccatctaacggactttttggcaatagtacatcggacaatacaggttttgatcctcatttagaagatgggatgtag

SEQ ID NO: 3935 - DNA, 1689 bp, Saccharomyces cerevisiae
atggctgctcgtccacaacaacctcctatggaaatgccggatctgtcgaacgccattgtggcacaagacgagatgggtagaccctttattatcgtgaaggatcaaggtaacaagaagagacagcacggattagaggccaagaaatcacatatattggctgctagatcagtagcttctattatcaaaacttcgttgggtccccgtgggttagataagatcttgatttcacctgacggtgaaatcaccatcactaacgatggtgctacaattttgtcccaaatggagctagataatgagattgcaaagttgttagtacaactttccaaatctcaagatgatgaaattggtgatggtactactggtgttgttgttctggcaagtgcgctacttgaccaagcattggagttaattcaaaagggtatacatccaatcaaaatcgctaatggatttgatgaagccgccaaattagccatttccaagttagaagaaacatgtgacgacatttctgcgtcaaacgatgaattgttcagggactttttattgagggccgccaaaacttctttgggctccaaaattgtttccaaggatcatgatagatttgctgaaatggctgtggaagccgtcataaatgtcatggacaaagatcgtaaagacgtggatttcgatttaatcaaaatgcaaggacgggttggcggatctataagcgattcaaaattgattaatggtgtcattttggataaagatttttctcatccacaaatgcctaaatgtgttttaccaaaagagggctctgatggtgttaagttagctatattaacgtgtccatttgaacctcctaaaccaaagaccaagcataaattagacatttcttcagtagaagaataccaaaaattacagacttatgaacaagataagttcaaagaaatgatagacgatgtgaagaaagcgggcgcagatgttgttatatgccaatgggggtttgacgatgaggccaatcatctacttctacagaatgatttacctgccgtaagatgggtaggtggccaagaactagaacacattgccatttccacaaacggtcgcattgttccaagatttcaagacttgtctaaggataaattaggtacatgttccagaatttacgagcaggagtttggtactactaaggatcgtatgctgattatcgagcaaagtaaagaaacaaaaactgtaacatgttttgttcgcggttccaataaaatgatcgtggatgaagctgaacgtgcattgcatgactcactatgtgtggtacgtaacttggttaaagactcacgtgtagtttacggtgggggagcagccgaagtgactatgtccctggctgtctctgaggaagctgataagcaacgtggtattgatcagtatgcattccgtggattcgcccaagcgttagacaccattccaatgactttggctgaaaattctggtcttgatccaatcggaactttgtctacattgaaaagtaaacaactgaaagaaaagatttccaacattggtgtcgattgcttaggttacgggtctaatgacatgaaggaactatttgtcgttgatccatttattggcaaaaagcagcaaattcttttagctactcaattatgtagaatgattttaaagattgataacgtcatcattagtggtaaagatgagtattga

SEQ ID NO: 3936 - DNA, 1689 bp, Saccharomyces cerevisiae
atgtcactcctttacatcattcttctattcacacaattcttactactgccaaccgatgcctttgataggtctgctaacacaaatattgctgtttattggggtcaaaactcagcaggaacgcaagaatccttagctacttactgtgaatcttctgatgctgatattttcctattatctttcttgaaccaatttccaacccttggtttgaactttgccaacgcatgctctgatactttttctgatggcttacttcactgcacccagattgctgaagatattgaaacttgccagtccctaggaaagaaagttctattatcattaggtggtgcatctggtagctacctcttttcagatgattctcaagcggaaacttttgcacaaactttatgggatactttcggtgaaggtacaggtgccagtgagagaccatttgactcagcagtcgttgatggttttgattttgatattgaaaacaacaacgaagtaggctatagtgcgttagctaccaagttaagaactttgtttgccgaaggtacaaagcaatattacctttctgccgcaccacaatgtccatacccggatgcttctgttggtgacttgttggaaaatgcagacattgattttgcgttcatccaattttacaataattactgcagtgtgagtggtcaattcaattgggatacttggttaacctatgctcaaactgtatccccaaataaaaatatcaaactgttcttaggtttacctggttctgcttctgctgctggctctggttatatttctgacacttctttattggaatcaactattgcagatattgcctcttcaagttcttttggtggtattgcgttatgggatgcatctcaagccttttccaacgagctaaatggtgaaccatatgttgagattttgaagaatttgctaacaagtgctagccagaccgccactactacagttgccacctcaaaaacctcagcagcctcaacttcatctgcttcaacttcatctgcttcaacttctcagaaaaagaccacacaatctacgacatctacacaaagtaaaagcaaagttactttatctccaactgcaagcagcgctatcaaaacatcaattactcaaactacaaaaacattgacgagtagcaccaagacaaaatctagtctaggtaccaccacaacagagagcactttaaattcagttgctatcacaagtatgaaaactactctatcttcccaaataaccagtgctgccttggtgacccctcaaacaactactactagcatagtttcttcggccccaattcaaacagctatcactagtactctttcgccagcaacgaagagttcttctgtcgtttccctacagacagctactactagtacgctttccccaacaacgaccagtacaagctcaggtagtacaagctcaggtagtacaagctcagacagtacagctcgtacattggctaaagaattgaatgctcaatatgcggctggtaaattgaacggtaaatctacctgtactgaaggtgaaattgcatgctctgctgatgggaagttcgccgtttgtgatcatagcgcttgggtttacatggaatgtgcttctggaaccacatgttatgcttatgactccggcgactcagtctatacccaatgtaatttctcttatttggaaagcaattacttttaa

SEQ ID NO: 3937 - DNA, 1692 bp, Saccharomyces cerevisiae
atgaccaaacaacaaacttctgtaatgcgtaacgcatctatagccaaggaagaacgtgaaggatctgataataataatgtggacagatccagctcagatgccatcagtgacaacgacgcagaaagatctaattctcattctgaaatagataacgaatcaaattttgatatggtgccttattcaaggttcagccataagcaaaaaatgcttcttgtcgttcagtgtgccttcacaggctttttttcaaccgtggcagggtctatctactatccagtgcttactattattgagaggaaatttaacatcacagaagagttagctaatgtcactattgtggtttattttattttccaaggggtggctccttcaattatgggtggtttagctgatacatttggaaggcggcctattgtattatgggcaatcttagcctacttctgtgcctgcatcggactggcatgtgcacataattacgcccaaatcctggctttaaggtgtttacaggcagcaggtatttctcctgttattgcaataaatagcggaataatgggagatgtaacgacaaaagtagagaggggtggatatgttggattggttgcagggttccaagttgttggaactgcattcggtgcattgattggtgccggattatcctcgaaatggggttggagggcaattttttggtttttggctattggttccggaatttgtctagttttttcaaccttattgatgccagagacaaaaagaactttggtgggaaacggctccgtaacaccaaggtcatttttgaataggtctttgatattgcatgttggttccgtaaaaaaaacattacatttagacgatcctgaccctgagaccttagaaccacgtactagcgtggattttttagcacctttaaaaattttgcacatacgagaaatagacattttattgtccattgccggcctgcaattttccacgtggaccactcatcaaacagccttaacaattgtattgagtaaaaagtacaatctatctgttgcaaaaataggcctgtgctttttacctgcaggaatctcgacactgacaagtattatctctgctggtcggtacttaaattggagctacagaacaagaaaggttaaatacaacagatggattaaagaacaagaattacagctgatggagaaatataaaggtgataaaaacaaggtagcagaacttattcactctaattctcattatgcattcaatttagtggaggcaaggttgcatccagcatttgtgacacttcttctcagtagcattggctttactgcctttggatggtgtatttcggtgaaaacaccgcttgctgctgtattatgcacaagtgcatttgcaagtttattttcaaactgtattttgaccttctctactactttgatagtagatctctttccgtctaaggcttctaccgcaacaggttgcttaaatttatttagatgtctcctatccgcaattttcattgcagcactgaccaagatggtcgagaagatgagatatggaggtgtttttacgtttttgagtgctataacttcatcttcatcgcttttattattctatctcctgaagaatgggaaacaactatcgttcgataggattagggcaaatgataagtcggctggaaggtcagttggtaaaaattcagaaaaagtttcgacgtga

SEQ ID NO: 3938 - DNA, 1692 bp, Saccharomyces cerevisiae
atgagattaagaaccgccattgccacactgtgcctcacggcttttacatctgcaacttcaaacaatagctacatcgccaccgaccaaacacaaaatgcctttaatgacactcacttttgtaaggtcgacaggaatgatcacgttagtcccagttgtaacgtaacattcaatgaattaaatgccataaatgaaaacattagagatgatctttcggcgttattaaaatctgatttcttcaaatactttcggctggatttatacaagcaatgttcattttgggacgccaacgatggtctgtgcttaaaccgcgcttgctctgttgatgtcgtagaggactgggatacactgcctgagtactggcagcctgagatcttgggtagtttcaataatgatacaatgaaggaagcggatgatagcgatgacgaatgtaagttcttagatcaactatgtcaaaccagtaaaaaacctgtagatatcgaagacaccatcaactactgtgatgtaaatgactttaacggtaaaaacgccgttctgattgatttaacagcaaatccggaacgatttacaggttatggtggtaagcaagctggtcaaatttggtctactatctaccaagacaactgttttacaattggcgaaactggtgaatcattggccaaagatgcattttatagacttgtatccggtttccatgcctctatcggtactcacttatcaaaggaatatttgaacacgaaaactggtaaatgggagcccaatctggatttgtttatggcaagaatcgggaactttcctgatagagtgacaaacatgtatttcaattatgctgttgtagctaaggctctctggaaaattcaaccatatttaccagaattttcattctgtgatctagtcaataaagaaatcaaaaacaaaatggataacgttatttcccagctggacacaaaaatttttaacgaagacttagtttttgccaacgacctaagtttgactttgaaggacgaattcagatctcgcttcaagaatgtcacgaagattatggattgtgtgcaatgtgatagatgtagattgtggggcaaaattcaaactaccggttacgcaactgccttgaaaattttgtttgaaatcaacgacgctgatgaattcaccaaacaacatattgttggtaagttaaccaaatatgagttgattgcactattacagactttcggtagattatctgaatctattgaatctgttaacatgttcgaaaaaatgtacgggaaaaggttaaacggttctgaaaacaggttaagctcattcttccaaaataacttcttcaacattttgaaggaggcaggcaaatcgattcgttacaccatagagaacatcaattccactaaagaaggaaagaaaaagactaacaattctcaatcacatgtatttgatgatttaaaaatgcccaaagcagaaatagttccaaggccctctaacggtacagtaaataaatggaagaaagcttggaatactgaagttaacaacgttttagaagcattcagatttatttatagaagctatttggatttacccaggaacatctgggaattatctttgatgaaggtatacaaattttggaataaattcatcggtgttgctgattacgttagtgaggagacacgagagcctatttcctataagctagatatacaataa

SEQ ID NO: 3939 - DNA, 1692 bp, Saccharomyces cerevisiae
atgagtattcggaatgataatgcttccggtggctatatgcagccggatcaatcttcgaacgcttctatgcacaaaagagacttaagagttgaggaggaaataaagccattggatgatatggatagcaagggtgctgtagcagcagatggtgaagttcatctaagaaagtcattttcgttgtggtcaattcttggtgttggattcggtttgactaattcctggttcggtatttctacatcgatggttgcaggtatatcttctggtggacccatgatgattgtttacggtataattattgttgccctgatttctatttgcattggtacctcgttgggtgaattatcttccgcatatccgcacgccggtggtcagttttggtggtctttgaagcttgcccctcctaagtacaaaagatttgcggcctacatgtgcggttcatttgcttacgcaggatccgtgttcacaagtgcttcaactacgttatccgttgctaccgaagtggttggtatgtacgctctgacgcaccctgaattcatcccaaagagatggcatatattcgtttgctttgaattgttgcatttgttcttgatgtttttcaactgttacggtaaatccttacctatcatttcatcttcctctctatacatttccctactatcctttttcacaattacaattactgtattggcatgttctcatggaaagttcaacgatgcaaagtttgtttttgccacatttaataatgaaacaggttggaagaacggcggtatcgcctttattgtcggtttgattaacccagcttggtcattttcgtgccttgactgtgcaacccatatggcgtttgaagttgaaaaaccagaaagagttattcccattgctatcatgggaacagtcgccattgggtttgtcacttccttttgttatgttatcgctatgttcttctctatacaagatctggacgctgtcttgtcttctacaacaggcgccccaatcttggacatttataatcaggcattgggtaataaatcaggtgcgattttcctgggttgcttgattctatttacctcttttggttgcgtcattgcttgtcacacttggcaggcaaggttatgttggtcatttgccagggacaatggtcttccattatcccgtttatggtcgcaagttaacccacacactggtgtacctttgaacgctcatttaatgtcatgcgcttggataaccctcattggcctactttatttggcttccagtacggcttttcagtccttaattacaggttgtattgcatttttattgttatcctacatcattccggttatatgtttacttgctaaaaagcgtaacatagctcatggtccattctggcttggaaaatttggatttttttcaaacattgttcttttgggttggactgtcttttctgtggtctttttttcctttccaccagttttacctgtgacaaaggataacatgaactatgtttgtgtagttattgttggttatactgcgtattcgattctttactggaaatacaagggtaagaaggaattccacgctttagaagaatctgagaacgaacaggctgaatatagtaataacttcgataccattgaagatagtcgagaattttccgttgcggcctctgacgttgaactcgaaaatgaacacgtaccgtggggaaagaagtga

SEQ ID NO: 3940 - DNA, 1692 bp, Saccharomyces cerevisiae
atgcctatgaacaattttctagatgaattcaatttatttgattcaatcattaccatgatgaagaacgacccatgttgcgtcgaggattatgagccaatcgtcgaaaacctgaaccgtatatttcaaaggacgtttaatgatgaagaacataggaaatcaatggctaactcccagcttttttgggaacgattaagagacaccttggaagcaatgctgttgccagcgtcgttaaatgagaatagctcaataccgtatacaagaacagtgaggggccttatcttaatgatgagaaaccttgccgctgaaaaccaggaaataccccaaaagcttttactacaaaacctcgtaattcgtggttttctgcatgcaactagtgagtatgtcgttgacactccgctaatcaaacatctatacatcgcatgtttaacgtgccttttcaatatacagcagaactactctacagtggatatgactacttttccagctcttttacaatttcttcaatacccttatgggatcaaattggaagacggtgaagaagaagagcatttctggctaccatatttatttcttttcaagacgtatctcaacaatgatgaattttccaacgaatttttcagggataatgatacaccccagaaagactattattgtgttagggatagaatatttttcgatatagtgacagccaaattcatccaggatcaagagaattcctttttaattgagaagggcagaaactatctggatgattcaaaattggaaataacttctattgacctatctgtcttagaatgtattagcaaaagtcttacaactgcttcttttggtaaatacctcaatgggttagaagaaagacagccaggaaaattcaccactttgttgcagatattgcaattggttgtaacgagtaaagaagattggaatacctatgagttgactgcaattatgtcatggtgctaccccattctgcaacgtcttgcatgcaaggatattcctgcctttttcaataaaagttgtaacgattatgctccttcagttgccatccaattacactccactttactttcttgcctggacataatttctgacttgtgcaaattcaatcatgttagaaaattcttaatttcgtatgactctgtgaaaatattggtatctctcttggatactttccaaaagaatttgttgaggattaattttttgaaaggaaacggtgatacggtgaatgaaattaaaatcacagatcatgaaggtaacaaaatcgaggaccggttattaattttcaaccgtgttaataccaacgaatcctttattagggctgataattttccccattgtaaattagtaataatcgaaatattggcatcgttagtgtatgcacatcctgaaatccaagatcaaataagagaattaggtggtcttgcattaattctttccaattgtgtcatcgatgataatgatccgtttatcaaggaaagatctattgtttgcttgaagtttttgttaaagaataatgccaagaatcaggaatatgtcaaaaaaatggaagctcaagacgttgttcaagacgatgcattgagcaaagctgggtttgaaatatcagttgaaaagggcgggaaagttagattagtatctaaagaagaagaccctgggaacgagaattctgagattattagcatagatgaagattaa

SEQ ID NO: 3941 - DNA, 1692 bp, Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 3942 - DNA, 1692 bp, Saccharomyces cerevisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatcagactaattgaactgaaactgcccgtctttgatgctccggaaagtttgatcaaacaagcgcaattgactgccgctacaaatgccaaacaataa

SEQ ID NO: 3943 - DNA, 1692 bp, Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 3944 - DNA, 1695 bp, Saccharomyces cerevisiae
atgatgaatgaagacatatccatcattgatggccataatagttttttaacggaaaaaagcaccgtgctattaacccaagccaagagaacactagaagacgaaaaggaaatgattactcccccgagctcaactgtgagaaaaacaatgaaggaagtaaataagaggccgtcgcatcccctctcaccggatcactcgtccccaattgctccatctaaggccaagcgccaaagatcggacacatgcgctcggtccaatggtaacctaaccttggaagaaattcttcaatctttggaaagaagaagaataaatggtgaactcgccaagaaacctccatattcgtatgcaactttgatttgcttggccattttgcaatctcaggagggaaagctaacgctatcccagatatatcattggatccacgttcacttcccttattacaagcagaaagatgctagttggcaaaattcaataagacataacttgtctttaaatgatgcgttcatcaagactgaaaagtcctgcgatggtaagggtcatttctgggaggtcagaccgggtgccgaaacaaaatttttcaaaggtgaaaatcgtggttatgaatttgtaaaggactccttacaagacattgggaagtattttgaaatagattctacacttgatgaattagaacaagttgagagtggagaaggcaatgatgatcttcctgacgaggaagaaagagaggaagcagggaaattcccttccattgaaattcaattgaactcctcccctatactgagagtttcccagttacatcacataccgcaattgaaaacagacaacagtgtactgaaccctcacgaaaacctagaatcgatgcggaacatgatagaaaacgatgtcaacaatatagattccttggaacctccttatgtcatgaagaaatatcatacttctttaggcttaccgtcgctggtgaatgccaaagatcatttccaggcgggtgtgaaaaacaataatatcacccaggcaaatagatttaatacactccctataactagcgcaaagtctcctcagaatttcagaaaatatttcacctcattcaattcaaattttgaagatttatctccacttcgaagtaatgtaggggctggttctctactcgacccacttccgtattccccattgaagctgtacgatcagaaaaatcttgcgctcatgtcgaaaccacaatctcagcaatcatattccaattctcaacttccacctccaccttcctctcatggttcggacttacttaaaacacccaagatgaggcattccgatggcttagagaaaaccccatcgcggttgataagcacacctaaggacggtaactcgattttgaggaaatggcagactccttcacacctttttgaagatttgtactgttctccgctatttagagctatagagactccaatcaggtatatcacgacgccggggggcactttggaaacccaaatttcaccaagaaagtcctctgcacccgatgtcctcacaagcgcaacgaattccaaatttgcttcaagcgggctgtttggcgtggatgtttattctgtttggaagcgcgcaactgaaaagatttctgatggtaacaatactacggatagcaatcaaaaacatcatccttatcataatcacccttccaacgatagcggtaatgaaaagaattga

SEQ ID NO: 3945 - DNA, 1695 bp, Saccharomyces cerevisiae
atgcaatcatccactgaaagtgatagagatattcaggatggtcctgatgctgatattcacgtcgcaccacccgtggaaaaagagtggtcagatggatttgatgacaacgaagtcataaacggggataacgttgagccaccaaaaagagggctcataggttatcttgtcatttacttattgtgttatccaatatccttcgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggtcttatttttgcccgtcttgctgatactttaggtagaaggctggcaattgtaatcgtggtgttggtatatatggttggtgcaattattcagatcagttcgaatcacaaatggtaccaatacttcgttggtaagattatctatggtcttggtgctggtggctgttcggtgttgtgtccaatgcttttgtctgaaatagctcctacagatttgagaggtggacttgtctcattgtaccaacttaacatgaccttcggtattttcttgggttattgtagcgtttatggtacgagaaaatacgataacactgcacaatggagagtcccacttgggctttgctttttatggactttgattatcatcattggtatgttattggttccagagtccccaagatatcttattgaatgtgagagacacgaagaggcccgtgcttccattgccaaaatcaacaaggtttcaccagaggatccatgggtactcaaacaggctgatgaaatcaacgccggtgtccttgcccaaagagaactaggagaagcttcatggaaagaacttttctccgtcaaaactaaagtccttcaacgtttgatcacaggtattcttgtgcaaacctttttgcaacttactggtgaaaactactttttcttctacggaactaccattttcaaatcagtcggtcttactgatgggtttgagacgtcgatcgttctaggtacagtgaacttcttttccactattattgctgttatggtcgtagacaaaattggccgtcgtaaatgtcttttatttggtgcagctgggatgatggcttgtatggtcatatttgcaagtatcggggtgaaatgtctttaccctcatggccaggatggtccatcctcaaaaggtgcaggtaatgccatgattgtgttcacttgcttctatatattttgctttgcaacgacatgggctcctgttgcttatattgtggttgccgagtcgttcccttcgaaggtcaaatctagggccatgtcgatttcgactgcatgcaactggttgtggcaatttttgatcgggtttttcacaccattcattactgggtctatccacttctattatggttatgtgttcgtaggttgtttggttgcaatgtttctgtacgttttcttctttttaccagaaacgattggtctatctttggaggaaatccaattactatatgaagaaggtataaaaccatggaaatctgcatcttgggtcccaccttctaggagaggtattccttccgaagaaagtaagaccgagaagaaggattggaagaaatttttgaagttctcaaagggttctgattga

SEQ ID NO: 3946 - DNA, 1695 bp, Saccharomyces cerevisiae
atggatatttttagagtattaactagaggagcttccgtgaagaaagagtcaggcccaaaggctaaggcagcagattacagcgttataaatggaaatgatgagaatcataaggaagataataatgaaagccagatcgtgaaagaacttgatttctttcgaaacaagagaatcattagcaaggtagaggatgatagagagaagacaaccgaaaacgattctccaaacaaagaggagaagagcggcaatgatgatggtctgataaaaccagtgattaccaataccgttgaggcatccgcgttgagaaaatcatataagggaaacgtgtcgggtatagatataccacttccaataggttcgtttgaagatttaatttcaaggttttcattcgataagcgtttactgaataacttgattgaaaacgggtttactgagcctaccccaattcaatgtgaatgtattcctgttgctttgaataatagagacgttttggcatgtggtcccacagggtctggtaagacgttagcattcttaattccgctggttcagcagattattgatgacaagcaaactgcagggttgaaagggttaatcatttcgcctacaaaggaattagcgaaccaaatttttattgaatgttttaagctatcttacaagatatttttggagaaaaaaaggcctctgcaagttgcactcttatctaaatctttaggcgctaaattgaaaaacaaggtagttagtgataagaaatatgatataatcatttctaccccattaagactaatcgatgttgtgaaaaacgaagctctcgatctctccaaagttaagcatttgatatttgatgaagctgataaattgtttgacaaaacattcgttgaacagagtgacgatattttgagcgcctgtagagagccatcgttgcgtaaagcgatgttttctgcgaccattccatccaatgtagaagagattgcacaaagtataatgatggatcctgttagagttattattggccacaaggaagcagcaaatacaaatattgaacaaaaattaatattttgtggtaatgaagagggtaaactaattgctattagacaactcgttcaagagggtgagttcaagccaccgatcataatatttttagagtctattacaagagcaaaagcgttatatcatgaattgatgtacgataggattaacgtagatgtgattcatgcagaaagaacagccttacaaagagacaggattattgaacgatttaaaactggtgaattatggtgtttgatctgtaccgacgttttagctcgtggtattgacttcaaaggtgtcaatctggtcatcaattatgacgttccaggatcgtctcaggcttatgttcacagaattggtagaacaggtagaggtgggcggtcaggtaaagctatcacattctatactaaacaagactcagtagctattaaaccaataataaatgtcatgaaacaaagtggttgtgaagtatctgagtggatggataaaatggctaaaatgaccagaaaggagaaagaaagtataaaaaacggtaaagcgcataaagaaagaaagcagattactactgtgcctaagatggataaggccaaaagaagacgtcaacaagaaatgattgcagcatccaaaagaagaaaaaatgaagaactttcaaaaaaacatttctcgaaataa

SEQ ID NO: 3947 - DNA, 1695 bp, Saccharomyces cerevisiae
atgtctagtgcgcaatcctctattgatagcgatggagatgttcgagatgctgatattcatgtcgcaccacccgtggaaaaagagtggtcagatggatttgatgacaacgaagtcataaacggggataacgttgagccaccaaaaagagggctcataggttatcttgtcatttacttactgtgttatccaatatcctttgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggccttatttttgcccgtcttgctgatactttaggtagaaggctggcaattgtgatcgtggtgttggtatatatggttggtgcaattattcagatcagttcaaatcacaaatggtaccagtactttgtcggtaagatcatctacggtcttggtgctggtggctgttcggtgttgtgtccaatgcttttgtctgaaatagcccccacagatttgagaggtggactggtctcattgtaccaactgaacatgacgttcggtattttcttgggttattgtagcgtttatggtacgagaaaatacgataacactgcacaatggagagtcccccttgggctttgctttttatgggctttgattatcatcattggtatgttattggttccagagtccccaagatatctgattgaatgtgagagacacgaagaggcccgtgcttccattgccaaaatcaacaaggtttcaccagaggatccatgggtactcaaacaggctgatgaaatcaacgccggtgtccttgcccaaagggaactaggagaagcttcatggaaagaacttttctctgtaaaaactaaagtccttcaacgtttgatcacaggtattcttgtgcaaacctttttgcaacttactggtgaaaactacttcttcttctacggaactaccatttttaaatcagtcggtcttactgatgggtttgagacgtcgatcgtcctaggtacagtgaacttcttctccactattattgctgttatggtcgtagacaaaattggccgtcgtaaatgtctgttatttggtgcagctgggatgatggcttgtatggtcatatttgcaagtatcggggtgaaatgtctttaccctcatggccaggacggtccttcttcgaaaggtgcaggtaatgccatgattgtgttcacttgtttctatatattctgctttgcaacgacatgggctcctgttgcttatattgtggttgccgagtcgttcccttcgaaggtcaagtctagagccatgtcgatttcaactgcatgcaactggttatggcaatttttgatcggttttttcacaccattcattactgggtctatccacttctattatggttatgtgttcgtaggttgtttggttgctatgtttttgtacgttttcttctttttaccagaaacgattggtctatctttggaggaaatccaattactatacgaagaaggtataaaaccatggaaatctgcatcttgggtcccaccttctaggagaggtatttcttccgaagaaagtaagaccgagaagaaggattggaagaaatttttgaagttctcaaagaattctgattga

SEQ ID NO: 3948 - DNA, 1695 bp, Saccharomyces cerevisiae
atgttttcacgaagtgatcgagaggtagatgatttggctggtaatatgagtcatttagggttctatgatttgaatattcctaaacctacttctccacaggcgcaatataggcctgctagaaagagcgaaaatggaagattaactcccggacttccaagatcatataagccgtgtgattcagatgatcaagataccttcaaaaatcgcatttcattgaatcactcaccgaagaagctacccaaggattttcacgagcgtgcttcccaaagtaaaacccagagagttgttaatgtatgccaactttactttctcgactattactgtgacatgtttgattatgttattagcagaagacaacgtacgaagcaggtgctaagatatcttgaacagcaaagaagtgtcaaaaacgtttctaataaggttttaaatgaagaatgggctttgtatttgcaaagagaacacgaagtactgagaaaaaggaggttgaaacctaagcacaaggattttcagatactgacacaagttggacagggtggttatgggcaagtttatcttgcaaaaaaaaaagacagtgatgaaatttgtgctttgaaaatattaaacaagaaacttttattcaaactaaacgagacgaatcacgtccttactgagagggacatactaaccacaactagatctgactggcttgtgaagttgctttatgcatttcaggatccagagagcctatatttagcaatggaatttgtacctggtggtgattttcgcacattgttaataaatacaaggatattgaagagcggtcacgcaaggttctatatcagcgaaatgttttgtgccgtgaacgcgttgcatgaacttggttacactcaccgggatttaaagccggagaatttcttgattgatgctacagggcatatcaagctgaccgattttggtctagcagcagggaccgtatcaaatgaaagaatcgaaagcatgaaaatacgcttagaagaagtaaagaatttggaatttcctgctttcacagaaaggtctatcgaggatagaaggaaaatatatcataacatgaggaagacagaaattaattacgctaactctatggtcggttcgcctgattatatggccctagaagttctggaaggtaaaaaatacgattttacagtggattattggtcattaggctgtatgctttttgaaagtttggttggatatacaccttttagtggttcttctactaatgaaacttacgagaatttaagatattggaaaaaaactttaagaaggccccgtactgaggatagaagagcagcattctcagatagaacctgggatttaattacaagactaatagctgaccccatcaacagagtacgatcttttgagcaagttcgcaaaatgtcttatttcgcagagatcaattttgaaaccctaagaacaagttctccaccatttattcctcaattagatgatgaaacggatgcaggttatttcgatgacttcacaaatgaagaagatatggctaaatatgcagatgtcttcaaaagacagaacaaattatctgcaatggtcgatgactctgccgttgattccaagcttgttggatttacttttaggcatagagatggaaaacaaggttcaagcgggatactttacaatggttcagaacattcagaccctttttcaactttttattaa

SEQ ID NO: 3949 - DNA, 1698 bp, Saccharomyces cerevisiae
atgaaaagaacggtaatatcttcctcgaacgcatatgctagtaagagatctcggctggatatagaacatgattttgaacaataccactcgttgaacaaaaaatattatccaaggccaattactaggacaggcgcaaatcaattcaataataagtctcgggctaaaccaatggagattgtggaaaaactgcaaaagaagcaaaaaacgtcgtttgagaatgttagcactgtcatgcactggtttcgaaatgatctacgtttatatgataatgtgggactgtacaaaagtgttgcgctcttccagcaattgaggcaaaaaaacgcaaaagccaaattatatgctgtttatgtcatcaatgaagatgattggagagcccatatggatagcggatggaaattgatgtttataatgggggcgttaaaaaatttgcagcagtccttagccgaattacacatacctcttcttctgtgggaattccacactccaaaaagtaccttatctaattcaaaagagttcgtggagtttttcaaagaaaaatgtatgaatgtaagttcaggaacaggtacgataatcactgctaatatagaataccaaacagatgaactgtaccgtgatattaggctgttagaaaatgaagaccatagattgcaattgaaatactaccacgactcttgcattgttgctcctggattgatcactactgacagaggcaccaactattctgtgtttactccatggtacaaaaaatgggtgctatatgtaaataattacaaaaagagtacctctgaaatttgtcatttgcatataatcgaaccattaaagtacaacgaaacttttgaactgaagccattccaatattcattaccggatgaattccttcaatatatacctaaatcaaaatggtgcttgccagacgtttctgaagaagcagctttatccagattaaaagatttcctcggtacaaaaagttctaagtacaacaatgaaaaagacatgctatatttgggtggaacctctgggctaagtgtatatataactactggtaggataagcacaagacttatagtcaaccaggcatttcaatcatgcaacggacaaataatgtcaaaagcactgaaagataattcgtccacccaaaatttcatcaaagaagttgcatggagagatttttacagacattgtatgtgcaactggccatatacctcaatgggaatgccttatcgattggacactttagatataaaatgggagaataaccctgtagcatttgaaaagtggtgtactggtaatacaggcattcccatagtcgatgccataatgagaaaattactgtacacaggctatattaataacagatctagaatgatcacagcttcttttctttctaaaaacttattaatagattggagatggggggaacgctggtttatgaaacacttgatagacggtgattcgtcttcaaatgttggtggctggggtttttgttctagtacaggaattgatgcccaaccatattttagagtttttaatatggatatacaagcaaaaaaatatgacccacaaatgatattcgtcaaacaatgggttcccgaattgatttcttccgaaaataagcgtccagaaaactatccaaaacctttagttgatttaaagcatagtagggagcgtgctttgaaagtttataaagacgcaatgtga

SEQ ID NO: 3950 - DNA, 1698 bp, Saccharomyces cerevisiae
atgtatcgcagtagaaaccgaccaaaaagaggtggagaaaatgaagttaagggaccaaattctgccttgactcaatttttaagagaagaagggatcagtgctgaaaatatcaaacaaaaatggtaccagcgacagtcgaagaagcaagaagatgcaacagacgaaaaaaaaggtaaagcggaggatgatagctttactgccgagatatctcgagtagttgaagatgaagaaattgatgaaattggaacaggtagtggtaccgagacagaaagagctcaggtttcctacgatgccaggatgaaattagtccctgctgatagtgatgaagaagaatatgaaactagccacatttctgacacgccagtcagtttaagttcggctaatgaccgggaatcattgactaaaaaaaggcaaaatactgcaaaaattatccaaaatcgtcgcagaaagcgtaaaagagcagctgacctattggatagacgcgtcaacaaagtatccagcttacaaagtctttgtattacgaaaattagtgaaaatatatccaagtggcaaaaagaggctgatgaatcatcaaagttggtatttaacaaattgagagatgtccttggtggcgtatcaaccgctaatttgaataatttggcaaaagcactatcgaagaatagggccctgaatgatcatactctgcaacttttcttgaagacagatctaaaaaggttaactttcagcgattgttctaaaatttcatttgatggttacaaaacgctagccattttttcgccacacctaaccgaattatccctacaaatgtgtgggcagttgaaccatgaatcattgctttacattgctgaaaagcttccgaacttgaaatcactgaatttagatggaccatttctgatcaacgaggacacatgggagaagttctttgtaataatgaaaggtagattagaagagttccacatttctaatacgcaccgcttcaccgacaaatcattatctaatttattgatcaactgcggttctaccttggtatccttagggttatccagactagattctatatcaaattacgctttattaccgcagtacctagtcaacgacgaatttcacagtctctgtattgaatatccattcaatgaagaggatgttaacgatgagatcatcataaatctgctaggtcaaatcgggcgcacgttacgtaaattggttttgaatggctgtattgacttgacagattcaatgataatcaatggtctgactgcattcattcctgagaaatgtccattggaggtattgagcttggaagaatcagatcagatcactacagattcactgtcgtactttttcagcaaagtagaactgaataatttgattgaatgcagctttagaagatgtctacaattgggcgatatggcaattatagagctattgcttaacggagcaagagatagtctgagaagcttaaatctcaattcattaaaagagctaactaaggaggcatttgtggcgttagcctgtcctaatctgacgtatcttgatcttggttttgtacgttgtgttgatgactcggtgattcaaatgttgggtgagcaaaatccgaatttaactgtaattgatgttttcggagacaatttggttactgaaaaggccacaatgaggcctggacttacgttgatagggagacagagtgacagtatataa

SEQ ID NO: 3951 - DNA, 1698 bp, Saccharomyces cerevisiae
atgtttaagaaggagcctcacataaaagctttaagtaatttgaagaattccgaaagaaagaagttgctacaaacattccaaaaacaaacgaataatgaggaatatagctttcgtacttccactataaaacaaaccaactttaacggccagaaaagtgtaggaacggtttacacagatgagaataataccccaatattattcaaggaaaagcataaggagcaactttttccaactgtgtattcttgttgggaatatcctgcgttattgccgatcgttttaactcatggatttgttatagaagaacatttattcaacggcgctaacttaatgatttccggttcgatcccaccctttgatcctcgttgtaaaataggtactctttgtggtatagctagcaaacaggcaccagaaactgtcttagccatcggtattgtcgaattagatctaccgtcctttgataaagtaattggtgaaacaggagttgctgtcaaaatcatacatcatttcaatgatgggctctccaaagtctttaaaatgaaattggaacctccatttgttctcagtactcaatcaaaggataacaatatcagtagtaaacagatagaatcctcggagcaaatcaaggctgttgaaaaggaacaagaagatgtaaaagaagcgtctgttgatgtagaggagattgctgaagttctagaccatttcactgtgtcggatgtagattatttcattacaagagcattatattataccttgactcaagataaaggtttggaattacccatttcagcttctaacttcatctcaaaccacattatgcgtaatttgcctccaattgatcacaatgaagtcaatgtaaagaaaacttcatggaaaaaaagcgcaaaatttttgaaacacttcgagaaagaaggcttcttgaaattaaaaggaaagggggatgacttaactattgtgggcaaaaatactgacaaggatgagttaaagaactttgtgccatataagcttggttgtagcaagtctgccacagaaagtagggagagcacaacctcgaaggagaaaacatctggaatgatgtattcactgactctgtataaaccctttaatcttgccaaagatcttttgaaggaggttaatttggcttctcacacgtactacacctctcaggacattagaagcgcggtttctcagtatatttctgtcaagaacctagcagacacaaaagataaaggaaaagttattatggacgatctattattcgatatggtcaataagaagaagaaagtcttgaatgcttcacgtatcattgctagaggtgaaattttgcatcccttactcaccaataattttaccgagttctatcagatattcaaaagcgatgatactctcttgttcaaggcgccaatgaagggttcccttccgcatattaagattattactgaaatgaaaattggcagaaaagttattaccagagtgagcaattttgaagtgtttcaagtcgacccagaatcacttgcggctgacttaagaaagatttgtagcggatcgacaacaataagtgaatcacaaacattcaaatgtgctgaagtgcaggttcaaggtccacacggtcaatcgatcattgatcaccttaacaagctaggtattccaagcaaatggatagactttgagaacaagttgaagaagaaaaaaagaaagtag

SEQ ID NO: 3952 - DNA, 1701 bp, Saccharomyces cerevisiae
atgacgaaaccgcgttacaatgacgtgttgtttgatgatgatgactcggtaccatcagaatcagttacgaggaaatcgcagagaagaaaggcaacgtcacctggggaatcaagagagtcctcaaaagatcgtctactgatacttccctctatgggggaatcatatactgagtacgtagactcttatttgaacttagaattattggaaaggggagaaagagaaacaccaatctttcttgaatctctgacaagacaactaacgcagaaaatatatgaactaataaaaacaaaatctttaactgcagataccttgcaacaaataagtgataaatacgatggtgtagtggcagaaaacaagctgttatttttgcaaagacagtattatgttgatgatgaaggaaatgttagagatggccgaaataatgataaaatatactgtgagccaaagcatgtatacgacatggtgatggcaacacacttgatgaataagcatcttaggggtaaaacattacattcctttttattttctcattttgccaatattagtcatgccatcatcgattgggtccagcaattttgttcaaaatgtaataaaaagggcaaaattaaaccattgaaggaatataaacgtcctgacatgtacgataaactactaccaatggaaaggatacatattgaggtattcgaacccttcaatggagaagctattgagggaaaatattcttatgtccttttatgccgagactatcgctctagttttatgtggttattaccacttaagagtaccaaattcaaacatcttatcccagttgtttcctcactttttttaacatttgctagggttccaattttcgtaacatcaagcactttagataaagatgatctttatgatatttgtgaagaaattgcatcaaaatacggtctccgtattggcttgggtttgaagagttctgcgagatttcatactgggggtatactgtgcattcagtatgctctaaatagttataagaaggaatgtctagccgattggggtaagtgcctaagatatggcccttacagattcaaccgaaggagaaataagagaacgaaacgtaaacctgtgcaagtactacttagtgaagttccaggtcacaatgccaagtttgagactaagagagaaagggttatagaaaacacatattcccgtaatatgttcaagatggcaggtggaaaaggtcttatatatttggaagatgtcaatacttttgcccttgctaatgaagcggataatagctgtaacaataatggaattcttcataataacaatataggaaatgataactttgaagaagaagtgcaaaaacaatttgatctaactgaaaaaaactatatcgatgagtatgatgatttggcacatgattcttcagagggcgaatttgaacctaataccttaactcccgaagaaaagcctcctcataatgtcgatgaggaccgaatagagtccaccggcgtggcagccccaatgcagggaacagaagagcctgaaaaaggggatcaaaaagaaagtgacggtgcatcacaagtagatcaaagtgtcgaaataactagaccagaaacttcctactatcaaactctggaatcgccgtcaacaaaacgacagaaattagaccaacagggtaatggagatcaaacaagagactttggcacatcaatggaattgtaa

SEQ ID NO: 3953 - DNA, 1701 bp, Saccharomyces cerevisiae
atgatgactcacacattaccaagcgaacagacacgtcttgttcctggatctgactcgagctctcgtcctaaaaagagacggatctcgaagagatcaaagataatagtatccactgtggtctgtattggtttgttgctggttttagtgcaactggcatttccaagcagttttgcattacgttctgcatcacacaagaagaagaatgtcatattcttcgtgacggatgggatgggacctgcgtctttgtccatggcaagatcattcaaccagcatgttaatgatttacctatagacgacatcctgacacttgacgagcattttatcgggtcttcgagaacaaggtcctcggactcactagtcactgactcagctgcgggcgccaccgcatttgcatgtgcattaaagagctataatggggccatcggtgttgatccgcatcacagaccttgtggtacagtgctcgaggcggctaagttagcaggttatctcactgggcttgttgttacgacaagaatcacagatgccactccggcttcattcagttcacatgttgattacagatggcaggaagatcttatcgctacgcaccagttaggcgaatatcctctggggagagtagtagacttactcatgggtggcggcaggagccatttctaccctcaaggcgaaaaggcttctccatatggtcaccacggtgctagaaaagatggaagagatttaatcgatgaggctcaatctaatggctggcagtacgtgggtgaccgtaaaaattttgattctttgttgaaaagccacggtgaaaacgttactttacctttcttgggtctctttgcagataacgacattccttttgaaattgacagagatgaaaaggagtatccttcccttaaggaacaagtcaaggtggctttgggtgccttggaaaaagcttccaatgaggacaaagattctaatgggtttttcttaatggtggaaggctccagaattgatcatgctggtcaccaaaacgatccagcttcgcaggtaagggaggtgttggctttcgatgaagcattccaatacgttttggagtttgctgaaaattccgatacggagactgttttggtctctacgtcggatcatgaaacgggtggtttagtcacttcaagacaagtcactgctagctatcctcagtatgtctggtatccacaggtgctcgccaacgccacccattcaggtgagtttttgaaaagaaaactagtagattttgttcatgagcataagggcgcaagcagcaaaatagaaaatttcatcaaacatgagatcctggaaaaagatttgggtatttacgattacacggatagcgatttagaaacattaattcatttggatgacaacgcaaatgctatccaagacaaactgaatgacatggtatcatttagggcccaaattggctggaccacgcatggtcacagcgcagtcgacgtcaacatatatgcatacgccaataagaaagctacatggtcatatgtcttgaacaatttacaaggcaatcacgaaaatacggaagttggccagttcttagaaaactttttagaattgaacctgaacgaagtcactgatttgattagggacaccaaacacacatcagattttgatgctacagaaatagctagtgaagtacaacattatgacgaatactaccatgagttgaccaactga

SEQ ID NO: 3954 - DNA, 1701 bp, Saccharomyces cerevisiae
atgatgagtcccgcccaagataaactgcagcaccagcatcataatcctaattcttcctcatcgtcatcctctaagatgacgaacgtttatcaggttaccacgccaaagtctcctcaggatttggaaaacaacatggatgagcccttcaaaatggacaccgccaccagtaatccggacaaggatagcgaaaatacccagcggttgaagtacgaatgtgccaaaggggaaatacagaatgttttgaacctacatataatgctaaaccacaagcatgttaggcacttacgaagaaatgttcaaaaggttaacgcaaaactagctctcttggaaaccctgcataaggatactggtctattgaacaaaatcgaacggacgtatcaactcaaaataaaacaacatcagcagcatagcgtgctcggcggccactttcacgacagtacggctacggaaaatacgaacgcatcaaattataacctgtcatacccggttctatcggattataacatcaactgtcagcctttgtcttcgagcagcaacagaaatctgtcaacaacacgcataccacaccaccattatcatactagaagcaagagtaacgggcttttgctagaaccttctgccctccgtccggcaaattcgaatataattgattacaggctaacaggttctaaatctctatcagaagccataaccaagcccactcccgtctcgcttcctcactctaattcggatggcatttcttcacctcgttcctcctcaatctcccccttagacgagcagccggggttccagatactcccttttaaaccaagtcagatgcatcttaaccacagacgtaattacagtagcacttgtttgacgagcaatagcggtatcatcggtaagactgaaaataatgagcccatttttagaagatatgacggcattttggttataattacgtgctccaaatgtgaccgttccggtttcacttccgcgcaaggtatcgtgaaccatactcgactaaaacattctaaactatattcaagccaaccattggcagttttaaacaaccaaaaactacttcctaatgataagcaggatccggaaattttatctaagttcaagaaactaaatttggacccaaacaaagactacctaccctctgacattgcaatcccaaaaccacaatcaccaatcaaccactccgagaaccatacgcgggctccaaagactgtcaagaacactcctcatttagaaaaactataccaaaataaagaagacttcaaaaaactgattgacatggttaatgaaactccggatgatttgaatgaatatttgaagcaacgtgaaattcaattaagatatcaaaaggagcaagaagaggaatcttccaaatctgatgacgaagcttcttacgtcccatcaccgtctctctcagcaacggctacaacaacaacgactacggacccaccctctccgccagtgctatcctcctccttacaaagaaaattgctgcgtaagagaaaactgagcttgaatagctctactcccatggaagatttacctttaagagaaaggttgagagcaaatcccactgacaagaaaccaagaaaagcggcccttttgactaatgaacttgagggtcctgatcctgcagcaaaatcatcatcttattacaatctaaggtcgaaatcaagactgcgtggttctcatacatag

SEQ ID NO: 3955 - DNA, 1701 bp, Saccharomyces cerevisiae
atgcaggttcaaaaaatggtgagagataacagtaataacggtagcgataaaagcgtccattgggagaggaggaataataacggcgcaggcccccgttatcgttccagaagcggtaataccggtgctttggcaacaaaactaagtaatgggacgctctctgtcagaggattagtgaaggaccgaacaggaagcggcaagatcgcgggctgtgtggaggcgtttctggatgccaggacccaattgaatacgccctgggaccgtgctaagtgcaattggctggaccagatagattactatgtacagttgagaaagaccgcgttttctaaggaattggaccaactaaggaagcccatgatcgatgcatatgtggcggagatgaggcagaagtttgatgcctcctatggacaatccagggcgcaattggaagccaaactggcgcaggtggacagtgaatggcatatggtacatggtgatgtgcatgcaaaactggaaaaactcgtggaagaacgccggtttttgaaaagattaagcgacacgatcgtaccacccaggtccaaaagatcacagcggctgtctccattgaccaaagaggaccgagccaactgtatctgtccgcagcccaaaggaatgagcgacaccgcttggttcgaagccattcagaagaaaatgttaggaatgaatggtaccatcaagctcctagagacagaacagaaactactggctgacgagaaaaacagcgtgaggaagacgttctggcccatggtggaagcacattcacgctcgaatgaatttgcttatctggagaaatgcatcaggctgatggcctctcagagagcaatatgcttttgtcttgatatagaggctttcgaaacaaaccagaacgtaatcaccgaaattgggatttcaatttatgaccccagggaaaatatggtgccgtcaatggttccaattacaaagaattaccacctaattatcgaggagtccctggaacttagaaaccaaaaatgggtctgtgactacaaggattgctacttattgggagaaagctatgttttgagcttgaaagagtgcgtgcatttcattcaatcactaataaactattacttggtcccggtgaccgaagaagacaagacatggtcaagggcatttgttggtcatcacgtgagcggggatcttaagtggctggagactattggtgtcaaattccctggcagagggtatgaaggccatctggaccatacgctgcttttggctgaaactcccggtgatctagacgtgttcatcttggacactgagcagttttacaggaaatcgtatggcgaaaagggcagcagtctgggcaagattctgcggttgttcgagataccgcatgcgtttctacacaatgccggtaacgatgcctactataccctgcatttgttcatgaagttttgcgatgttaatttcaggaaaataagcggcatggacgatgttcttaaagtaatgggccaagtaaaagtttggggagaacgagacgtacgagagcctaaagtggtgcccatgtcgtatgccatctccatcgaggaggcagtcaaaaatcggacgtaccgcaagggcgtcaagagcagtaggaaggaaagagtctgccaaacggaattcggtgggttaacgtatttcggaactgctaaagacgccttcacaagcactcttccgacacactaa

SEQ ID NO: 3956 - DNA, 1701 bp, Saccharomyces cerevisiae
atggagtactggcattatgtggaaactacgtcatcgggccaacctcttcttcgagaaggtgaaaaagatatctttatcgatcagtccgtaggtctttaccatggcaaatctaagattctacagcgacagaggggcagaatctttttaacgtcacaaagaattatctacatcgacgatgcaaagcccactcagaactcgcttgggttggaattggacgatctagcgtatgtaaactattcatctggcttcttgaccagatcacctcgtctgatcctgtttttcaaggacccctccagtaaggatgaacttggtaaaagtgcggaaacagcaagtgccgacgttgtttcgacgtgggtctgccccatctgtatggtttcgaacgaaacgcagggggaattcactaaagacactctacctacacccatttgtatcaattgcggtgtgccagcggactatgagctcaccaagtcgtctataaattgttctaatgcaatcgacccgaacgccaacccacagaatcagttcggagtgaactctgagaacatttgccccgcctgtacttttgctaatcatcctcaaataggaaattgcgagatttgcggccacagattgcctaatgcatccaaagtacgatcaaagctgaacaggctaaactttcatgattctagggtccatattgagctagaaaaaaattcactggctagaaacaagagctcgcactcggcattatcgtcctcgtcctcgacaggatcatcgacagaattcgtgcaattgagtttccgcaaatctgatggcgtattgttttcacaagctacagagagggctttggagaatatactcactgaaaagaataagcatattttcaatcagaatgtggtttctgtaaatggtgtagacatgaggaaaggggctagttctcacgaatacaacaatgaggtgccatttattgagactaaattgagcagaattggcatatcaagcttggaaaaatctagagaaaaccagcttttgaacaatgacattctctttaacaatgcgttgaccgacctaaacaagctaatgtcgctggctaccagcatcgaaagactatacaaaaatagcaacataacgatgaaaaccaagacattgaacttacaggatgaatcaaccgtgaatgaaccgaaaacgagaagaccgctattgatacttgatagagagaagttcctaaataaagagctgttcttggatgagattgcgagagaaatttacgagttcacgttgtccgagtttaaagatttgaacagtgataccaactatatgatcataactctggtagatctatatgcaatgtacaacaaatctatgcgtataggtacaggcctgatatctcccatggaaatgagagaagcatgcgaaagattcgagcatttaggtctaaatgaattgaagttagtgaaagttaacaaaagaatattatgtgtaacgagcgaaaaattcgacgttgtaaaagaaaagctagtagatctgatcggtgataatcctggttctgatctcctaagattgacacagattttgagttccaataattcaaaatcaaactggacgctaggtatccttatggaggtattacaaaattgtgtcgatgaaggcgatttactgatagacaagcaactgagtgggatttactactataaaaactcttattggccctcgcatatataa

SEQ ID NO: 3957 - DNA, 1701 bp, Saccharomyces cerevisiae
atggtagaaggagactcttatgtggagactttagactccatgattgaattattcaaggattacaaacctggttccataactttggagaatataacacgactttgtcaaactttgggtctcgagtccttcacagaagaattgagtaatgaactttcaagattatcgacggcatctaaaattatcgtgatagatgttgactacaataagaagcaagacagaattcaggacgttaaactcgtactagcatctaattttgataattttgactactttaaccaacgagatggagagcatgaaaaaagcaacattcttctaaattccttaacaaagtatcctgatttgaaagcttttcataacaatttgaagtttctatatctgttagatgcatattcccacatcgagtccgattctacctcccataataatgggtcttctgacaaaagcttagattcaagcaacgcatcatttaacaaccaaggtaaacttgatctttttaagtatttcacggaactatcacactatataagacaatgtttccaagacaattgttgcgactttaaagtcaggaccaatttgaatgataaatttggaatatatattttaacccagggcatcaatggtaaggaagtgcctttagccaaaatttatttagaagaaaacaaaagcgattcacaatacaggttctatgagtacatatattcacaagaaaccaaatcttggataaatgaatctgctgagaatttttctaacggcatttccttggttatggaaatagtagcaaacgctaaggaaagtaactatacagacttaatttggtttcctgaggatttcatatcaccggaacttattatagataaagttacatgttcatcaaactcatcttcttcgccacctataattgatttattttcgaacaataactacaatagtagaatacaactgatgaacgattttacaacaaaattaatcaatattaaaaaatttgacataagtaatgacaatctagatctaatctctgagatactaaaatgggttcaatggtcgaggatagtacttcaaaatgtttttaaactggtctccacacctagttcaaattcaaattcatcggaacttgaacctgactatcaagctccattctccacctcgactaaagacaaaaattcttcaacatctaacactgagccaattccaagaagtaacagacatggaagtgtagtagaggcctctagaagaaggcgttcttcaactaataaaagcaaacgtcccagtataactgaagcaatgatgcttaaagaagagggtttacagcaatttaatttgcacgaaattttatctgaacccgcaatagaggaggaaaatggagacagcatcaaagagcactctacaactatggatggtgccaatgacctcggattcaccgcctctgtttcgaatcaagaaaatgcaggaactgatattgtgatggaagatcatggtgtactgcaaggcactagtcaaaattatggtactgcaacagcggatgacgcagacatagaaatgaaagacgtcagttctaagcctagtaaacctgaatcgtcggtcttacaactaattgtaagtgaagatcatatcattctcgacactatttcagaatgtaacttgtatgatgatgtaaaatgctggagtaaatttattgaaaaatttcaggatatcgttagctaa

SEQ ID NO: 3958 - DNA, 1701 bp, Saccharomyces cerevisiae
atggttacagaaaatcctcaacgtcttactgttttaagacttgccaccaataagggtccattagcacaaatatggcttgcttcaaatatgtcgaatataccaagaggatcggttatccaaacacatattgctgaatcagcaaaggaaattgcaaaagcttctggctgtgatgacgaatcaggggacaatgaatacataactttacgaacatctggcgaattacttcaaggcattgttcgtgtatattccaaacaggccacttttctccttacagatataaaggacacattaacgaagataagtatgttatttaaaacaagccagaagatgacttctacagtaaacagactgaacactgtaacaagggttcatcaattgatgttagaagatgccgttacagaaagagaagttttggtcaccccagggttagagttcttagatgatactactataccagtgggcttaatggcgcaggagaattcgatggaaagaaaagtccaaggtgctgctccctgggatacttcacttgaggtcggtagacgattcagtccagatgaagatttcgaacataataatttgtctagtatgaaccttgattttgacatcgaggaaggtccgataacttcaaaatcttgggaagaaggaacaagacaaagctcacgcaactttgatacgcacgaaaattacatacaagatgacgatttccctcttgatgatgctggaactattggttgggatctagggattaccgaaaaaaatgaccagaacaacgatgatgacgataactctgttgagcaaggaagaaggctaggtgaatcaatcatgtctgaggagcctacggattttggatttgatctggatatagaaaaagaagcacccgcaggcaatatagatacgataaccgatgccatgacagaatcacagccaaaacaaactggcacaagaaggaactcaaaattactgaataccaaaagtattcaaatcgatgaagaaacagaaaattcagaaagcatagcttcatccaatacatacaaagaggagagatcgaataatttattgactccacagcccaccaattttacgactaaaagattatggagtgaaataactgaaagtatgtcctatttaccagatccaatccttaagaacttcttatcctacgaatctctaaaaaaaagaaaaatacataatgggcgagaagggtcaattgaagaacctgagttaaacgtgtcgcttaatcttaccgacgatgtaattagtaatgcgggaacaaacgataactccttcaatgaactgaccgataacatgtcagacttcgtaccaattgatgctggcttaaatgaggctccttttcctgaagagaatatcatcgacgcaaagactagaaatgagcaaactaccatccaaactgaaaaagttcgtcctactcccggtgaggtggcttctaaagctattgttcaaatggcgaagattttaaggaaggaattaagcgaagaaaaagaagtaatattcacggatgtactaaaaagtcaagcaaatacagaaccagaaaatattactaaaagagaagccagtagaggatttttcgatattttatcacttgctacagaaggatgtattggtttgagtcaaacagaagcattcggaaatattaaaatagacgccaaacctgcactatttgaaaggtttatcaatgcttaa

SEQ ID NO: 3959 - DNA, 1701 bp, Saccharomyces cerevisiae
atgtccaaagtaatgaaacccagcaacggaaaaggttctagaaagagttcaaaagcagccacacctgatactaaaaatttctttcatgcaaagaaaaaggatccggtgaaccaagataaagcaaataatgcttctcaaattacgccaacagtgccacattctcatccatcagatatggttatccctgaccatttagccgaattgattcctgagctgtattctttccaacaactggtggattccgagaaaagattagatcattttattcatctgcgaaacttacatatgaagcgaatggttgcgcagtgggagaggtcaaagctatcccaagagtttctttatcctcatttaaattttccaaatgtaaaatttctccgaatcttcatttcaaatgttagtgaaaaccaaccctggcaaatggacacaaacaatgaggctgaccttatggcactggagaatgccacttggacgatgagaatcgaaggtcgattattggacaatgtgcaagctaatgatccagcaagagaaaaatttagctcattcatagaatcgatagtggtagacttcaaaaataaggaaaacgataatgtgccatcgactaaatttaatgcggcccctgaagaaaatgccaccgaaggacccagtgataagaaattgaacttaaacttaccgttacaattttcactgccgaatggtgacaactctactacgactaataccgaccaaaataatgccacgatgggggaggagactgccaaaaaggatatgagttctacaactccaaaactagaatcagtgaaatggcagtatgacccgaataatcctgtagacttcgatggtctcgatattaagagggtagggtctgaaaatgtagaatgcactataagcatcctgcgaaaatcatccccagaagagccatttatgagctactctccacaactaaccgcaataataggattgaagagcggtacatcacatgatgcaatattttccatatataaatacatccatttaaatgaattgcttaccaatgatgagtctgcattcgaaaatttgatgggcaacaggaacaatcacaatagcaacaccagtactagtaagatgcttgatgcagcctccagtcaagtttctattgtaaaattagacactcagcttattaccttattacccagcagtcttaaagaatcttctccagatacaatgaaattaacggatttactgtcccttattaatagtactcacctgctcccattacagccaattgaaattgattacacagtacgcgttgataaagcttccacttatggtgagttggttcttgatattgaagtacctgatgtcaacgctctaaaattcaataatacacaaagagaaagtcaaattggggctgctgaattgaatgaaaatgccagggaattggaacaaatcaaacccaagatagctttacaggacaaagaaataacgtccgttctctcgaatctacacgagagcaacaaacgataccgtttcttcaagaaaattagtgaggacccagttaaagcattaaatgaatgcattgcttctacctcgaatgctttgaaagttttatcgggagatgagggctataatgaagatatggtaaggcgggctaacttttacaaggaaaatgaagctatgttgcgcgagaatatagaagtcatattatcaaatggacgaatgtag

SEQ ID NO: 3960 - DNA, 1701 bp, Saccharomyces cerevisiae
atgtccacaaacctgaacccattcatgaataatacgccttcctcctccccactcaagggttctgaaagtaagagggtatcgaaaaggccaatatctagttcttcgtccgcctcactattatcatctccctccaggcgatcgaggccgtctacagtatatggtgataggtatattccttcccgaacagatatagatttcaattccatcgtttccatcagtagtatggcaagcgttccagcccttaatccatcgagtacggaagatcaagtagaataccaaaaggaaagacaggcacatgaaacttataatactttgctgaagaatgagctttttggcgagatgctaagcaaggatacggtaggctcagagagcagtatagatcgcattaagaatacgagaccatctactagaggcaatgtgcacgcagaaaatacaactagacatggttatgaactggaacgagtatcaactccacctcctgaagctgctggtttagaggaattttcgccacattccacgccagtcactcctcgacgtctttttacatcacagcaagatgaaatcacgagaccctcaagcaactcagttaggggcgccagcctgttgacttatcaacaacgtaaaggtagaagactatctgcggcctctttgttacaatctcaattttttgattccatgtcgccagttaggccggattccaaacagctcctattatcaccggggaagcaatttagacaaatagctaaagttccctatagagttttagatgccccatcattagcagacgatttttactacagcttgatagattggtcaagtactgatgttttggcagttgctcttggaaaatcgatttttttaaccgataataacactggcgacgttgttcacttatgcgacacggaaaacgaatacacaagcttaagctggattggagcaggctctcatctggcagtaggtcaagcaaatggacttgtagaaatttatgacgtaatgaaaagaaaatgtattaggacgttgtcgggacatattgacagagtagcgtgtttatcttggaataatcatgttttgacgtctgggagtagagatcatcgaatactgcatagggatgttaggatgccagatcccttttttgaaactatagaatcgcacactcaggaagtctgtggcctaaagtggaatgtagcggacaacaaacttgcctcaggtggtaacgataacgtcgtccatgtttacgaaggaacgtcgaaatctccaatcttgacgtttgacgaacataaggctgctgttaaggcaatggcctggtctcctcataaacgaggtgtgctagctaccggtggtggtacagcagatagaagactaaaaatctggaacgttaatacgtcaataaagatgagtgatatagatagcggctctcaaatatgtaatatggtatggtcaaagaatactaacgagcttgtgacatcacatggttactcaaaatataacttaaccttgtgggactgtaactctatggatccaattgcaattctgaaaggtcatagtttcagggttctgcatttaacgttatccaatgatggaaccacggtggtttctggggctggagatgaaacattgcgatattggaaactttttgataaaccaaaagcgaaggtacagccaaattcgttaatatttgacgcatttaatcaaatacgttag

SEQ ID NO: 3961 - DNA, 1704 bp, Saccharomyces cerevisiae
atggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcgacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaacccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattga

SEQ ID NO: 3962 - DNA, 1704 bp, Saccharomyces cerevisiae
atgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataa

SEQ ID NO: 3963 - DNA, 1704 bp, Saccharomyces cerevisiae
atgactggcgacggtagtgcacatatttctaaaaacaatcaaaatcaacacaaagatcgcttcaagtttattgtgaatgataaaagtattctaggacctcaatggttaagcctttaccaaacggatgggaaagtaacattcgcaaagtcccacttcgagcaagcaatgatgaacgttattagagaaccaaatattaactctactgtcatattaagagcggatattttgaaagagatcaatcatgctgcagaagctgggtctgagccaaaatttgacgagtccgtattaaaaaagtttgagatcgataatggtaatgaaagcggtgaagaagatgtcaagaagataaatattgaagatttaaacataaggtcgtgtgaaacatctgagagtttaaaattgtcacccgttcatgaatttgtaagaaggatcattcctaggaatttttacaaagatgctatcataaaccaaacatgtttaatcctaaatagcaaagaccctaattttcaggagacctcattgattgtatatacgccgcacattaactctgagaaagactgtccgttttatattccaagaacgcaaagtgtaggcattttgttacaccagtcagttctttctgtacactacattcccttccccgaggataaaactgcctttacagatgaatctgagcgtgttgtaagaaccgcttataggttattacaaactgctaacaaacactcaaagggtgtgatgcagggttatgaaaagagggtcaatcacgatcaagtggtaaataaagtcaattttcagaacacatacattgttttgaagaaaaaatactccaagttcctggtggagaattgggcagagtctacagacccaaaaaaacatgtttttgaagacatagccattgccgctttcctgattgaattatggattaaagtgtacggtccagacttccgttcaaaaatgcaatttagagatttgggatgcggcaatggtgctctttgttatattttactgagtgaaagtattaaaggtctcggcatagatgcaaggaagcgcaaatcgtggtctatctacccgcctgaagtgcaatcatcgttaaaggagcaagttataataccttctatccttttaagaccccatcctgctttgaaaagacaagtacctcatttggaacacaatgggagatttttcccagtcaaggtgacgcacgaagtgattgcccccgcaaccgtcgtgtattcaagtgaggacttactaaaatctccgcaggtcaatacagcagagttcccaccagatacttttattataggtaaccactcagatgagttgacttgctggatcccattactaggtcatccttatatggttataccttgttgctctcataatttttctggccagagagttcgttttaacgtaaggaaacgttcgcctaggtcaaatgaaatcaaaaaccagaataacagtaagagcacctactctggtttggttgatcacgttgaatatatttcatctcgtgtaggctggaaagtagagaaagagatgttaaggataccaagcacaagaaatgcagccatcataggtgtagaaaatgcaaccttaaagcattttccaacgcaagcagtgtacgatatgatttgggaagacggtggagctgaagggtggattcagaacacaatgtccttattgaaaagaaacccaagaaaccattaa

SEQ ID NO: 3964 - DNA, 1704 bp, Saccharomyces cerevisiae
atgggacagtcttcttcaatcagttccagtaacgaagagggttcttcccactcaaaaaaattcacaaatagcaaagatattttggcatatttcaataacaaagcacagcaacaggtcactattccagaattagtcagttttaagggaaatttgcaaattgaagatctaaacactccaatttctcacaaagctttatgcaactcactttattttccgcagaatcatgccatgattgttgggatagtgactaacatgttgagggttttgagcaacttcccattaatgaaatcatcttacgaaccaattacgggatatgggttattaaaatgcattttgttgttaaacagggcacgatgtgccaaattcttgaaaaccaagtcctatgatcaactaaaactgctgtttatctctttatcacttcagaaaactgacaaagaagaactctccgaagaaagtgaaaacgacggaaacaaggagttgactataaaacaaataataactgggtttgatgatgttgatacagaaatgctgtgcattcctgctgattttatgcttcagtttttaacttggcttttaattttaacagttgattgtccaaccaccaattctaaattggataatacagagactcatgatcaatggggcaatttcaaagtctcagcactcaatctccttagaactatgaatccagacgtggtgggcgatatagaatcacattccataacgtttcaacaattttcaactgcaataagaactgtaatgcccaatctattaaaaccattagagaatttaatggagcattttttttatttgcagcacgatttagttgatcatgacacaaacttatcgtctattcaggattctaaagttatgactccagcactgttggcacagttatcgacgggactaccaaaggaattatttattcataagctacaaagtttatacatcggcaggaaaagtggcttctcaatgaggtctttgcaagcaaaggtgttcaaatggatggcgccttcgattttagttgttagcggaatgaggataacaaattctgaagaatacgcagctgagaagaatccaagataccgccattttcttgaagaatttcctaaattgaaagagtcagatcaaatgatggatgcatcgcatttgaataaaaggaaaactactttcgctgtgtacatagacgatccgtggaaagtaacaaataaagattattttggcgatctgaatacgagaataatagaaatatcacccaggcaggatatttataaagtcaaccaaaaaggcacgatctatttcaatacaattggtggcggaattggaatcggggataaacaaccattaataaaaccagcatccaagagatacataccagggaacgtgtcgcttacttttgacagcacattagaatttgctgtgtttagaaatactggttacggaggttcattagaccctggtttattgtcgatggaaagaaaggaggaaaattccccttatgaattgcattttttgattcaagatgttgaggtatggggctgtggtggtgagaaagaactagaagagcaaatcaaacagttggaatgggaagaagcagaatctaaaagaagacagcaaattaacctgagaagcttgggagaagaccgtgccttactggaaatggcaggtttagttggccaacatcaaggtggcggttcaatgtga

SEQ ID NO: 3965 - DNA, 1704 bp, Saccharomyces cerevisiae
atgtcaggtgttaataatacatccgcaaatgagttatctactaccatgtctaactctaactcagcagtaggcgctccctctgttaagactgaacacggtgactctaaaaattcccttaacctagatgccaatgagccacctattgacttacctcaaaaacccctctctgcgtataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacatatcagaggaactctggtccaattgtaccagctgatgggtacgatgggtatttttctaggatactgtaccaattacggtaccaagaactatcacaacgccactcaatggagagtcggccttggtctttgctttgcctgggctacattcatggttagtggaatgatgtttgtaccagaatcaccacgttacctgattgaggttggtaaagatgaggaagcgaaacgttcactatcgaaatccaacaaagtctcagttgacgatccagccttgctagttgaatatgacactataaaggcaggaattgaacttgaaaagctggcaggtaacgcatcatggtctgaactactctccactaaaacaaaggtctttcagcgtgttctcatgggagtgatgatccaatcgctgcagcaattaaccggtgacaactacttcttttactacggtaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttacgtattcttaggctgtctggtttttgcatacttttatgtctttttctttgtcccagaaacaaaaggcctgacactggaggaggtgaatactatgtggctggaaggtgtgccagcatggaaatcggcctcatgggtgccaccggagagaagaaccgcagattacgatgctgatgcaatagatcatgacaatagaccaatttacaagaggttcttttccagctga

SEQ ID NO: 3966 - DNA, 1704 bp, Saccharomyces cerevisiae
atgtccggtgttaataatacatccgcaaatgatttatccactaccgagtctaactctaactcagtagcaaatgcaccatctgtaaaaactgagcataatgactctaaaaactccctcaacctggatgccactgaaccacctattgacttacctcaaaaacccctctctgcatataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacaaatcagaggaaccctggtccaattgtaccagctgatgtgtacgatgggtatttttctaggatactgtaccaattacggtaccaagaactatcacaacgccactcaatggagagtcggccttggtctttgctttgcctggactacattcatggttagtggaatgatgtttgtaccagaatcaccacgttacctgattgaggttggtaaagatgaggaagcgaaacgttcactttcgaaatccaacaaagtctcagtcgacgatccagccttgttagcagaatatgacactataaaggcgggaatcgaacttgaaaagctggcaggtaacgcatcatggtctgaactactctccactaaaacaaaggtctttcagcgtgttctcatgggagtgatgatccaatcgctgcagcaattaaccggtgataactacttcttttactacggcaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttatgtattcttaggctgtctggtttttgcatacttttatgtctttttctttgtcccagaaacaaaaggcctgacgctggaggaggtgaatactatgtggctggaaggtgtgccagcatggaaatcagcctcatgggtgccaccagaaagaagaaccgcagattacgatgctgacgccatagaccatgacgatagaccaatctacaagaggttcttttccagctaa

SEQ ID NO: 3967 - DNA, 1707 bp, Saccharomyces cerevisiae
atgagctctcaaaaggtttttggtattactggacctgtttccaccgtgggcgccacagcagcagaaaataaattaaatgatagtttaatccaagaactgaaaaaggaaggatcgttcgaaacagagcaagaaactgccaatagggtacaagtgttgaaaatattgcaggaattggcacaaagatttgtttatgaagtatcgaagaagaaaaatatgtcagacgggatggcaagggatgctggtgggaagatttttacgtatgggtcctatagactaggagtccatgggcctggtagtgatatcgatactttggtagttgttccaaaacatgtaactcgggaagatttttttacggtatttgattcactactgagagagaggaaggaactggatgaaattgcacctgtacctgatgcgtttgtcccgattatcaagataaagttcagtggtatttctatcgatttaatctgtgcacgtctagaccaacctcaagtgcctttatccttgactttatcagataaaaatctactgcgaaatctagacgagaaggacttgagagctttgaatggtaccagagtaacagatgagatattagaactggtaccaaagccgaatgttttcagaatcgctttaagagctattaagctatgggcccaaagaagggctgtttatgctaatatttttggttttcctggtggtgtggcttgggccatgctagtggctagaatttgtcaactataccctaacgcctgtagcgcagttatattgaacagatttttcatcattttgtcggaatggaattggccacaacctgttatcttgaaaccaattgaggatggcccgttacaagttcgtgtatggaatccaaagatatatgcccaagacaggtctcatagaatgcccgtcattacaccagcttatccatcaatgtgtgctacccataacatcacggaatctactaaaaaagtcattttacaggaattcgtaagaggcgttcaaattacgaatgatattttttccaataagaagtcctgggccaatttattcgaaaaaaacgattttttctttcgatacaagttctatttagaaattactgcatatacaaggggcagtgacgagcagcatttaaaatggagtggtcttgttgaaagtaaggtaaggcttctagttatgaaactggaggtgttagctggaataaaaattgcacatcctttcaccaaaccctttgaaagtagttattgttgtccaaccgaggatgactatgaaatgattcaagacaaatacggtagtcataaaactgagacagcactgaacgcccttaaactggtaacagatgaaaataaagaggaagaaagtattaaagatgcaccaaaggcatatttaagcaccatgtacataggccttgactttaatattgaaaacaaaaaggaaaaagttgacattcacattccctgcactgaatttgtgaatttatgtcgaagtttcaatgaggattatggtgaccacaaagtattcaatctagccctccgcttcgtaaagggttacgatttgccagatgaagttttcgatgaaaatgaaaagagaccatcaaagaagagtaaaaggaagaatttagatgctagacatgaaaccgtgaagagatctaaatcagatgctgcttcaggtgacaacatcaatggcacaaccgcagctgttgacgtaaactaa

SEQ ID NO: 3968 - DNA, 1707 bp, Saccharomyces cerevisiae
atgtcacttagattgccacaaaatcccaacgcgggattgtttaaacaaggctacaatagttactctaacgccgatggccaaattattaaatcaattgcggccattcgcgaattacatcaaatgtgtttgacttctatgggaccctgtggtagaaacaagatcattgttaaccatctcggtaaaatcattattaccaacgacgcggccaccatgctaagagaactagatattgtccatcctgcagtgaaagtcctcgtaatggcgactgaacaacagaagatcgacatgggagacggtacaaatttagtcatgattttggctggcgaactattaaatgtgtccgaaaaactgatttcaatgggcttgtctgccgttgagattattcaaggttataatatggcaaggaagtttactttgaaagaactagacgaaatggttgttggtgaaattactgacaagaatgataaaaacgaacttttgaaaatgattaaaccagtcatctcctccaaaaagtacggatctgaagacatattgagtgaacttgtttctgaagctgtatctcacgttttaccagttgctcagcaagctggagaaattccttattttaatgttgattctatcagagtagtaaagattatgggtggatcgctttccaattctaccgtcatcaaaggtatggttttcaatcgtgagcctgaaggccatgtaaaatcattatccgaagataaaaagcataaagttgcagttttcacttgtccgcttgacatagccaatactgaaacgaaaggcactgttttattacataatgcacaagaaatgctcgatttttctaagggcgaggaaaagcaaatagatgccatgatgaaagagattgccgacatgggcgtagaatgcattgttgcaggtgctggtgttggtgaattggcgttacattatttgaatagatacggtatactagtcttgaaggtaccaagcaaattcgaattaagaagattatgtcgcgtttgtggggccactccattgcctagattaggtgcgccaactccagaagaattaggtttagtggaaactgttaagacaatggagataggtggtgatagagtaactgtgttcaaacaagagcaaggtgaaatttcaagaacatctactatcattttaagaggtgccacacagaataatttggatgatattgaaagagccattgatgatggtgttgcagccgtcaagggactaatgaagccatcaggcggtaagttgttgcctggtgctggtgctaccgaaattgaattgatttctaggataactaagtatggtgaacgaacacctggattgctacagttagctataaaacagtttgccgtggcttttgaagtggttcctcgtaccctagcggagaccgctggtcttgatgttaatgaggtactaccaaacttatacgctgcacataacgtaactgaacctggtgcagttaagacagatcatttatataaaggtgtggatattgatggcgaatctgatgaaggtgtaaaggacatcagagaggaaaatatttatgacatgcttgcaacgaaaaagtttgctattaacgtcgctacagaagctgcaactactgtgctttccattgaccaaattatcatggcaaagaaggcgggtggtccaagagcacctcaaggcccaaggccaggtaactgggaccaagaagactga

SEQ ID NO: 3969 - DNA, 1707 bp, Saccharomyces cerevisiae
atgtctgatcaagaacgaggttcagaaaacgtatgtttcattgataagggaggtgaagaaaagtttgtaaaatgagactttatgaggtcattggaattaaatagacatcaacgaatggtgagtcaccatttaatgctgccttcaaaacgcttgcttcaatgtgattccactggttaaagggggttttttgaatgcattgctaatgtttatctactggctatgaaagtgagaatatcaattataaataaaaccctgattttctacctgccatgctataatgtacagtttattccaactttgaaacgcaatgacttattggtctctctcattatgaaatttagttacttttactaatgttattcattgttgtagaataatcgaagtagatcgaggtcgagatcacctgttcgtcgtcggatgagtgatgatcatggttatgaaagagacaaccatttgtcccggaggtcaggtaattataacggtaggcgtaagttcgcagatacgtacagaggaagcagagatagaggagaatatagaggaggtagagaaaggtctgattacagagaaagagaaaggttcaataacagagataatcctagatctagagaccgttacgatgataggcgcagaggaagagatgtgactggtcgttatgggaacagacgtgatgactatcctagaagctttaggagtagacacaatacacgtgatgacagtaggagaggcggttttggtagtagtggagcaagaggtgattacggtcctttgttggcacgtgaattggatagtacatacgaagaaaaggtcaatagaaactattccaatagtatattcgtgggtaatttaacatatgacagcacccccgaagatctcactgagtttttttcacagataggaaaagtagtccgcgcggatataattacatcaagagggcaccacagaggtatgggtacagtagagttcactaattcggatgatgttgacagggccatccgccagtacgatggggccttcttcatggatcgtaaaatcttcgtcaggcaagataatccaccaccgtcaaacaatatcaaggaaaggaaagcactcgatagaggagagcttagacataaccgaaaaacacatgaagttattgtaaaaaatttacctgcttccgttaattggcaggctttgaaagacatattcaaggaatgtgggaatgtcgcacacgctgatgtggaattggatggcgatggagtatccactggatctggtacggtgtccttttatgatattaaagatctgcatagagcgattgagaaatacaacggttatagtatagagggtaacgtcttggatgtcaagtctaaggaaagcgtacataaccacagtgatggagacgatgttgatatcccaatggatgattctcccgttaacgaagaagctcgaaaatttaccgaaaacgttgtcggtggaggtgaaagaaatagactcatatattgcagtaatttgccattttcaactgcaaaaagtgatctttacgaccttttcgagacaatcggaaaggttaacaatgctgaattaaggtatgattccaaaggggcaccaactggaatagctgtcgttgaatacgataacgtcgatgatgcagatgtttgtattgaaagattgaataattataactatgggggttgtgatttggatatatcgtacgctaaacgcctctag

SEQ ID NO: 3970 - DNA, 1707 bp, Saccharomyces cerevisiae
atgtcttcattatatactaagttggttaaaggggcgaccaaaataaagatggcccctccaaagcaaaaatatgtggaccctattctctcgggcacttcgagcgcaagaggattgcaagagattacccacgcattggatataaggttgtctgatacagcctggaccattgtttataaggcattgattgtgttgcatctgatgatacaacaaggcgaaaaagatgtcacgctaaggcactattcccataatttggatgttttccaattgagaaagatttcgcatactactaagtggtcttccaatgatatgagggctttgcagagatacgacgaatacctaaaaacacgttgtgaagagtatggcaggctaggtatggatcacctacgagacaattactcctcgctaaagctgggcagtaagaaccagctttcaatggatgaagagctagatcatgttgaatcattggaaattcaaattaatgccttgataaggaataaatactctgtttcagatttagaaaaccatttgttattgtatgcattccaattgttagtacaagatttactaggtctgtacaatgctcttaatgaaggtgtcattacacttttagaatcattcttcgaattgtccattgagcacgcaaaaagaacactggatctctataaggatttcgtggatatgacagaatatgttgttagatacctaaaaataggaaaagctgtcggtttgaaaatccccgttatcaaacatattactacaaagttaattaactcccttgaggagcatttgagagaggaaacaaaaagacaaagaggtgaaccttctgaaccgcagcaagatagaaaaccatctacggccattagctctaccagtagtcacaataacaacagcaatgacaagaataagtctatagcgcagaagaaactggaacagataagggaacaaaaaagactgctggagcaacaattacaaaaccaacagttgctcatttcccccacggtcccacaagatgcttacaacccatttggatcacaacagcaagatttaaataatgacaccttttcattcgaaccaacccagccacaaatgaccgctcaagtccctcaaccaactgctaaccccttcttgataccgcaacaacagcaacaggctttacagttgacatctgcgtctacaatgccacaaccaagtgagatacagattactccaaatttgaataatcaacaaactgggatgtatgcttctaaccttcaatacaccccaaatttcaccggctcagggttcggcggatacacgaccaccgagaacaatgcaattatgaccggcactttagatccaacaaaaacggggtctaacaacccattttcgctagaaaatattgccagagaacagcaacaacaaaatttccaaaactccccaaatccttttaccctccaacaagcacaaaccaccccgattcttgctcatagtcaaacaggtaatccatttcaggctcaaaacgtggtgacatcaccaatgggcacatacatgacgaatcccgtggccggtcaacttcagtatgcctctactggtgcgcagcagcaaccacaaatgatgcagggtcagcaaacagggtatgttatggttcccactgcgtttgtccccatcaatcaacaacagcaacaacagcagcatcagcaagaaaatcctaacttaatagatatatag

SEQ ID NO: 3971 - DNA, 1707 bp, Saccharomyces cerevisiae
atgtttctggactattctggatatgaggctcttactgaaatcaactcttcctttggaaagtatgttcttctattgcaacaatttgaaggctgtcgaagtttgaaagatcggcttcaaatgcttaaggatctggggagggaatttatgatattcgagaacttgaatgtggaagatttcagagaatctaaaaatatgattcacagattttatactatggttatttctttaagacagattatggaaattgggcccttagtcaggcgtagccctgctgttttagttgtggaattcgattgtccggtagaggattgcctagatgaactggatccgttgcatccattgaacagggcctttatatttattcataaacaatggacctattatcatcaatattatatagttgaaaaggtaaaaaaggtgattcttgatatggccccggtaaaggaagatgattggagcatccttcacaaggttgtttattcagaaggttttgtcgaaagacgatataaaaagaagaaatacctcggtgatatttacattccacaaccattaatgaaaagcaataaaatcactactatctcaaatttttcccaacttaccaaaatttccaacgtcagagtttacagattcaacgctacagcagcgtgtgatccgcagaacttgaacaaaaaaaacttgagtatcaaagagcttaaagataaagaccttcctaatcttatttggactttagaaccagaaaaattctatgttgacatgagaccttacaaggaacacgaggaaaggaaaaaacggagagaagaagaagccaaggtgaggatgcaaggtgaggaacaggagaacattatgatagagagaaaaaaaatggatagtattgaagttgaagcgtcatcaggattgaaaaatatcataaaaacacctctcgctaatagggttgtcaatacttttaataactgcgctgctgtggtaataggctatgtaacagaagtggataaagtaaaggatgacaatgaagagaaaaataacgacagacctaaaattgcgaacgacggaatagctcaaaagtctagaagcgaaagtgaagataatgcaggaacaccgatggaaaacgcgtactttcaacctgaaccccaagataatgaccaaaacaacatatcttggaataccactatgaaagatattgatccaatttacatgagtgaaagatgtgctagagtttggagaaaggagcaacaaatgctaggattggagaaggctcagacatttgagaaaaaatattgtaaagatcagatggttatggacgaaaatcaggtcgaagaacctggtaagcactcggagagacatacaaaaaatcaggtagttagacctaggaccaaaatagcatcttccgccagtaaaaatgataatagtaataataaaaatagtaaatcatgcaaaaattgccataaagaggaagcgcacggtctagtgagagaataccttaagattaaactcaacatatcacctcatggagaaaggaatcagcgaacaaaggacaagagaaaatgtataatgaaatacaatgcgagcagtaacaacatcaacaaaatgcctggggagagtgaagtacttgggtcaactattttaacagatatccactttaaggatgtcgtaactgtgaaatttagggattttaaagccaaatttagaaaagtcaaaataaacgcttga

SEQ ID NO: 3972 - DNA, 1710 bp, Saccharomyces cerevisiae
atgaaactgaaaactgtaagatctgcggtcctttcgtcactctttgcatcgcaggttctcggtaagataataccagcagcaaacaagcgcgacgacgactcgaattccaagttcgtcaagttgccctttcataagctttacggggactcgctagaaaatgtgggaagcgacaaaaaaccggaagtacgcctattgaagagggctgacggttatgaagaaattataattaccaaccagcaaagtttctattcggtggacttggaagtgggcacgccaccacagaacgtaacggtcctggtggacacaggctcctctgatctatggattatgggctcggataatccatactgttcttcgaacagtatgggtagtagccggagacgtgttattgacaaacgtgatgattcgtcaagcggcggatctttgattaatgatataaacccatttggctggttgacgggaacgggcagtgccattggccccactgctacgggcttaggaggcggttcaggtacggcaactcaatccgtgcctgcttcggaagccaccatggactgtcaacaatacgggacattttccacttcgggctcttctacatttagatcaaacaacacctatttcagtattagctacggtgatgggacttttgcctccggtacttttggtacggatgttttggatttaagcgacttgaacgttaccgggttgtcttttgccgttgccaatgaaacgaattctactatgggtgtgttaggtattggtttgcccgaattagaagtcacttattctggctctactgcgtctcatagtggaaaagcttataaatacgacaacttccccattgtattgaaaaattctggtgctatcaaaagcaacacatattctttgtatttgaacgactcggacgctatgcatggcaccattttgttcggagccgtggaccacagtaaatataccggcaccttatacacaatccccatcgtaaacactctgagtgctagtggatttagctctcccattcaatttgatgtcactattaatggtatcggtattagtgattctgggagtagtaacaagaccttgactaccactaaaatacctgctttgttggattccggtactactttgacttatttacctcaaacagtggtaagtatgatcgctactgaactaggtgcgcaatactcttccaggatagggtattacgtattggactgtccatctgatgatagtatggaaatagtgttcgattttggtggttttcacatcaatgcaccactttcgagttttatcttgagtactggcactacatgtcttttaggtattatcccaacgagtgatgacacaggtaccattttgggtgattcatttttgactaacgcgtacgtggtttatgatttggagaatcttgaaatatccatggcacaagctcgctataataccacaagcgaaaatatcgaaattattacatcctctgttccaagcgccgtaaaggcaccaggctatacaaacacttggtccacaagtgcatctattgttaccggtggtaacatatttactgtaaattcctcacaaactgcttcctttagcggtaacctgacgaccagtactgcatccgccacttctacatcaagtaaaagaaatgttggtgatcatatagttccatctttacccctcacattaatttctcttctttttgcattcatctga

SEQ ID NO: 3973 - DNA, 1710 bp, Saccharomyces cerevisiae
atgaaggatttaaaattatcgaatttcaaaggcaaatttataagcagaaccagtcactggggacttacgggtaagaagttgcggtatttcatcactatcgcatctatgacgggcttctccctgtttggatacgaccaagggttgatggcaagtctaattactggtaaacagttcaactatgaatttccagcaaccaaagaaaatggcgatcatgacagacacgcaactgtagtgcagggcgctacaacctcctgttatgaattaggttgtttcgcaggttctctattcgttatgttctgcggtgaaagaattggtagaaaaccattaatcctgatgggttccgtaataaccatcattggtgccgttatttctacatgcgcatttcgtggttactgggcattaggccagtttatcatcggaagagtcgtcaccggtgttggaacagggttgaatacatctactattcccgtttggcaatcagaaatgtcaaaagctgaaaatagagggttgctggtcaatttagaaggttccacaattgcttttggtactatgattgcttattggattgattttgggttgtcttataccaacagttctgttcagtggagattccccgtgtcaatgcaaatcgtttttgctctcttcctgcttgctttcatgattaaactacctgaatcgccacgttggctgatttctcaaagtcgaacagaagaagctcgctacttggtaggaacactagacgacgcggatccaaatgatgaggaagttataacagaagttgctatgcttcacgatgctgttaacaggaccaaacacgagaaacattcactgtcaagtttgttctccagaggcaggtcccaaaatcttcagagggctttgattgcagcttcaacgcaatttttccagcaatttactggttgtaacgctgccatatactactctactgtattattcaacaaaacaattaaattagactatagattatcaatgatcataggtggggtcttcgcaacaatctacgccttatctactattggttcattttttctaattgaaaagctaggtagacgtaagctgtttttattaggtgccacaggtcaagcagtttcattcacaattacatttgcatgcttggtcaaagaaaataaagaaaacgcaagaggtgctgccgtcggcttatttttgttcattacattctttggtttgtctttgctatcattaccatggatatacccaccagaaattgcatcaatgaaagttcgtgcatcaacaaacgctttctccacatgtactaattggttgtgtaactttgcggttgtcatgttcaccccaatatttattggacagtccggttggggttgctacttattttttgctgttatgaattatttatacattccagttatcttctttttctaccctgaaaccgccggaagaagtttggaggaaatcgacatcatctttgctaaagcatacgaggatggcactcaaccatggagagttgctaaccatttgcccaagttatccctacaagaagtcgaagatcatgccaatgcattgggctcttatgacgacgaaatggaaaaagaggactttggtgaagatagagtagaagacacctataaccaaattaacggcgataattcgtctagttcttcaaacatcaaaaatgaagatacagtgaacgataaagcaaattttgagggttga

SEQ ID NO: 3974 - DNA, 1710 bp, Saccharomyces cerevisiae
atgactgatcgtaaaaccaacttgccagaagaaccgattttcgaagaggcagaagatgatggctgcccttcgatagaaaattcttcacatctgtcagtacctacagtggaggaaaacaaggacttttccgagtataatggggaagaggcagaggaagttgttgttccagaaaagcctgcttcagcctatgctactgtttctatcatgtgtttatgtatggctttcggtggatttatgtccggttgggacacaggtacgatttctggtttcgtcaatcagactgattttttaagaagatttggtaattatagccattccaagaacacttactacttatctaatgtgagaactgggttgattgtgtccatcttcaatgtgggaagcgccattggctgtcttttcttgtctaaattgggtgatatttacggccgctgcatgggtttgattatagttattgtcgtttatatggttggtattgtcattcaaattgcctctatagataagtggtatcagtattttattggaagaattatcgctggtataggtgctggttccattagtgttcttgccccgatgcttatttcggaaactgcgccaaagcatatcagaggtacgttgctagcttgttggcaattgatggtgactttcgcaattttcttgggttattgtaccaattatggtaccaagacttactcgaattctgtccagtggcgtgttccgcttggtctatgttttgcatgggctattattatgattggtggtatgacgtttgttccggaatctcctcggtttttggtgcaagtcggtaagattgagcaagctaaagcttcttttgccaagtcgaacaagcttagtgttgacgatcctgctgtggttgcagagattgatcttcttgttgctggtgtggaggcagaagaagcaatgggaactgcttcatggaaggaattattttcgagaaagactaaagtttttcaacgtttaacgatgacagtcatgattaactctctgcagcaactaaccggtgacaactatttcttctactacggtactactatcttcaaatctgtcggtatgaatgactcttttgagacttcaattgtcttgggtattgtgaattttgcttcttgcttcttttcactttattctgttgataagttgggccgtcgtagatgtcttttacttggagcagccaccatgacggcgtgcatggttatttacgcctccgttggcgtcacaagactatatccgaacggtaaaagtgaaccatcatctaaaggtgctggtaattgtacgattgttttcacgtgtttttacattttctgcttttcctgcacctggggacctgtatgttatgtgattatttctgaaacatttccattaagggtgagatccaagtgtatgtccgttgcaacagcggccaacttattgtgggggttcctaatcgggtttttcactccttttattacttcggcaattaatttctactacggttacgttttcatgggttgcttagcgttttcatatttttacgtctttttctttgttccagaaacaaaaggtctaactttagaagaagttgatgagatgtggatggacggtgtattaccttggaaatctgaatcctgggtaccagcttctagaagggatggtgattatgataacgaaaaattacagcatgacgagaaacccttctacaaaagaatgttttag

SEQ ID NO: 3975 - DNA, 1710 bp, Saccharomyces cerevisiae
atgatgaccaaagctttttttaacaaactaccgtttgaggtattccgtcggtacgttaggacaggtaaaagcatccctcaaagaagccccaggacaagaaaatctcttctggtgggtgggactattgcatcagcagtagttttgtacaactttaatgacacttttcatgattctgtaaagcacacggcactgacgactaaaagaatcgctgtcgtcacacaagctaccactcgttgcttctaccattacaagagggctctaaataaaagctatgagaacaaaaaagaacgagaagttgccttaaataaatgtcataagatgtgtgccttaatcacgttgcatgcgctacgatcgaatggtgggatatatatcaaattaggccagcacattggggccatgacctacctgttgcctaaagaatggacggatacaatgataccgttgcaagaccactgtcccgaatccacctacgaagaaattgatgagttatttaaagaagatctaggcaccagcattgaggatatgtttttagaattcaacaaaaccccgataggtgtagcttccttggcacaggttcatgtggcaaaactaaaaaatagtgacggtaaaggttctagtgtagctgtcaaatgtcagcatccatcgttgaaggagtttataccattagatgttatgctgacaagaacagtgtttgaactgctggatgtcttcttccctgattatccgttaacgtggcttggtgatgagcttcagtcttcaatctacgtggaactgaattttaccaaagaagctgaaaatgcagaaaaaacccgtcattattttagtaagttcaagaagcaaacagcattgaaaatacccaaggtcattgaaagccacaaaagaattttgattatggaatatgttggaggcaaaaggttggatgatttggagtacattgacagtcacggtatctcgcgcagtgaagtttcgagttgtctctctcatattttcaataacatgatttttactcccaatgtaggtattcattgtgatcctcatggaggaaatctggccatacgatctgttaagcccgctaaagataatggataccataactttgaaattgttttatttgaccacggactctatagatatcctagcacgagaacaagaagactttatgccaaattttggttgtcgctcctattcgacaaggaccagacaaaaatgaagaagtatgccaaaggattcgcaaacatcaccgacgaacagtttccccttttagcggctgcaattacgggccgtagcattgatgctgctttgaattacgacatttcaacgagtcgaacacaagaagaaatggacgtcatggcaaatgggatcttggaaggaacgttactgagcgacttgatgagcattttgtctagaatccctcgtgtagtgcttttgatattgaagactaacgacctaaccagacatcttgatgaatgtctacagaatccactcgggccagagaggactttcctgatcatgacgcaatactgcgccaagacggtctacgacgaaaaagtggaaagaattaattcggagtatgcgaggtggtctattaaatggatgtgggagaacttgacaaactggatagtctatgagaggcgtattaatcaattgtatttttatgattttgtgttgtggtggaaaaaatttattccgaagacttggttgtcatcttaa

SEQ ID NO: 3976 - DNA, 1710 bp, Saccharomyces cerevisiae
atgtcatttcaaattgaaacggttcccaccaaaccatatgaagaccaaaagcctggtacctctggtttgcgtaagaagacaaaggtgtttaaagacgaacctaactacacagaaaatttcattcaatcgatcatggaagctattccagagggttctaaaggtgccactcttgttgtcggtggtgatgggcgttactacaatgatgtcattcttcataagattgccgctatcggtgctgccaacggtattaaaaagttagttattggccagcatggtcttctgtctacgccagccgcttctcacatcatgagaacctacgaggaaaaatgtactggtggtattatcttaaccgcctcacataatccaggtggtccagaaaatgacatgggtattaagtataacttatccaatgggggtcctgctcctgaatccgtcacaaatgctatttgggagatttccaaaaagcttaccagctataagattatcaaagacttcccagaactagacttgggtacgataggcaagaacaagaaatacggtccattactcgttgacattatcgatattacaaaagattatgtcaacttcttgaaggaaatcttcgatttcgacttaatcaagaaattcatcgataatcaacgttctactaagaattggaagttactgtttgacagtatgaacggtgtaactggaccatacggtaaggctattttcgttgatgaatttggtttaccggcggatgaggttttacaaaactggcatccttctccggattttggtggtatgcatccagatccaaacttaacttatgccagttcgttagtgaaaagagtagatcgtgaaaagattgagtttggtgctgcatccgatggtgatggtgatagaaatatgatttacggttacggcccatctttcgtttctccaggtgactccgtcgcaattattgccgaatatgcagctgaaatcccatatttcgccaagcaaggtatatatggtctggcccgttcattccctacctcaggagccatagaccgtgttgccaaggcccatggtctaaactgttatgaggtcccaactggctggaaatttttctgtgctttgttcgacgctaaaaaattatctatttgtggtgaagaatcgtttggtactggttccaaccacgtaagggaaaaggacggtgtttgggccattatggcgtggttgaacatcttggccatttacaacaagcatcatccggagaacgaagcttctattaagacgatacagaatgaattctgggcaaagtacggccgtactttcttcactcgttatgattttgaaaaagttgaaacagaaaaagctaacaagattgtcgatcaattgagagcatatgttaccaaatcgggtgttgttaattccgccttcccagccgatgagtctcttaaggtcaccgattgtggtgatttttcatacacagatttggacggttctgtttctgaccatcaaggtttatatgtcaagctttccaatggtgcaagattcgttctaagattgtcaggtacaggttcttcaggtgctaccattagattgtacattgaaaaatactgcgatgataaatcacaataccaaaagacagctgaagaatacttgaagccaattattaactcggtcatcaagttcttgaactttaaacaagttttaggaactgaagaaccaacggttcgtacttaa

SEQ ID NO: 3977 - DNA, 1713 bp, Saccharomyces cerevisiae
atgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatctagaagaggtgccaactacgacgctgaagaaatggctcacgatgataagccattgtacaagagaatgttcagcaccaaataa

SEQ ID NO: 3978 - DNA, 1713 bp, Saccharomyces cerevisiae
atgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatccagaagaggtgccaactacgacgctgaagaaatgactcacgatgacaagccattgtacaagagaatgttcagcaccaaataa

SEQ ID NO: 3979 - DNA, 1713 bp, Saccharomyces cerevisiae
atgaaagaatcccctctcataacgttggttaaaagacattccgagacacattttgccaatatcaagtatgggtattatgtgttgataatatcattggtctatctcattggattggctcttttgagagctttcggaaggagaaccccatccagatcgtcgtcagctttcaaaaataagataatttatcggttgtatgatatagatcctgcaattcacttaggtatattgttttttgcagtcttgattccattttattaccattactctttgactacccaatctacggtctatctcaaaagattagggaggttgagttacgccttgatcccgctgaacctattcctcactttaaggcctaattggttccttaggaaaaattgcacctacactgattttataccgttccataaatggttttcacgtattatcaccgtgattggtttgcttcatgggattttcttcatcattaagtgggcgatagacgataatgtctctctaaagcaaaaattgattctgaaaactttcaattttgcgggattcataatatcaatattggtactttttttacttatttgctcgattgggccaatgagaagatacaactatcgtttgttttacatcgtacataacctggtgaacgtggccttcatcttactcaccccaatacactctaggccaggtgttaagttcccatttcttctactaaactgtaccctattattcattcatattatcaatagaatagtatttgcgaaatccttgatgattttgaataagaatgcgaattattcaaaaacaaatttagtccatgtaagattgcccagggctattcttccagattattttgaaccagggtcgcatattagaataagcccttacagaagaattaatcccctctattggttgctaccatcgcatccatacacaattgcgtctttggcagaagacaattcaattgatcttattataaaggaaacctctacagccgagccaggtagccagatagagtctcttcgtagtaatccaaaatcctttcatttagatcaagaaaaaacctatactttgattaatagttatcctccctctgtacccgaagaatgttattctcaaggcacgaatatagctattatatgtggtgggtctggtatatcttttgccctaccactatttaggcatttttttaacaaggagaatgtaaaatacttgaaaatgatctggctgataaaagattactctgaatatgaacttgttttggattatctcaagacaaatgggttgacttttgagaaaaaactctcgaataataagaggatttcagtatttattagtggagaatacacggcggaaacacggttagacgaaattacgaccaatatcgacgatgaaaactcagaatatgaaatgggatctttcaacaatgaagacgaagacctttcgatttctaatttcaattcagaaaatgcggacagcaatgacaatacgccagagacaagtcatagccccacaaaagagaatggaagcatgatcgaggtaaaatccaaacacagttttactctttccaacgaattgaagagcttcaacaatgaaagtgcacaagtgaaccaaaatgaaacatggttgttttcatgtggtcctccctcgttattacaattgtctaaaaaatattgtaacgatgaaaggatcaactttgtctgtgagacttacggattatga

SEQ ID NO: 3980 - DNA, 1713 bp, Saccharomyces cerevisiae
atgaattcaactcccgatctaatatctcctcagaaatccaattcatccaactcatatgaattggaatctggtcgttcaaaggccatgaatactccagaaggtaaaaatgaaagttttcacgacaacttaagtgaaagtcaagtgcaacccgccgttgcccctccaaacaccggaaaaggtgtctacgtaacggtttctatctgttgtgttatggttgctttcggtggtttcatatttggatgggatactggtaccatttctggttttgttgctcaaactgattttctaagaagatttggtatgaagcaccacgacggtagtcattacttgtccaaggtgagaactggtttaattgtctctatttttaacattggttgtgccattggtggtatcgtcttagccaagctaggtgatatgtatggtcgtagaatcggtttgattgtcgttgtagtaatctacactatcggtatcattattcaaatagcctcgatcaacaagtggtaccaatatttcattggtagaattatctctggtttaggtgtcggtggtatcacagttttatctcccatgctaatatctgaggtcgcccccagtgaaatgagaggcaccttggtttcatgttaccaagtcatgattactttaggtattttcttaggttactgtaccaattttggtaccaagaattactcaaactctgtccaatggagagttccattaggtttgtgtttcgcctgggccttatttatgattggtggtatgatgtttgttcctgaatctccacgttatttggttgaagctggcagaatcgacgaagccagggcttctttagctaaagttaacaaatgcccacctgaccatccatacattcaatatgagttggaaactatcgaagccagtgtcgaagaaatgagagccgctggtactgcatcttggggcgaattattcactggtaaaccagccatgtttcaacgtactatgatgggtatcatgattcaatctctacaacaattaactggtgataactatttcttctactacggtaccattgttttccaggctgtcggtttaagtgactcttttgaaacttctattgtctttggtgtcgtcaacttcttctccacttgttgttctctgtacaccgttgaccgttttggccgtcgtaactgtttgatgtggggtgctgtcggtatggtctgctgttatgttgtctatgcctctgttggtgttaccagattatggccaaacggtcaagatcaaccatcttcaaagggtgctggtaactgtatgattgttttcgcatgtttctacattttctgtttcgctactacctgggccccaattgcttacgttgttatttcagaatgtttcccattaagagtcaaatccaagtgtatgtctattgccagtgctgctaactggatctggggtttcttgattagtttcttcaccccatttattactggtgccatcaacttctactacggttacgttttcatgggctgtatggttttcgcttacttttacgtctttttcttcgttccagaaactaaaggtttatcattagaagaagttaatgatatgtacgccgaaggtgttctaccatggaaatcagcttcctgggttccagtatccaagagaggcgctgactacaacgctgatgacctaatgcatgatgaccaaccattttacaagagtttgtttagcaggaaataa

SEQ ID NO: 3981 - DNA, 1713 bp, Saccharomyces cerevisiae
atggaaggtttcttcaggatacccctcaagcgggcaaatttacacggaatgttgaaggctgctatatccaaaattaaagcgaattttaccgcgtatggtgcaccaagaatcaatattgaggatttcaatatagtcaaggaaggaaaagcagaaattcttttccctaaaaaggaaactgttttctataatcccatccaacaatttaatagagatctaagtgttacatgcatcaaggcgtgggacaacctatatggtgaggaatgtggccaaaagagaaataataaaaaaagtaagaagaaaaggtgcgcggaaactaacgatgattcttccaagcgtcaaaaaatgggaaacgggtcaccaaaagaagccgttggtaattctaatcgaaacgaaccttatataaatattttggaagcattgtcagccactgggttaagagccattaggtatgctcatgaaattccccatgtgagggaagttattgctaacgatttacttccagaggctgtcgaatctataaaacgaaacgttgaatataatagtgtcgaaaacattgtcaagccaaaccttgatgatgctaatgtcttaatgtaccgtaacaaagcgacgaataataagtttcacgtcatcgacttggatccttacggtaccgttacaccttttgtagatgcggctattcagagtattgaggagggtggtctaatgctggtaacttgcactgatttatccgttttggccggtaacggatacccagaaaagtgttttgccttatatggtggtgcaaatatggtttctcatgaatcaactcacgaaagtgcgctgagactagtattgaacttactaaagcaaactgccgcgaaatacaagaaaactgtggaaccgcttttgtcgttgagcattgacttttacgtcagagtttttgtcaaagtcaaaacaagcccgattgaagtcaaaaacgttatgtcaagtactatgactacttaccattgttcccgttgcggctcttaccacaatcaacctctgggcagaatttctcaacgcgaaggtaggaacaacaaaacattcaccaaatactcggttgcgcaagggcctccggttgatactaaatgtaagttctgcgaggggacataccatttagctggtccaatgtatgcaggacctctacacaacaaggagttcatcgaggaggtgttgagaattaataaagaagagcatcgtgaccaggatgatacatatggaacacgtaaaagaattgaaggtatgctatctctagctaagaatgaattatccgattcgccattctatttcagtcctaaccatattgcatcggtaataaaattacaagtacctcccttgaaaaaagtagtcgcaggcctaggttccctaggctttgaatgttcattgacacatgcccaaccatcgtccctaaagactaacgctccatgggatgcaatctggtatgtgatgcagaaatgtgatgatgagaagaaagacttaagcaaaatgaatccaaatactacgggctataagattttatcggcaatgccaggatggttgagtggcactgtcaaatcagagtatgactcaaagctgtcgttcgcaccaaatgaacaaagcggtaatattgaaaaactaaggaagctaaaaattgtgagatatcaggaaaatccaacaaagaattggggcccaaaagcccgtcccaacacttcataa

SEQ ID NO: 3982 - DNA, 1713 bp, Saccharomyces cerevisiae
atggacagcgtgtcaaaccttaagagcacaaattttcagaacaataatgacccaaaagaatctgtagaagaagcagtgctaaggtatgtgggagtcgacttgaagaatcatattaaaaagacaaagaagaaattgaagaaacagaagaagagaaagcatggttcaaaaatgtctcatgaagatgaagacactgatatggattggtatttgaaaacatcgggttcaaaagatttacgtaaagtggatgatatcgaaccaaattctgttgctgtagcagctgttgctgccgcatacaacagctcaatgagagaaaaagataagaggagctgtcataaaaaatcttctaatagtagatcagagaggaagaagcaccgtaaaagaaaaagctctaaagaaagaaaagccaaaataaaaatggtcctagatccgcagctgactacactggacgatggcataacgacaacagcatttttacctgatgatctcattgctgaaacagcttttgataagtatgttgatactgaaaaggcatacctagctaaacatccaagtaaatcgttagaagttaatgaggatgataaagaaaacaactttaataacaatagcagcacgctggttagaatttataccgatttagaggggataccaaatgacggcagctacataaagcgcactccaaagataccagaaaaggatgtgaaatcagacgacttgatattggcaccagaagaaaacaatggagataccgcattactgcgatccgatattgtgaaagcgtcagtaattgacggtgctatcacaaaatccatcggtaagaagttcactcccagcgaggaaaatgctttggaccaattcatcgaagaatacatgaaaataagaggcttggatagacgccaaatgtgcgagagaatttggtctacagacggagtcattagagatgggttttgggcaaatatcagcaaagttttaccttatagaacaaggtcctcaatatataaacatataagaagaaaatatcatattttcgaacagcgtgggaagtggacgccagaggaagatcaagaattggcaagattatgtttagaaaaagagggtcattggaccgaagtaggcaaattgttaggcagaatgcctgaagattgtagggaccgttggagaaactatatgaagtgtggttcaaagcgaggttctaaaagatggtcgaaagaagaagaagaattgttgactactgtagtaaatgaaatgattgaagaggcacaccaatatcaaaggatgaaggcattggaggctgccaacaaaaatgatagatacaatcaaatgtattctaggggtccaaagggaaagagaattagcgataatcctaccttcaaagatatgatcaattggactgtcgtcagtgaacgcatgagcggaactagatcccgtatacagtgccgctataagtggaataaattagtaacagatgaagcagccagaagtatgttgagcattcctgtttctgaaaggaagtggctgctagaacgattgaaacagctacctaaaacgtcctattcaaatatcgactggaacagtatagctacctacaagcccggatatcctcgaactggtcttgaactgagattatgttacgagcagatgagagaaaagattcatgactttaaaggaaggtcaacagctgaaataattgattcattgttggaacaaatcaattaa

SEQ ID NO: 3983 - DNA, 1713 bp, Saccharomyces cerevisiae
atggttgccgctttaacgtatttgcctactgagcttatccaaaggatatttgagttcactgtggtggaaacagactctcaatattggttgtacaatttagtggctctaattgatttttctgtctcttcgagaggtggtggctctataacggaagacttcttgacaaattacgttaggaagaatttgatggttttagatctgacctgtgaggccacgcaagactcgattttacgagcggagtacgggtttctgaagagattgttgccatacattgacatggacgcacaatatatcagagttgttgatttggaaaccaatgctgacaaggcccagaatttaaaagcagaaaaacttattgttatatttgacgaattctcagatttgaaactcatagaaaccttcttccccttggcgaattccaattcaaacataatcgagttcgtattctgtgttcgcaatataaagagttcgttttattcacctttggaaaaattacatattgcgaacatagtcgcagatattgatattaacacattgtatctggacttcgtggattcaaatatctattcggatcaaaatttctttgggatttttgatcccgatatttttcagctgattaataaaaactatagaaacttcttttctaagactaacgaaaaggggaagaaaagaccccccatttgcaagaaaatctgttttccctttgttgaaacattgaatttggattatatggcccttgattcattctttaattcgatactgcataaactaacaacaaagataaaaacatttgaaaggaacaatgagtttgacgtggataaaaatttaaatttaaactcgacaacgacagtagcagctttaattatcaagtcgatcttgcaacaattcttcaacaattttcatatcagcttccctaatttggttaccttgaattttattaagatgtctacctacccaaacaataatgagattacccaatgttgtaacttcatagatttatcttcatatgttctaaacaaatgtttaagtgagaatatctcgataaatttcctctttcagttgcactctttgaaaaattggtcaatgcccaagattaaagaattcactgggcacaaattcaagtatgacgaaacaacattttcaggttcaccagaaaggtacatcaaatcattgaggggaaacattaaaattttgcaagaaatggcaattaacgaaaccaacgatggtacttgctatttcagagtcaagttgatacctgagggggtagaaaaaactcaaataatcaactggatcccctttacttcttcatttagcgatgataccttcaaacaaagacaccatttaaagaggccaatgatttgcttgaagaacaactctttaagatcgctcactgtcaaaatcatacgtattgaaaaatgttcatccatccgaatccagggattttacctaccaaatctgcaggaactgttcatcaacaataccctttgcgacaccacccaacaccaaaaacaagcgtcaaatgatatgagttgtatagagttcacttcatggaatgaactaccacaatgcaagaaattgggatttgctcaattagaggacgactctaactacgttcttaatatcagtaacctacaagaccatttaccaaatctggacctgcgggagagtttcccaactttcttcgatataagacagaagtttgtcgtggtttga

SEQ ID NO: 3984 - DNA, 1713 bp, Saccharomyces cerevisiae
atgtcacttctaatagattctgtaccaacagttgcttataaggaccaaaaaccgggtacttcaggtttacgtaagaagaccaaggttttcatggatgagcctcattatactgagaacttcattcaagcaacaatgcaatctatccctaatggctcagagggaaccactttagttgttggaggagatggtcgtttctacaacgatgttatcatgaacaagattgccgcagtaggtgctgcaaacggtgtcagaaagttagtcattggtcaaggcggtttactttcaacaccagctgcttctcatataattagaacatacgaggaaaagtgtaccggtggtggtatcatattaactgcctcacacaacccaggcggtccagagaatgatttaggtatcaagtataatttacctaatggtgggccagctccagagagtgtcactaacgctatctgggaagcgtctaaaaaattaactcactataaaattataaagaacttccccaagttgaatttgaacaagcttggtaaaaaccaaaaatatggcccattgttagtggacataattgatcctgccaaagcatacgttcaatttctgaaggaaatttttgattttgacttaattaaaagcttcttagcgaaacagcgcaaagacaaagggtggaagttgttgtttgactccttaaatggtattacaggaccatatggtaaggctatatttgttgatgaatttggtttaccggcagaggaagttcttcaaaattggcaccctttacctgatttcggcggtttacatcccgatccgaatctaacctatgcacgaactcttgttgacagggttgaccgcgaaaaaattgcctttggagcagcctccgatggtgatggtgataggaatatgatttacggttatggccctgctttcgtttcgccaggtgattctgttgccattattgccgaatatgcacccgaaattccatacttcgccaaacaaggtatttatggcttggcacgttcatttcctacatcctcagccattgatcgtgttgcagcaaaaaagggattaagatgttacgaagttccaaccggctggaaattcttctgtgccttatttgatgctaaaaagctatcaatctgtggtgaagaatccttcggtacaggttccaatcatatcagagaaaaggacggtctatgggccattattgcttggttaaatatcttggctatctaccataggcgtaaccctgaaaaggaagcttcgatcaaaactattcaggacgaattttggaacgagtatggccgtactttcttcacaagatacgattacgaacatatcgaatgcgagcaggccgaaaaagttgtagctcttttgagtgaatttgtatcaaggccaaacgtttgtggctcccacttcccagctgatgagtctttaaccgttatcgattgtggtgatttttcgtatagagatctagatggctccatctctgaaaatcaaggccttttcgtaaagttttcgaatgggactaaatttgttttgaggttatccggcacaggcagttctggtgcaacaataagattatacgtagaaaagtatactgataaaaaggagaactatggccaaacagctgacgtcttcttgaaacccgtcatcaactccattgtaaaattcttaagatttaaagaaattttaggaacagacgaaccaacagtccgcacatag

SEQ ID NO: 3985 - DNA, 1716 bp, Saccharomyces cerevisiae
atgaatgatcctcgtgaaattttagcggttgatccgtacaataatattacttctgatgaagaggatgagcaagccatcgcgagagaacttgaatttatggaacgaaagaggcaggccttagtggaacgattaaaaagaaagcaagaatttaagaaaccccaggatcctaattttgaagccatcgaggtacctcaatctcctaccaaaaaccgtgtgaaagtggggtctcataatgctacacaacaaggcacaaaattcgaaggttcgaatattaatgaagtaaggttatctcaattacagcagcaaccaaaaccaccagctagtacaaccacatactttatggagaaatttcaaaacgcaaagaagaacgaagataaacaaattgccaagtttgaaagcatgatgaatgcaagagtacatacgttcagtaccgatgagaagaaatatgtgccgataatcacaaacgaattagaaagcttttcaaatctttgggttaaaaagaggtacatacctgaagatgacttaaaacgggctttgcatgagatcaaaatccttcggttgggcaaactttttgctaaaattcgcccacctaaatttcaagagcctgaatacgccaactgggccaccgtaggcctcattagccacaaatcggacatcaaatttacatcatctgaaaagccagtcaaattcttcatgttcaccataacggactttcagcatacactagatgtttatatcttcgggaaaaagggtgtagaaagatattataatcttcgcctgggtgatgtgatagcaatattaaacccagaagtactaccatggagaccctcagggcgaggaaattttatcaaatccttcaaccttcgaattagtcatgacttcaaatgtatcctggagataggttcaagtagagatttaggttggtgtcccatagtgaataaaaagactcacaaaaaatgtggctctcccattaacatatctcttcataagtgttgcgattaccatagagaagtgcaatttcgtggaacaagtgctaaaagaattgaattaaatggtgggtacgccttgggcgcgcctacgaaagtggactctcaaccaagcctatataaggccaaaggggaaaacgggtttaatataatcaaaggtactcgtaagcgcctgtcagaagaggaggaaagacttaaaaagagctctcacaattttacgaatagtaattctgccaaagcatttttcgacgagaaatttcagaatccagatatgctggcaaacttagacaataaaagaaggaaaataatagaaactaagaaatcgacagcactgagccgcgaactaggcaaaattatgagaaggagggaatccagcggattagaagataagagcgtcggagagcgacagaaaatgaaacgaaccacagaaagtgccctccagacagggcttatccaacgcctaggattcgatcccactcatggaaaaatttcccaagtactcaagtcttctgtatcagggagcgaacctaagaacaacttactcggtaaaaaaaaaactgttataaacgatctcttgcattacaagaaggaaaaagtcattctcgcaccttcaaagaacgaatggttcaagaaaagaagccatcgcgaagaagtttggcaaaaacatttcggatccaaggaaactaaagaaacttctgacggtagtgccagcgatcttgagataatataa

SEQ ID NO: 3986 - DNA, 1716 bp, Saccharomyces cerevisiae
atgacggatgaaaaagtgaactcagatcagaatatgaacggtaagcagggagttaacttaatttcatccttgcctacaacacaagtgccggtttcaattttgaccaacaaggagagaagaaaaagtattcacgatgaatcaaatttcgaaagatctgatagtcatgaagatcaatcaaaatccaactctaataggaggaatatttacaaaaacgattatagcacaaatttgagggatttctcttttgccaatctgaagcaaaatagtgaaaggaacaaagatggccatgaaatacagatcaacaccagtatgccagctaatacaaatggccagcaaaaaaggttttcaccttcattaccttctgctgtttcatttacggtgcccgaggtggaaaggttgccgtatcatagatattcgatatccaataaacctggaaagcagcagcagcagcaggaacaactgcagcaaaatcaacaacaagaagagcagcaaaaggcacaactgcaggagcaaaatcaacgagcaaaacagcaagaagaggtgaagcaaattcaggagcaagtgcaaaaaaagcaaactgaaagacagcaactgatagacgaaaaggagaggatagcgaatgcaatatttaaggagaacactactaatgatggtactgatatcaggaaacattcggtatcgagtggtacgagcaatagcgaagatgaagtagattcaccttcgatggaaaaaaattctatcgttcatatgccaggtgattttatctacttcaatcccaagtcaaacgcttctaaacctatcactgcaaaggcggcgccattatcggctaataactccacacataaaaacaaggaagttatcactgcacccacagggcctcgtgtacccttcacagagttctttcagaaggaagacgacaagaaattccacattctcattggtgcgacgggctcagttgccacaataaaagtacctctaattattgataaacttttcaagatatatgggcctgagaaaatctctattcagttgattgtcacaaaacccgctgagcattttttgaaagggctcaaaatgtcaacacacgttaaaatttggagggaggaagacgcttgggtattcgacgctgtgaataagaatgatactagcttgagtctgaacttgatattgcaccatgaattaagaaaatgggctgatattttcctgattgcgcctttgtcagctaacacacttgctaaactggccaatggtatatgtaacaatttgctaacttctgtgatgagagattggtcaccactgaccccagtgttgattgcgcctgcaatgaatacattcatgtatatcaatcctatgacaaagaaacacctgacgagtttagtgcaagactatccgttcatccaagttttgaaaccggtggaaaaggtattaatatgcggagatattggtatgggtggtatgagagaatggacagatattgtagagatcgttaggaggagaatcaatgaaatacggaaagctagggacgaggaaactggtgataaagagcaagaacaagaagaacaagagggtgctgacaatgaggacgacgatgatgaggatgacgaagaggatgaggaggacgaggaggaggaagaagctctaaatgaaacagcatccgatgagagcaatgacgaggaagacgaagaggatgaggaagacgtgaaaaccgaagtttaa

SEQ ID NO: 3987 - DNA, 1716 bp, Saccharomyces cerevisiae
atgagaagctctggcacatatgagaatgatccttctggggaaataacctcaacttccccaaagcagtcgaagcagaaaaagcctaccaaatttagggaaagaatgcgcaggtggttacaaaatgggaaaaataacaaccaccaaggagaggaggatgttcctgaaatatttaacaagaatttttatccgcaaacaggcatgacagctttcaacaataatgataatggtgaggttcaggatgttacaaacaatttttttttgcccagtgaagatgaatctggtccagttcaaagtagtgttaaaacttttttaactggtaacaatgatgaagattctaacttccaacaaaaccagaatcctaaacaaaagtccgaacttccaaagtcaccttaccggcaaaaacctacgcaagaaatagcattattgaaagatcttttcgttaccaacaaatatgacgatccctatttgaattcttccacaaggtttggtaacataacttcaacttttcccagtagtttgtcattgaggactgtcaccttacaaacaataaaaaaaagaattgactgtatttctgcaaaaaaaaaagaagtgtggaagacagaggaaaaatttctaaaagatatcttaatgtggttacagagttcaaattttgaagaccctgatacaatatcattaatacatgaaattgaaaaaatatttgaagaggatatccattttgaacaaaacgtgtcggattgcttaaaagaaatctcaaataatttcgaatatatctgcatgcgagaaacccaattgataaacgaaggaaacatactaaaaaatgacttaaaaaagtacgcaaaagcaagggaacataaaggcgaaaagcatgaagatactgaagtcttgagggaaaaagtaatatcatcacaaaaatcgtttgatgttacaaagaggcactataagcatgcaatttcaataacgacaagacagctatttatgaatttggcgtttgagtactacgaaaattgttcagatatgaaggatatttcgagaaaatacctacaagaatctttgtccactttacaaactatcgacacattgagtttttcggaagaattagaaaaaattagaaagagaagatttgataagttttgggcaaaaactaatcctgatccaacaaacaatattcaaaagtttgttaatatgagaacaggagtagcaggttttaatgattccttaatgaatcacttgtacgggaaactaagtttcggggtagcgccagttgaagaagaattacaaaactcacagccggagcacactgatgtgcctgaaaatgtttggaatgaggttctctctgattataattcaatggatggtaatccaattacttcaaataaattcctttctgcgaaagaacttgagcccgatcaattagttgaacttctcgctcaggaaaaagaagagaaagaggcaaaaaatatcagctcttcaactgcagaagttccatcgatatcgcaacctgaaataaagaaggagaatctcgaatcaaatgattccttgattttaagaagcacgaaaagaaatgtaaatgtcaatgccgctagtttgaggaatctttccattaaaaaaactcaagtcaaaccggagtctgcaagtgaagaaagcaaagttcttgctgcagctttaaatgatgcaaaacaaaacttggatgaaaacgtctggagaactcctatctaa

SEQ ID NO: 3988 - DNA, 1716 bp, Saccharomyces cerevisiae
atgagtatgtcaagcaaaaacgagaataagatatcagtagaacaaagaatatccactgatatcggtcaggcttaccagttacaaggccttgggtctaacctaaggtcgattcgctccaagactggtgccggtgaagtgaactatatcgatgctgctaaatctgtaaatgataaccaactgcttgcagagatcggttataaacaagaattaaaaagacaattttcaacattacaagttttcggtattgcgttctccattatgggtctattgccctccattgcatctgtgatgggtggtgggctcggtggtggtccagcaacattagtgtggggttggttcgttgctgcgtttttcattttactggtgggtattaccatggctgaacatgcaagttccattcctaccgctggtggtttgtactactggacgtattactatgctccagaaggttataaagagattatttcttttattattggttgctcaaactccctagcgttggcagccggtgtgtgttccattgattacggtttggctgaggaaattgctgctgctgtcacattaaccaaagatggaaattttgaagtaacgagtgggaaactttacggtatatttgctggagcagtggtggttatgtgtatttgtacatgtgttgcttctggggccattgctcgtctgcagacgctaagtatatttgccaatcttttcattattgttttattgttcattgcgctaccgattggtaccaagcatagaatgggaggtttcaatgatggtgactttatatttgggaaatatgaaaacttaagtgactggaataatggttggcaattttgtcttgctggtttcatgcctgctgtctggactattggttcctttgattcatgtgtccatcaatctgaagaagccaaagatgccaagaaatcagtccccattggtataatctcatctattgctgtttgttggattttaggttggttgattattatttgtttaatggcctgtatcaaccctgatattgacagcgttttggactccaagtacggctttgctttggctcaaataatttatgattcgttaggaaaaaaatgggccattgcatttatgtcattgatcgcattctgtcaatttctaatgggtgcttccattaccacagctgtttctagacaagtttgggcattttcccgtgataacggtttgcccctatcaaagtatattaaaagagtggattctaaatactcggtcccttttttcgctattttggctgcctgtgtaggttccttgattttaggattgttatgtttgattgatgatgccgccactgatgcattatttagtctggctgttgcaggaaacaatttggcatggagtacccctacagttttccgtttaacatcaggtagagatttatttagacctggtccattttatttgggtaaaatctggtctccaattgttgcttggacaggtgttgctttccaattgttcattattattttggttatgttcccctctcaacaacatggtattactaaatccacaatgaattatgcatgcgttattggtcccggtatctggatccttgcaggtatctactacaaagtttacaagaagaaatactaccacggtccagcaaccaatttgtcggatgatgattatactgaagccgttggtgctgatgttatcgacacaattatgtccaaacaggaaccataa

SEQ ID NO: 3989 - DNA, 1716 bp, Saccharomyces cerevisiae
atggattctagaacagttggtatattaggagggggacaattgggacgtatgattgttgaggcagcaaacaggctcaacattaagacggtaatactagatgctgaaaattctcctgccaaacaaataagcaactccaatgaccacgttaatggctccttttccaatcctcttgatatcgaaaaactagctgaaaaatgtgatgtgctaacgattgagattgagcatgttgatgttcctacactaaagaatcttcaagtaaaacatcccaaattaaaaatttacccttctccagaaacaatcagattgatacaagacaaatatattcaaaaagagcatttaatcaaaaatggtatagcagttacccaaagtgttcctgtggaacaagccagtgagacgtccctattgaatgttggaagagatttgggttttccattcgtcttgaagtcgaggactttggcatacgatggaagaggtaacttcgttgtaaagaataaggaaatgattccggaagctttggaagtactgaaggatcgtcctttgtacgccgaaaaatgggcaccatttactaaagaattagcagtcatgattgtgagatctgttaacggtttagtgttttcttacccaattgtagagactatccacaaggacaatatttgtgacttatgttatgcgcctgctagagttccggactccgttcaacttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaacttgcgaaagagcattggcgactccaggttcctcagtgtacttatatggaaaagagtctagacctaacagaaaagtaggtcacataaatattattgcctccagtatggcggaatgtgaacaaaggctgaactacattacaggtagaactgatattccaatcaaaatctctgtcgctcaaaagttggacttggaagcaatggtcaaaccattggttggaatcatcatgggatcagactctgacttgccggtaatgtctgccgcatgtgcggttttaaaagattttggcgttccatttgaagtgacaatagtctctgctcatagaactccacataggatgtcagcatatgctatttccgcaagcaagcgtggaattaaaacaattatcgctggagctggtggggctgctcacttgccaggtatggtggctgcaatgacaccacttcctgtcatcggtgtgcccgtaaaaggttcttgtctagatggagtagattctttacattcaattgtgcaaatgcctagaggtgttccagtagctaccgtcgctattaataatagtacgaacgctgcgctgttggctgtcagactgcttggcgcttatgattcaagttatacaacgaaaatggaacagtttttattaaagcaagaagaagaagttcttgtcaaagcacaaaagttagaaactgtcggttacgaagcttatctagaaaacaagtaa

SEQ ID NO: 3990 - DNA, 1719 bp, Saccharomyces cerevisiae
atgctatcaaaatcagaaaaaaatgtcgacctcttggcaggcaatatgagcaatttgagtttcgatgggcatgggactcctgggggcactggactatttcctaaccaaaatataacaaagaggaggacaaggcctgcgggtatcaatgattcaccttcgccggtaaaaccatccttttttccttacgaagatacttccaacatggacatagacgaagtatctcaacctgatatggatgtctcgaactctcccaagaagcttccaccaaagttttacgaaagagcaacttcaaataaaacacagagagttgttagtgtttgcaaaatgtactttctagaacattactgtgatatgtttgactatgtaattagtagaagacaacgcacgaagcaagttctagaatacctgcaacagcaaagccaacttccgaattctgaccagattaaactcaacgaagagtggtcctcttacttacaaagggaacatcaggttttgagaaaaagaaggttgaaaccaaaaaatagggattttgaaatgatcacacaagtaggtcaaggtggttatgggcaagtttatttagccagaaagaaagacacaaaagaggtgtgtgctttgaaaattttgaacaaaaaactattgtttaagctcaacgagacaaaacacgttttaactgaaagagatatcctaaccacgacaaggtctgaatggttagtaaaacttctgtatgcattccaagacctacaaagtttatacctggctatggaatttgtaccaggcggtgattttcgtacattattaataaatactagatgcttgaaaagtggccatgcgagattttacatcagtgaaatgttttgcgctgttaatgcgttacatgatttaggctatacacatagagatttaaagccggaaaacttcttaatcgatgccaagggacatataaaattaacagattttggtttggctgctggtacgatttctaatgaaagaattgaaagtatgaagataaggttagaaaaaatcaaggacctggaatttccagcgtttacagagaaatctatagaagatagaagaaaaatgtacaaccagttgagggagaaggaaattaattatgcgaactccatggttgggtctccggattatatggctttggaggttttagaaggaaagaaatatgactttactgtggattactggtcgttgggttgtatgctgttcgaaagtttagttggttatacaccatttagtggatcatcgactaatgagacctatgacaacttaaggcgctggaaacaaactttaagaagaccgagacaatctgatgggagggcagcattctccgatagaacttgggatttaataacaagattgattgccgatccaatcaatcgattaagatccttcgaacatgttaaacgcatgtcttattttgcagatataaactttagtactttgaggtcaatgatcccgccttttacaccccaactagacagcgaaactgatgccggttattttgatgacttcaccagtgaggctgacatggccaaatatgctgatgttttcaaaagacaagacaaattaacggctatggtagatgactcggcagtatcatcaaaacttgttgggttcactttccgacatagaaatggtaaacagggttccagtggcatcttattcaacggactggaacactcagaccccttttcaaccttttactag

SEQ ID NO: 3991 - DNA, 1719 bp, Saccharomyces cerevisiae
atgctgaggaattgtttgaggaaattgggaaatcatcaaacgaaatgttcggtaaaaacgttacacaccccaatctatagaacaaaaaaccttcaggttctcagagatacgctctctggtattaagctgttggaaaaaataataacttcatcctcctacaataaaacattgatatatgaacctaagtataaatccaagccacaggtcgttagttctcatgataccatgagacttcacaatgtaatgcgtgagttactagattccctacaagtagatgaagctaccaacacacgacttcaatcaaacaggcctcgaaagctggggagggttggtctacaattattcatggattgcattcaggacaacttaacagcaacttcaacatctttgacatgctctttactggagcactatttcaagtatcccgaaaaagaagtgaccaatgggatcaaggccggattacgatatatcagagattttcttgcgaagaacaagattatagtgaaaagtcaaaacgatgttgatgctctggtcgagcaattgactatgtcctcctcagacagccaaagcatcaaaagggttttgaaagccattaattatgaattgttttcggatgacattgtgcgggtcataaacggcaacaaaacttacgatgaggttgatgtatccaagggttggaaatatccagctggtattttagatagtaatgaagcctatttaaggtccctggagttgcctactaagaaattagtttccattgataaagatatgctagttcttatgtatgatgggacgttacgagacgctaataaaattctacccacgataacgtatgcaagaaagttgagaaaatctgttctcttaatcgttaacggagattgcacaggtgatgcattaacatccgttacaattaacaataacagaaacaagagagaaaataatgaaagccgaatagtggttttgaagtactctaaaaaggcgaacaatgacttagcgccacaggagaatcttgattttataaagttcttacggttgccttgcggatatgacagcatctactcaccagaatatagtcctttagtgccaagcaaaatgtgtgcggataaatattacggcagtatcgaatccataaaagcgaccacaggggaggcattcttatataactccattgatgctgaagcgattccaaataaagttccgaaatccttcctccaaaatacggtcactttaagcattggtggacataacgaaatcgaaatcgacagaagaagaaatgcaatagataattgcttaaataacgtcctatgtcatgggctggccaaaggtttcatcccaggttacggcatctccctactgaaggcaattccaggtttgaatgaactgaaagcaaatgaacccaatttcatgactaaggtaggcatcaatgctgttttatcagcagttattctcccatcagaagtggcgtttaagaatgcatatgggtacaactattatgagatcaatagcctgatagcaggcgctataaacgaaaaatcgtttccaatggccaagttttctccaaattcagaaccggtgaacacagtaaaggatggaaacttggagccatggagcaaaatggattcttgtttagccggtgtagaaacgttcattgaattacttacaagctgtaatacaattatcacatgtgtatacaaaaagcctgaacggcacaaagcctag

SEQ ID NO: 3992 - DNA, 1719 bp, Saccharomyces cerevisiae
atgggaagcgaaccgtttcagaaaaagaatttgggtctgcaaattaattcgcaagaaagtggaacaacccgctcaacatttcattcgctagaagatctaggagatgatgtaattaatgaaagctgggatcaggtgaaccaaaagagagccaatatagatcatgatgtctttcatgagcaccctgactcttccccatcattgtcagcacagaaagcaaaaacaaaagaagaggaagttgctgtaaagtcatcgaactcccagtcaagagacccttctcctgatactcaagcacatattccatatacttatttttccaaggatcaaagactaatcatttttggaattatcatttttataggatttttgggcccaatgtctggaaacatatatataccggctttaccattgctgcaaagggaatatgatgtaagtgcaacaacaataaacgctacagtttctgtatttatggctgttttttccgttggtccattgttttggggcgcactggcggattttggtggaaggaaattcttatatatggtgtcgttatcactaatgttaattgttaatatacttttggccgctgtaccagtcaatattgctgccctttttgttttaagaattttccaagctttcgcttccagctctgtgatttctctgggagctggcactgtaacagacgttgttcctccaaaacacaggggaaaggccatagcgtatttcatgatgggtccaaacatgggtcctattatagcacccattgttgctgggcttattttaatgaaaggaaattactggagatggctttttggtttcacttctatcatgacaggaatagcattgatcttggttactgctttacttccagaaacgctacgttgtatagttggtaatggagaccctaaatggggtgacaaaaaagatgaacgtgaaaataacgaatctccattcttcgaaggtaataaaatatcacatcggcgtctgttcccagacattggtatccgtaaaccagtcaataatgatgctttcttccaagaaaattttccaaagccgcctaaagcaggtttgacactatattggaaaatgattaaatgtcctccaataataatcacgtccgtcagtactgcactcctgttctccagttactatgcgttcagcgtcacgttttcgtattaccttgaacatgactaccgttttactatgttagaaattggtgctgcttatgtctgcccaggtgtagctatgttactaggatctcaatctggtgggcacctctcagattatcttcgttcacgctggatcaaaagtcatcctaaaaagaaattcccggcagagtttcgtttattactgaacctaattggaattttactaacaatatgtggcacaataggatacggatgggcaatcttctttcattatcattttgtggttcttttagttttttccgctctcactgcctttggtatgacctggtgcagcaacacatcaatgacatatttaactgagttattccccaaaagagctgctggaactgttgctgttagtagtttctttcgaaatgtgggcgctgccattagttccgctatcattttacagctctgtaacgcaatgggaattggatggtgttttacagggctcggtctctgcagttcaatttcattgattggtatattatatcttctcatttttcaaagaaaatatactgccaaagaattttaa

SEQ ID NO: 3993 - DNA, 1719 bp, Saccharomyces cerevisiae
atggttatcatcctcctaggtctttgcacattaggttttccaagaacagcattctgtccctccataatgacaaattctacagtgagtattaacacgcctccaccatatcttactctagcttgtaatgaaaaattaccaacagttatgtcaattgctggatcagactcaagtggtggagccggtgttgaagctgatattaagactatcaccgcacacagatgttatgccatgacatgcgtcactactttgactgctcaaactccagtgaaggtgtacggcgctcaaaatataccaaagaaaatggtatctcaaatattagacgccaatttacaggacatgaaatgtaatgttattaagactggcatgcttacggtggatgcaatcgaagtcttgcacgaaaaacttttgcaacttggtgaaaatagacccaagttagtaattgatccagttctttgcgccgcttctgactcttctccaactggaaaggatgtggttagcttaatcatagaaaaaatttctccttttgccgacattttaactcctaacatttcagactgtttcatgttactgggcgagaacagagaagttagcaaactacaagacgttcttgaaatcgcgaaagacctttctagaatcaccaattgctccaatattttagtgaagggaggccacattccatgtgacgatggaaaagaaaagcatattactgacgttctttacttaggtgctgaacaaaaattcatcacttttaagggccaattcgttaatactacacgcactcatggcgctggatgcacactggcttctgctatagcatctaacttggctcgcggttattctctttcccaatctgtttatggtggtattgagtatgtacagaatgccatcgcaattggctgtgacgttaccaagaaagctgtgaaggttggaccaattaatcacgtttacgccgtagagattccattagaaaaaatgctcaccgacgaatgctttacagcatctgatgctgtacctaagaagccaatcgaaggttctcttgacaaaatccctgggggtagcttctttaattatctgataaatcatcctaaagtcaagccgcattgggatgcctacgtgaatcacgaatttgttaaaagagtggcagacggcacattggaacgcaaaaagttccagttttttattgaacaagattatttatacttaattgattatgtgagagtttgctgcgtcacaggtagtaaatctccaactctagaagatctagaaaaggaccttgttattgctgattgcgcccgtaatgaactaaatgaacatgaaagaagattaagagaagaatttggagttaaggacccagattacttacaaaaaattaagagaggtcccgcattaagggcctactgtcgttacctaattgacatttccagaagaggaaactggcaagaaatagttgtagccctcaacccttgtctaatgggttatgtttatgctgtagacaaagttaaggataagataacagcagcagagggttctatttatagtgaatggtgtgatacttgcgcgtcttcattttgctaccaagctgtgcttgaaggtgaaaggctcatgaatcacatcttggaaacatatcctccagatcaacttgattctttggtgacgatctttgcaagaggttgtgaattagaaactaatttctggaccgccgccatggaatacgaatga

SEQ ID NO: 3994 - DNA, 1719 bp, Saccharomyces cerevisiae
atgtctcccttaactagaaccgtagctataaagaaaacggttaaggttctatctaaatgtcaatctggtagagaatacacacagaagtttctccaacgtgcatattcaacatcacatgccaacagcacatactattcaaggacaaagctattcatatcatcacattctaaagctctaaacattgctctactaagcgggtccctactgttgacctactcctactattcccctaaaaagatcctctcccttgatacaattaacggaataaaagattattctacaaatactagtggtaacattaacatgccgtcacctaatccaaaaggaacagagacacaaaagagtcaacggtctcagaatgaccaatctgttcttatcttgaacgattctaaaatagaggctaaactacatgatagagaggaaagccattttgttaaccgtggcactggtatattcaggtatgatgtggcacagttgccctctaaccatccaatagaagacgatcacgtagaacaaatcattaccattccgatagaaagtgaggatggcaagtccatagagaaggatttgtatttttttggaatttttgatggacatggtggtcctttcacttcggaaaaattatctaaagatctagtccgttatgtagcgtatcaattaggtcaggtatatgaccagaacaaaacggttttccattccgaccccaaccaattaatcgattctgcaatttcgaaaggttttttgaaactagataatgatcttgtaatcgaatcgttcaggaagctgtttcaagatccaaacaacacaaatattgcaaacactttaccagcgatttctggttcttgtgcactattaagtttatacaactccactaactcaattttgaaagtggctgtcactggagactcaagggctttaatttgtggtttggacaacgagggcaattggacggtaaagtcgctatccaccgaccagaccggtgataatttggatgaagtacggagaattaggaaagaacatccaggagaaccaaacgttataagaaacggaagaatattgggttcattacaaccatccagggcatttggagactatcgctacaagatcaaagaagtcgatggaaaaccattatcggatttgcctgaagttgccaaactttattttagaagagagccaagggatttcaagacacccccatatgtcactgcggaaccagtgattacttctgccaaaattggtgagaacactaaatttatggtgatgggttcggatggtttattcgaattactaactaatgaagaaattgcttccttggttatcaggtggatggataaaaatatgaatctggcacctgtgaaggcagaaccggggaaattaccaaaagttatcgatgtatctgaagacaaggaagcacaaagaccggcattcaggtacaaggataataattcgagctcaccatcaggatcaaacccagagtatcttattgaagacaaaaacgtcgccactcatttaattagaaatgcattaagtgcgggcggaagaaaagaatatgtatcggcattggtaagtataccatcgccgatgagtagaagatacagagatgacttgacagtaacagtggcgttctttggtgattctggaacaccctcaattgtctccaatgctacttcaatagttatgaacccggaggcaacaacaaagccaaaacctagattatga

SEQ ID NO: 3995 - DNA, 1719 bp, Saccharomyces cerevisiae
atgtgtggtatctttgcagccttcaagcatgaagatattcacaacttcaaaccaaaagctctacaactatctaaaaaaatcagacaccgtggcccagattggtcaggaaatgccgttatgaattccaccattttcgttcacgagaggttggctattgttggtttagactccggtgcccagccaatcacttcagctgatggcgaatatatgcttggcgttaatggtgagatctacaaccacatccaactaagggagatgtgctctgattacaagtttcaaactttcagtgactgtgaacccatcataccgttatatttggaacatgatatcgatgctccaaaatatctggacggtatgttcgcattttgtctgtatgattccaagaaagaccgtattgtcgctgcaagagaccctatcggtgttgtcactttatacatggggcgttcttctcagtctccagagaccgtttattttgcctccgaattaaaatgtctaactgacgtttgtgacagtatcatttcgttccctcctggtcatgtctacgattctgaaacggacaagattactcgttactttaccccagactggttggatgaaaagcgtatcccatccaccccagttgactaccatgctatcagacacagtttagaaaaggccgttagaaagaggctaatggctgaagttccatacggtgttcttctatccggtgggctggactcttctttgattgctgcgattgctgctcgtgaaacggaaaaagctaatgctgatgctaacgaagacaacaatgttgacgagaagcaacttgcaggtatcgatgaccaaggccatctacacacatccggttggtctcgtttgcattcgtttgcgattggtctaccaaatgcacctgatttacaagcggctagaaaagtcgccaaattcattggttctatccaccatgaacacacttttacattacaagaaggtttggatgctttggacgacgtgatctaccatttggaaacttacgacgttaccactatcagagcttctacaccaatgttcttactatctagaaagattaaggcccaaggtgtcaaaatggttctttctggtgaaggctcggacgaaatattcggtggctatctatatttcgcacaagcaccttctgctgcagaatttcacaccgaatctgtgcaacgtgtcaagaacttgcatttggcagattgtttgagagctaataagtccacgatggcttggggtctagaagctcgtgttcccttcttagacaaagactttttgcagctatgtatgaacattgatccaaatgaaaagatgatcaagccaaaggaaggacgtatcgaaaaatacattttaagaaaggcattcgacactacagatgaaccagatgttaagccatacctacctgaagaaatcttatggagacaaaaggaacaattttccgatggtgttggctactcatggattgacggcctaagagacactgctgaaagggccatttctgacgccatgtttgccaatccaaaggctgattggggcgacgatattccaaccaccaaagaagcttactggtacaggctgaagtttgatgcttggtttcctcaaaagactgcggcagacactgtcatgagatggattccaaaggccgattggggttgtgccgaagatccttcaggtagatacgccaaaatacacgaaaagcacgtcagtgcttaa

SEQ ID NO: 3996 - DNA, 1719 bp, Saccharomyces cerevisiae
atgtgtggtattttcgccgctttcaggcacgaagacgtgcatagatataagccaaaggctctacaactatcaaaaagaatcagacaccgtggtccagattggtccggtaatgctatcaagaactccactatatttgttcatgaaagactagccattgtcggtgtggaatccggtgctcaaccaattacttcttcagacggagagtacatgctatgtgttaacggtgaaatctacaaccacattcaattaagagaagaatgcgcagactacgagtttggaacactgagtgactgtgagcctatcatcccaatgtacttaaagcacgatatcgacgctcctaagtacttggatggtatgtttgcttggactctttacgacgctaaacaagatcgtattgtggcagccagagacccaatcggtattacgacattatatatgggacgctcttccgcttctccaaagaccgtttattttgcatccgaactaaaatgtttgactgacgactgtgacactatcactgcattcccaccgggccacgtatacgattctaagactgacaagatcacccgttacttcacaccagattggctggacgaaaaacgcattccttccaccccaatagattacatggcaattagacactccttagaaaaagccgttagaaagagattaatggccgaagtcccatacggtgttctattgtcgggtggtttggactcctctttaatcgcttccattgctgcccgtgaaactgcaaaggccactaacgatgtcgaaccatcaacttacgatagtaaggcaagacatctagcaggtatcgacgatgacggtaagctacacactgctggttggacaagtctccattcctttgccatcggtttaccaaatgctccagatttgcaagccgcaagaaaggttgccaaattcatcggctctattcatcatgaacacacctttacattacaagaaggtttggatgctttggacgacgtgatctaccatttggaaacttacgacgttaccactatcagagcttccactccaatgttcttactatccagaaagattaaggcccaaggggtcaagatggttctttccggtgaaggttccgatgaaatcttcggtggttatctatatttcgcacaagctccttctgcggcagaatttcacactgaatccgtgcaacgtgtcaagaacttgcatttggcagattgtttgagagctaacaagtctacgatggcttggggtctagaagctcgtgttccattcttagacagagaatttttgcaattgtgtatgaacatcgatccaaatgaaaagatgattaaaccaaaggaaggacgtattgaaaagtacattctaaggaaggcattcgacaccacaggagaaccagatgctaagccatatttaccagaagaaattttatggagacaaaaagaacaattttccgacggtgttggttactcctggatcgacggattaaaagataccgccgaagcagtcatttcagatgaaatgtttgccagtccaaaggccgaatggggtagtgacattccaaccacaaaagaggctttctggtacagactaaaattcgatgctttgttccctcaaaagaccgtggctgacaccgttatgagatggattccaaaggccgactggggttgtgctgaagatccttctggtagatatgcccaaattcatgaaaaacatatcgaataa

SEQ ID NO: 3997 - DNA, 1719 bp, Saccharomyces cerevisiae
atgttgagatcatccgttgttcgtagtcgcgctactttaaggcctttattgcgtcgtgcttactcctctcataaagaattgaaattcggtgtagaaggaagagcctcccttcttaagggtgtcgaaactttagctgaagcggttgctgctactttgggtccaaagggtagaaacgttttaatcgaacagcctttcggtcctccaaagattactaaggatggtgttacagttgccaaatctattgtgttgaaggacaagtttgaaaatatgggtgccaagttactacaagaagttgcctccaaaaccaatgaggctgctggtgacggtactacttctgctactgtcttaggtagagccatcttcacagaatccgtcaaaaatgtcgccgctggttgtaaccctatggatttgagaaggggttctcaagttgcagttgaaaaagtgattgaatttttgagcgccaacaagaaagaaattaccacatctgaggaaattgctcaagtagcaaccatttctgccaatggggactctcatgttggtaagttactagcttcagctatggaaaaggttggaaaagaaggtgtcatcactatcagagaaggtagaacattggaagatgaacttgaggttactgaaggtatgaggtttgatcgtggttttatttctccatacttcatcactgatccaaagtcgagcaaggtggaatttgaaaagccattgctattgttgagtgaaaagaaaatttcttccattcaagatatcttgccagctttggaaatttccaatcaaagcagaagacctttgttgatcattgctgaagatgttgacggtgaagctcttgcggcttgtattttgaacaagttgaggggtcaagttaaggtttgtgctgtgaaggcgcctggtttcggtgataatagaaagaatacaattggtgatattgcagtcttgacgggcggtactgtttttactgaggagttggatttgaaaccagaacaatgtaccatagaaaacttgggttcttgtgactctattaccgttactaaggaagacaccgttatcctgaacggtagtggtccaaaggaagctattcaagagagaattgaacaaatcaaaggctccatcgacattaccaccacaaattcatatgagaaggagaaactgcaagagcgtttggccaaattgtccgggggtgttgctgtcatcagggtcggtggtgcatctgaagttgaagttggtgaaaagaaggaccgttacgatgatgctttgaacgctaccagagctgcagttgaggaaggtatcttgccaggtggtggtactgccttagtgaaggcatctagagttttggatgaagttgttgtcgacaatttcgatcaaaaattgggtgtcgatatcataagaaaggccattacaagaccagccaagcagatcattgaaaacgctggtgaagaaggttcagttatcatcggcaaattgattgatgaatatggtgatgattttgccaagggttacgatgcctctaagtcagaatacaccgacatgttagccactggtatcatcgatccatttaaagtggttagatccggtttagttgatgcttctggtgttgcctcactattagctactaccgaagttgctattgttgatgccccagaaccaccagcagctgctggcgctggtggtatgccaggtggtatgccaggaatgccaggtatgatgtaa

SEQ ID NO: 3998 - DNA, 1722 bp, Saccharomyces cerevisiae
atgcaagataccaaatactacgaaccaacaaatatttttcgtcagcctgctattaatataaagaagagatcagataaaaagaggattttacaatcgatgatgactttatccacatacaaaaaaacgtggcaaaacaatacttcgaaaatgaattcaccgattttgcgaaaagcatcagacaacttcaatgactattatacaactaaaaaattaaaatcagattattggaaactgtacggtgttgatgaaagtgagttatccataccttcagacatgtccattgtggataatatacttctagtatctacaatgaacgagaaagacaacttgaaactttttgaaatttccgctgagaaaaagctgaaggaactacagacgattactgttcccggtaaacccattacttgtatctgcttattgcccatggtagattttccgccacagattttccccagctctcaaataaatcctaaccacaaccaattaatattgacaggtcatcaagacggtatagtcaatctgatagcaacttcaacatataagggatgtgctaaaataataaaaaggtttaaccacaacaagtttctaaaatctaccgtatcaacgtcgattccgattctggaaataacgccaaaaacagcacctattttgaaggtttcgccatggaacaagaccggttttgtttcccttctaaatgactccctctttatatatgacttgaaatcaaatcttgattgcataaaaacacctatttttttgcaatcatatccaggtataaattcttttgccgttaatgaattccatgatcccttcttactggccttagttggctcaaaatttggaccaaatggcatctcgctgcttgatttgagaacaaatctctatattccagatattttagataatagcatatctgcaggatgtggaaaagaccatttgcaaagaaagaacacaagtttggattgcgtatggataagtaatcatcacgttgcacagagcttgaacgataaaattcaaatttgggacattcaatcctgcgacggtaaaccagtttgtgaattatatgctaagaaaggatacattgaaagtctaaaatttaacgaaaacacaggcgcgttatatagcagtgatgaccaaggctttgtcatttgttgggatttacaaaacctacaaaacatgaaatatggtgagttagtccatggatttaactcaattagcctagatagtgaaagtgaactactattaaccaagcaagtcttccaatgtggaaacattattgtgagtggtatgagtgataaaaatatttgcttgaagagcaatgacactaaggccaatggaaaaggatgtggatttttattccttgatatggcaaacgatggaagtttagtaactcttgacaatttttgtgaactgggattacatcaaatttgtcaagttcaattcaatgtcgataccggtaaaataatcgatggtaatggtactgggaagagtggaatatctgattcttctatgttatcattatccaatgagagtgaccatagtatgacagaaacatctgatgatatgttctcaaattctggtaattgggattgttcttcagcaaatactgttagcgaaggtagattgaatgatgaccaagaggatatcgtcttcacaaagaggatgtattctgtaaatgatgtgcatttaagtggatctactattgatactactgttgtctag

SEQ ID NO: 3999 - DNA, 1722 bp, Saccharomyces cerevisiae
atggatgaaactgtgaacatacaaatgtccaaggaaggtcagtatgaaatcaattctagctctataataaaagaggaggagtttgtagatgaacaatattctggggagaacgttacgaaggccatcaccacagagagaaaagtcgaggatgatgctgctaaggaaacagagagctcaccacaagaaagaagagaggtgaagcggaagttaaagcagcggcatatagggatgattgctctcggcggcaccattgggacgggcctcataattggtattggtccgccattggcacacgccggccctgttggtgccttgatatcgtatttatttatggggacagtgatttactccgttacacaatcgttaggagagatggtcacttttatcccggttacatcttcattttctgtcttcgcccaaagatttctgtcgccagcgctgggagcgactaacggatatatgtactggctgtcgtggtgtttcaccttcgcactggaactatccgttttggggaaagttattcagtactggacagaagcagtgcctctagcggcttggatcgtgatcttttggtgcctgttaacttcaatgaacatgtttcccgtaaagtattacggagaatttgagttttgtattgcctccataaaggtcatcgcgttgctcggttttatcattttctcattctgtgttgtgtgtggtgcgggacaatctgatggacccatcggtttcaggtactggagaaatccaggagcctgggggcctggcattatctccagtgataaaaatgagggccgttttctcggatgggtttcctctttgattaatgctgcatttacgtaccaaggtactgaactggttgggataaccgctggtgaagcggctaacccaagaaaagctctcccgagggcaataaagaaagttgtagtgaggattctagtcttttacattctttcactatttttcattggccttttggtcccatataatgacccaaagttggatagtgacggtatatttgtctcttcatcgccctttatgataagcattgagaattcaggcacaaaagttctcccagatatatttaacgcggtcgtgctaatcaccattctttccgcaggtaactctaatgtgtacattggctcaagagtactgtatagtctgtctaaaaatagcttggcgccaaggttcttgtctaacgtgaccagaggtggtgttccatacttttctgttctatctacatccgtgttcggatttttggctttcttagaggtttctgcaggcagcggcaaggcctttaactggttattgaacataactggtgtggccggtttctttgcctggcttttgatttcattttctcatatccgtttcatgcaagccataaggaaacgtggtatatcgagggatgacttaccttataaagctcaaatgatgccttttttggcatattatgcatcttttttcatcgctctaattgttctgatccagggcttcaccgctttcgcacctacttttcagcctatagactttgtcgctgcatatatatcaatattcctatttttggccatatggttatcattccaagtttggtttaagtgccgcttactctggaagctgcaggatatcgatatcgattctgaccgccggcaaatagaggagttggtatggatagagccagaatgtaaaacaaggtggcaacgagtttgggatgtcctttcataa

SEQ ID NO: 4000 - DNA, 1722 bp, Saccharomyces cerevisiae
atgggtgtttctgcggtgttgaaaagagctaggaatttactagcaacgttcatagtctgctgttttatggcagtagtgcttgttctggcgctggcacaccattttataaatgagcacagagacactaggagttcatcgacccaaatcgaagttgatgacgaaagtaaaagaaacgtacaccatgaccatgttctcactagaaccaatgcatacgcgacgccatacctcgatctggaacatgacaagaaaaacggtatcgtctacgatcatacaagaacggttgtccgtaaaaagaaccacgaagtggggtcctcgtcactgcataaaaacctttttcacaaatttttgacaaagcttatttttaggtttatcgagaaggaaaaagttaccgaaggcgtaacgcaaggaaagttcaataatagtagcaatgaaattgccaatcatgaaccggtttttgaaaaaattcctgtacagtgcgacaatccattacagaatctaatcttatcggaagacttgacattagttgcggatcttaattattattttaaccagtacaatattcaaatagaggaatttagattggagaccgaagatgggtttgttatagatttgtggcacttgataccaaaatatagaacgacagattctgacaagaagaagaggccacccattttgatgctacatggccttttgcaaagcagtggttcgttcgcatccaatggtagaaaatctctggcatattttctgtatcaatccggttacgacatatggttagggaataacagatgcgggtttaggccggaatggaacgaagcgaaagtaccgacactagcttccaggtgggactgggaccttcgcgagatggttaagtacgatctgacccttttgattgataccgtgttagctaagacgcagtttgaaaagcttactttgatctcgcattctcagggcactacacaggggtttatgggcttggtcaacgaagataagtttttccctcccggttcgggatctaaagaatcttttttcacttctaagatcgcaaactatattgccttggcccccgcagtgtatcctggtcccttacttaacgagaaattgtttgttaagcttatgacaaaggaaatcgaaaatccctggttctttggtgaaacgagcttttttgagataatgatgattgtaagaaacttgtgcgttggtgagagcttgttctcctttgtttgttacaccatcttcaattacctgtttgattggaacgataccctttgggataccgcattaagagatcgccatttcctgttttcgccagtccatgtttcagtgaagttgatgcaatggtggctgtcacccgaccccaacaaggtaagttttaaatttggttcccataagatgttccccgacaatgttaagtggttttcagacgcatcaaaggccccaaatatctacttgtttgttccaaagcaagatagattggtggacggagaaagactaatcaatcatttcgtcaatgtggagtcgaatgtcaactacaagatctggtacattgatgagtatgcccatattgatgtcctatgggcacatgatgtcatagagagaattggtaaaccaattttacagaatttgaacaactattactccaagaagccatccagcgcctttgaaagtgattgttcggacacagaggtggaaacggagctggaaatggttgctgagaaggcttga

SEQ ID NO: 4001 - DNA, 1722 bp, Saccharomyces cerevisiae
atgtcagatgttacccaacagaaaaagaggaaaagatccaaaggagaagttaatccatcaaaacccacagtagacgaagaaatcacagatccatcctcaaacgaagatgaacaactagaagtttcggatgaagaagacgcattggaatctgaagaagaattcgagggtgaaaatccagccgataaaagaaggaggcttgcaaagcaatatctggagaatctgaaaagcgaagctaatgacattttaactgataataggaacgctgaagaaaaagatttaaacaatctcaaggaaagaacaatcgacgagtacaacaattttgatgctggagatttggataaggatatcattgcgtccaggttaaaagaagacgttgctgaacagcaaggccgagtcttcagatattttggcgataaacttctaatatctgaagcaaaacagagctttaccagggtaggggaaaataaccttacttgcattagttgtttccaacccgttttaaacaaatacaccttcgaggaatcatctaatggcgataagaacaaaggtaggttatttgcctatacagttagcaaagacttacaactcaccaaatatgacattactgactttagcaaaagaccaaagaagctaaaatacgctaaaggaggagcaaaatatatacctacgagcaagcacgaatatgagaataccacagaaggccattatgacgaaatcttaactgtagcagcctcaccagatggtaaatatgttgtcacaggtggaagagataggaagttaattgtatggagcacagaatctctatcacccgttaaagttattccaacaaaggatcgccgaggggaagttttatcgttggcttttagaaaaaattctgatcagttatatgcatcctgcgcagattttaagataagaacatattcaataaatcaattttcccagttggagattctttatgggcatcatgatatagtggaagatatatctgcgttggcgatggaaaggtgtgttaccgttggtgcccgtgatagaacagctatgctttggaagattcctgacgagaccagactaacatttagaggtggcgatgaacctcaaaagctactaaggagatggatgaaagaaaacgctaaggagggagaagatggagaagtcaaatatcctgatgaatcagaggcacctttatttttctgcgagggtagtattgacgttgtgagtatggtggatgattttcactttataacaggctccgataatggtaatatatgtctatggtctctggcgaagaagaaacctatcttcacggaaagaattgcccatggtattttacctgagccctctttcaatgacatttcgggggaaaccgatgaagaattaagaaaaagacagttgcaaggcaagaaattgctacaaccattttggatcacatctctttacgctattccatattcgaatgtattcatatctggatcatggagtggatcgctaaaagtttggaaaattagtgataatctcagatcatttgagttgctaggtgaattatctggcgctaaaggtgtagttaccaagattcaggttgtagaaagtggtaaacatgggaaggagaagttccgtattttggctagtattgccaaagaacacagactcggtagatggattgcaaatgtttcaggtgccagaaatggtatatattcagctgtcattgaccaaacaggcttttag

SEQ ID NO: 4002 - DNA, 1722 bp, Saccharomyces cerevisiae
atgttacagcagggttcttcctcgaggaggagtttgcatggtaatgattttcacacgctcacttctccttcaaggagagactctttgagtattcctagggctgtggacgctagatctgcgtctacgattgatctgttctacataccggatgctaccgtctcaaggaggcactctactctggtggctaatagatcagacaataatggtaatggcgcaccgatgcgccagtacaataaacctaactttgcttcctcctcgacttcatctctgccttcaactagaaatcgcccctctcgctacgataacatgaatatgaatatgaatatgaatatgaacatgaacatgaacatgaacatgaacatgaacaaccatactaccagtgatcacaatgcgcacccgcaatatcgttgtagaccaaacccgtccagacgccactccttaatgaccattcccgaaaagtactctggtagtcgctacagtctccgatcatccccgcctacctattctaatccacgtgttaggaaggaacttactcctttccaattacaaagaaagcagatgaaaagcgcttttcaattccccaacggtgaaaatttcacgccaagaaaccagatagcaaggcttccgccatcttcgacttttcccgactctccttctagttcatcgttgcctttgacccagactggaggcccatcttccgcagataacgattccattgccactggcacgaacaatcgttctcctcaacaaacgaaagctgctgatgctaatcagaaatctgaatccgagtctccaaaggcaattagatcaaattctaaaaagatatctcgtttcttcaggaaaatctggtcgtccaagtcatcaaattctgcagattccgtagaagagaatagcaaaacaaagcagaaaaggaaaaatccggagagagttgtaccagaaccgataacgtcccttgaccaaccggttgaaattataaaacagagtttttcaaccgttaacaatcacgaaacggctgtaccttcaattaaggactctggcatagtacaagaattgacagcactcggagataataacaggataccagttcttccaccccctaggtcaccaaacagacctacactgtctgataaacgaactacaaagttatactactgtagtcaagattcgtctaatgaagatattgctccagaggaaaagagcaccgttttcttaaagcgtttgcaggatgaatggtctaccgtgtatttaaacaaattgcctttgactgcttctgtgccatcttctctctctaccactactgatgctgcgaactcttcgttcataaactcttcaatatcatcgccggctccttcttcttcgtcctcgtcatcgttggtttcccgtggaccaatgcaatccatatcttcttcgccaacacctgccccttcttcagggtcatcgaaatctaaaaatgccgtcaaatccttacgctttgcggatgagatttatgtaaacgatacgtggtccgccgcggactattgcaggtgtgataatacctttttgaataatttctttaaaggaaagagccaagacattaccaatccttctacttttgtcggtaataatctctcatccacaaaaaatatatccaatattgaaatcaaaatggaggtgaatgagttcaaaagaaaggaaatgcgcgttcaccaggatagcgctaagtatacacattactacttataa

SEQ ID NO: 4003 - DNA, 1722 bp, Saccharomyces cerevisiae
atgttgaatttcgcatcaagagcgtcatgtgtgacaagacgtcaagcaagcttgtattttgttaaaaatcaaggccctagattaatagcttccactattccctcgtgtcattggcctttgagagcgcaaggagtacagcccaactatcctttatctttgagattttattctactgataagtcgaaaagtgttacgaagcccgtagctccaacatccaccgatgctcctgccaagcccaaggagacgcttatggtcaaagtgaagcacgccttgaaacattatgctaatgggacgaaacttttgggttacgaaatcaaagtttctactaagcttttgattaaatttgctcagggttacgagttgtctagaagagagaggaaccaattgaggaggacaatgggcgatgtgtttaggttgatccctttttcagcgttccttattattccattcgccgaactatttttgcctttcgctttgaaactcttccccaacttactaccctccacttacgaatccggcaaggataagcaagccaagagaaataagctcatcgagatcagaaaaaagacatccgaattcttgcatgagactttggaagaatccaatttgatcacttacaacaccattgaaaatgcagagaagaagcaaaaatttttgaattttttccggaagctttattctgccaaggaaggtaagattatgactttccaacacgatgaaataagcgccattgcgcaaatgttcaaaaacgatagcgttttggataacttgtcaagaccacaattggcagcaatgtcgaagtttatgtcactaaggccatttggtaacgataacatgcttcgttaccaaattcgttccaaactaaaggatataatgaacgacgataaaactattgactacgaaggcgttgaaagtttatcgcaagaagagctgtatcaagcttgtgtgtctcgtggtatgaaagcgtacggtgtatccaaggaggacttggtcgataatctaaaagtttggctagaattgagactgagacaaaaaatcccatccgtcttgatggttttgagttccacgttcacgtttggaggacttccaaaggagaactattcaaaggcattctcgccactagctgaaaaaaaagaaacaaaaagcaaatatgacgaccttttggatctgtactacgacggtatattacaagtgctaagttccattccagatcccgtttacaacgtcgcaaaactagatgtatctgaatcgaaatcatccgctgctgaaactgaagctgaaaagcaagttgctgaaaagaagataaagacggaagaaaaacccgaggaaactgctataccgaaggaagaagccaccgcaaaagagtctgttatagctaccaccgcttctgcggttactcctaaactagtcgtagttaatgaaaaggcagaaacagcgaagacagaggaaatatctcaggaaaaagagaacgcagagcctaccgactctgcggaagccacggaagctgaagaaaagaagacatccgacgataacgagttcaaattgaacgttttgaaggagcaagaagaactaataaagaaggaggaagaggaagctaagcaaagagcttcgagagagcatgtgccagatgatatcaacctagatgaagaggaagaagcaaaatctgtacctcccattccggccgatcaagctgcgaagacttttgtcattaagaaagattga

SEQ ID NO: 4004 - DNA, 1725 bp, Saccharomyces cerevisiae
atggcagttgaggagaacaatatgcctgttgtttcacagcaaccccaagctggtgaagacgtgatctcttcactcagtaaagattcccatttaagcgcacaatctcaaaagtattctaatgatgaattgaaagccggtgagtcagggtctgaaggctcccaaagtgttcctatagagatacccaagaagcccatgtctgaatatgttaccgtttccttgctttgtttgtgtgttgccttcggcggcttcatgtttggctgggataccggtactatttctgggtttgttgtccaaacagactttttgagaaggtttggtatgaaacataaggatggtacccactatttgtcaaacgtcagaacaggtttaatcgtcgccattttcaatattggctgtgcctttggtggtattatactttccaaaggtggagatatgtatggccgtaaaaagggtctttcgattgtcgtctcggtttatatagttggtattatcattcaaattgcctctatcaacaagtggtaccaatatttcattggtagaatcatatctggtttgggtgtcggcggcatcgccgtcttatgtcctatgttgatctctgaaattgctccaaagcacttgagaggcacactagtttcttgttatcagctgatgattactgcaggtatctttttgggctactgtactaattacggtacaaagagctattcgaactcagttcaatggagagttccattagggctatgtttcgcttggtcattatttatgattggcgctttgacgttagttcctgaatccccacgttatttatgtgaggtgaataaggtagaagacgccaagcgttccattgctaagtctaacaaggtgtcaccagaggatcctgccgtccaggcagagttagatctgatcatggccggtatagaagctgaaaaactggctggcaatgcgtcctggggggaattattttccaccaagaccaaagtatttcaacgtttgttgatgggtgtgtttgttcaaatgttccaacaattaaccggtaacaattattttttctactacggtaccgttattttcaagtcagttggcctggatgattcctttgaaacatccattgtcattggtgtagtcaactttgcctccactttctttagtttgtggactgtcgaaaacttgggacatcgtaaatgtttacttttgggcgctgccactatgatggcttgtatggtcatctacgcctctgttggtgttactagattatatcctcacggtaaaagccagccatcttctaaaggtgccggtaactgtatgattgtctttacctgtttttatattttctgttatgccacaacctgggcgccagttgcctgggtcatcacagcagaatcattcccactgagagtcaagtcgaaatgtatggcgttggcctctgcttccaattgggtatgggggttcttgattgcatttttcaccccattcatcacatctgccattaacttctactacggttatgtcttcatgggctgtttggttgccatgtttttttatgtctttttctttgttccagaaactaaaggcctatcgttagaagaaattcaagaattatgggaagaaggtgttttaccttggaaatctgaaggctggattccttcatccagaagaggtaataattacgatttagaggatttacaacatgacgacaaaccgtggtacaaggccatgctagaataa

SEQ ID NO: 4005 - DNA, 1725 bp, Saccharomyces cerevisiae
atggcgaaaaaaaactcacaattgccctctactagtgagcagatcttggaaaggtccacaacaggagctaccttcctcatgatgggccaacttttcaccaaactggtaacgttcatactaaataatttgttgatcaggtttctgtcgcccagaattttcggtatcacggcctttctagaatttatacagggcacagtgttattttttagcagagatgcgattcgtctgtcgacgttgagaatctcagactccggtaatggaataatcgatgatgacgacgaggaggagtaccaggaaactcattacaagtctaaagttttgcaaaccgcagtcaattttgcttacattccgttttggatcgggtttccactgtccattggtcttatcgcctggcagtacagaaacatcaacgcgtatttcatcactcttccattcttcaggtggtcgatttttcttatctggctgagtatcatcgtggagctgttaagcgagccattcttcatcgtcaaccagtttatgttgaactatgccgcaaggtcaagatttgaaagcatcgcggtgactacaggatgtattgtcaattttatagttgtttatgccgttcagcaatcccgctacccaatgggggttgtcacatcggacattgacaaagaaggcatcgccatattggcatttgccttgggaaagttagcacattcgatcaccctgctagcatgttactactgggactatctcaagaatttcaaaccaaagaaattgttcagtaccaggctaacgaagataaaaacgcgtgaaaataacgaattgaagaaaggctacccaaagagcacatcttattttttccaaaacgacattttacagcacttcaaaaaagtttattttcaactatgttttaagcatttgttgacagagggtgataagttgattatcaattctttatgtactgtggaagaacaaggcatttacgctctattgtcgaactatggatcgctactaacaagattattatttgcgccgatcgaagaatctctgcggttatttttggcccgtttattatcctcgcataaccctaaaaatttaaaactatctattgaagtcctggtgaatttaacaaggttttacatatacttatcgttaatgatcattgtatttgggcctgccaattcatcctttttattgcagttcttgattggctcgaaatggtccactacttccgttttggacactataagagtctactgcttttacatcccatttttatcgcttaatggtatttttgaagcttttttccagagtgtagccactggtgaccaaattttgaaacattcatattttatgatggccttttctggtattttcctgctcaattcctggcttcttattgaaaaactcaaactatcaatcgaaggcttgatattgagtaacatcattaacatggtgttgagaatattgtattgtggagttttcttgaataaatttcatagggaactgtttacagattcctcttttttcttcaattttaaggatttcaaaacagttattattgctggctcaacgatctgtctacttgactggtggtttattgggtacgttaaaaatttacaacaatttgttgttaacgtattattcgcaatgggattgttagcgttaattttggtcaaggagcgccaaaccatacaatcttttattaacaagagggcggtttccaattctaaagatgtataa

SEQ ID NO: 4006 - DNA, 1725 bp, Saccharomyces cerevisiae
atggctttacatcaatttgactatatttttgccattgccatgttatttgcatttttggatgcctttaacatcggggcaaacgacgtggcgaactcattcgcgtcgtcgatctcttctagatctctaaaatactggcaagccatggttttggcgggtctctgtgagttcttgggtgctgtcttggcaggcgcaagagtttctggtactatcaagaacaacattatagattcctccatttttaccaacgaccccgctgttttaatgcttactatgaccagtgctttgattggctcgtcttgttggttaacatttgctactgcaatcggaatgccagtttctactacacattccattgttggtggtacaattggcgctgggattgcagccggtggagctaacggtgtcgtttggggttggagtggtgtttctcaaattattgcgtcatggttcattgctccgattttggcaggcgcgatcgcagctatagttttttcaatttctaggttttctgtccttgaagttaagtctttggaaagatcgattaagaatgctttactgctggttggtgttttagtattcgccactttctctatcttaacaatgttgattgtctggaagggttctccaaacctacacttggacgatttatctgaaactgaaactgccgtatctattgttctcacaggtgcaattgcttcgatcgtttacttcatctttttctacccattctacagaagaaaagttttggaccaagattggacactaaagttgattgatattttcagaggtccatctttttactttaagtccactgatgatatcccaccaatgccagaaggccatcaattaacaatcgattattacgagggcagaagaaatcttggaacaactgtttctgttgaagacgaagaaaataaggcagcgagtaattctaatgattccgtcaaaaacaaagaagacatccaggaagtggacctggttagaactgaaactgaaccagaaacaaagttgtcaacgaaacaatattggtggtcattattaaagcaaggacctaaaaaatggcccttattgttctggttagtaatctctcatggttggactcaagacgtcattcatgctcaagttaatgatagagatatgttatctggtgacctgaaaggaatgtacgaaagatctaaattttacgacaatagagtagaatatatctattcggttctccaagccattactgcagccactatgtcttttgctcatggagctaatgacgttgccaacgctactggtcctttgtctgctgtgtatgtgatctggaaaactaacactattggggcaaagtccgaagttcccgtgtgggttctggcttatggtggtgttgccttagttattggttgctggacttatggttacaatattatcaaaaatctaggtaataagatgattttgcagtcgccatcaagaggcttttcaattgaactagctgttgctattactactgtcatggctacccaattaggtattcctacctcaacaacccagatcgccgttggtggtattgtcgctgttggtttatgtaacaaggatctcaaatcagttaattggagaatggtagcctggtgttattctggttggtttttaactttaccaattgctggtttgattgccggtatcataaatggtatcattttgaatgctcctcgctttggtgtggaataccaaatgacataa

SEQ ID NO: 4007 - DNA, 1725 bp, Saccharomyces cerevisiae
atgtcaattaggcctctcacgttaaacggtttagatgagccagaaacctcttttgaagaactgaatacaactctacctcgctttcaatcccatgaaacattaactttggaagaaaacgtgccaccattgagtacatcaacttatataccgcctccatcctcggtaggtacttctgacactggcacggtattttccaatagtaccagcgcgttttggtctaataagcaagcagacgatgatcaggacatggaggtagaccaggatgatgaatttctaaatgacttccaggaattccaaaataaaaaggatgattttgacgatgctattaaaacaaattttcatttgagaaatggatgtcgaactggccctttcaaaaacgacattttcgcagaagagtttgatagaaaactgagtttggaagataaaccaaggctaaagcaacctagatcaatgatggaattgaaaccaaaaagaaaactatcaaatagcgtcacttcaagaaacttaaggtctggtaattctgtaagatttaagaaatctatgcctaacttagctttagttaatccagctatcagagaagaagaagaggacgaagaacgagaaagagaagatcaacgagagtttaattacaagattgataacgatacgcaggacacaattttggcgaaattcagttcagatgatgaaggtgactttctgacaggatttgaagaattagagggtgaagcaattgatgaaacgatttcttcgaacgataaagaaagtgccgaccatccgcgtttcttaaagaagtcatcctcatctttgccattaaaaatatcacctgcacaatatgatatagtaaagcatgacgaattattaactccaggtcttcataggcgacaacgagattggaatacccagcaggaactggactcttttaaagaaaaacgatcagtaagacactgttctaatcaaaatgtacaactcaatggtccagctaaaatcaaaacaataaaacagcaaattgatcataatactccaatgaagaaaggttctatgatatataacccgaaaactatgaagtgggaaggaaatgaaaacgtcttaagcaaatttagtgatgtagacacggcaaacaggaaagctttattgataaaaaacaagctacaacgagatgcagattctaagaagcaaaaatattctgatctacagcatgcaagagccacttcgagaaatcaaaaggtcatcgggaacatgattttagatgaacaaaatttaagatgggttagtgtttcagaggaagaagcagacccttttgcaggcattcctgagataaacttaccaccagttggcaaaagtatgaaaaaacgtagctcctcaccatttttgcgttccaaaagccaagttaatacgccatttgtttcaaatgacaatgatggcgtttatcaaagtacggctgctcaagcaagactccgtaaataccattcaatgaggacacttaacggtacaacagaaactccagaaataagctctactttccatttgagttcaagagcattggaaaaattttaccacgaggagaacaggtggtgtaaaaagttagcctcatggtttataccccgagatgagaccattatcagtgttgatgaggaaacaatcatggatgaaagtacggtcaatagcaagagaaaatcctatatgtatgaaatcaggaacatggtaatcaattcgacaaaagattag

SEQ ID NO: 4008 - DNA, 1725 bp, Saccharomyces cerevisiae
atgtcggaaggaagaacgtttctgtcacagttgaatgtcttcaacaaggagaactatcaattttcttcttctactacaaaaaaggaagtaagtaactcgacagtggatgctgacaacggtgcctccgattttgaggcaggccagcaatttgctacagaattggaccaaggtgaaaagcagttaggtattttgtcgtgtattgggcttatctgtaatagaatgcttggtaccggtgttttcgccgtttcctcgaccatttacacactatgtgggtctgtggggcttgcattaattatgtgggcagttggcgccattattgccatttctgggttatatgtatacatggaattcggtacggctataccgaaaaatggtggtgaaaaaaactacctggaggctattttcaggaaaccaaaattcttcattacctgtatgtatgctgcgtatattttcttcctaggttgggctgctggtaattccatcaatacagctattatgtttttaactgctgctgatactgaagtgaccaaatggaatcaaagaggtattggtgtggccgtcgttttttttgcattcctaattaattctctgaatgtcaagattggtctatatttgcaaaacattttaggtattttcaagattggtattgtcctcttcatttctattaccggttgggttgcccttggcggtggtctcaaagatggttatcaatctcacaactttcgtaatgcttttgaaggtactgaaaccgccactgcttatggtattgttaacgccttatatagtgttatttggtcgtttgtcggttactccaatgttaactatgcacttggtgaagttaagaaccctgtgagaactttgaagattgctggtcctacatcgatggtcttcttggctataatctacatttttgtgaacattgcttacttcgctgtggttccaaaagataagttaatttcttcaaaattgattttagctgctgacttcttcgatattgtgtttggcggccaagccaagagagcagcagccgcactggtcgggttgagtgccttaggaaatgttctttctgtcattttttctcagggtagaattattcaacaactaggacgtgaaggtgtgttgcccttttctaatttctttgcctcttctaagccattcaactccccaatggttggtttgtttcaacattttattgtttgtacagtaaccattttagccccacctccaggtgatgcatatttgctagtccaaaatttaatttcctacccaatgaatattattaattttgccattagcgcgggtttgctttggatatactggcaacgtagacaaggtaaaattgaatggaacccaccaattaaggccggtgtttttgttacgggatttttcacattatccaatttatacctgattattgctccttacgttccaccttcaaatggcgagtcggtgtattcaagcatgccatactggatccactgtgtaattgcttggggtattttcttctttggtggtgtttactacgttgtttgggcccaattattgccaagatggggccactacaaattggtttccaaggatgtgcttggtgaagatgggttctggagagtcaaaattgccaaagtttatgatgacactattggcgatgtcgatacacaagaagacggcgttattgaaacgaatataatcgaacattacaaaagtgaacaagaaaaatcgctgtaa

SEQ ID NO: 4009 - DNA, 1725 bp, Saccharomyces cerevisiae
atgtggaggagaatattcgcgcatgaactcaagtatgatcaacccaatgcatcttcaaaaaacttgatcctttcagttctgaatacaaccgctacaaaacgagaggctaaggattatctctcaaaatatacaaatgatagtgggcagcataatcattgtttgttttttatcagggacctgcataaagtcgcaccagcgattttgtcccagttttcaagtgtcataaagagactaggaatgctaggtttgcgacctatgtttgtaattccgccgtcgccaactcatgtaaatatacaggcagagttacttgacagtatcgttacagaagcagatttaaagccacttcaccttaaggagggtcttactaaatcccgcactgggttatatcattctgttttttcgcaagagagtcgtttctttgatattggaaattccaattttataccaattgtgaaaccttatgtgtataatgaagagactgcttcagaattcatgacaaaggatgttgtaaaatttatggattgcctgtgccaagggaatattccacacattgacaaattcttcattctaaataatgccggaggtataccttcgggagagagaaatgataacgctcatgtattcatcaatctttctcaggaactcgagcatttgtcctcgtcattatctcacaatataagcactctaaccaaacgagagccacgctcccaaaacctgttacacagaatggaggtgtacgttaaaaaagatgagatatcttccttagaatgtgaataccatgatcatttagaaaacctgttattgatggacaaagttttatcaaatctagcggctacagcaacgggactgattacaactgtcaaagctgccgcactatcatcagataggaaaaatcctttagtatataatttattgacagaccgatcgctaatttcttcttctttaccaaggtttaaaaaaaaggacggcgagatagactcaccagccaacatgtttgatgatcacgcatggtatgaattgccttcccaacaggtaaatgcagctccttctaactcagatgcagttttagtgacaactgttctcaaaaagggcgtccatatcaaaacttatgactataagacgctgactcaattcaactcaattgggcttccaaagaagtttcacgtacctgagaaaggagcaaaaccctcgagcaatagtccaaaactagatatcaacaaatttaaatccatcatcgatcagagctttaaaagatctttggatttgcatgactacataaaaaggattaatggaaaaatagctacaattattgtgataggtgattatgaaggcattgcaattcttacctatgaaggctcggaggaaaattcctttgtttatctcgataagttcgccgttctaccacacttgaaaggctcgctgggtatatctgatataatcttcaatttgatgttcaaaaaatttcctaatgagatactttggagaagcagaaaagacaatgtggtgaacaagtggtattttcaacgtagcgttgctgtgctagatttgtcgattgacttagaccccgaacactgtgatgaaaagcaaagccaatttaaactattttactacggtaaccctcaatacgctaagagggcactacgtgacaagaaacgtttaagagaattcatgaggtctgtcagggacatcaagccaagttgggaaaatgaaaaaaatatttcatga

SEQ ID NO: 4010 - DNA, 1728 bp, Saccharomyces cerevisiae
atgacggaaattgaatttgggcaaccccttcccagcaatctagactatgctgtttcttttggcattcctacatgggattcggcaataggctatgcggaaaaggtgccagaggtaataggcaaaatggctacaggatatccgaggtactttcctcaaccccccgtccagaggctttgtgcttactttgttaagaaatttgggcgaggttcagaaaactgtcgtccttttccatccgttaacctgggtttaaagtgtttcgagtacgtaaaatctgtctcaggacctgaaagtaaagctcaccttgaagtggaaacagttacgattaaaaaccgtggggcaaaaacgtcgaaagaaccggcggaattggtgctaaccattgctgctgtccttgcatcggaggaagagttcgagactgtgaaagagtattggaaattaagaggtgaatgtgtatctagtcgattggcgttgtctgtcaaccaacttcttgactgcgctaatcatggctcagagcaggtattgcgtgagctagaggctggtgtttttgcagcaaagaagggggaggagaaagcaaagaacctgataaagggaaggatagttgagaatcgcttcaggccctttggtttggagaagaaaaccccgaattgggagggactcaacctcaacccaaatgaagacgtttatcttgtatcaagtggcatgtctgcaatatctacggctcgtaatttactcaccttttgggaggagaagaagaattcaggagattcattaaacaagaccacctctgaccaaaagaaaaagccattattatgtgacactgttggcatcttcggcttccctttcaaagatacgcaggtcattatgactaaatttggaaaatgtaaattttttggatttggaaattctagagacgttgtcgaattacaaaagtttttagaaacaagcaaacaacgcattcttgccgttttcgtcgagacaccttcaaatcctctgctgaatatgccggatttgaaaaaattgaggagtttggccgaccagtatggcttttttattgtaattgatgatactattgggggccttaacgttgacatcttgccctatgctgatatagtcagcacgtccctgactaagcttttcaatggtgctagtaatgtaatgggcggctctgtcgttttaaatccgaaatcatctctgtatccatatgctcgtgagtacttcaggagcgctaatttcgaggatttgttatggtgtgaagatgcgatagttttagaacgtaattccagggattttgaagatagaactttacgtgctaatgcaaacacaggaatattgttgaatgatttgcttttacccgaggaggggaaaatatgcaaaaagatttattatccaactgttacttctaaggagacctttgagaactacgaaagtgtacgtaatgaacgtggtggctatggatgcttgttctctgtagcctttttcaatgagggcgatgcaaaagcattctatgactctttaaaggtattcaagggaccttctaatggtactaactttaccttagcatgtccatatgtccatctggcgcaccactcagaattagaagaagtttccaagtttggggccgaccccaacattattagagtaagcgtaggtttagaagatatccagtggttattgaaagttttttcaagtgctttagatgttgtgaaaagcagaggctccaaacactcatga

SEQ ID NO: 4011 - DNA, 1728 bp, Saccharomyces cerevisiae
atgattacaatgattaacaacaaaactttcaatagaaaaactacgggaacactgaagaagctggttttgtcatcagacaagtcactgcgaagatctttcaacggggcaagcagtactaaagacttcgtgttctcggaatcaagtaaagtagaagaatggtgggaatcagccagatttaagaatatcagtcgtccatactcagctacggatgttgtaaagcatcggggcagccttcctgctaatacttcaatttatccttcatcttatcaagctcgaaagctgttcaacttactagaagagaatttcaagaatggtactccacttcacacgttgggagttatcgatcctgtacaaatgagtcagttggcccgttgcagaaatatcaaagttgcttacatatctggttgggcttgttcttccacattagttggatctacaaatgaagtatcgccggattttggcgattatccatacgatactgtgccgaatcaagtggagagaatattcaaggcgcagcaattgcacgatcgaaaggctttcttggaggcctccatcaaaggttctactcctgttgattatttaaaaccaattatcgcggacgcagacatgggtcacggtggcccaacgactgtaatgaaagttgctaagttgtttgcggagaaaggggctgctggtattcatcttgaagatcagatggtgggaggcaaaaggtgtggccatctaagtggggctgttttggtgcccacagcaacacatcttatgagattgatttccaccaggtttcaatgggatatcatggggacagaaaatttggttattgcaagaacagattcctgtaatggtaagctgttgagttcaagcagtgatccgagagaccacgaattcattaggggtataataagagataacgtggtgccttggagcgaaaaattgattgagatggaggacaaaaaaattcccaactccgccattgctgacatggaaaaagaatggtaccatgaaaatgagctgtttacatttgaagaggccttagaaaagcagtttacggcaagcgagtttgaaagctataaagaaaagaaggaagaccttatggtaaacaagctgggtagagcatacctaagcttaagagaaatgaaacttttagctcaagaagtgacaccactaaagaaaattatatttgactgggatgctccgaggaccaaagagggatattacatgtttaacggttgtattgaagcagctattagaagatctttggtgtttgccccatattctgatatgatttggctggaaacgaaaactcctgacctggagcaggcacgctcattttcaagaaaaattcataaacaacttccagctaccaagctagtatataacttatctcctagtttcaattggagcgctcacggctttgatgataaggcattaaaatccttcgtatgggacttggcaaaagaaggcttcacgttgcaactggtttcccttgccggtctgcattcagatggagtatcattctgggaattagccaatagcttccaaagtgacggaatgaaagcatacgtcgaaaaagtgcaaaaacgggaaaaggagactaattgtgatatcatgacacaccagctatggtctggtgcagaatatgttgattccttaatgaaagttgtccaaaacggtgcttcatcccaaactttaagtacatctggtgagagctttaccgaaacgcaattttga

SEQ ID NO: 4012 - DNA, 1728 bp, Saccharomyces cerevisiae
atgcaatgtcgatcaattgtgcatcgtctgtactctaaggtctcccacgtaacgacgccaattttctatcccaatgccaaaccgcacctcggccatctttactccagcttattaagtgacgtttaccatcgatggcaattatttaaaggtaatctatccttctttaccacaggtactgatgaacatggattgaaaatccagtgtgctagtgaaagcaatggcttcgatcagccaaaaaagttcgtcgataagctatacccagagtttgttcaattagacaaaatatatggcattaattatacaagatttataaggactacggatcctgaccacattgaaaacgtgatgaaattatgggaactttgtttgaaaaatggctatatttacatgggcgaacataagggttggtattccatttctgatgaaacattctatcctgaatccaaggttattaaagaccccaaaaatgatggtaagtatctgaatacagaatcgaaaaacgaagtagtttatcagtcagagacaaattacttctttaggctatccttatttaacaagaaaatagttgaccatataagaaagaatccagatttcatttttcctgcttctaaaagagaccaaattctaaaagaactagaaaccggtgggacattgccagatttatcgatatcgagaccctctgcgagacttaaatggggtataccgactcctaatgatccgtcccaaaaagtttatgtgtggtttgatgccttgtgtaactacctctcctccatcggtggcataccgtccatcttgagtaatgctactgaagtagtttcaagacattatagcgacaaatcaaacgtaaaaggccaattgttaataccatacccaaaagaagtgcagcgaaacaccattcacgtgataggaaaggatatcgcgaaattccataccgtatattggccttcttttttactggctgctggactgcctttaccaagacaaattgttgttcatggacactggctctgcaatggaatgaaaatgtccaaaagtttgggtaatgttgtagatccgattgatatggcacgttattatggagccgatattgtgcgttggttcttgttagaaaattctaaactggaagaggacggcgattttcaagaagccaaattatacgagacaagagagcttttagtatccaaatggggcaatctgattaacagatgttgtggctcgaaattcaatattgaaagagctgttatgaaatttagcgacaaggcaaattttcaatttcaggagattttccaaaatgaaccaatagtctccgaacgaattgagaatctggctaaactactcaacaaatcacaagaggtttttgacgaaaaaatagccatattccagtatcctcaactgctaaggcatgtttggagtattatcaacgatgcaaatactttggttcaaaatagtaaaccttgggagagggaattagatcaacaagacaatataatatttttggctatggaaacgtctagaatcctctccattttatgccaatccattataccatctctctcacaaagtttcctagatcgtattgatgtttcaaaggagaaaaggactataaattatgctagattgggttccgataaaacatatggaaagcaatctaacaagaaaggccgagaagtacctttgaaaaaaattccattcaggttgcaagaggaacaaacgaatatgaggtcatga

SEQ ID NO: 4013 - DNA, 1728 bp, Saccharomyces cerevisiae
atgcagcaggacgacgattttcaaaattttgtagctaccttggaatcattcaaagatttgaaatctggtatttcaggttctcgtattaagaaactaaccacttacgcacttgatcacattgatattgaatcgaaaatcatatctttgataatagactactcaagactttgtcccgattctcataaattaggttctttatatatcatcgattcaataggtagagcttacttggatgaaacaagatcaaattcaaacagcagcagcaacaaacccggtacttgtgcccatgccataaacacgttgggcgaagtaattcaagaactgctatccgatgctattgcaaaaagtaatcaagaccacaaggaaaaaattcgtatgcttttagacatttgggacaggtccggcttgtttcaaaagagttacttgaacgccatcaggtcaaaatgctttgctatggacatatcgaataacaccgcgaacaccgcttcacaacaactatcactggatcccaagcagaggtcgaaacaaatcttgtcaaatctaaagaaaagtcctcctttaaacttgaacataagtcttccaactgatttgacttccacagatccagccaaacagcaagcagctcttttccaagtaatagcggctctgcagaaacattttaaaactttgccttcacatacatccgtgggtacagtcgcacctccccaagcccatacaattaccgaatatggtagcagacgtgaacgtgaacgtgaaagagaaagatataactcaagaaggaatagatcaagatctcctccggcaccattttctcagccatcgacaggcaggaaggaccgctatccatctgtggcccaggaccaatacagcataggcgcccccaatacgacatttggcacaaacaatcaccacttataccccgatgagcttaatgtttccaataatcctcattatagaccaaaaccagtaagttacgactctacattgccaccagatcatattaaagtctacagccgtactcttttcatcggtggggtaccactaaacatgaaggaatgggaccttgctaacgttttaaaaccttttgctgaagtacaaagcgtcattctgaataactccagaaaacacgcttttgtgaaagtttattcaagacatgaggccgaaaatgttttgcaaaacttcaataaagatggagccctgccattgagaactaggtggggagttggttttggtccaagagattgttgtgactatcaacacggttacagtattattcctatgcacaggctcacggacgctgataaaaaatggtcagtaagtgcgcaatggggtggcacttctggtcaacctctcgttaccggtattgttttcgaagaaccggatattatcgttggtgaaggtgtttcttccaaggcaatatctcaaaagatgcctactgattctggcagaaatgggccacgttctggtaaacctaacaaatctggtagcatatcgtcgatatctccagtaccctacggcaatgcaccattggcatctcctccaccacagcaatatgtgcaacctatgatgcagcaaccgtatggttatgcccccaaccaaccattaccttctcagggacctgccgcagcggctccccctgtacctcagcaacaatttgaccccactgctcaattgaattctttgatgaatatgcttaaccaacagcagcagcaacaacaacaaagctaa

SEQ ID NO: 4014 - DNA, 1728 bp, Saccharomyces cerevisiae
atgctatcagcaaggtgcctcaaatctatatacttcaagagatctttctcacaactgggacacatcaagccccccaagcacataagaaatgaacctgttaagccatttagaaacatagacttaaaagactgggacttactgagggcttccttgatgaaattcaaaagttcttctttagaagtgccactggtcatcaatggggaaaggatatatgacaataatgaaagagcgcttttcccgcagactaaccctgcgaaccatcaacaagtactggcaaacgtcacacaagccacggaaaaagatgtcatgaatgctgtaaaagccgccaaggatgccaaaaaggattggtacaatctaccgttttatgacagatctgcaatttttttgaaagccgctgacttaatttccaccaagtatcgttatgacatgttagctgctacaatgctgggccagggaaaaaatgtgtatcaggcagaaatcgactgtatcacggaattatctgacttttttagatactatgtcaagtatgcatcagacttgtatgctcaacaacccgtagagtcagcggatggtacttggaataaagctgaatacagacctttagagggatttgtgtatgctgtttcaccattcaactttactgctattgctgcaaacttgattggggctccagctttgatgggtaatacagttgtctggaaaccttcacaaaccgctgccctttcaaattacttattgatgactgttttggaagaagcgggattgccaaagggtgtcataaatttcattccaggtgatccagttcaagttactgaccaggtattagctgataaagattttggtgccttgcattttaccggttctacaaatgtctttaagagtttgtatggcaaaatacaaagtggcgttgttgaagggaagtacagagattacccccgtattattggtgagacaggtggtaaaaatttccatctagttcacccaagtgcaaatatatcacatgcagtactctctactattagaggcactttcgagttccaaggccaaaagtgctctgccgcttccaggttatatcttccagagtcaaaaagtgaagaattcttatccgatatgtttggcatattgcagtcacagaatgttgtcccaatgaacacatccgcaagtccaatttctggtgggaatttgcggggatttatgggtcctgtcatccatgaacaaagtttcgacaaattagttaaagtaattgaagatgcaaagaaagaccccgagttggaaattctttacggtggacaatacgataaaagccaaggttggtttgtcggacccacagtcataaaagccaagagaccagatcatccatatatgtcaacagaattttttggccctatattaactgtttacgagtatccagatactgaatttaatgaaatctgtgatattatcgataatacgagtcaatacgccttaactggtgctatttttgccaaagatcgtaaagcaattgaatacgcagatgagaagttgaagtttagcgcaggaaatttctacataaatgataagtgtactggtgccgttgtttctcagcaatggtttggtggcgcaagaatgagtggtaccgacgataaggctggtggtccaaacattttaagcagatttgtcagtattagaaacacaaaggagaacttctacgagttgactgatttcaaatatccatcgaattatgaataa

SEQ ID NO: 4015 - DNA, 1728 bp, Saccharomyces cerevisiae
atgggctcctctttggatttggtggcgagcttctcgcatgattccactcgttttgcattccaagcaagcgtcgcacaaaagaacaatgtggatatttatccattaaatgaaactaaggattatgtggtcaatagttcattagtgagtcatattgactatgagacaaacgatatgaaggtttcagatgtaatcttctttgggtggtgtagtgatttgatagatacgcagtcatccaatatcaaaagaaaattagatgaagatgaaggaactggtgaatcaagtgagcaaagatgtgaaaactttttcgttaacggatttcctgacggaagaattgttgtttactcttctaatggtaaggatatagttaatatcatcaagaataaaaaagagattttgggagcagacacagacgagtctgatatatggattttggatagtgataaagtcgttaagaaattacagtataacaattcgaaacctctaaagacttttacgctagttgatggtaaagatgacgaaatagttcatttccaaattttgcaccaaaatggcactttattggtatgcattattactaaacagatggtttatattgttgatccatcaaagagaagaccctctactaagtatagttttgaaatatcagacgctgtagcatgtgaattttcttcagacggtaagtatctgttaattgccaacaacgaagaattaatagcttacgacttgaaggaagattcaaagctgatccaatcatggcctgtccaagtgaagacattgaaaactttagatgatttgataatggctttgactactgatggtaaaattaataattataagattggcgaagccgacaaagtttgttctatagttgtaaatgaagatttggaaattatagatttcacgccaataaacagcaagcaacaggttctaatttcatggctaaatgtcaatgaacccaactttgaatctatttctttaaaagaaattgaaactcaggggtatattacaataaacaaaaatgaaaaaaataatgctgatgaagcggaccaaaagaaattagaagagaaagaagaagaagctcagcctgaagttcaacatgagaagaaggagactgaaactaagataaacaagaaagttagtaaatcagatcaagttgaaattgctaatattctctcatcgcatttagaagctaattcaacagaaatattggatgatctgatgtctggaagttggacagaaccagagattaaaaaattcatcttaaccaagatcaatacagtagatcatctaagtaagatatttttgactatatcaaagtcaataacacaaaatccatggaatgaagaaaatttacttccgttgtggcttaagtggttgctgactttgaaaagtggggagttaaattctataaaggataaacatacaaagaaaaattgcaagcatttaaaatctgcattaagatcttcagaggagatcttgcctgttctactcggtatacaaggtagattagaaatgttgaggaggcaagcaaaattgagagaggatcttgcacaactatctatgcaagagggtgaagatgatgaaatagaagttatagagcattcaaatgtaattagtaatcctttgcaggatcaagcatcgcctgttgaaaagcttgaaccagattcaattgtttatgcaaatggagaaagtgacgaatttgtcgacgcatcggaatacaaagattga

SEQ ID NO: 4016 - DNA, 1728 bp, Saccharomyces cerevisiae
atggtgaacgttggtccttctcatgctgcagttgctgtggatgctagcgaagcccgcaaaagaaatatttcagaagaagtattcgaactgagggataagaaagattctacagtggtaattgagggtgaagccccggtaagaacttttaccagtagctctagtaaccatgaaagagaggatacgtatgtttctaaaaggcaggtaatgagagatatttttgctaaatacttgaagttcattggacctggattgatggttagtgtggcttacatcgatcccggtaattactctactgccgtcgatgcaggtgcctctaatcaattttccctactttgtatcattttgttatcaaactttattgccatatttttgcaatgtctgtgtatcaagttgggttccgttacgggactagatctaagtcgagcttgcagagagtatttaccacggtggctcaactggacattgtatttttttgcagaatgtgccgttatagccaccgatatagctgaagtgattggtacagcgattgccttgaatatcctgatcaaagtgccccttccagcgggcgtggccattactgttgtggatgtgtttttgattatgtttacatataaacctggtgcgtcatcaattaggttcattagaatatttgaatgttttgttgcagtattagttgttggcgtgtgcatttgtttcgcaatagaattggcttatatcccgaagagtacgtccgttaaacaagtgttcagaggatttgtgccatctgcccaaatgtttgaccacaatggtatttataccgctatttccatcttaggtgctactgttatgccacattcgttgtttttgggttccgctttagtgcagccaaggcttttagattatgacgttaaacacggtaattatactgtttctgaagaacaagataaagtgaaaaaatctaaatccactgaagagattatggaagaaaaatattttaattatagacccacgaacgctgctatcaaatattgcatgaaatattctatggtcgaattaagcataactctcttcaccctagcgcttttcgtcaattgtgccatcctagttgttgcgggctccactctatataactcaccagaagcagatggggcagatttgtttactattcatgaattattatcaagaaatctggcacccgcagcaggtacgattttcatgctcgcacttttattaagtggtcaatccgcaggtgtagtgtgtactatgtcgggtcaaattgtaagtgagggtcatattaattggaagttgcagccatggcaaagaagattggccactagatgtatttcgataatcccttgtttggtcatctctatctgtatcggtagagaagctttatcaaaggccttaaatgcttcccaagttgttttatccatagttctgccatttttggtagcacctttaattttcttcacatgtaaaaaatcaatcatgaaaaccgaaattaccgtcgaccatactgaagaagatagccataaccatcaaaataacaacgatagatctgcaggtagcgtaatcgagcaagatggttctagtggcatggagatagaaaatggaaaagatgtcaaaatcgtttatatggcaaacaattggattatcactgttattgctataattgtgtggcttttcttatctttactgaacgtttatgccattgttcaattaggcatgtctcatggtgatatcagttaa

SEQ ID NO: 4017 - DNA, 1731 bp, Saccharomyces cerevisiae
atgaatgtgctgttaaaaagacgcagtttaacgtttgcaccgagatggctgtggtgcaagtgtcgaagtagcaggagcaggccgtattctctggcacacgcggtcgacacaagtaagatggaggcaaccaggaggaacggtcagattgtgaaggacctgggtagatactatccgtcaatgtcagaatcagcactccacgatctttgccaggagtataaagaagtcactatcgcagactttaatgagagattcttgggcaacccagccacattacaccatgaggataatcctaatttgttacttagtattaatggcaggattaaaagcattaggttttcaggccagaagattgtttttatagatctttacaacggcagtagcggattgaagaatgatacgcaactgcagttgatcgtaaactacaataaaattggtgggagtagtgaggataaggcgaatttctcagaatatatgaactttttgaagaaaggagattatattaaggcgctcggttatcccgggttttcccaatccagagtcaagatgctgtccttgatatgtaataagctacctatagtattgtctgtttcgcaactgccgttaccttccagactgaatgatgaaaccaagatcaaatctaatagagttgttgactaccaattaaacggcactcagacactgctagtaagggcgcgtatcatcaaacttttgaggaagtttctcgacgacagaaacttcgttgaggttgaaacgcctatactgtcatcaaagtccaacggtgccatggcgaagccctttataacgtcgtccaaggacttcgaccatttggagttgcgtattgcaccagaattatggctgaagaggcttataattagtggtttacaaaaagtatacgaaataggaaaggtctttcgaaacgaaggcattgattccacgcataatgctgagttttccactttagaattctatgaaacttacatgtcaatggacgatatagtcacaaggactgaagatttgttcaaatttttgattactaacttgcaaaagttctttcaagatacccgtctgcctgtccctaagacgtttagtgaattacatctggcactatccgagaataattggaagtttagaaaagtcgaattcctgcccactttgaacaaagagcttggcattgatctaatgaactctggattggatatcaataagccgagcgaacttttgaaggctttaccgaaagacattgcgaagaagtattttccttctgcagataacactgggcaattatcttcgctgcaaatcctaaataaactatcggacgtgttcctcgagcagcgccattgtcaatcaaccttgcctacggtaatataccatcaacctgcaatattatcgcccttagccaagacggatccgcaaaataagcaagtcacgaagagattcgaagtcttcatcaaaggtaaggaatacatcaatgcttacgaagaggaaaattgcccccaattacaactgcagaagtttctacaacaaaagcagattaacgaattgacaggaaacaaaactgagaccttatcgcctgttattgactaccagtatgttgagacgatgaaatacggtatgcctccagtaggtggctttggccttggcatagatagattgtgcatgctattttgcgacaagaagaggatagaagaggttctgccctttggctgtgtggatgatgtaaacaggcagtaa

SEQ ID NO: 4018 - DNA, 1731 bp, Saccharomyces cerevisiae
atgacaaaatatgagcgtgaccctgaattggtgaactttctatcgaaagtggaggatttgaactctaagagatacagtaatattcctagttcaaaaccagcgggggaagcgctttcaccagttagaagtcacaactctggggaatacagaagggctgatatgatgacagggaaaaatgtggaaggttgcgacaatttggcctaccgatctgcgtacaattatgaaatgacgttttctccaaagaagactcattactcattaagtgagctgaatctcgaacgaataacgccaaggccggatttggagggaagtgcctctcaaaaagaaaaaaaatttttaatttctgaagaagattatttattattgcagaaattgaaagcctctcaaacatataatgattccaatgctgacaaaaatttgccttcctttgaaaaaggtcctcgtatgcccagtcggggtcgacccagaccgagagagaaggaaataatcaccatccaatatgattttgaattaccaggaagagccgatataccctcctcctcctcttcttcatcaccaccgcctttgcccacaaggcgtgatcatatcaaaatcacagatgggaatgaagagaaaccgcttcttccaacaaggcctaacaaagcagaagttacagaaagtccgtcatcaaggtcaataaaaccggatgctgtggtacctgagcgcgttaagcctgctccacctgtctcacgctctacaaaaccggcgagctttttaagttctttggaagataacaaattgacaaaggcgaagagttataattcggaaatggaaactcccaaaacaactgtaaaaagttctcatatcgattacttggattccatacaactaaaaccaaccaccttatctcctacaatgaaaaataaacctaaaccaacccctccttctccacctgcgaaaagaattccaagatctgaaagttttatcaagtctatgctaaactcgaatctcacgacaacttccaagccttctttgcctgaaaaacctcaaaagctacggaatgcaaatttggccgcccataagaccaaaccaagcataccgccaaagaaagtggagttgaatatagtattacctgagctacgtcccgtagaaacttctccaacaaagcagaacttcgaaaactcaatcgatttgcccaagttacgatccagcaaccgtaacattaaaaaagaagaggaggacagtattccagaagcaataaaaggtatacaaaatctgaagaaaaccaaacagcagaagcctgcaatccctcagaaaaaatcatttctaacaaataattcgaaaaatactacactcaaaaatggtgatgatattaacaagttaaatgacgaaattgaagctctatcattgcggaataacctgaagaaacggccaccaacggcgccacaacgtaaaatttctttgccagaggcattgcgaaaagtcgaattgatgaaaaaatctaaaaccgagcctgttttagagtcctcaaacgaactgagcataaacgcaaaattagacgcaataattgcctctagaaacttaagagcatctaatactctaccagaacttagcggtgttaacactaatattgcaacttctgacaagtatactacttctagagatgaaacagtgaaggaaactaaaccattagttcacccgaataaaaataggactcgtggtcccagaagaaaacttccaacacgcgtgtaa

SEQ ID NO: 4019 - DNA, 1731 bp, Saccharomyces cerevisiae
atgagtctggaacccacacaaacggtctccggtacgccgccgatgctgcatcaaagaacacacaaacaagtatacccattgcggatggaaactatcccaatattggaatccgactccaaggctactctacaaagcaacgagcccacccagaaagatgaggaggagaccgaatattttgagaataaacaatccgtgtcgaatttgagccccgatttgaaattcaaacgacacaagaataaacatatccaggggttccctactctgggcgaaaggctggataacctgcaagatataaaaaaggccaagagagtggagaatttcaattcttctgcgccaattgctgacgacaatcatagtggagatgcgactgcaaatgcgactgcaaatgcgactgcaaatgcgactgcgaatgttaatgcaagtgcaatgcccgctccatatatgccttattactattactaccatccgatgaatgcaccaactcctgcaatgataccatatcctggatcaccaatgcattcgattatgcccaactcctcattacagcccttttattcgcaacccactgctgcaggcggtcccgatatgactactccccaaaatatatcttcatcacaacaattgctgccagctccgcaattgtttccgtacggatcattccatcaacaacaacttcagcaaccacactacattcaacgaacaagggaaaggaaaaaatcaatcggaagtcagagaggtagaagattgtctatgttagcatctcaagctaatgggggaagcactattatatctccgcacaaggatattcctgaagaggatttttacaccgtggttggaaatgcgtcttttggtaaaaatttacaaatacgacagcttttcaactggtgtttaatgagatctctgcataaattggagttgaaggctaaaaaccaagaggaagaaggggaacttgaacatctgaccaaaaaatccaagctcgaatcaacaaaggcagaaactgattatgtggatcccaaacgtctggctatggtgataataaaagagtttgtcgatgatcttaaaaaagatcatattgcgatagattgggaagatgaggaaaaatatgaggatgaagatgaggagaagattctggataatactgaaaactacgatgacacggaactgcgacaactgtttcaggaaaacgacgacgacgacgacgacgacgatgaggtggactactcggaaatacagaggtctagacgtaaatttagtgaaaggagaaaagccctaccgaaagaaccaaaaaaactattacctaatagcaaaaacgtggaaaacacaaagaatcttagcattttaacgagcaaggtgaacgcgatcaaaaatgaagtgaaagaatgggcagtcactttagacacttcgagaccagatcttgaatggcaagaattgacttcattctcatcacaaccactggaaccgttgtcggatacagaagagccagaccttgcgattgcagatgttgagacaaagttagaaacaaaagtcgatgagctaaggtaccagtcgcatatattaaactcgcactcactagccttaaacgaaataacaaattcaaaagtgaataaattgaacatagaaacaatgagaaagatctcaagcgaaacggacgatgaccactcacaagtgattaatcctcaacagctgttgaagggattaagtttatctttcagtaaaaaactggatttatga

SEQ ID NO: 4020 - DNA, 1731 bp, Saccharomyces cerevisiae
atgatcgccttaccagtagagaaggcccctagaaagtccctatggcaaaggcacagagcctttattagtggaatagttgcccttattatcatcggcaccttcttcctcacttcgggtctccacccagcaccacctcatgaggcaaagcgtccacaccatggaaaaggtcccatgcactcacccaaatgtgagaagattgaaccattaagtccatcattcaaacattccgtcgacacaattcttcatgaccctgcctttagaaacagctccattgagaaactgtccaatgctgttagaatccccactgtagtccaagacaaaaaccccaaccccgcagatgatccggatttctataagcatttttatgaactacacgactattttgagaagactttccctaatattcacaagcatttgaaattggagaaagtcaatgagctgggtcttctatacacatgggaaggttctgatcctgatctaaaaccattattgttaatggcccatcaagatgttgtacctgtaaacaacgaaactttatcatcctggaagttccctccattttctggtcactatgatccagaaacagattttgtttgggggcgtggttctaacgattgtaagaacttgttaattgccgagtttgaagctatcgaacaactgttgatagatggattcaagcccaacagaactattgttatgtcgcttggttttgatgaagaagcaagcggcaccctcggtgctgccagcttagcctcatttcttcacgaaagatatggtgatgatggtatttacagtatcattgacgagggtgaaggtatcatggaagtcgacaaggatgtctttgttgccactccaatcaacgctgaaaaaggctatgtcgacttcgaagtcagtattctaggccatggtggtcattcctctgtcccacctgatcataccacaatcggtatcgcttcagaactgattactgaatttgaagccaacccatttgactacgaatttgagtttgacaatccaatctatggattgttgacatgtgctgctgaacattctaaatctttaagtaaggatgtgaagaagacaattttgggcgcaccattctgtcctagaaggaaggacaagcttgttgagtacatttccaaccaatcacatttgcgcagcttaataagaacaacacaagctgttgatatcatcaatggtggtgttaaagctaatgctctgcccgaaactaccagattcttgatcaatcacagaattaatttacattcttctgtggctgaagtctttgaaagaaacatagaatatgcgaaaaagattgctgagaagtatggctatggtttatctaagaacggtgacgattacattatccctgaaaccgagttaggtcacattgacattactctcttgagagaattggaaccagcaccactttcgccaagttcaggccctgtttgggacattttggcaggtactattcaagatgtttttgaaaacggtgttctacaaaacaacgaagagttctatgtgactactggtttattctctggtaacaccgatactaaatactactggaatttgtccaagaacatttataggtttgttggctctatcattgatattgatttactgaagacattgcattcggttaatgaacacgtggatgtcccaggtcatttatctgccattgcctttgtttacgagtatatcgttaatgttaacgaatacgcttaa

SEQ ID NO: 4021 - DNA, 1731 bp, Saccharomyces cerevisiae
atgatttctgctactaattgggttccaagagggttttcctcggaatttcctgaaaagtatgttctggatgatgaggaagtggaaagaattaaccaattagcacagttgaatttggatgatgctaaagctactttggaagaagcagaaggcgaatcaggtgttgaagatgacgccgcaacaggtagttctaataagttgaaggatcagttggatatagatgatgatttgaaagaatataacctggaagaatatgacgatgaggaaattgcagataatgagggtggtaaagacgtttccatgttcccgggtttaagtaatgatagcgatgttaaattccatgagggtgaaaaaggtgaagatccatatatttcattgcctaatcaagaggatagtcaagaggagaagcaggagttacaagtttacccatccgataatttagttcttgctgcgagaacagaagatgacgtttcgtatttggatatctacgtttacgatgacggtgctgggttccacagtagcgatattcccgttgaagaaggtgatgaagctgacccagatgttgctcgtggattggttcgtgaccctgcactttacgttcaccatgatttaatgttgcctgcttttccactatgtgttgagtggcttgactacaaggttggatccaattccgaagaagcagccaattatgctgccattggtacgtttgatccacaaattgaaatttggaacttggactgtgttgacaaggcctttcccgatatgattctgggtgaacctcttgataattcaatggtgtctttgaaaagcaaaaagaagaagaagaagtctaagactggacacattactactcatcataccgatgctgttttatccatggcacacaacaaatatttccgttccgttttagcatccacctctgcagatcataccgtaaaactatgggatttgaactcaggtaacgcagcccgctccttagcttccattcattcaaacaaaaatgtttcatcatctgaatggcacatgttgaatggttccattcttttgaccggtggttatgattctcgagtagctttaacagatgttagaatttctgacgaaagtcaaatgagtaaatactggtctgccatggcaggtgaggaaatagaaactgttacatttgccagtgaaaatataatattatgtggtactgattctggtaatgtgtattctttcgatattagaaacaatgaaaaccgtaaaccagtttggacattgaaggcacacgatgctggtatctccacattatgttcaaacaaattcatccctggtatgatgagtacaggggccatgggtgaaaagactgtcaaattatggaaattccccttggatgatgctacgaacactaagggcccaagcatggttctgtctcgtgatttcgatgtcggaaatgtattgacatcgtcattcgctccagacatcgaggtagcgggtaccatggtcattggtggtgtcaataaagttttgaaactatgggacgtttttaccaatagatctgtacgtaagagctttaaaagtgaactagagaatgttcaagcaagagcaaaagaagaagcccaaaaaataggaaaaagttcaagaatcgccagaaaatacaccagtaacgataacccagatactgttataaccattgatgatcaaggtgaagatgaagaagaaagagaaggtggagatgagcatgatgacatggcataa

SEQ ID NO: 4022 - DNA, 1731 bp, Saccharomyces cerevisiae
atgtcagctactctactaaagcaaccattatgtacggttgttcggcaaggtaaacagtccaaagtgtctggattgaaccttttgagactaaaggctcatttgcacagacaacacctgtcaccttccttgataaaactacactctgaattgaaattggatgagctgcaaactgataacacccctgattacgtccgtttagttttaaggtcctctgtatacgatgttattaatgaatctccaatctctcaaggtgtaggtttgtcttcccgtctaaacacgaatgtcatcttgaaaagagaagatctattgcctgttttctctttcaagcttcgtggtgcctataacatgattgccaagttggacgattctcaaagaaaccagggtgttattgcctgttcagctgggaatcatgcccaaggtgtggcctttgctgctaaacacttgaaaatacctgctactatcgttatgcctgtttgtacaccatctattaagtatcaaaatgtctcgagattagggtctcaagtcgtcctatatggtaacgattttgacgaggctaaggctgaatgtgccaaattggctgaagagcgtggcttgacgaacattcctcctttcgatcatccttatgtcattgccggtcaaggtactgtagctatggaaatcctaagacaagtacgtaccgctaataagatcggtgctgtctttgttcccgtcggcggtggtggtttaattgctggtattggtgcttatttgaaaagggttgctcctcatatcaaaatcattggtgttgaaacttacgatgcggccactttacataattccttgcaacgcaaccagagaactcctttacctgtggtgggtacttttgccgatggtacgtctgtgcgtatgattggtgaagaaacatttagagtcgcccaacaagtggttgatgaagttgttcttgttaacactgacgaaatctgtgctgcagtaaaggatatttttgaagatactagaagtattgtagaaccatctggtgccctttcagtagccggtatgaagaaatacatctctaccgtacatccagaaattgaccacactaaaaacacctatgttcccatcctttctggtgctaacatgaactttgatagattaagatttgtttccgaacgtgctgttcttggtgaaggaaaggaagtcttcatgttagttactttacccgacgtccctggtgcgttcaagaaaatgcaaaagatcatccacccaagatctgtcactgaattctcttaccgttacaatgaacatcgtcatgagtcctctagtgaagtgcccaaggcttacatttacacttctttcagcgtcgttgacagagaaaaggaaatcaagcaagttatgcaacagttgaatgctttaggttttgaagctgtggatatctccgataacgaattggctaaatctcatggtagatacttggttggtggtgcttctaaggttcctaatgaaagaattatttcatttgaattccctgaaagaccaggtgccttgactaggttccttggaggcctaagcgattcttggaatcttactttattccattatagaaaccatggtgccgatatcggtaaggttttagctggtatttccgttcctccaagggaaaacttaaccttccaaaaattcttggaagatttaggctacacttatcatgatgaaactgataacactgtttatcaaaaattcttgaaatattaa

SEQ ID NO: 4023 - DNA, 1731 bp, Saccharomyces cerevisiae
atgtccctttctctgggtgccgctatttacattgcattaaaacctatatttaaaatttacaccattatgcttgttggctatttggtagctaagttcgatattgtttccatggaaaatgcgaaaggtatatcaaatatggttgttaacgctattttgccttgtttgaccttcaacaaaattgtgtccaatatttcatggagggatataaaggagattggagtgataatactttcagcttttatcttgtttgttttaggtgccacgggcgccttatttactacatttgctacgactgtgcccaaaaaattcttctgggggctcatatttgcgggtttctttccaaatatatcagatttacctattgcctatattcagagcatgggtaacggctccatttttactgctgaagaagctgataaaggtgttgcttattcctgcatttttttatttattcaaagtttcctaatgatgaattttggaatgtggagagtggtcggacttgattttagagatacaaaagaaccagatagtgagaatattactccgtcagtaagtcccgctatcgacgatcgcaaacttactgaaataacaaagttacctaatatcacacgtcctacaaatgcctatcaatcggaagatgcgagaagtaatagcgatttgtcttgtaactctattactacaaatgaaatgacaccgcaggcattctacgaaggttttactggctacatcaaaccctataaagaatcaaatggtgcatcccataaatttgaaagtgaccttccgcatgctgaaatatatagggtttcctcgacttattcaagcccaggcgcattggagttctcgcgaatagatggcagttccctctcatatagtcgtatatcaaaaaatagcgatggcagaagttatagaagaaaaaggaaagcggatatgaatgagttgatttccaaatacagtgccgccgaaaaaataaggcaaggtgaattagatttatcaagaccactatccttgactgaagaagttggaagcaggaacgcaagtattggtaatgtgcacactggttataccgatgaaagttccatcgaagaagaaaattgcactaatatggccaccgacgggaggggtagcctctccttctttatagagagacacaatctcaaatggttgcagtactttattataaattgcctcaggccagcatctctgggggcaatactaggaataatatgtgcattaattccctgggttaaagcatgcttcgtaacgacatatgttcacgttcataaggcgcctgatggagaacctgttctgaattttttaatggattttacagagtatattggaaatgcatgtgttccattggggcttctattacttggcggaacgttggcaagattagaaattaagtcattgccacctggatttattaaatccgccttattgatgacatgctttcgattaattgtcattcctattattggcgtcctatgggtaaataaactatattcgatcgattggctggatacgggcataggaaaatttgacatgatattaacgtggtccatgccgagtgctactgctcaagtatatttcacagcattttatacgccagcatgtggtgatcacattcaaatgaactgtttgtccgtcttatttgtcatgcagtatgcgattcttttcatcactgtggcgtttgttgttacatataccttaaaggtcgatttaaaagtttga

SEQ ID NO: 4024 - DNA, 1731 bp, Saccharomyces cerevisiae
atgtcgaatgagagcacacgagttaccgttagtcgcggttgtacagcctccgacgagtgtgcgcaagcattggaacggacaaacgatgagctagacagagaatcatcggtatcagaaagtagaagtgatgaagagagccacgagaagttatcccgacgtcgattcccgacgctaggtataggcatatggctcgatttgaaggacagaataccgtattacaagtcagattgggtagatgcgtttaattacagagttattccctctattgttgacacctactttaataacctgctacctgcaatagcctttgcgcaagatatgtttgataggactgataattcctatggtgtgaacgaagtacttctatccagtgcaatggctggaattgtttttggagttcttggtggacagcccttatgtatagtgggtgttactggccccatctctatttttaattatacggtctacgaaattataaagcctttgaataccagctattttggcttcatgttttggatttgtatgtggtctatgatttttcatttagttttagcatttacgaacgccgtttgcctcttgcaatacgtgactacgttcccatgtgacatatttggattatttattaatgtggtctacattcaaaaaggaatacaaattttaacaagacagttcagtgctaaatcaggggagaaatcagtacaagacggatttgctagtgtcgtggtggcgctggttatgactgcgtttggtcttttctttaaattatttcattattaccccctcttttctcataggatcagaacattcatatctgattattcaactgcgctttcagtgctattctggtcatcatttacacattttggtggctacttgcatgatgtcaaatttaaaaaattgcctattacgaaagctttttttcctacttccaaagtcaataggcctcaaaatacttggctggcatatgaaccgattcctgttaaagacgtctttattgccctaccatttggtatatttttaacaatcttgttttactttgatcataacgtatcgtcgctaatggcacaaaggcatcagtataagctgaaaaaaccatcctcttttcattacgatttcgcactattgggacttaccacttgcatcagcggggttctaggaatcccggcgcccaatggtttgattcctcaagcaccattgcacacagagacactgctagttagggattcaaaccaaaaggttatcagttgcgtagagcaaagatttacaaatacgtttcagggcctgatgattctagggacaatgacaagaccgttattggtatgcttaggagaaatccctcaggcagtactttccggattgtttttcattatgggcatcaatggcctaatgacaaatagtattatacaacggttggttttcctgttttcagaccctaacagaagagataatacttcacctttaatgaaagtatccaagaagtcaatgctgatatttctttcctttagcctgacggggtttgctggtgaatttgctatcacaaatactatagcggccatcggctttcccttagtattgcttttaagtgtgttagtttctttctcgtttgcttatattttcccgactgaagaattaaagattctcgatactaatgtggcacaaaaatttaccattaaaaatttgttattggaaaatattcgtgatgcaaagttctgtgataagcatgaagactaa

SEQ ID NO: 4025 - DNA, 1731 bp, Saccharomyces cerevisiae
atgtctgaagaagctgcctatcaagaggatacagcagtccaaaatactccagctgatgctttgtcgccagttgaatccgattctaattccgctttgtctactccatccaacaaagctgaaagagatgacatgaaagatttcgacgagaatcacgaagaatctaataactacgttgaaattccaaagaagcccgcctccgcctacgttacagtttccatctgttgtttaatggttgctttcggtggttttgttttcggttgggatactggtaccatttctggttttgttgctcaaactgattttatcagaagatttggtatgaagcaccacgatggtacttattatttgtctaaggttagaactggtttaattgtctccattttcaacattggttgtgccattggtggtattattttagcaaaattaggtgatatgtatggtcgtaaaatgggtttgattgtcgttgttgtcatctacattatcggtatcattatccaaattgcctcaatcaacaagtggtaccaatatttcattggtagaattatctctggtttaggtgtcggtggtattgccgttttatctcctatgttgatttctgaagtctctccaaagcatattagaggtactttggtttcatgttaccaacttatgattactttgggtattttcttgggttactgtacaaactacggtaccaagacctacaccaattctgtccaatggagagttccattaggtctaggtttcgcttgggctttgtttatgattggtggtatgacattcgttccagaatctccacgttatttagttgaagtcggtaaaattgaagaagctaagcgttctattgctctttcaaataaggtcagcgcagacgatccagctgttatggctgaagtcgaagttgttcaagctacagttgaagctgaaaaattagctggtaatgcctcctggggtgaaatatttagcactaagactaaggttttccaacgtttgatcatgggtgctatgattcaatcattgcaacaattgacaggtgataactatttcttctattacggtactaccgttttcactgctgtcggtttggaagattcttttgaaacttctattgtcttgggtattgtcaactttgcttccacctttgttggtattttcttagtcgaaagatatggtcgtcgtagatgtttattatggggtgctgcttccatgacagcttgtatggttgttttcgcttctgttggtgttacaagattgtggccaaatggtaagaagaacgggtcttctaagggtgctggtaactgtatgattgtcttcacatgtttctacttattctgttttgccactacctgggctccaattccatttgttgttaactctgaaactttcccattgagagttaagtccaagtgtatggctattgctcaagcttgtaactggatctggggtttcttgattggtttctttactccatttatttcaggtgctattgatttctactacggttatgttttcatgggctgtttggtcttttcttacttctacgtcttcttcttcgttccagaaactaaaggtttgactttagaagaagttaacaccttatgggaagaaggtgttttgccatggaaatcaccttcttgggttccaccaaacaagagaggtactgactacaacgctgatgatctaatgcatgatgatcaaccattttacaagaagatgttcggaaaaaagtag

SEQ ID NO: 4026 - DNA, 1731 bp, Saccharomyces cerevisiae
atgttgaaatatcgtacattgtctcgatcatgtcatatttttcacccaaaatctctttcaaacaataccctgaaatctgaaactactcaggaactacttcaaactgtgggattcgtaagacgctcgcaggttgggttgttccaatggctgccacttggactcagatcacttaataaagtatcaaatgctatacggaaccgaatggatagcgatggtggagccatagaagtttcattaagtgctatctcgtcaaaagcattatggcaagcgacggatcgctggaacaacagtgaattatttaaattgaaggattctaaagggaagcagtactgcttgacagcaacatgtgaggaggacattacagatttaatgaaaaattacattgctagttataaagatatgcctatcacaatataccaaatgacaagaaaatatagggacgaaatcagacccaggggtggtatcttacgtggacgagaatttttaatgaaggatgcgtattcgtttgctagtaatgaagaggatgcgtttgccagttttcaaaagctagatgatacttacaataagatattcaaagatctgaaaatcccctttgttagtgcgtgggcagatagcggtgacattggcggtgagtttagcaaagaatttcacctgattcatgaatccggtgaggataccttgatgagttgcaaacattgcggcgatatatcaactttggatatgtcccagtcatatcctgaaaaagatggtcaatattcaggtgatgtcgattgtaagtatgctttgactaaggatcactcaacattgatatgtttctactatccaaaggatagacaattgaattggaatttagcattaaatgctatggataaagacatcgatttgacgttgaggaacaaaccaaatgatcacgtcttacaagtctacgaaaaagataacgaagatattatgttcagtaaaatattaagagttatggactgtagattgaattcaaaatccaactttcctgattttccactaaagaaatacctgaaaaataattttggtcaaatcagtgacgtttctatagtggatgcacaggaaaacgaaatctgtggcaaatgtgaggaaggaaggttagaacctctcaaaagtattgaggtaggccacatatttttgctgggtaataaatactcgaagccgttaaatgtcaagtttgtcgacaaagaaaacaaaaacgagacatttgtccatatgggttgctacggcattggagtaagcaggctagttggagcaattgctgaactagggcgtgattccaatggatttagatggcccgctataatggctccatacaaagtatcgatttgtactggaccaaataatcctgaaaactcacagaggttacaggatgttaaatcagagctgctgaatgatcctaccatgcaaaatttacagaatgacatccttgaccagtttaatgaaaaactgggtataggtgctagaataaaattatcgcatgccatgggtataccattatgtgttatcgtgggctcaaaaagttggcccaatgtggaaattgaagttcgtggcataagatggggagaaaaggacctgtggagaaagcagtttgaaaaaagatgtagcgaactgcaatggaagtgtaccaaaaatgaacatggaattgagaaacatactgttccaatccagcatttagcggaagtcattggcgtattgctaaaggatatgtag

SEQ ID NO: 4027 - DNA, 1734 bp, Saccharomyces cerevisiae
atgaaaggtgatcgttcgaggcaaaatatggctgtgacaaagaaggcaaagttaaaaaaaaatgacgagccaaaaaaggttttgaagactgccgcgaccgaaaaaggtgagggatccaagcgctactccttatggaatttctggataagcacattgtttttaaaattactattgattcctgactacttcagtacagattttgacgttcatagaaattggctggcaatcaccaataaattgcccatcagcgaatggtattatgagcacactagtcaatggacattggattatccgccattttttgcttattttgaatggtttttatcgcaatttgttcctaaatctgtacgtgatgacggttgtttggatatagtggagatcggaaagttcggtttgccaacaatcgttttccaacgactcactgtcatcttcagcgaaattcttctatttgtcatccttcaaatatacattaatactacaaagctaagtgaaagatctcaaagttttgtggttgcttctagcattgtactatcacccgggtttttaataatagatcacattcacttccaatataatggttttctttttgcgattctaataggctccattgtcgccgccaagaataagagatacatcttgtgcgctgttctgtatactacagccatatgtttcaagcatatatttttatatttggcgccatgttatttcgtgtttttattgagagcatacgttctcaatgtcaacaatttcaagtttaaaagttacaaagattttttgttcctgataagatgggcaaatcttttgaagttggctaccgttgttgttggaattttcactatttgtttccttccatttgctcatcaaatgccgcaagtgttgagcaggttattcccattctcaagaggactgacgcatgcatattgggcaccaaatttctgggcgttgtattcttttatggataaaatactcactacggtaatgttgaaattaccgtacgtccacacttttgctacaaaatttattaaacctcctctgatccctcagaatatcaaggaaattaatgaaaggctcgcggcaaacaacaatggaagtaaaggtctagttcaagacgtattttttgttattctccctcaaattcctccaaaattaacgtttattttgacgatattttaccaggtcttagcagtacttccacttttgtttgatccatcgttcaaaagatttgttggctcgttgactctctgtgggttggcatcgtttttgttcgggtggcatgtgcatgagaaagctataatgctagtcatcattccgttcacatttcttgttggatttgatcgtcgtcttttggtaccgtttatgttagttgcctcagctggttatgtttccttgtatcctcttctgtacaaaggccaagattttttcattaaaacattatacacttatgtttggtgtataatttattttgccgcttttagaaaaactacgaagatttcttcaagtgtagaaagaagaatctttttcttggataggttggcattaacgtacatcttttcattgttaccaatcgtcaccgtattacaaatattggatgaagtcaagtggagatattcatttttgcaaaaatttgaattcttaggattaatgatatatagtgtctattgttcattaggtataatcagctcgtggtttgccttatcgtggttatataattttgacgaattactatggcagtga

SEQ ID NO: 4028 - DNA, 1734 bp, Saccharomyces cerevisiae
atgaacctttttgatgtggctgacttttatataaacaaaattgtgacttcccaatcgaaattgagcgtagccaatgtcaatgaacaccaaaggattaaggttttgctgttggataagaataccacacctacgatatccttatgtgccactcaaagtgagttgttgaagcatgaaatatatctggtagaaagaatagaaaatgagcaacgtgaagtgtccaggcatttaaggtgcttagtttacgttaaacccacagaggaaacactgcaacatctgctgcgtgagttaagaaatcctcggtacggcgagtatcaaatattctttagtaatattgtctctaaatctcaattagaacggctagctgaatctgacgacttggaagctgttactaaggtggaagaaatattccaagacttttttatattaaaccaagatttattttcgtttgatttgcaaccaagagaatttttaagtaataaattggtttggagcgaaggggggctaacaaaatgtaccaacagcttagtttctgtgcttttatccttaaagataaaaccagatatcaggtatgaaggagcaagtaaaatttgtgaaagattggctaaagaagtttcctatgagattggtaaaaacgaaagaactttttttgattttcctgtgatggattcgacacctgtgttactaattttagatcgtaatactgatcctataacacctttacttcaaccttggacctaccaatcaatgatcaatgagtatataggcattaagcggaatatagttgatttatcgaaagtgcctagaattgataaagacctggagaaggtcaccttatcatcaaagcaagatgctttcttcagggataccatgtatttgaattttggtgaattgggtgataaagtaaaacaatatgtgactacatacaaagacaagacacaaaccaacagccaaataaattccattgaggatattaaaaactttattgagaagtatccagagtttagaaaattatctggaaatgttgcaaagcatatggctatagtgggggaattagacagacagttgaagataaaaaatatatgggaaattagtgaaatagaacaaaatctatcagcacacgatgccaatgaagaagatttctccgatttgattaaattgctacaaaatgaagcagttgataagtattacaagttaaagcttgcatgtatttattctttaaacaatcaaaccagctcagacaaaatccgtcaactagttgagattctgtctcaacaacttcctccagaggacgtcaactttttccataaatttaaatcgctttttagccgccaggataaaatgactcaaagtaaccatgacaaggacgatatattaaccgaactagcaagaagatttaatagtagaatgaattctaagagcaacaccgctgaaaacgtctatatgcaacatattccggaaatttcgtcattactaacagatctctctaaaaatgcgttattcagggatcgtttcaaagaaatagatactcaaggccatagagtgatcggaaaccagcagagcaaagatattcctcaggatgtaatattgtttgttattggcggtgtaacttatgaggaggcaaggctagtccatgatttcaatggaacgatgaataacagaatgagggtggttttaggaggcacctctatactttcaactaaagaatatatggattctattagatctgcaaaataa

SEQ ID NO: 4029 - DNA, 1734 bp, Saccharomyces cerevisiae
atggctgatattactgataagacagctgaacaattggaaaacttgaatattcaagatgaccaaaagcaagccgccactggttcagaaagccaatctgttgaaaactcttctgcatcattatatgttggtgacttagaaccttctgtttccgaagcccacttatatgatatcttctctccaatcggttcagtctcctccattcgtgtctgtcgtgatgccatcactaagacctctttgggctatgcttatgttaactttaacgaccatgaagccggcagaaaagcaattgagcaattgaactacactccaatcaagggtagattatgccgtattatgtggtctcaacgtgacccatcattgagaaagaagggttctggtaacatctttatcaagaacttgcaccctgatattgacaacaaggctttgtatgacactttctctgtgtttggtgacatcttgtccagcaagattgccaccgacgaaaacggaaaatccaagggttttgggtttgttcacttcgaagaagaaggtgctgccaaggaagctattgatgctttgaatggtatgctgttgaacggtcaagaaatttatgttgctcctcacttgtccagaaaggaacgtgactctcaattggaagagactaaggcacattacactaacctttatgtgaaaaacatcaactccgaaactactgacgaacaattccaagaattgtttgccaaatttggtccaattgtttctgcctctttggaaaaggatgctgatggaaaattgaagggtttcgggtttgttaactacgaaaagcatgaagacgctgtgaaagctgttgaagctttgaatgactctgaactaaatggagaaaagttatacgttggtcgtgcccaaaagaagaatgaacgtatgcatgtcttgaagaagcaatacgaagcttacagattggaaaaaatggccaagtaccaaggtgttaatttgtttgttaagaacttagatgacagcgttgatgacgaaaagttggaagaagaatttgctccatatggtactatcacttctgcaaaggttatgagaaccgaaaacggtaagtctaagggttttggttttgtttgtttctcaactccagaggaagctactaaggccattacagaaaagaaccaacaaattgttgctggtaagccattatacgttgccattgctcaaagaaaagacgtaagacgttctcaattggctcaacaaatccaagccagaaatcaaatgagataccagcaagctactgctgccgctgccgccgccgctgccggtatgccaggtcaattcatgcctccaatgttctatggtgttatgccaccaagaggtgttccattcaacggtccaaacccacaacaaatgaacccaatgggcggtatgccaaagaacggcatgccacctcaatttagaaatggtccggtttacggcgtccccccacaaggtggtttcccaagaaatgccaacgataacaaccaattttatcaacaaaagcaaagacaagctttgggtgaacaattatacaagaaggtttctgctaagacttcaaatgaagaagcagctggtaaaattactggtatgattttggatttgccacctcaagaggtcttcccattgttggaaagtgatgaattgttcgaacaacactacaaagaagcttctgctgcctatgagtctttcaaaaaggagcaagaacaacaaactgagcaagcttaa

SEQ ID NO: 4030 - DNA, 1734 bp, Saccharomyces cerevisiae
atgggaaagctgataaagttaatcacaactctgacggtgttggtatcgttgcttcagtactgttgcgaattcaatagtgggagcatatcgtgtgaacgcacgcaaacgctttgccattataccaatccaagagtctggaacacctacttttcaagaaattgtgaattatacaaaaataaagttagtcccggtttcgatatagtggcgcgtaaatatgacacggctgtcaaacctgtcatcgatgacgctacagtaaaagtgaacaaggtcgctatacagcctgcattcaaggtcatccattcacaatgtaagaaatggaactgtggaaagtattaccaattggtccgctccccaatggtcaagactagacgatttttcttcgcaaaatacaatgcttttgtgaaacctaacttagacaaattctttactgcggagtttcgctctcatttgaaggaaagaattttaaagtataaaaatataggccattattactttactatcacttcaagatgcatcaaatccaaatacgactttattgttggtaatacagaggaaaaattaatgggaaagttcaagaataaggacacgcatggcattcatggttctgtcacacgtgagccttcctcggaggacatggttttaaccgtaagtactatggagtctgacgaagaggagctaactacaacaagtactcaaacagtggttgaaacaattactttggaccaggaagaggctagcgctgttgctaatcatgcgcacgacgatgaggcttccacagacgttgaaggctccacagacgtcaatgtcaatgaacaggctctgttgcaagaggattttgacatgtggagtgagactatattgcagaaaacacaagacgtcatacagctatttgaaaaggatgtttccaaatacatcaatggtaaattggttgaggaggccaaccattttaaagccaagtttcaatctttagatgataaatctaagaagttcttctccaagatttcgctagccattaacgatattgaatgtgtggaaggcattgatagtgaaactggcaagaaaattttcttcgataaatctggaagtactgagatttctcagtacataacgagagagttagttcgtgagtacttcaacgagacgcgctcgacgttagacgaactgacaaatgctatggagaaagatttgagcgaaatcactgatgaaattgaaaaaaaagttaatgcaattagagaggaaaacgtcgaggtatttgaagaatggggtgatatcattgtaaatgaatggtccaaaagaatggcttatgtggatgttatcaacgctcacatgggtgcagatgatgacactacgcttgatgaagagaaagcaaagtcttctgttaactggaagaagtttttgaagggcaagaaacagatcatagaatctagagacaagctggctcaccattccgctgacttatcccgtgttaacgcgtttaggcaaaaagtgcaaaagaagatattatcgttcactcaagagagtggtgagtttttgtatattctaagatcgaaagccaacctgcaatttcaggaacgtgaaagaaaggaacgtgaaagaaaagagcgtgaaaaagctgcagcagaagagttccaaaggcagcaggagctattacgacaacaggaagaagaagacgaagaagacgtatcctacacctctacttcgaccatcaccacaaccattaccatgacattgtga

SEQ ID NO: 4031 - DNA, 1734 bp, Saccharomyces cerevisiae
atgtctaccgctaccatacaggatgaagacattaaatttcagagagaaaactgggaaatgataaggtcacacgtttcacccataatatccaatttaacaatggacaacttacaggaatcgcacagagacttatttcaagtcaatatacttattggccgcaacataatttgtaaaaatgttgtggattttactctgaacaaacagaatggcaggctaatccctgctttatccgctttgattgccttgctaaattctgatattccagatattggagaaactttagcaaaagaactaatgttaatgttcgtgcagcaattcaatcgcaaagattacgtgtcctgcggaaatatccttcaatgtctgtccattttatttctttatgatgtaattcatgaaatcgtgatcttacagattctattgctactccttgaaaagaattctttacgactggtcattgccgtgatgaaaatatgtggctggaaacttgcacttgtcagtaagaaaacccatgatatgatttgggagaagttaagatatattttgcaaacacaggagttatctagtacactacgtgagtcgttagagactctgtttgaaataaggcaaaaagattataaatctgggtctcaaggtctgtttatattggacccaactagttacacagttcatacgcactcctatattgttagtgatgaggatgaagccaacaaagaactgggaaattttgaaaagtgtgaaaatttcaatgaactaaccatggcgtttgatacgctacgacagaagctgctgataaataatacgtccgacacaaatgaaggtagtaacagtcaattacaaatctatgacatgacatctaccaatgatgtcgagtttaaaaagaagatttatttggttctgaaaagttcattatcaggtgacgaagcggctcacaaattgctaaaattaaagattgcgaacaatttgaaaaaaagcgtggtagatataatcatcaaatctagtttgcaggaatctacattctctaaattttattctattttgtccgaacgtatgataacgttccacaggagttggcagacagcttacaatgaaacttttgagcagaattatacacaagatatcgaagattatgaaactgaccaactgcgaatcttaggtaagttttggggacacttaatatcttatgaatttcttccaatggactgtcttaagataattaagttaactgaggaagaatcgtgtcctcaaggaagaattttcatcaaatttttatttcaagagctcgtaaatgagctcggattagatgagctgcaattaaggctaaactccagcaagcttgacggaatgtttccgctggaaggagacgccgaacatataagatactccataaatttctttactgccataggattgggcctgctcacagaggacatgagaagccggttgacaattattcaagaagttgaggatgcagaggaagaagaaaaaaaattgagagaagaggaggaacttgaaaagttacggaagaaggccagagagtcacaaccaacccaagggccaaaaattcacgaatccaggttatttttacagaaggacaccagagaaaatagtagatcaagatcgccattcacagtggaaacaagaaaacgtgctagatccagaactccaccaagaggatcgagaaaccatcgtaacagatccaggactccgcctgcaagaaggcaacggcatagatga

SEQ ID NO: 4032 - DNA, 1737 bp, Saccharomyces cerevisiae
atgaaatacgttgttgtttctggtggtgttatctcaggtattggtaagggtgttttagcgtcctctacagggatgctactgaaaaccctcggcctaaaggttacttccatcaagattgacccatatatgaatattgacgccgggacgatgtctcccttggaacatggtgagtgttttgtacttgatgatggtggggaaacggacttggatctcggtaattacgagcggtacctcggtattaccttaagcagggaccacaacatcaccaccggtaagatatactcccacgtaatttccagagaaaggagaggtgattatttaggtaagacagttcaaattgttcctcatttgactaacgcaattcaggattggattcaacgtgtttcaaaaattccagtggatgacacaggattagaaccagacgtctgtatcatcgagttaggtggtacggtcggtgacattgagagtgcgcccttcgtggaagcattacgacaatttcagttcgaagttggaagagagaatttcgccctgatccatgtttcacttgtgcccgtcattcatggtgaacagaagacgaaacccacccaagcagcaatcaaagatttaaggtcattagggcttattcccgatatgattgcctgcagatgcagcgaagaacttaacaggagcactattgacaagattgccatgttttgccatgtggggccggagcaagtggtcaacgttcatgatgttaactccacgtaccacgttcccttattgctgctaaagcaacatatgatcgactacctccattcaaggttgaaattaggtgaagtgcctctaaccttggaagacaaggaaagagggtctcaattattgactaactgggaaaacatgaccaaaaacctagatgattctgatgatgttgtcaagattgctcttgtgggaaaatacactaatttgaaggattcctacctatctgtgaccaaatccttagaacacgcaagcatgaagtgccgtcgtcagctagaaatcctctgggtagaggcaagtaacctagagcccgaaactcaagaggtggacaagaacaagttccacgattcatggaataagctcagttccgccgacggaattttggttcctggtggatttggcacgagaggtattgaaggtatgattcttgctgccaaatgggcccgtgaatccggtgttccctttcttggtgtctgtcttggattacaagttgccgctatcgagttcgcccgcaatgtgataggccgcccaaacagcagttctacagaatttttggacgagacactactagctcctgaagaccaagtagtcatatacatgcccgagatcgacaaggaacacatgggtggcacgatgagattgggtttgaggcctaccattttccaaccgaactcagaatggagcaacataaggaagctttatggtgaagttaatgaggtgcatgagagacatcgtcatcgctatgagataaacccgaaaatagtgaatgatatggagtctcgtggctttatttttgttggtaaggacgagacgggccagcgttgcgaaatattcgaattgaaaggccatccatactacgtgggcactcaataccatccagagtatacatcgaaggtgctggaaccatcaagaccgttttgggggcttgtggccgcagcctccggcacacttggtgaagtgatcaaggacataaatctaagcgagggaaatgaaaatgaatga

SEQ ID NO: 4033 - DNA, 1737 bp, Saccharomyces cerevisiae
atgatccggttaccgaggctgtatcaaaggtacctattatacttggtagtttttgtagtgattgccctattttacttcctacaggcgccaagagttgaagagcacattggtttcgaccttgcactcccgatatcacacgttgataatctatggttccaaaataaaggtctagagggattctcaaatgacgataagctagttgtaaatataggctatgacgaatgttttcatattggtcgtttttatgaaggatgttttaatcggcatgaacttaaatcaactttaactgatgggcaccaatacttacaaaggaaaagaattcataaagacttgagaggttcctttggacgcaggtggtttggaaagtcagaatacctttactatgatgtgttataccctgctttggtggactactttggatccaacctagaaaagctaaatgttgaggcagtaactggaatttccaaatatcctaaagacaaatcgctaccctttatggatgtatccatcacattcgagcctattagcatagaactattgcagaaaaggagctacataagcgatattaacattctctttggtgttgattgcatccagccgatagcaaattggactcttcaaaaagaatttcccttagtaaaataccgctacagcgaacctgcttatttgacttacaaattcgttggtactcgtcctgtagacacaggagctcaacggctgcaagaaactgatgaaggaaagttcaaaattgttcagttggcggatctccacttgggtgtgggggagtctgaatgtatcgatgagtatccaaagcatgaagcttgcaaggcagatccaaaaacggaaactttcgttcaacaagttcttgacattgaaaaaccgcagttggttgtttttactggtgaccaaatcatgggtgatagatctattcaagactctgaaaccgtattattaaaggcggtagcacccgtcattgcaagaaaaattccgtgggcaatggtatggggaaatcacgacgacgagggaagcttaacgcgctggcagttatccgaaatagcttcagtactaccatattcccttttcaagtttagtccccatgatacacacgataatacgtttggcgttggtaattatatttatcagattttttcgaacaatgatacagaagtcccagtaggtacactttattttctggactcacataaatattctacggttggtaaaatttatcctggatatgattggattaaggaatcacagtggaaatacattgaagattatcatgatgtgaacttgaagttcaaaacaggtctttcaatggcattttttcacatcccactgccagaatacttgaatattgaatccaagacacatcccggagagaaaaatcccctcattggaatgtacaaagaaggtgttactgcacctaagtataattctgaggggataacaactttggataggttaagtgtggatgtcgtcagttgcggacatgaccattgtaacgattactgtcttcgagatgactctacgccgaacaaaatctggctatgctatggcggtggaggtggagaaggtggttatgctggctatggaggtacagaaagacgtatccgtatttatgaaattaatgtaaatgagaacaatatacacacatggaaaagattaaatggcagtccaaaagagatttttgattttcagtctatgttggacggtaattctccagaatctgtttaa

SEQ ID NO: 4034 - DNA, 1737 bp, Saccharomyces cerevisiae
atgggttcatgttgtagttgcttgaaagattcttcagacgaggccagtgtctcaccaattgccgataatgaaagagaagcggtgactttattactagggtatttggaggataaagaccaattagacttttactctggtggtccactaaaggccctaactactttggtgtattcagataatctaaatttgcaaaggagcgccgctctggcattcgcagaaattactgaaaaatacgtccgtcaggtctctagagaggtactggaacccatcttaatattattacaaagccaagatccacagattcaagtggccgcttgtgcagccttgggtaatttggccgttaataatgaaaataaattattaattgtggaaatgggaggcttagagccattaataaaccaaatgatgggtgacaatgtagaagttcaatgtaatgctgttggatgcattaccaatttagccacaagggatgacaataaacataagattgctacttctggtgctttaattccattgactaagctagctaaatccaaacatataagagttcagagaaatgctacaggtgcattattaaatatgacacattctgaggaaaatagaaaagaattggttaatgcaggtgctgtgcctgtattggtatctttactgtcgtccaccgatcctgatgttcagtactattgtactactgctttatcaaatatagcagtggatgaagccaatcgcaagaagttggctcaaactgagccaagattggtttccaaattggttagtctgatggattctccatcttcaagggtaaaatgtcaagctactttggctttacgaaacctagcgtccgatacaagctaccaattagaaattgtaagggctggtgggttgcctcatttggtaaagttgattcaaagtgattctataccactggttttggctagtgtggcatgcattagaaacatttctattcaccctctaaatgaaggtttaattgttgatgcaggtttcttaaaaccattagtaagattgttggactataaggattcagaagaaattcaatgtcacgccgtatctactttgagaaatttggctgcatcatctgaaaaaaacagaaaagagttcttcgaaagtggtgctgtcgaaaaatgtaaggaactggctctagattcacctgttagtgttcaaagtgaaatttccgcatgttttgctattttagccctagcagatgtctccaaattggatctactggaagcaaatatcttagatgctttaatccctatgactttttcccagaaccaagaagtttctggtaatgctgctgctgctttggcaaatctatgttcaagagtgaataattatacaaaaattattgaagcatgggatcgtccgaatgaaggcattcgtggatttctgattagatttttgaaaagtgactatgctacctttgaacacattgcgctatggacaattttacaattgctagaaagtcataatgataaagtggaagatttggttaaaaatgatgacgacatcattaacggagtgagaaaaatggcagatgtgacctttgagcgtttacaaagatcaggaattgatgttaaaaatccggggagcaacaacaatccaagctcgaatgataacaacagtaataacaatgacacaggatctgaacatcaacctgtagaggatgcaagtttggaattgtataatattactcaacagattttacaatttttacattga

SEQ ID NO: 4035 - DNA, 1737 bp, Saccharomyces cerevisiae
atgtcaattcaggcttttgtcttttgcggtaaaggttccaatttggctcccttcacccagccagattttccattccaaacgcagaacaaagacagtacagctgccacgagcggtgacaaacttaatgagttggtcaatagcgccctcgattcaactgtcataaatgagttcatgcaacattcaacgcgcttgcccaaggctcttttgcccatcggtaatagacctatgattgaatacgtcttggattggtgtgatcaggcagatttcaaagaaatcagtgtggtcgcacccgttgacgaaatcgaattaattgaaagtggactgacttcgtttttgtccctaagaaagcaacaatttgaactaatatacaaggctttgtcaaattccaaccacagtcatcacttgcaagatcctaagaaaattaatttcatcccttcgaaggcaaattctacaggtgagtccttgcaaaaagagcttttgcctagaatcaatggcgattttgtaatcttgccctgtgattttgtcacagatatacctccacaagtcttggtcgatcaatttaggaatagggatgataataacctagcaatgactatctactataagaactctttagatagtagtatcgataaaaagcaacagcaaaagcaaaaacaacagcaatttttcactgtttattcagaaaacgaagactcagagaggcagccaatacttttggacgtttattctcaaagggacgtcacaaagacaaaatatctacagatcagatctcatttattatggaactatccaaatttaacagtatccactaagttactgaactcattcatctacttttgttcctttgaactttgccagttgttaaaattaggacctcaatcaatgtcaagacaagcttcattcaaagatccatttactggaaaccaacaacagcaaaaccctcctactactgatgatgatgaagatcgcaatcatgatgatgacgatgattacaaaccttcggctacatctatccagcctacctacttcaaaaaaaagaatgatctcatcttggacccaataaactgtaataaatcattgagtaaggtttttagagatttatctcgtcgttcgtggcaacattcgaaaccgagggaaccaataggtatttttattttaccaaacgaaaccttgttcatcagagccaataacttgaatgcttacatggacgctaatagatttgtactaaagataaaatcacaaacgatgttcacgaaaaatatacagattcaatctgccgctatcggtgctgatgccatagtagatcccaaatgccaaatctctgctcatagtaatgtcaagatgtctgttctcggtactcaggccaatattggttccagatgtcgtgttgcagggtctctcttatttcctggagtccatcttggtgacgaagtaatcctggaaaattgtattattggacctatggcaaaaatcggttcaaagtgtaaactcagcaattgttatatcgaaggccattatgttgtggagcctaaaaataactttaaaggtgaaacactggccaacgtttatttggatgaagatgaggaggacgagttaatatatgatgatagtgttattgctggagaaagtgaaatcgccgaagaaactgacagtgatgatagaagcgatgaagattctgatgatagtgaatataccgacgagtacgagtacgaagatgacggattatttgagcgttaa

SEQ ID NO: 4036 - DNA, 1740 bp, Saccharomyces cerevisiae
atgaagtacgttgttgtttcaggtggtgtcatttcgggtatcggtaaaggtgttcttgcatcttcaactggtatgctaatgaaaaccctcggtttaaaggttacgtcaattaaaattgacccttatatgaacattgatgcaggtactatgtctcctttggaacatggtgaatgtttcgtgcttgacgacggtggtgaaacagatttggacttgggtaactacgagagataccttggagttactttgactaaagatcataacattactactggtaaaatatactcgcacgttattgctaaggaaagaaaaggtgactatttaggcaaaaccgtgcaaattgtccctcatttgaccaacgctatccaagattggattgagcgcgtggccaaaattcctgtagatgacaccggtatggaaccagatgtttgtatcattgaattgggtgggacagttggtgacattgaaagtgctccttttgtggaggcactaagacaattccaatttaaagttggaaaggaaaattttgccttgatacacgtttctctagttcctgtcatccacggtgaacaaaaaactaagccaactcaagctgccatcaaaggtttgaggtctcttggtttagttccagatatgatcgcctgtagatgtagtgaaactttggataaaccaacaatcgataagattgccatgttttgtcatgtggggcctgaacaggtggttaacgttcacgatgttaattctacttatcacgtcccattgttgctactggaacaaaagatgattgattacttacacgccagattaaagttagatgaaatatcacttacagaagaagaaaaacaaagaggcctggaattattgtctaaatggaaggccacaacaggtaacttcgatgaatccatggaaacagtgaagattgctttggttgggaaatacaccaacttgaaagattcttatctatcagtgataaaagcattggaacattcatccatgaagtgtcgtcgtaagttagacattaaatgggtggaagctactgatttggaacctgaagcacaagaaagcaacaaaactaaatttcatgaagcatggaacatggtcagtaccgcagacggtatcttaatccccggtggttttggtgttagaggtactgaaggtatggttttggctgctagatgggctcgtgaaaatcacattccattcttaggggtttgcctgggtttacaaattgccaccattgaatttacacgtagtgtgttgggaagaaaagacagtcattcggcagaattttatccagacattgatgaaaaaaatcacgttgtcgttttcatgcctgaaattgacaaggaaaccatggggggctcaatgagattaggtttgagaccaacatttttccaaaatgaaactgaatggagtcaaatcaagaagttatacggtgacgtctccgaagtccatgaaagacaccgtcaccgttacgaaatcaatccaaagatggttgatgaattggaaaacaacgggttgatctttgtaggtaaggacgacactggaaagcgttgtgagattttggaattaaagaatcacccatactatattgctactcaatatcacccagaatacacatcaaaggtcttagatccatccaaaccatttttgggtttagttgctgcttccgctggtatccttcaagatgtcattgaaggtaagtacgatcttgaggccggcgaaaacaaattcaacttttaa

SEQ ID NO: 4037 - DNA, 1740 bp, Saccharomyces cerevisiae
atgaatagggacaacatggacacaacaaagcgcaaagaagatcatacaaagcatactactgatgtaatagaattttacgaagaaggaaccgcagcttcttctttaaacatagccacagaaaaggccaactcaagtccgtccattttgagaagaattatcaacagggcggcatggctttctaagaaagtggacgcaatgggagtagagtctaccggtattcagaggatatctccctatgaacgaggaacatcaaagaaacaatttttgcatgtcgcggggctatggttgagtgccacaggtggtttgtcttccatgtcgtcgtttttattaggccctctgcttttcggtttaagctttagagaatccgtagcctccagtttaatatcggtaacaattggttgcttaattgctgcctattgctcgatcatgggaccgcagtccggttgcagacagatggtaacagctagatacctgttcggatggtggtttgttaaattagttgcattagcttccattatcggtgtcatgggttggtctgtggttaattccgtggttgggggtgaaatgttagctgctatttctaatgataaagtacccctatgggtagggattgtcatagtgaccgtatgctcctttttagttgccattttcggtatcaaacaagtcattaaagtggaaacttacttatccgtacccgtcctgacagcatttttactactgtacatttcatcaagtgataaatacagcttcgtcaatgcatacgtttcaaagggaaatttggactcttccacccgaaagggcaactggatgagttttttttcattatgctatagtattacggctacttgggggtctattacagcagactattatatattgttcccagaagatacaccatatattcaaattttttgcctaacgttttttggaacatttttgcctacctgtttcgtcggaatcttaggtctcttactagcttctgttgccatgtcgtataagccttggtcagtcgagtacgattcccatggaatgggtggtctactttgggcaggttttcagcgttggaacggcttcggaaagttctgcgtggtagtactggtattcagtttggtatccaacaacatcatcaatacgtattcggcagcattctccatccaactttctagtgtgttttgtgcaaaaatccctcgctggttctggtctattgtttgtactataatttgtttggtatgcgcattaataggtcgtaatcattttagtactattttgggaaatttcctaccaatgataggctactggattagcatgtactttatcttattattcgaagagaatttagtattcagaaggtttttcttacatttgtacaccaaagagtttcctacagttacaggagaaataaatggaccggaacttgttggatcttcaaaagaagtggagaaagatgcagttactaatatccatttgttaaaaagaaaacataaggtgactaaacatcgttacaattgggacaaatgggaagattatgaggttttaacgcacggttatgcagcaacatttgcgtttattgtaggagttgctggtgtggtagttggtatggcgcaagcctattggattggcccaattgctgccaaatttggtgaatatggtggtgatgtcgcaatgtggttaagtatggcgttctcaggtgttgtataccctccttgtagatacttagagctacgtaaatttggtcgttaa

SEQ ID NO: 4038 - DNA, 1740 bp, Saccharomyces cerevisiae
atgagtgagaccagctcaagtcgcaggagcgcgagtaaagacgctgtcaaatcttacttcgcaggcaaatacaataaagtgttggattctatactggaggcagaagcagcaatatcaaaatcgccaactgtagcagaagatctatcaggaagctcctccagcggaaattctgagatgagccatccttcgctaaccgcctcctccgcaacaagccaaggcattagcaaaaaggaactactccaacaaattgctggttcattattcagtacgtccattgagcgcctgaagactgcccactcatcagaagtatcaagtactccggaatattcagtaaatgattcgtatggagagcaagagtgcagggagtgcgatggtgttttcaagtgttcagcgcactttgagggcgcgcccgaatattatgacgatgaaaccgaatcagggccagctctagaacctatgacttccaatagtgaaaaagatccttttatcgatgtatttttggataaactaatatcgaggttggtccctgaaaagctaccagaaagagagcattttagtagcaaaaccaccattgagcatgatctagacacaggaagggttcccgtgttttcagcaactacattgggtagtaatttcaaaaaattgtctaagaaaatgggctcaatatttgaactccaggactccatagttcgactgctgacttggagaaaccctaccgggacggtgacgtcgttaatattattcactttgatatgttttaatccaatgtacttggtaattttgcctatattccgctttgtctatggtattgtagttcctggctatgtgcgtaaacatcctttacaaaggagtatatatcctctgaaacggaatcacggatcatcattgttatatgatgtgtgctatgagggaaaaaatgagtacagctacggtcaacagtttttctccaaatcttttatggacactttggaatcaagaaatcaagaaatagacgaaatatcagaattagataaaagaaccgaaaacacaggggaattgaaacaaggaatgaaagtactaattaatttacgcgatatgcaaaacatgacctctggtacccttcatgttattgaggcaatcaatagttttcttcgtaagtcttctagttttcaaaacgaagagtgctccactaaacgtttttttacaggatttcttttgattgttttcttaaaaatattatcaccatttgtgaattggagctatgtatgtagcatattcgcctggtgcttactgatatatatgcatccaagagctcatccaaaaataataagttttttcaaaacaggaacaatgggaaaagaatacaaaaacttgaaaaaaagagaacaccaggcgcttaacatgatattcgatgaacaaccggaaactaaattcatcgagatttttgaaatatataaaaaggccttactgccgaacgactggaagtttttccgatattcaaatagaattttcgatcctcaagatccgtatagaagagcacagcaattcccaccgggagtagattctttggctgatgttattccccccacaggctggtcatttgatcctaattttgagtggaaaattgacaatgatgtggataggtgggtggtagaacgtgggttgaatctgccaattaccggcgaattcttatttgatccaatgttcaagaggaggagactgatacatcgtgttattaagaatgcaacaccagtagcataa

SEQ ID NO: 4039 - DNA, 1740 bp, Saccharomyces cerevisiae
atggatgaaaacggtacagtaaagcctggctatgaattaaagggactcaattcgggaaattcgaggtcaaatatggataaggatcccatcgttagcaaatttcatagggctggtctcaatgattctgcagacgaggaagatactgatatcaatggtaatcgcaacactagctggataacttcaatgattagtgaagaaaaacgcaaggtggagggaaaatctatgctgaatgatgaggaagatttgcatttatccaaagctactttgaacaaatgcgatgctctagttaagatattagcggatattatcaagctagagtttgttattcaccaatcatggtatatcagatcccttcacaagagtgtcttaattcaatttgaagtagaaacgtctggtggaaataagaatagcgccggtgatagcggcgacgatgatgatgataatcataatggtaatctggacgatagcttttataaagatttaagcttaaaatgcatcaaaaaatgcgagaagtcttcccttgcacttgagtcgctgtcaagggacattgaccaaattagagatttcataatgtccaatacaatagaagacaacagggttgacaggcttttgcagaattcgatgaccctgttattagagtgttggatctactctatgaagagattgcgccgtctaaggatgaagattgcaggtatctttgttaggtccaaacttttgcttattgatcatgaattagtgaccatatggcattttttacaggagcaaaacgagcacgaaacggttaataatgagaacgaactgaaattggcagaaacaataaaatcatacagagcgttcattaagatatttattcaacaattggaggactccgaatcgggatctccatcctcctctttgtttgaagaatgtttacacgtttttttggatatagaatcgatgtacaactctttaaacctgaattggcttttgaacgaaaacaaagcattacaagaaagactactatcaccatcgtcgacatcggagaacgatcatactaataaccttcccgttattgatgagacaaaggaaatcgaagatatcagctcatttgtcaatagcattgtggatgcatccatgttgacacatgatttgactcctattaactcatcagatagcgacaatttatcaaacggagaaatcgatcgtctagatggaagaaggttatcctcttccacgtcagatatgtcattgatgatgcaaaggacttctctgcagaaacaacttcctagcttattaactgccttcaacaacgcaagaagactagaacaagaattgcaaaacgcatgcaaagtaaacgataacaaacatagcacgaaagatactgattcaaatatacgacggaatgaacatgctatgtcttcaagtgtatcctccatcatctcccaaaactccacattagcatcaccgtctcctccgatgtcatcgtcctttatatccacggcgccatcacaatcaagttctcgtatgagtacattaccactgtctccttcctcttcattattggaatcacaatcgcaaacgctgaagaacaatatgtcgcaatggttgaaccaatcgcgatctggcctcaacggcacaaaacttattccaacaaaccacattgggtttcacagcaatgttctgaatactttgtatggtatcggtggtggtccggtatcgaaatcttataaatccaatcaaccttcttcacaaaatacttga

SEQ ID NO: 4040 - DNA, 1740 bp, Saccharomyces cerevisiae
atgtatgtcacttttaatgaggctttggatagttcttttggtaatctagagagtccgaatcatgacttcaaagtaggtgaccctaacatggtaccaactccccctatggattcagattctgcagcaattagtttggctttcttaataagtctttctattacgtttgcaatattaatgctcatcttggtagtaatagcggcatatgtcaccttttgtggtgatgatgaatcagaatacgacgaagagaacgccttaggtacacgaacttcaggaactctgcactctttgtttggtaaaaaacatagtggcatcttgttggattcgagttttgcatcccctggcgggtttgatgatgagatcgttcttcaggaaagagaacttgaagaattaccaaagatgtcagcgtacgaggttgagttgtatataagagcgaaagagtttcaaatgatgagcccgccaatggtgaaggactttggcacgtatttggacagtgacgaccagcagtttattaaggatcgtggcattcaaagctattttttgctaccaagcattaatgataatatagacgaatatggaaactttctacccagttttattgtccaggataaactagatattcaattttcaaagttcaataagagctcatccactgtaatgaactatcccctacctcacaataggaaggacgcagtgtatttcgaagttaaaattttcagacatattcaaaagtccaatagtatattcagtataggtttgactactgtaccatatccttatttcagggtaccgggcatggccaaatactccattgcatacgaatccacaggtaaactgaggataaataaccccttcactgccagcacattattaccaaaattggaagaaggtgacacggtaggattcggttacagatataaaacaggtacaatcttcattacacataatgggaaaaaattaatggatgtaacacaaaatattggcattgatcttttcattggaattggcgcgtttaatgccgcatatacaagaacatatacgagggatggtctattggaagacccggataatgttagcttccgtgaagctctctctgaaggcaaagatattgaagtcgccaaagatcttcaaagagttcacgatccacatgatgaaagtgatgaaatgacgtcagatgaggttgaattacatgttaatttgggccaagttgggttcgtctttatagaagccaatgtgaaaaaatatgcgtttgggagtgtttatggccaaattggaattcctcctgcgtataatggaaccgagatcaagaaggatactattttacagaaaggagaagaattgccaccaagatatgctgacactgataatttctttggtagtatgaaggtaaaagaagggtcatcctctaggataacggcgcaaactagtaagcccctgtggtctgttgggacgtatgaaagaatctcttctaactttgacagagaaaataatgtttaccacgacagtcttgaaaccgacgataacaacaccgataacaatgttaataacaacgatgagaacgctggttgcaatgaaaattcgccattattggaagatgatggcaataaaagaccggaaaattcaaataccccccgtgaagtatcagatggagctatcaataagaaccctagaaataaatctactaaaaaacgtcaaagaaacagaggcaaatcttctaaaaagaagaacagatcgagaaaataa

SEQ ID NO: 4041 - DNA, 1740 bp, Saccharomyces cerevisiae
atgtccctttttaccaggccttttctaaggagcccccggcagttttctgtagcaaggtatgtgtattgggctagaagccctgcccttcgaagtaacttgagaataccgtcaatagcagcggcatcgctaagagcatattctaatgagtctaaaactggaagggatgctcctcccgacaaaaaatcaaaaaagctatcaaacctgaaatacattactgaaagggattccctgctggtgcagaccaacaatatttttactaagctcaaaataaacatacgatggttcttgaaaaagtccacccggccgttcaattcagacgatataagtgcgttcatctcatggatcctcgtgagcaacattttcatattcatcttctggacaaccacctttgtatctttgatcctttacttaatcaataccgtgtttgcacaagaatacctcgcaagcaagattggtaaatttattactaagaatgagtcgttgtcaatcgttttcgagagtgccattgtaccagactggtcgtctgggaaaatcagctttcaaaaagtcttcgtctccaggagaccaaaggtctcgcgcggctttaccaagggttcacagcaggatgccctgcaaagggcgaagttggcccttagtgagagaatattggttaaccaacaggactttgataatggcaattatacacagtttgatctgaccattgaccaagtcgacatatcgttgaatttcagaaagtggataaatgggaagggtatcctagacgaagtgaccataaatgggcttagaggagtcatagacagaacacacgtggtgtggaaaaaggacgacgatcctaagaactatctgaacgtctaccagccgggcgactttgaaatatcaaaattcaccatgaacgatgtcctttgtacactgtaccagccaaatgggttcaggccattccaggtgagtatatttaattgcgatctaccgcaattgagaaaacattggttgttctacgatatcttgaatgcgaacaatatcaatgggacctacgacaattcaatgttcactatccacaagaagttcagaaccgatgatcagcatcaggaccccacgctgctatggaagcaaatgacaaggtttagggtagacaatctcgacatcgatcacctgaacgccggtatcgaaggaccctttggatggatcaacgaaggtcgcgtgaacatgattggcgacgttcttttaccagatgacgatgccgcgtctgactcgctgcaactgacagaaatcctcacagagatcggtgaccgcttaatcaaaaaagcgaaaaggtacacttcatcccttcctctggttgggccaggattctccccggccgttgatgaaattgacccgaacgactactttattatggacttttctttaagactatacaatgtcaaagccgaagtccctctgttcacttctggcttaacgtatatcaatagtgcattgataaggcctattgtcgggtacatcaattctcacaggacatacatcccaatcaaatgccgcattgtaaagaaaaagtctgattttgagggctcctggaccatatatgattcataccttatgcgggatctaagtgcggaagcgtacgatgccttcgccgactacgtcgctgacgatgaaaagaggacattacgcttgagaagggtgggcttttggtcactgcaacttatactccaggtgattttgatgagtctcggtgctatcgcgtga

SEQ ID NO: 4042 - DNA, 1743 bp, Saccharomyces cerevisiae
atgcttatcagatttagatcaaaaaacggtacacacagggtttcttgtcaagaaaacgaccttttcggaacggtcattgaaaagttggtgggtaatctggaccccaatgccgatgtcgacacatttactgtttgtgagaagcccggtcaaggtattcatgctgtttctgaactagctgatcgaacagtgatggatctaggactaaagcacggtgacatgctgatccttaactattcggacaagcccgctaatgagaaagatggtgtcaatgttgaaatcggatccgtaggtattgacagcaagggaattcgtcaacacaggtacggtccactaaggatcaaagaactcgctgtagatgaggaactagagaaagaggacggattaattcctcgtcaaaaatcaaaactatgcaagcacggtgatagaggtatgtgtgaatactgctcgcctttacctccttgggacaaagaatatcatgagaagaataagatcaaacatatatcgtttcattcatatcttaaaaagctaaatgaaaatgctaataagaaggagaacggcagctcttatatttcccctctttcagaacctgattttagaatcaataagcgttgccataatggccatgaaccatggcctcgggggatatgttctaaatgtcaaccatcggcaattacattacaacagcaagaatttagaatggttgaccacgttgaatttcagaagagtgaaataattaatgaatttattcaggcgtggaggtacacgggtatgcaaagatttggctatatgtacggatcttattctaagtatgataacacacctttaggtataaaggccgtcgttgaggcgatatacgagccccctcagcatgatgagcaagacggtttaaccatggacgtagaacaggtcaagaatgaaatgctacagattgatagacaggctcaagaaatggggctttcgcgaattggcctaatatttacagatttatctgacgcgggagctggggatgggtctgttttttgcaaaagacataaggattcgttttttctttcatcattagaagttattatggctgctaggcatcaaacaaggcatcctaatgtaagcaagtatagcgaacaaggttttttttcttccaagtttgtaacttgcgttatatcaggtaatttggaaggtgaaattgatatttcgagctaccaagtatccacagaagctgaagcattggttactgcagatatgataagtgggtccacatttccttcaatggcatatattaatgacactacagatgaaagatatgtacctgagatattttacatgaagtcgaatgaatatggtataacagtgaaggaaaatgcgaagcctgcatttccggtagactatcttttagtgacgctgactcatgggttcccgaataccgatacggaaaccaactcgaaattcgttagttccaccggatttccatggagcaatcgacaagctatggggcaatctcaagattatcaagaattaaaaaagtatttattcaatgtggcttcaagtggagatttcaatcttttgcatgaaaaaatctcgaactttcatttactattatacataaattctctgcagatactctctccagacgaatggaagttactaatagaatctgctgtgaaaaatgaatgggaagaatctctactaaaacttgtctcatcggctggttggcaaacgttagtcatgatccttcaggaaagcggctag

SEQ ID NO: 4043 - DNA, 1743 bp, Saccharomyces cerevisiae
atggccatattgaaggataccataattagatacgctaatgcaaggtatgctaccgctagtggcacttccaccgccactgccgcctctgtcagcgctgcctcatgtcctaatttgcccttgctcttgcaaaagaggcgggccattgctagtgcaaagtctaaaaaccctaatctcgttaaaagagaattgcaagcacatcactcagcgatcagcgaatacaataatgatcaattggaccactatttccgtctttcccacacagaaaggccgctgtacaacctgactaacttcaactctcagccacaagttaatccgaagatgcgtttcttgatctttgacttcatcatgtactgtcacacaagactcaatctatcgacctcgactttgttccttactttcactatcttggacaagtattcctcgcggttcattatcaagagttacaactaccagctcttgtccttgaccgcgctttggatttcgtccaaattttgggactccaagaatagaatggccactttgaaagtcttgcaaaacttgtgttgcaatcaatattctataaagcaattcacgactatggaaatgcatcttttcaaatcactcgattggtccatctgtcagtcggcaacattcgactcctacatcgacatcttcttgttccaatctacgtccccgttatcgcctggcgttgtcctttctgcccctttggaagctttcattcaacagaaactggccttattaaataacgctgctggtactgctattaataaatcgtcctcttctcaaggcccctctttgaacatcaacgagatcaaattgggtgccattatgttgtgcgagttagcttccttcaatctcgaattatcatttaaatatgatcgttcactaattgcgctgggtgcaattaacctcatcaaattatctttgaactactataattcaaacctttgggaaaatatcaatctggctttggaggaaaactgccaagacctagatattaaattgtcagaaatctctaatactttattggatatagcaatggaccaaaattctttcccctccagtttcaaatcaaaatatttgaatagcaataagacatctttagcaaaatctctcttagacgcattacaaaactattgtattcaattgaaactggaagaattctaccgttcacaagaattggaaaccatgtacaatactatctttgctcagtcctttgacagcgattcattgacttgtgtttactcaaatgctactactccaaagagcgctacggtttcatctgcggccacagactatttctcggatcacactcatttaagaaggttgaccaaagatagcatttctccaccatttgccttcactccaacctcatcttcatcctctccatctccattcaattccccttacaagacttcaagttcaatgacgaccccagactctgcatcacaccattcacattcaggttcgttctcttctacccaaaattcttttaaaaggtcactgagcatcccacaaaattcaagcatcttttggccaagcccactaactcccaccaccccatctctaatgtcaaatagaaaattattacaaaatttatctgtgcgttcaaaaagattatttcctgttagacccatggccactgctcacccatgctctgcccccacccaactgaaaaagagatcaacttcctctgtggattgtgattttaatgatagtagcaacctcaagaaaactcgctga

SEQ ID NO: 4044 - DNA, 1743 bp, Saccharomyces cerevisiae
atggtattgcgcatacgaagaattaagaaactggcaccattgatcttcacatcattgttgtctctcattgttctttttagggtctaccgacagtatccattctccgaccatttcgaaacacgcagagaagatgatcgctctggcaacgtgcactgcttttctagactgcgtcaaatagaggaatatgaaaagccggaattgacaagtaaattctatgaaccgaatagatggaaatcttttatatcttacgtgaccaggagtcgcaaggatgtgaaaactgtgtcccgatcgctatccaatttggatttgtatcaaaaatgctcaaaagaaatccgtgctgatcaggatatttcccttcttcatagcatagaaaccaagttgttcccatatataaacttcacagccctaaatagtgaacaatctcataatttttggcctgttcatacccgatttgatggaacaaagtaccgtggacaggtattacaattttcttctgagaacaattcgttcattggaacttcacccattgaattcaaggctagcgaacctttttgggagaactggttgaattcagctcttcaaaggaattcaaaaggtgtggtaatgagcgtatcggaatatctggtggctgatacaattcgactaataagagttttgcggctgttaaataattcccttccaattgaaatcgttcacaaatcggatttacatgagagttctcaacagctcttgatagcagcagcaagagaatctggatccttaaattatccccctcaggaattgtggtttctggatgtgaaagacatgttaaatgacgaatatttagcgagattcaagagattttcgaataagtggctggcaattaccttttgttcatttcaaataccaatctttttggactctgatactgtaccttttgtcccgttggatacactctatgaaattgacggatttaaaagaacaggtacactgtttttcaaagacaggagttttccaacctccaagttaagtccactccaagttaaagttttgaagcagataatcaataatagtctggatgtatcctcggattcggagcaaggttttgaaatcttaaaacataacctaaacgatgagatggcaattgatgcaatagaggccttgattttcaagaaacaaaaacattacatggacagcggcttagtgatattcgataaacaaaaacactttttctgtctaccaatcgcaataatgctgcaattttcgcctatccaagagtttttccatggtgataaggaatggttttggcttagtttgtttatttccaaaaaagagtttactttttatccaatagaggcttcgaatgtaggaagattagagaagccggagactctagaaagcagtacaatctgttctacccagctatctcacacggacgtgtacggtaatcttttgtggttgaatggcggattatccgtttgcaaaaaaaattgttggaattatgattttacaaagcgtaaagagattgcggccaaatacaaaagcgttgatgaattacggaattactatcaatcacctgtgaaactcgaagctgtcataatacccgatgtcagcaagtccccctggtcgcaacagagcgaatgcgttatgtacagctattgcacacattataggaagggacagtacggaaaattgatagagtttacagattctcaaaagaaatattacgagaaagttgtagaattatggaacaaggttgtatag

SEQ ID NO: 4045 - DNA, 1743 bp, Saccharomyces cerevisiae
atgtggataaatagactggttaaacatccatcctacagtgttctgaggttttacacgaagaggctctgcactgtatcagtgaaatcgctgcgtgaatttggtgtactgccgaatagcacaatatgtcattctgtctatccccgaagaacgtatgtaatgggtagggctgtcataaatgatattttaatcaaaaaatcctattcaactcacacggtatgtgcaattgatcgatcaaaagatgaaaataatgggagcgcttatgacaaattcgaggcaaaaggtatacctatagatgttcacacattaaaacgaattatcagctcgagtggaatggatgaatccgaattttccaagagtataagttacttattcgcgaaaaccgtggaccctgaaccgaaggatgttctgtctttagaggacctgtcttttcttttgagcaaactatacacacaacggtttcaaattaggagaatctgtagagacataaacgctaaatattcagaattttggttcaaacttttttccttatatgcagaaaaagttgatgccaagagaaaccaagttaacttacggaatacgaaactagatgcatgtgaaatatttgatgcaaatcttatgatcaagaactttatagagctcggtcaattaggtaaggctcaaaaaattttaagctttattcttgatagaaatcctgatatattactgtctccgaaaaatgcagatattagcacaatagttcactttttacaactgcgttgtggcgctttggcgccttattggaaaataccagataatagtgagcaaaaacaaggttttttaagaaaaatggttcgactaggtgcgaaaaatacgtcaattcgtctttcttctacttacaaagccatggatcaccaaacattattaaagattgctgatcttgctctgcaggagaaaaagcttttgaattccgaggatttgttgtccactttaattcaatcctttggacacctaggccaaacccaaatattggaacggtgtattgaacatatatggcaaatatcaccccaagagtttcctagtcacgtagtaattaagcaccgagggtgctatcctagttccaaaatactcgtttcaatcttagtgtcattctactttaatgaccacgatcttcacagaggcctaagtattttggattcattcataaagcactatccggacgtgaaattggatgcgctattttggagaaggctgtttcagctaagtcattttgcttggacaccagcaaacgacaagaaagccacttctgttgttagatgttggcatttaatgaagcagtggtatgcatctaagcggctaaggccttcagttgattatgagacgttgagacaactgtacgatatcatgaagaaaacaggcaatttcccgcttggaattgatgttttaaggagtttcaaaccggggatcgaaagaacgagagcagaaaatgctggaaaagttaacaatatcattatcaaataccaaaaatgtattattaaggagcttgtaaatagaggtagattttcagcggtaagggaattcattgatagttatggttttgatagaaaaatgaccaaagatttgaatattttttgtgcgaatcgtatgtttctaagaagtaagaaaatgaaaaacaagattgagaacaaaaaggaaagggagaaagtgcggctagatagtttcgatgacgatgaagatgatggtatgattataggtagcctttggtaa

SEQ ID NO: 4046 - DNA, 1746 bp, Saccharomyces cerevisiae
atgaactcgttagcttcaaacacaccgctaaatggtactccagtaagcgaggcacccgccacaagctccgagcctgtgaacatgttcgagacaatggtggctaaccctattaaagtgtctcgattacagtctaatggagttctgacgggacctgcagccaatactaagtccatccactattcgctggccaattttaatgtgttccagtcgctacccaaggaaacggccagaggtgtagacgatttgacgaggatggagatggcgttactgagtgggataccggaggagattaagtggtctttaaaaaaatatcttacgtatagtaacaaggcgccatatatgatcagcttacggacattgccggacctgttgccacttttcaagactttcatattgcctttggagcgcatcgtggaaggtcttaacaaatcgtctatatgtgattcaaaggcgatggattctctacaaatgggtctaaatgccttgctgatcctaaggaatctggctcaagatactgattcggtgcagatactagtcaaggatcgagaaatcaaatctttcattcttttcattttgaagaagtttcagtgcgtcgctacaggcgataacaagtggcaattgtacgaaggaaatgcaactttttttaacgagttgacccattatactctggacttgatggaggccatttcgtcctatattgctcctgcaatgaaggatgatcattatttccaaacgctggtgtccatcttgaactacactaaggacagatacatggttatttctatattgaggtctctttcaagattactggttaggtccaaagctaacgaggaaagtgcagcggacaatttggaccataagactctttcgttgatcgtttcctttttactgttagaatgcgatagtgagctgattattgcttcgttggatttcctctatcaatacattttgcccggttctcaaagaatcactgagttattcaagagtaaggagtgctctttgatactggaagccacgctgcctaatttattatcatataatatcgccacaccagattaccatcttttgcaaaagcacaaaattaggttgattaaaaggttgaagcctcccgctccaaaggagcctcccaatttatctgaggatctgtttcaacaacttttcaaacttaacgagcccttgaggtcaaccgcttggttgagatgttgctttgagcctgtacaagaagcagaatttacacaaatatcgctttggagatcctacgaatccaaatttggtcagcctgttcgcgaatccggacgcaaattgttacctgccgtggaattcatcaagaatgtctcgaatgctttcaataacgccgctgctatcgtaatcactgacccggtaaccggcaagaaaaggtttgttatcaagggcattcaaccaagatttaaagctttgggtattgcagacggggaaagagaatcccaggtacccatttcggcactaaaatccaaatttttgaatgactctaaggaaattacacctgcaagacaaaacagcataccagaggtcaaattccctcaagaactctcagatgtttctaaagtggcctgtacgtttttgtgccttttatccaacgacacggatgatggtgctggttccgcattttgtcaacgcatcaggccactggttctacataaattggctgatattccacctttaacattagcattgtctgaatacatggaaaacacgtcggggttatga

SEQ ID NO: 4047 - DNA, 1746 bp, Saccharomyces cerevisiae
atgacgatcatccataatcctaaatggtggaaagaagccaccgtctaccaaatttatcctgctagtttcaaggactccaacaatgacggatggggtgatttagctgggattacctccaaacttgactatgtcaaagaattaggtgtcgatgcgatatgggtgtgcccattttatgactctcctcaagaagatatgggttacgatattgccaactatgagaaggtttggccacgttacggtaccaatgaggattgtttccaaatgatagaagaagctcataagagaggtatcaaggttattgttgacctggttatcaaccactgttctgaagagcatgaatggttcaaggagagtagatcttctaaggctaatccaaagcgtgactggtttttctggagacctccaaagggttacgatgagaaaggtaatccaattcctcccaacaattggagatctttctttggtggatctgcttggagatatgacgaaaaaactggtgagttctttctgcatgtgtttgctcttggccaacctgatttcaattgggaaaatgaagagtgccgtaaagccatttatgactcctcagtgggctattggctacgtcacaacgttgatggctttcgtattgacgtaggcagcatgtattctaaggttgagggcctacccgatgctcctatcactgatcctacagttccttaccaaaaaggaactgaatttttcataaatgggccacgtatccatgagtatcataaagaaatgcataactacatgctctcgcaagttccagagggtaaagaaatcatgactgttggagaagttggtatcgggaatgaagacgacttcagagtttataccagtgccaaagaaggagaactaaatatgatgttcaacttcaagcacacctcagtaggtgaaaacccaaaatgcaagtacgaacttattccctttactttaaaagactttaagctggctcttgctgaaagctttctgtttatcgaaaacacagattgctggtcgaccatctatttggagaatcatgatcaacctcgtagcgtttcgcgttttggctcagattctcctaaatggcgtgagatttcgtccaagatgttggctactctcatcatttcattgactggtactgtttttatctaccaaggacaagaattgggtatgcccaacttcaaaaacagaaaaattgagcaaatcaaatgcgttgaaggtactggtacatatgccgccattaaacgtgattatggtgaagattctgaaaagatgaaaaagttttttgaagcattagctttgatctctagagatcatgggagaacaccattcccatggagtgctgatgagccttctgcaggtttctcgaaggatgccaaaccatggattgacatgaatgaatcatttagagacggaatcaacgcagaagctgagttaaaagataaaaactcagtcttctttttctggaaaaaggccttacaagttagaaaggagcacaaagatatccttgtttatggacataactttcagttcattgatcttgataatgacaagctattcatgtttacaaaggacacagataacaaaaaaatgtttgctgttttcaatttcagtagcgataatacggacttttcagttcctgataatgaggcctcctacaccatgttttttggcaactatgcaaactcaaatggtgattcccgcaccttgcagccatgggaaggaagactttacttgttgaagtaa

SEQ ID NO: 4048 - DNA, 1746 bp, Saccharomyces cerevisiae
atgactgatttcgatttaatgaattttccatttcatgagcgtttggattctcctgtatcagagaatggggaaattaaagacggagagccaatcccacaaaactggctaaatgaaaatcatgtcggaaaatccatcttacctttattcgttaaccctgaagatgtcatcaattgcaacttttccaatgctagagactcatatgaagagaacaaatcaccatctatggatcaaatgaattatgctagaaatactagttatcaggaatctccaggattacaagaacgaccaaaaaacgaaaaagataagtctcccataggtactgatgttcataaaaaggatgtacccaatttcatacactctactcctagagaaaactcttcgaagcattttacgagggcaaatgaacaggcttctgctcaaccaactgatgaacatacatcgccagatatctcgatagaagactgtaacggtgccaaaatttttctacaaaactccttatcgaaagaggattttcgaatgttagaaaatgtgatactggggtatcaaaaaaaagttattgaattgggtagagataatctaagacaagaggaaagagcaaactctttacaaaaggagctcgaagcagctacgaagtcaaacgacaaaaccttagataacaaaaaaaaaattgaagaacagacagtattgattgaaaacctaacaaaggacctttcgctgaataaagaaatgttggaaaaagccaatgatactattcagacaaaacacactgcattactaagtctcactgactccttaagaaaggccgagctgtttgaaataccgattggtatattgtttttcgatttgtatgactcggaggaaaattcttcaaaattagatcacatattacaagaaaaatatcctaatattaaagggtttttatgtgcatcacagcaagaagagctgagccgcatttctcagcgatttaaaaatgcaaaagcagaagctgaggatctccgaaatgagttagagaataaaaaaattgaaatccagaccatgagagaaaaaaataatactttaattggtacaaataaaaccctttccaaacagaacaaaatactatgtgataaatttgacaagttgacaatcgatgagaaggaaattttgaaaggatgtaatgaggaaataaaaattaagctggaaaggttgaatgaaagactaggatcatgggaaaaaagcaaagaaaaatacgaaacatcattgaaggataaagaaaaaatgctagcagatgctgaaaagaaaacaaacactctatcaaaggaactggataatttgaggtcgcgatttggaaacttagagggaaatacttctgaaaggattacaataaaaaatatcttacagtcaaggcccgatatttcggcagaagaatgtaatttccttatggttgaacaaattgattcagcaaatttgacgactttacaaaatactgtcaaagaaattgttttggctgttggtattccttatccaaagttaaggcgaaagattccgttgctggctatcaaattgaaatatgaaaacatcatgctgtccaattttgctcaacgtctgcatagacaagtatatagtcaagaaatgaatctaaagaaatttacggatcaagcatactatgattttatgtcaacgcgcaggatggattccatagatcaccatttggagaggtgtctggaccatctgtatgatcatatcctggagaagatggtgaagtaa

SEQ ID NO: 4049 - DNA, 1746 bp, Saccharomyces cerevisiae
atgtctaaacaatttagtcataccaccaacgacagaagatcatcgattatctactccaccagtgtcgggaaggcagggcttttcacgcctgcagactacatcccacaggagtcagaagaaaacttaattgagggcgaagagcaagagggtagtgaagaagaaccttcctataccggcaatgacgatgagacggagagggaaggtgaataccattcgttgttagatgccaacaattcgcggacattgcaacaagaagcgtggcaacaaggttatgactctcacgaccgtaagcggttgcttgacgaagaacgggacctgctaatagacaacaaactgctctctcaacacggcaacggtgggggagatatagaaagtcacggacatggccaagcaattggaccggacgaggaagaaagaccagctgagattgcaaatacgtgggagagcgcgatcgagagtggtcagaaaatcagcacaacttttaagagagaaacgcaagtgatcacgatgaatgcgttgccgctaatcttcacctttatcttgcaaaattcgttgtcactagcatctattttctccgtctcacatttagggacgaaagagctaggtggtgttacactcggttctatgactgctaacatcacgggtcttgctgctattcaaggtctgtgtacatgtctggacacactgtgtgcgcaggcatacggtgccaaaaactaccacttggtgggtgtgctagtgcagagatgtgctgtgatcaccatcttggcgttcttgccaatgatgtatgtttggtttgtttggtcggaaaagatcctagcactaatgattccggagagagaactatgcgcgctagcggctaactatctacgtgtaaccgcattcggtgtgccaggattcatcctttttgaatgtggtaagaggttcctacaatgtcaaggtatattccatgcatccacaatcgtgctctttgtgtgcgcacccttgaacgcattgatgaactacttacttgtttggaatgacaagattgggattgggtaccttggtgcgccattatcggttgtgatcaactactggttgatgacgctcggattactaatatacgcaatgaccaccaagcacaaggagagaccactcaaatgctggaatggtatcatccctaaggaacaagcatttaagaactggcgtaagatgattaacctagctattcccggcgtggtgatggtggaggcagagttcctcggctttgaagtgttgacaattttcgcttcccatctgggcaccgatgccttgggcgctcagtcgattgtggctacgattgcgtctcttgcataccaagtgcctttctctatctccgtttctaccagtacacgtgtagccaattttatcggcgcgtcgctatacgacagctgcatgatcacgtgccgcgtgtccttattgttgtcctttgtgtgctcctcaatgaacatgttcgttatctgccgttataaggaacaaatcgcaagtctattttctactgagagcgctgtagtgaagatggtcgtggacacactacctcttcttgcgttcatgcaattattcgatgcctttaatgcgtccaccgccggatgcctacgtggtcaagggagacaaaaaaataggtgggtacatcaacctagtcgcattctactgcctaggtgtgcccatggcatatgtgttagcattcctgtatcatctgggtgtaggcggcttatggttgggtataactag

SEQ ID NO: 4050 - DNA, 1749 bp, Saccharomyces cerevisiae
atggaggaaactaagtactcttcgcagcaggagatagaaggagcatgtggttcagacgcttcattgaatgctagaggtagcaatgattctccaatgggactttccttgtacctctgcctggcttcgttaactcttgtactattcataactgcactggatattttgatagtgggaactattattgacgtggtcgcagaacagttcggaaactactccaaaacaggttggctcgttacaggctacagtttaccaaatgctattctgagtctcatttggggaagattcgcatctatcataggtttccagcatagtctcattttagcaatacttatttttgaagccggatccctaattgctgcccttgcctcttcaatgaatatgctcattttcggtagagttgttgctggtgttgggggaagcggactccaaacgctttgctttgttattggttgtacgatggttggtgaaaggtcacgtccattggtgatttccatcctaagttgtgcatttgctgtagctgctatcgttggtcctataatcggaggtgcctttacaacccatgttacctggaggtggtgcttctatatcaatcttcctatcggtggtcttgccattattatgtttttactcacctataaggccgagaataagggtatacttcaacaaattaaagatgctataggaacaatctcgagctttacttttagtaagttcagacaccaagttaattttaaaagacttatgaatggcataatcttcaagtttgacttctttggttttgccctctgctctgcagggctggtccttttcctactggggctaacctttggtggtaataaatatagttggaactctggccaagtcatcacatatttggttttgggtgtcttactttttattttttcattggtgtacgatttcttcctattcgataaattcaacccggaacctgataatatatcctacaggcctctccttctaagaagattggtagcaaaaccagccataataatagtaaacatggtaacatttctattatgtaccggttacaatgggcaaatgatatactctgtccagtttttccaacttatatttgcgtcgagtgcatggaaagccggtcttcacttgataccaatcgttattaccaacgttattgcggccattgcaagtggtgtgattaccaaaaagctcggtttagttaaaccactcttaatatttggaggcgttcttggggtaattggagcagggcttatgacacttatgacaaatacgtccacgaagtcaactcaaattggtgttttgctattaccggggttttcccttggatttgctctacaagcatcgctcatgagtgcacagcttcaaattaccaaagatcgtccagaagctgctatggactttattgaagtaacagctttcaatacattcatgaagtcattaggtacaactcttggtggtgtgctttcaaccactgttttttccgcctcctttcacaataaagtatcacgagctcatctagagccttacgaaggaaaaacggttgatgacatgattttgtatcgtcttcaaaactacgacggttctcattcgactattggaaacattttaagcgactccattaagaacgtattttggatggatctagggttttatgccttaggatttttgttttgtagtttttcatccaataagaaattaatcataccaaaaaaggacgatacaccagaagataatttagaagacaagtag

SEQ ID NO: 4051 - DNA, 1749 bp, Saccharomyces cerevisiae
atgggcggtcaagaaagtatatcaaataataactcagactcattcattatgtcgtcccccaacttagactctcaggaatcttcaatatcacctattgatgagaagaaaggcaccgatatgcaaaccaagtcgctttcaagctattctaaaggtacgcttctctctaagcaagtacaaaatttattagaagaagctaataaatacgatccaatatatgggtcatctttacctcgaggatttttaagagatagaaacaccaagggtaaggataatgggttggttccgctggtggagaaggttatacctcccattcacaagaaaaccaataatagaaacacaaggaagaagtcatctaccaccacgaagaaggatgtaaagaagccaaaagctgcaaaagtaaaaggaaaaaatggcaggactaaccataaacataccccaatttcaaagcaagaaatagatactgcacgagaaaaaaagccattgaaaaaaggtcgggcaaacaagaagaatgatcgcgatagtccttcatcaacatttgttgattggaatggcccgtgtctacggttacaatatccattatttgacatagagtacttaagatcacatgaaatatattctggaactcctatacaatccattagtttaagaacaaattctccacagccaacgagcttgacatcagataacgacacttcctcagtaacgacagcaaagttgcagagtattttattttcaaattatatggaagagtacaaagtcgacttcaaaaggtcaacagccatttataatccaatgagtgaaattggtaaattaattgaatacagctgcctggtctttttaccttcaccttatgctgaacaattgaaggaaactatactaccggacctaaatgcatcatttgataactctgacacgaaaggtttcgtgaatgctataaatttatacaacaaaatgattcgtgaaattcctaggcaaagaataattgaccatttagaaacaattgataaaattcctcgttcattcattcatgacttcttgcatatcgtctataccaggagtatccatccgcaggcgaataaattgaaacattacaaagcattcagcaattatgtttatggagaacttttgcccaatttcctatctgatgtatatcaacaatgccagttgaagaagggtgacactttcatggatctcggttcgggagtaggtaattgcgtagtacaagctgcgttggaatgtggatgtgcattaagcttcggatgtgaaatcatggatgatgctagcgatttaactatactgcagtacgaggaactaaagaagaggtgtaagttatatgggatgcgtttgaacaacgtggagttttcattgaagaaaagctttgtggacaataacagggtcgctgaactaattcctcagtgcgatgttatcctcgtaaataattttttatttgatgaagatttgaataaaaaagtcgaaaagatactacaaacggcaaaagttggatgtaagatcataagtttgaaaagtttaagaagcctcacttatcagatcaacttctacaatgttgagaacatcttcaatagattaaaggtgcaaaggtatgatcttaaggaggatagtgtttcatggacgcatagtggcggagagtattatatatcaacagtgatggaggatgtggacgaaagtttattcagccctgctgcaagaggtaggaggaacagaggtacgccggtgaagtataccagatga

SEQ ID NO: 4052 - DNA, 1749 bp, Saccharomyces cerevisiae
atggtacaagaatcacgtccagggagtgtaagaagttactcggtcggttaccaagcaaggtccagatcgagttctcaaagaagacattcgttaacacgccaacgttcctcgcaaagactgattagaaccatcagtatcgagtctgatgtgtctaatattactgacgatgacgatttgagagctgtcaatgagggagtagcgggtgtgcaactggacgtctctgaaaccgcaaataagggaccaagaagagcatcagcaactgatgtcacagatagtttgggttcgacttcgtcggaatatattgagattccctttgttaaggaaacattggatgcaagtttaccttcggattatctgaagcaggacatattaaatctcattcagagtttgaagatatccaaatggtataacaacaagaaaatccaaccggtagcacaagatatgaacttagtcaagatctctggtgcgatgacaaacgcaattttcaaagttgaataccctaagttaccatcgttgctattgagaatatacggaccgaatattgataatatcattgacagggaatatgaattgcagattttggctaggctttcattgaaaaatataggtccttccctttacggctgttttgtaaacggtagatttgagcagtttctggagaattctaagactttaacaaaagacgacattagaaactggaagaactctcaaaggattgcaaggagaatgaaggagttacatgtaggtgttcctctcttgagttcagaaaggaagaacgggtcggcttgttggcaaaagattaaccagtggttgcgcacgattgagaaagtcgaccaatgggtgggggatcctaaaaacattgaaaactctttattatgtgagaattggtccaagtttatggatattgtcgatagatatcacaagtggcttatttctcaagaacagggtatagagcaagtcaacaaaaatcttatattctgccataatgatgcccaatacggcaatttacttttcactgctcctgtgatgaacacaccgagcctatacactgcaccttcgtctacatcattgacttcccaatcaagttccttatttccttcgagctccaatgtcattgtagatgatataatcaacccgccaaagcaggagcaaagccaagattccaaattggtcgtcattgattttgaatatgcaggtgccaatcccgccgcatatgatttagcgaatcatctttccgagtggatgtatgattacaacaatgctaaggccccacatcagtgccacgctgatagatatcccgataaagaacaggttttgaatttcttatactcttatgtttcgcatctaaggggtggtgctaaggaacccatagatgaagaggttcaaagactctataagtcaatcattcaatggagacccactgtacaactattttggtcgctctgggccatcctacaaagtggtaaattagagaaaaaagaagcctccactgccatcactagagaagaaattggacccaatggaaaaaaatatatcatcaagactgaacccgaatcccctgaagaagactttgttgaaaatgacgacgagcctgaagctggcgtcagcattgacacgttcgattatatggcttatggtcgtgacaagattgcggtcttttggggcgacctcattggcttaggcataatcaccgaagaagaatgcaaaaatttcagctctttcaagttcctcgatactagttatttgtaa

SEQ ID NO: 4053 - DNA, 1749 bp, Saccharomyces cerevisiae
atgtctctaaagggtaaatttttcgcctttttacctaatcctaacacatcttccaataagttctttaagagtatattggagaaaaagggcgccacaattgtgtcaagtattcaaaattgtcttcaatctagccgtaaggaagtggtcattttgattgaggactcctttgttgattctgatatgcatttgactcagaaagatattttccaaagggaagcaggcttaaatgatgtcgatgaatttcttggtaagattgaacagtcaggcattcaatgtgtgaaaaccagttgcatcacaaagtgggtccagaatgataaatttgcgtttcaaaaagatgatttgattaaatttcaaccatccattatcgttatatcagataacgctgatgacggacaaagttctactgataaagagagtgagatttcaactgacgtagaaagtgaaaggaatgatgacagcaacaataaagatatgatacaagcttcaaaacctcttaagcgactcttacagggggataaaggaagagcttcccttgttactgacaaaacgaagtacaaaaacaatgaattgattatcggagcgttgaaaaggttaacaaaaaaatatgagatcgaaggtgagaaatttcgtgcaagaagttatagactggctaaacagtcgatggaaaattgcgatttcaatgttcgttccggtgaagaagcacatactaaattaaggaatatcgggcctagtattgccaaaaaaatacaagttatattagatacgggagttttaccaggtttaaatgattcagtgggattagaagacaagttgaaatacttcaaaaattgttacggcattgggtcggaaattgctaaacgctggaatcttctaaattttgaaagcttttgtgttgcagctaagaaggacccagaggagtttgtatcagattggacaattttatttggttggtcatattacgacgattggttatgcaagatgtctcggaatgaatgtttcacacatttaaagaaggttcaaaaagcgctgcgtggcattgatcctgaatgccaagtcgaattacagggaagttataataggggctattccaagtgtggtgacattgatcttttatttttcaagccgttttgtaatgacacgaccgagttggcaaaaatcatggaaacgctttgtattaagttgtacaaggatggctatatccattgttttttacagctaacgccaaacttggaaaagctattcttaaaaagaatagtggagagatttcgtacagcgaagattgttgggtatggagaaagaaagaggtggtattcttctgagataatcaagaaatttttcatgggagtcaaattgtctccaagagaattagaagaactgaaagaaatgaaaaatgatgaaggcacattgttaattgaagaagaagaagaagaagaaacaaaattaaaaccgattgaccaatatatgtctctgaatgccaaggatggaaattattgcagaagattagactttttttgttgcaagtgggatgagcttggagcaggaagaatacactatactggatctaaagagtacaatagatggataagaatattggcagcgcaaaaaggcttcaagcttacacaacacggtttatttcgaaataatatccttctcgaaagctttaacgaacgcagaattttcgagttattaaacttaaaatacgctgaacccgaacatagaaatatcgaatgggaaaaaaaaactgcataa

SEQ ID NO: 4054 - DNA, 1752 bp, Saccharomyces cerevisiae
atgcccaatacgcatactcaacatgtgcaaatatcagagccaaatcctgtaaatactttgtctacaccatccaaaagaggtcaccgccatcgcagatcgctagcaatatcaggagattttgattttttgaaacagcctgcagcaattgtgaatttaccacctccacaggcggctgaaaattgtccttcaactgccccaactgctgtatcaagtacattatcgccaatacgctacaatagatttccttgcaaaaccaatgaagacgctggaacgttagatttgcctgaaccaagattttatccgttatcaccaaagaacaatctgcaaacaccaagtccacgatttttcattagtgaagagccaagtttttcatcgccagttaaaggcgtcccagatgccattattaaccttgacgatgcgttgaagacaaggcctaggtcatttaaatcacatagaagatctgaatccgctcctcctgatttggaggttatggtagataagggcaattgtgcagccggttctaactctatgattaaagaagaagaggactccttaattgaaccagaatcgaaaaatgaatattatgagcaaaagcttccaacagcactattatccccactgcggccttccctttgtgtatctgaacaggccattgatgtagatgattcagctctcaatgggtcaccgacccatcacaaccatgggatgcaaaacgccaatgcacggaattccaacacattcaattcgttgaagatcaaaggccaaaagcaaagatattatcattatacgaagcagctacctttgaccgtaggctgtgactcgcaatctccaaaagaacaaaggtcggctgcttcaatgacaatcaatcaggcaatgacaccttcttccctggcctataccccttctaaactagcatctactcccgcaacaccagtatccttttatgacagcaatgcggacattaacttagaaagtgataattttccactaaaagataaccctagatatgccaaggatggttatcctaaaaagtgcggcaattcacagcttaatcgtgtgctggatagcgataaaagacaggattttagtggagaatcgagaagaagaagatcgggcagtcctatctcccacatgcaacaccgcaacctgattgataatatgaaaggtagacgaaacagtaacacgataaactcaatcttcaactacaagagtcaacattatgaaatgccatatgatgatatgatgaaaaatgaaaacattaatgcacagtccatgcccttttcagtcaacggtgtcaacaatgaaaatagtatcggaggggttattacgagagcggacgatgcaccccttcaacactctgtggtcaaatcctgtacgcctgatggcaaggaagaaatgaataggcttaaaagtaatgacagtaatgaatattccaagtctgaagggcagatcagaaccaattcgcaactaagtaaggacattctcatgggtgaaccaggtgatatggttgatctgtcctcttttgtcaacgcgcagagaaaagcctcaaatgaaactggtgacttagtctttagtttatcccaggatgatgacgcactgaaaacgttccatgcgagcaacagcgcagcaacaagcaatgaaagctggtgtattagcgatgatgcgttaggaaagcaggcgcaggacagtgaagttaggaggaaaagaaaatccaaattaggactctttagacatattttttcaaggaagtaa

SEQ ID NO: 4055 - DNA, 1752 bp, Saccharomyces cerevisiae
atggatgaatttgaatctaccaaactttcgaaggttcagttttccactagcgtgttaagtacgccttcgaatgaaggaaataatctaatacacagattcaagaactctttcaagcgaaatgattcaccagcgatccaagaaggtttgctgtattcggagctttcagaggaagaaaaaatacaatgggacttagccaaccagccgtataaaaaggtcctagatcaaagacacctgaccatgatagccattggaggtactctagggacgggtcttttcattggtttaggggaatcactagcgtccggacctgcttctttgctaattggtttcttgttggtcggcgcatctatgctctgtgttgttcagtgtggggccgaactttcatgtcagtaccctgtttccggctcctatgcgctgcacgccagtagatttatagacccatcagtcggcttcagtataggaattaactacttattgatgtggctcatatcttaccctagcgagctggtaggatgttcgcttaccatctcttattgggcaccatcggtcaatcctgctgcctgggttgcaatcgcgttcgttttaagcatgctattgaatctttttggggcaagaggctttgcagaatcagagttttatatgtcaattttcaaaattgtggctctattcatttttataattattggtattgttctcattgcaggtggtgggcctgattctactggatacatcggcacgaagtattggcacgatccaggctccttcgctgttcctgttttcaaaaacctctgcaatacttttgtttcggcagcatactcctttagtggtacagaaatggttgttttaaccagcactgaagcaaggagtgtttcctcagtctctcgggcagcgaaaggtacgttctggagaattatcatcttttatattgttacagtgattataattggttgcctggtcccttataatgatcctcgtctgattagcggttcatccagtgaggatattactgcttccccgtttgttattgccttgagcaatactggtgctatgggaacaagagtgtctcattttatgaatgcggtcatcttgatagccgtattttctgtttgcaattcctgcgtttacgcatcctctagattgattcagggtttggcgacagcaggccaacttccaaagatctgcgcttacatggacaggaatggtcggcctttagttggcatggctatatgtggcgcttttggattgttaggctttttggttgtttccaagaaccagggtacagttttcacatggttgtttgcgttgtgttccatttcatttttcacaacttggttctgtatttgcttctgtcaagtcagatttaggatggcaatgaaagctcaaggaaggtcaaaggatgacattatctatagatcgacattagggatatacggaggaattttcggctgtatcttaaatgttctattggtaattggagaaatatatgtatcggctgcacccgtgggtagtcccagttctgctgctaatttctttgaatattgtatgagtattcccataatgattgctgtatatattggccatagaatttaccgcagagactggagacactggtacatcaagcggatggatattgacctcgatagcggacattcgttagaggacttcgaagccaccaagcttgagagggatgaggataagaaatacgtttcctctaagccactttactataggatctatcggtttttctgttaa

SEQ ID NO: 4056 - DNA, 1752 bp, Saccharomyces cerevisiae
atgtcacaggtaatagaaccacaattagatagaacaacctattattccatattaggcttgacatcaaatgcgacttcctccgaagtacataaatcatatctaaaactggccagattacttcacccagataaaacaaaatctgataagtctgaggaattattcaaagctgtggtgcatgcacattcaattttaactgatgaagatcaaaaacttcgatatgatcgagatttgaaaatcaaaggtttacacacttaccagccgaagaaaaactgtcatattttcaagaccaaggcaaaggaatcacaaggggctagtcccacacttggtcaatcagaagcttatcataggcaaaataaaccttatgagcaacagccctacggtttcggtgtaggcaaaaaaatgacctcaagctctaagagtaaggttccgatattcaagtccttcaatttaaaaagctaccaacgaaaccactattattcatccaaaaaggaaaggaaacatggaagtcctgatattgattctttgttccatgaaaccaatggagcctcaaaagtaagaatgactgatgccggtaaaatggatacgaactctcagttccaagaaatatgggaaatattgggtaaaaatgcgtacacacataaatcttactctgaagatccaaattcatgtttgggatcagcactaagcgatcatgaagaagaagaagaagcaggaaaacaacaacagcaacagcagcaacaacagcaacagcagcaacattatggaatgacgtcgaagtctagcagtcctgatgaagaaaaaaaaaataataaagaaccgaaaagggaaagcagagtctctccagaggaaaatggcgaagaagaaacgggacacaaacaatttaaattgcccaagaccagtactttttctagtggatcccatgattcaaatttgcaatctcctttttacaatcatgagtatcgacattacgcaagaagtaaattcgaatgcaagaatcagtttagaaagtcagtttctcccattaaagagatacctgcaacaactagtgccaatgaaggatggaacattttgagagacattattgaaaaactcaatataagcaatgtagacgatcgaaataaagacttgctgtttcgtcgggatgaaataggtgataaaaatcacagcgactcaatcgacatagaaaatttatctatcaaagaacctaaagggatgaaaaggagaaagaaagatgatatatctttagaagaattgttccaatctttaccaagagaaaaagattattttatgatggatgcaattaatgactcgttagaatcaatcaatctttttaaaaagccgaagaccactcagagtcacgaacaaggtggaacttttgcccaagcagaaagtaatcgtgcaaaattcaaaccgttactagaacagtgtggaattacacccgagatcttagatttggaaataccagagattccggaatttgatgcagtggctgaccttgaaacattgaagcttaacgtgcagctgtttaataaccaatgtaacaaacttaaagaaacaatacatcaagtatcattacagcgcctgagagcagatacgcagttcagtgatatgttaacccaaaagcaaagtattatggtttggaaaacatacctagaatttgataaaagtttaatggacaaattgaacatcttacaagaaagacagatgcaggtcattaaaattttttccgaaagatgtgacggtaaagtataa

SEQ ID NO: 4057 - DNA, 1752 bp, Saccharomyces cerevisiae
atgtcatcagatgcgttaaaagcactacttcagtggggtgcgtcatttggtgtaatagtgccagaggaactcaagtttttatataccgatcttaagggcattatttgcgtatgtgaaaaagatatagacaatcccagcatcaagattcctcccgagattgtcatttcaaggaatctgcccatgaagttttttgggctaagtgaatccactaagaatatcaacggatggctgaagttgttcttcgcaaaaataaaatttgatagggataatgatactatcgtggacaatgttcgtgtgaatgataaatttaaaccttacttggatgcattgccttcccgcctaaattcgcccttggtctggaacccaagcgagttgaagcgtttatcatctacaaacatagggaattcgattcatgaaaagttcgaaggtatatttaaagagtggtttgaactggtcagttcttcagatatgtttgacttggaaagagtggcagatgatgtgcagaccttccataatctcgatgagttgacatatgaggctttgtatgagaagattttgaagataacagaacttcaaagaccaactatctggtattcttttcctgcatttttatggtcgcaccttatattcatttcaagagcattccctgaatatgtgctaaacagaaactgtcctgacaactctattgtactgcttcccatcgtcgatcttctaaatcatgactaccgttccaaagtcaaatggtatcctgaaaatgggtggttctgttatgaaaaaatcggtaccgcctcccaatcacgagaactatcaaataattatggcggtaagggaaatgaggagttactctctggatatggatttgttttagaagacaacatatttgactcagtggctttgaaagttaaattgccattagatgtggtatctacaattcttgaaacagaacctagtttgaagctgcccttactttcggattacaccacttatgcttttgaaaacaaagactgtgtccagcaagaaaagaaggctactcgtagtgctacagactacatcaatggggtgacttacttcattaacatacaaaatgaacaatgtttagaaccattactggatctttttacctacctttctaaggccgaagaggaggatctacacgatttgagagcccgtttgcagggtatacaaatgctacgaaatgcattgcagagcaaactcaacagcattactggaccacctgcaactgatgactcttatgcaattgatccttacagagtctattgtgctgacgtttatactaaaggtcaaaaacaaattttaaaagaggctttaacgaggttgaaaaaactagaaaaaacaatgctgtcagagaacaagcaccaattgctaaccatgagcaaaattcttaagaatgaccctgcttttgcagaaactgaattaccttcgctgttcagcaacgaagatggtgaagaggtcatctttgaatctacttatgatttattgatactttggattctactgaaaacgaaaaagaattcttaccccaccaaatatgaatgggttggacagcagtatactaatttcaagcaaactgcatatatttcagatgatgccaaggctttccatactgcatacttcgagaagcaagacgatgtggatttggccgaagtagatcatgcgattcagtttgtagtagacaattcctttaccagaacttcatctacaaccgaagagactattttagtacgtaagtag

SEQ ID NO: 4058 - DNA, 1752 bp, Saccharomyces cerevisiae
atgtcattcagattattcacgaggacttctcaacgtctccctcgccttaactgggttagtcccatcaggcgatacgccaaacaacctcaatacgatgaagcagagttgtttgcagagaacattaaccatggcgcatataaagcaaagaaaaggccatcagacgagcatttccaatggcctgagaagtctcctgatcagatcacaaaggaatctgaactccaatgggaaaggatggcgaaattatctgctgttgggcaagggatcctcattctcgtggtagtgggtgggttgggaacggcctacttgcgttggccagaattaaaatcctggtggttaatcaagatgaatggcggtcgcataaatgcaacgcaagagcaaagtggacaggattcgttggaaaaattgatcagacaaaaggccaaaaatctattaagggagattcctcaagtgcctgcctttcaacttggaatagatcatcctggtgtatacatatggggaaggtgtcattctaaggactcattgttccctgttagagtacctaatttggatggtcgtaaattcagagatatcctattagctccctctgacgatttcaacaccaattttgcaattgacgagaaaggcgatttgatatcgtgggatgatttgggacaaacaaaaacgatattgccagatcaagatttgacctcaatgaagtattctagtcactttttgtacgctttgaataaaaagggtgaaatattggtcatacctataagaacgccggatctgatagcttcgcaagtatcatcaagaaggtcgaaattgttgccatggaagacaaaactaagatatgattggaaattacaaacaaatcagattttcaacggtaaggaaggagaaaaacgtgtagtacaatttgacgctggtagccatcatctggtgttgctatctaatttaggtaaggcttattgctgcgcgacgggaaatgatcaaaaacaagctcaagtatccaaaggacaattcggtataccaacattctcacaattcgatgagtttcctcccaataatcaactattcgaaattgaactgctgaacaaatttaagcatgaaggagaagacgttgtccgcaaaagagaaattaaaaagatagcttgcgggtcgtaccatacactggcaatagataagactggtgaaatttatgcctttggctggaataggttcggccaattggcactacctatttcgtacaatctagaatatgtttctttcccaagatcggtaacgcatgcatttaaaccgcatttcccggggatgacgaattggaaatgtgtggatattcattgtgatgatgaaacatcgtttgtgaccattcgtaagcctggctcaacgtcagaccatcattatttcgcgtttggtaatggactttttggtgaattgggcaacaacactttcaagaactcgcaatgtgatcccataaaaatcaagtcggatgacaagaaattgaccaactggagttgcggctctcattgtgtgttcactgaaactgaacaagaaaacgaggtcattgcatggggtaataacgaccatggccaactaggtattggaaagaaaactatgaaatgcgctaagccaatgaacattcccgaagttctcaaaccaggacaagacacgacagatttggactcaatttataacagtaaattacacttaaaaaaggagcaacgtgtagtcaccaatggtaataaaagttgcttatactggcgggtttga

SEQ ID NO: 4059 - DNA, 1752 bp, Saccharomyces cerevisiae
atgtctatttggaaggaagctaaagatgcaagtggaaggatatattattacaatactttgacaaagaaatctacgtgggagaagcccaaggaactaatttctcaggaggagctacttcttcgagaaaatggctggaaggcggccaagacggcagacggcaaagtatactattataatccaacaacaagagaaaccagctggactattccggccttcgagaagaaagtagaacccatcgcagaacaaaaacatgatacagtatcccatgcacaggttaatggaaatagaatagcccttacggctggagaaaaacaagagccgggacgaactataaacgaggaggaaagccaatatgctaataactctaaactgcttaatgtcaggagaaggactaaagaagaagcagagaaggaatttattaccatgctgaaggaaaatcaagtagactctacttggtcattcagtagaattatttcagaactggggaccagagatccaaggtattggatggtcgatgatgaccccttatggaagaaagaaatgtttgagaaatatctttccaatagatcagccgatcaacttcttaaggaacacaatgaaacaagcaaattcaaagaagcctttcagaaaatgttgcaaaacaattctcatataaaatattacacccgttggcctaccgcaaagagactaattgccgacgaaccaatatacaaacactccgtggtcaatgaaaagacaaagagacagacctttcaagattatatagataccctcatcgacactcagaaagaatcaaaaaaaaaattgaaaacacaggccctaaaagaactaagagagtatttaaacggtattataacaacatcatcctctgaaactttcataacctggcagcagcttttaaatcactatgtttttgataagagtaagagatatatggcgaaccggcacttcaaagtcttaacccacgaagatgttttaaacgagtatctgaaaatagtaaatacgattgaaaacgatcttcaaaacaaactaaatgagctccgactgcgcaattataccagagaccgtattgctagagataactttaaaagcttattaagagaagtgccaatcaaaatcaaagcaaatactagatggtcagatatttatcctcatataaagtctgatccgcgctttttacatatgcttggaaggaatggctcgtcctgccttgatttatttttagattttgttgatgaacaaaggatgtacatctttgcacaaagatcaatagcccaacagacgttgatagatcaaaattttgaatggaatgatgccgatagcgacgagatcaccaagcaaaacatagaaaaagttctggaaaatgaccggaaatttgacaaggtggataaagaagacatcagtttgattgttgatggtttgataaagcaaagaaacgaaaagatacaacagaaactccaaaatgagcgtaggatattggagcaaaagaagcactatttttggttacttttgcaaaggacatatacaaaaaccggtaagcccaagcctagtacgtgggatttagcttccaaagagcttggcgaatctcttgaatacaaggcactaggcgatgaagataacataagaagacaaattttcgaggattttaagcctgaaagctctgcaccgactgccgaaagcgctactgcaaacttaacgttgaccgcgtcaaaaaagaggcatttaactccggctgtggaattggactattga

SEQ ID NO: 4060 - DNA, 1755 bp, Saccharomyces cerevisiae
atgactatttctgatcatccagaaacagaaccaaagtggtggaaagaggccacaatctatcaaatttacccagcaagttttaaagactccaataacgatggctggggtgatttaaaaggtatcacttccaagttgcagtatattaaagatcttggcgttgatgctatttgggtttgtccgttttatgactctcctcaacaagatatggggtatgatatatccaactacgaaaaggtctggcccacatatggtaccaatgaggactgttttgagctaattgacaagactcataagctgggtatgaaattcatcaccgatttggttatcaaccactgttctacagaacacgaatggttcaaagagagcagatcctcgaagaccaatccgaagcgtgactggttcttctggagacctcctaagggttatgacgccgaaggcaagccaattcctccaaacaattggaaatctttctttggtggttcagcttggacttttgatgaaactacaaatgaattttacctccgtttgtttgcgagtcgtcaagttgacttgaattgggagaatgaagactgcagaagggcaatctttgaaagtgctgttggattttggctggaccatggtgtagatggttttagaatcgataccgctggtttgtattcgaaacgtcctggtttaccagattccccaatttttgacaaaacctcgaaattacaacatccaaattgggggtctcacaatggtcctaggattcatgaatatcatcaagaactacacagatttatgaaaaacagggtgaaagatggtagagaaataatgacagtcggtgaagttgcccatggaagtgataatgctttatacaccagtgcagctagatacgaagtcagcgaagttttctccttcacgcacgttgaagttggtacctcgccatttttccgttataacatagtgcccttcaccttgaaacaatggaaagaagccattgcatcgaactttttgttcattaacggtactgatagttgggctaccacctacatcgagaatcacgatcaagcccggtcaattacgagatttgctgacgattcgccaaagtaccgtaaaatatctggtaagctgttaacattgctagaatgttcattgacaggtacgttgtatgtctatcaaggtcaggagataggccagatcaatttcaaggaatggcctattgaaaagtatgaggacgttgatgtgaaaaacaactacgagattatcaaaaaaagttttggtaaaaactcgaaggaaatgaaggatttttttaaaggaatcgccctactttctagagatcattcgagaactcccatgccatggacgaaagataagcccaatgctggatttactggcccagatgttaaaccttggtttctcttgaatgaatctttcgagcaaggaatcaatgttgagcaggaatccagagatgatgactcagttctcaatttttggaaaagggccttgcaagccagaaagaaatataaggaacttatgatttatggttacgatttccaattcattgatttagacagtgaccagatctttagcttcactaaagagtacgaagacaagacgctgtttgctgctttaaatttcagtggcgaagaaattgaattcagcctcccaagagaaggtgcttctttatcttttattcttggaaattatgatgatactgacgtttcctccagagttttgaaaccatgggaaggtagaatctacctcgtcaaataa

SEQ ID NO: 4061 - DNA, 1755 bp, Saccharomyces cerevisiae
atgccagtagtcaatcatgaggatagtgaatttcacctttcgcacacagaagaggacaagttaaatgagttccaggtcatcacgaatttccccccagaagacttgccagatgtggtgagactgttgaggaaccatggttggcagttagaaccagcattgagccgatatttcgatggagagtggaaaggcgaaccagaccagatgggagagcccactcaaacgtctacacccatggctgagaccttggttcctcccgcgttgggacctagaccgttgttatttacagcctcactgcccgtggtcagaccattgccagcgaacttccgcaatgatttcagaacaattgggctaaatggacgctctaacactgtgtggtccatgtttgaatcttttagttatgatggtaacccctttctttttattttactgttgatccctcggataatcaataggttatctgccacaatattcacgttcttttgcactctattgtccctgcattcgataagtggtggcggtaattcaggaaaacccaagatctccaaggttccaaaggcaccaaccagagaaacccatatcccacttgcagaaatactgggtgacacgaaggacaaggatgcattttgcgaactaaaaagctttaaaccagacatttccttcaatgaggccttgcgtattgcaaaagaagagtttaagtttatgttgctcatcctagtgggcgacacctacgataccgatactgataccgtagatgttaattctaaactactattggaaaagattttgttaaacaagaagactttacagtacttgcgcaagattgataacgacctgattatctatttgaaatgcgtacacgagttggaaccttggctggttgctcgccaactaggtgtcagaaacaccccggagatattcctcattgccaacgtggctaataaggcttcccattcagaaactttgccctcacaaagactctccattctcggcaagctaaaggtcaattcactgaacagattcttgcagtcgttaacaaacgtggtggaaaagtacactccagaattagttgttaataaaactgaaatgcacgagctacgcatgtcaagagaaataaaaaaactgcaggaggatgcgtacaaaaagtcgctagaaatggacagaatcaaagctatagaaaaggaaaagagcttgaaacacgctcaggatttgaaattaaactcaactgctcggcaattaaaatggttaaaggcttgcatcgatgagatacagccgttcgagacaacggggaagcaagctactctgcaatttaggacttctagtggcaaaagattcgtcaagaagttcccctccatgactacactttaccaaatctaccaatccattgggtgtcacatatacctcgcggtatattctagtgaccccgcagaatggtctaacgccctccaggacaaaatcaggcaattatctgcagacgacgatatgctctgctttaaagaaggacaactcgaaactgctactgctaccactatcgaagagctcggccacatcatcaacaacgagcttacctcatttgatctcgaacgtggtaaacttgaattcgactttgaattggtatcgcccttccctaagtatactgtgcatcctaacgagcacatgtcggtggaccaagtgccccagctatggccaaatggcagtcttctagtggaagcactggatgaagaagatgaagaagatgaggaaaatgaagaacaatga

SEQ ID NO: 4062 - DNA, 1755 bp, Saccharomyces cerevisiae
atgggaatacacataccatatctcacgtcaaagacatcgcaatcaaatgttggtgatgccgttggcaacgctgatagtgtagagttcaacagtgagcatgactcaccttcaaagagaggtaaaattacacttgagtcacatgaaatacagagggctcccgctagcgatgatgaagataggattcaaattaaacccgtgaacgacgaggatgacacgtcggtcatgatcacttttaaccaatctctttcgcccttcatcatcactctgacttttgtcgcatccatatccggtttcatgtttggttacgacactggttatatatccagtgcgctgatctcgatcggcacagatctggaccacaaggtacttacttatggggagaaggaaattgtcactgcggctacctctctgggagctttgattaccagtattttcgccggtactgcagctgacatatttggtaggaaacgttgtttaatgggttcgaatctgatgtttgtcattggcgcaatcttacaggtctccgcacacacattctggcaaatggctgttggtagactgatcatgggtttcggtgtcggtatcggctccttgatcgcgccacttttcatcagtgaaattgctcccaaaatgatcagagggagactaactgtcatcaattccttatggttgactggtggtcaattagtcgcttacggttgcggtgctgggttaaactacgtcaacaatggttggagaattcttgttggattgtcactaattcccactgctgtgcaattcacatgcctgtgctttttacctgacactccaagatactacgttatgaagggcgacttggcaagggctactgaggtgttgaagagaagttacactgacacttcggaggaaatcattgaacgtaaggtggaagaacttgttactttgaatcaatctattcctggtaagaatgtccctgaaaaagtctggaataccatcaaagaattgcacacagtaccatctaatctaagggctttgatcattggttgtggtttacaagcaattcaacagtttaccggttggaattcgttgatgtatttctctggtaccatcttcgaaactgtcggtttcaaaaattcttccgctgtttcaatcatcgtgtccggtaccaattttattttcactttagttgcctttttttccattgacaaaataggccgtagaaccatattattgattggattaccaggcatgaccatggctttagtcgtgtgctctattgctttccattttctaggtattaagtttgatggcgctgtcgctgtggtggtttcctccggtttctcctcttggggtattgtgatcatcgtatttattatcgtatttgctgcgttctacgctcttggtatcggtactgttccatggcaacaatcggaactattcccccaaaacgtgagaggtattgggacttcatatgcaactgctacaaactgggctggttcactggttattgcatccacatttttgaccatgttacagaatatcactcctgcaggtacatttgcctttttcgcgggattgtcgtgcttatcaaccattttctgctacttctgttatccagaattatcgggattggagttagaagaggtacaaactattttgaaggacgggttcaacatcaaagcctcgaaagctttggccaagaagagaaaacagcaagttgccagagttcatgaattgaaatatgaaccaactcaagagattatagaggatatatag

SEQ ID NO: 4063 - DNA, 1755 bp, Saccharomyces cerevisiae
atgggggcaaagagtgtaacagcctcttcttcaaagaagattaaaaaccggcataatgggaaagtgaaaaagagcaagaaaatcaagaaagtacggaaaccacagaagtctatatccttgaacgacgaaaacgaagtagagattttacctagtcgtaatgagcaagagacaaataaattacctaaagatcacgtcacggcggatggaattcttgtattagaacataaatctgatgatgatgaaggattcgatgtctacgatggacatttcgataaccctactgatattccctcgactactgaagaaagtaaaacgccttcattagcagtgcacggggatgagaaggatcttgctaacaatgatgattttatctctctttctgctagttctgaggatgagcaagccgaacaggaagaggagagggagaaacaagaattagaaattaaaaaagaaaagcaaaaggaaatccttaatactgattatccatggattttaaatcatgatcactccaaacagaaagaaatctcggactggctaacctttgaaatcaaggattttgttgcctatatctcaccaagtcgtgaagaaattgaaattcgtaatcaaaccataagtacaataagagaggctgtcaaacagttatggccagatgctgatttgcacgtgtttggatcatattctaccgatttgtatttgcctggttccgatattgattgcgtggtaacgagcgaacttggtggtaaggaaagtaggaataacttgtattcgttagcaagccatttaaaaaaaaaaaatttggcaacagaggttgaagttgtcgccaaagctcgcgttccaatcatcaagtttgttgagccacattcagggatccacatagatgtttcatttgagagaacaaatggtattgaagcagcaaagcttattagagagtggttggacgatacccccggcctgagagaattagtccttatcgtaaaacaattcctacacgcaagaagactaaataatgtgcataccggtggtcttggtgggtttagtattatatgtcttgtcttttcctttttgcatatgcacccacgtataataactaacgaaatagatccaaaggacaacttgggtgtgctcctgatagagttttttgaactttatgggaaaaattttggttatgatgatgttgcactgggatcatcggatggatatccagtatactttccaaaatcgacatggagtgctattcagcctattaaaaatccattttcattggccattcaagatccaggtgatgaatcaaataacatcagtcgagggtcctttaacattcgagatattaaaaaggcatttgctggtgcttttgatctgttgacgaatagatgttttgaattacattcagcaacttttaaggatcgattggggaaaagtatattgggaaacgtgatcaaatatcgtggaaaggcaagagatttcaaggatgaaagaggtctagtactgaataaggctattattgaaaatgaaaactatcacaagaaacgtagcagaataattcatgatgaagattttgccgaagatacagttacctccacagccaccgctaccacaacagatgatgattatgaaataacgaacccacctgctaagaaggctaaaatagaagaaaaacctgaaagtgaaccggccaagagaaatagtggagagacatatatcactgtctctagcgaagatgatgatgaagatggatataatccttataccctttaa

SEQ ID NO: 4064 - DNA, 1755 bp, Saccharomyces cerevisiae
atgtccgctaaatcgtttgaagtcacagatccagtcaattcaagtctcaaagggtttgcccttgctaacccctccattacgctggtccctgaagaaaaaattctcttcagaaagaccgattccgacaagatcgcattaatttctggtggtggtagtggacatgaacctacacacgccggtttcattggtaagggtatgttgagtggcgccgtggttggcgaaatttttgcatccccttcaacaaaacagattttaaatgcaatccgtttagtcaatgaaaatgcgtctggcgttttattgattgtgaagaactacacaggtgatgttttgcattttggtctgtccgctgagagagcaagagccttgggtattaactgccgcgttgctgtcataggtgatgatgttgcagttggcagagaaaagggtggtatggttggtagaagagcattggcaggtaccgttttggttcataagattgtaggtgccttcgcagaagaatattctagtaagtatggcttagacggtacagctaaagtggctaaaattatcaacgacaatttggtgaccattggatcttctttagaccattgtaaagttcctggcaggaaattcgaaagtgaattaaacgaaaaacaaatggaattgggtatgggtattcataacgaacctggtgtgaaagttttagaccctattccttctaccgaagacttgatctccaagtatatgctaccaaaactattggatccaaacgataaggatagagcttttgtaaagtttgatgaagatgatgaagttgtcttgttagttaacaatctcggcggtgtttctaattttgttattagttctatcacttccaaaactacggatttcttaaaggaaaattacaacataaccccggttcaaacaattgctggcacattgatgacctccttcaatggtaatgggttcagtatcacattactaaacgccactaaggctacaaaggctttgcaatctgattttgaggagatcaaatcagtactagacttgttgaacgcatttacgaacgcaccgggctggccaattgcagattttgaaaagacttctgccccatctgttaacgatgacttgttacataatgaagtaacagcaaaggccgtcggtacctatgactttgacaagtttgctgagtggatgaagagtggtgctgaacaagttatcaagagcgaaccgcacattacggaactagacaatcaagttggtgatggtgattgtggttacactttagtggcaggagttaaaggcatcaccgaaaaccttgacaagctgtcgaaggactcattatctcaggcggttgcccaaatttcagatttcattgaaggctcaatgggaggtacttctggtggtttatattctattcttttgtcgggtttttcacacggattaattcaggtttgtaaatcaaaggatgaacccgtcactaaggaaattgtggctaagtcactcggaattgcattggatactttatacaaatatacaaaggcaaggaagggatcatccaccatgattgatgctttagaaccattcgttaaagaatttactgcatctaaggatttcaataaggcggtaaaagctgcagaggaaggtgctaaatccactgctacattcgaggccaaatttggcagagcttcgtatgtcggcgattcatctcaagtagaagatcctggtgcagtaggcctatgtgagtttttgaagggggttcaaagcgccttgtaa

SEQ ID NO: 4065 - DNA, 1755 bp, Saccharomyces cerevisiae
atgtcgcgggaggcatttgatgtaccgaatataggtactaacaagtttttaaaagtcacacctaatttatttaccccagagcgattgaatttatttgatgatgtcgaactatatcttacgttaataaaagcatccaaatgtgtcgagcagggagaaaggctgcacaatataagttggagaattctgaataaagctgttctaaaggagcataatattaatcgatctaaaaaaagagacggcgtgaagaacatatattatgtgttaaatccaaacaacaaacagccaataaagccaaagcaggcagcagtaaagcagccaccattacaaaaggccaatttgcctcccacaacggcaaaacagaacgttttaactcggccaatgacatcaccagctatcgcacagggtgctcacgatagatccttggataatcctaattctacaaacaatgatgtgaaaaatgacgttgctccaaacagacaattctccaaatctactacgtcagggttgttttcaaattttgcagacaaatatcaaaaaatgaaaaatgtgaaccatgttgctaataaggaagaaccacaaactattatcactggttttgatacaagcactgttataaccaagaaacctttacaatcaagacgctcaagatcacctttccagcatataggagacatgaacatgaactgcattgataatgagacttccaagagtaccagtcctactcttgaaaatatgggaagtagaaaatcctcttttcctcagaaggaatctttattcggaaggccaaggtcttacaagaatgaccaaaatggtcaactgtcactttcgaaaacatcctctagaaaaggaaaaaacaagatatttttcagcagtgaagatgaagattccgattgggacagcgtttcgaatgattcagaattctacgctgatgaagatgatgaagagtacgatgattataatgaggaagaagcagatcagtactatagaagacaatgggacaagcttttatttgccaaaaatcaacagaatcttgactcaacgaaatcatctgtttcatcagcgaacacaatcaactcaaacacatcccatgatcccgtacgaaaaagtttactcagtggactattccttagtgaggcaaatagcaacagtaataaccacaatactgcacatagtgaatacgcttctaaacacgtttcgccgactcctcagtcctctcatagtaatatcggtcctcaaccgcagcaaaatccaccgagcgctaatggtataaaacaacaaaaaccttctttgaaaacaagcaacgtgacagctctagcatcgctatctcccccgcaaccatccaacaatgagcggttatcgatggatatacaaaaggacttcaaaactgataatgagtccaatcatttatatgaatctaatgctccgctaactgctcaaactatactgcccaccgccttatctactcacatgtttttgccaaataacattcaccaacaacgaatggcgattgccactggtagtaatacgcgacatcgtttttcgaggcggcagtcgatggatatcccatccaagaacaggaatactgggtttttgaagaccagaatggagatctctgaggaagaaaagatggtacgtacaatatcacggcttgacaatacgagtattgcaaacagtaatggaaatggtaatgatgacacctctaatcagagaacggaagcactggggcgtaagacgagtaatggagggcgaatatga

SEQ ID NO: 4066 - DNA, 1758 bp, Saccharomyces cerevisiae
atgatcacccaaactgagctagataactgcttacaatgggctcaaaataatggagccttcatcgatccgaaaatctcttttaggattacagaggatgctggtgttagtgcatttgtaaacgaaaaattctctcccaaacccgaccaagctttgattagggtacccgaaactctgctgatcacttcccagcaagctttatcagaattttcccaggctgctaatgaaaggagtcttttgaattccgtgacacagttgtacttgtcaaagttgaaatttggcaccgatgcagttcacctgaaatccttttacaaaccatatttagatgtgctacccttgcaccttccacaaccatatttttggtctactgatgaagtcatgaatttgcatggtacagacgtgtacttaactatgagagatacgctgaacaaactagtaaaggagtggaggatgctgttccaagctttatctattgaacactcttctcaagataagcagttcttgtctttattccaggagaataaagactctgccgtagtgccgttggaacagttctgcgcacacatcaatggatgtaaactagaagattcggaatggaactcgttcgtggcgtatctttggtcgtactgcatctttaattctagggcatttcctcgtgtcattttaggcagggccggtacagaccgcaccaatctgaacgaaggatttttgtatccaatagtagatttattaaaccataaaaacgatgtaccagtaagatgggagatgaatgaacaaaatgaactttgtttcatgtcgcagactaccacatttagtgcacaggatgaattgtttaataattatggtaatatttctaatgaaaaatgtttgttaaactacgggttttgggattcctcgaataagtttgacttctctaggttgactttaaagctaccatccaccttagttagcggtttgcccgtggattttaacaaatcaggtaattttgttactgacgatggagaaactaccattttacaatttagtttaaaaatttctgaaccattaccaccggttctactagcgttatttgcctacctaagtaaattaaagtctgaagaaactccaaccgtaaggagcgtattggaaggtattgatcaattaacatctgtagtatcccagagattgctgttttataagaattttaaaattaaaacttcttcgactcaaaaattacgccctcatgttattaaactaatcaaactatactatcaagataacaaaaaaattctgaacgccactactgagaaattgtccgttttacaaaaaaaaatatatagcaataataaggagttttctctgtcattcaagacaatttttaaaaacgacaaaatatttgccaattctctcttactggtatttggtgctataaattacgaagatttgatcacaaaagactgtcttaatgacgcattgttgctctggatagtcaaattaatcaacgataaaagtaataatcagggaggtttcattaaacaaaccttcaaagaagttagtgattcaattgtcattgaaaaagaagatgttatggagtttttgccgttctataaaaaatacttccctaatttatcggagagaattccagaaatttatagtgtcggtgattggggcataagacagttcattgtggcagatactgcgattgatagattggtttggatcaggaaatcaaataaagagcctatatttctaatgaagaaggcatacgacttacagatttag

SEQ ID NO: 4067 - DNA, 1758 bp, Saccharomyces cerevisiae
atgctgggccgggcactaatcaacaagtatggatttttaattcatcctaggagatttgtacatttaaacgataagtcccttgatggaacatttatactaccttcgaagaaaaatcatatgtatgatgttccaactaatgatccaagcggtatcctgaatgcctcggatatcgatagaatcaataatttgccatttttcgataacaccagtccgacaaaagagacaaatactaaggaaggagcattgttgagcgaaaaattggccagcgttaaagaattatttggagaagaccctgaaaatccttcgtttatcaattacagattccccagaggtttagagaatccctattttgacattcaagtaaatcagctaaagaaaaaacgattatccgtcacacaattatgcactacgcagaattggtgcgagttaaggaatttttacgacttttattctcaaaatttgtctaaccaactactgaacttaaaatttcaggtgcagaaaggtaaaaagattcataaatcactagaggacgaaacgcatcctgaattaaatcagtataaaagctttacccacaatttccttgcactgacaaaattatctatggatattgataatgatatggatgccctgctagataactggttcaactctatcaatagattggtctctttattcaccaaaggtgacggtcatgcaagagaaatagtttgtcatggcttcattaacttagaagatggcaaactggtggagcatttgctgaacagtgatagcaagacaaaggaaaatgtgattatatcaggtgttattgaccacttaactcttagaaataggcacaatcatcaagtacagaaaggtgcagctcatcttgatacggaatatcagagctggggtaatatcctcactaatttactatcaaatctaaaagaactgaagtcgaataacgagattgttatctctgatatcaaaactaggtcagtaccaaaaataccatctattgagtccgttatagaatcctctaaattacagacaatgtattataagttttttttttcccaccttagtcaagacatgacacaaacctaccatagctttttaatcaatgcccagagaagaggactcgacgttgatgcgcccataaatcctaccaagattttaacattcatactaacaaacccactcttcgctaatgatgtgaagaacctcctgtacggactaccgataaatcattctgctttcgataacgacgccaaaggctctaatacatttgatatgaccgcgttcaatgatttgctggatagaggtcccacatcttttaacgttccgattgagcaagacgaagatagttcggagtcaacaaaatgtgtatctttgcgagattatggacatttttatacgaaatggaagacacctctaactttgaaatactttgcggcaaggttatcacagatctattttattgtgggtaatctcgtttcgaatgatttaatgatagaatattattaccataacgataatttccacaatatcatcttcccatatgatcccttgaaactgggaacccatgcccatgattctgcaatggtttggtttggtggcagagatatgcatccaattgagcctactcaaaaaaacttcaacacatactgtaagttttgtgactacagacacgtttgttcttggaaaaataaaaatgaattgaaacttattgatctagggaaagaattaaaaaaaattattcttgaatcaagtatgaagtag

SEQ ID NO: 4068 - DNA, 1758 bp, Saccharomyces cerevisiae
atggagaacgacaaggcgtcacatgcgagcccaagcattggagtgaacgaatttgtcgttcaaggggagatatccatagacgactccgaaaggtctgtcaagagtgttagcgttagcataagtgatgatgaggatagtaagacagatgtacaagataatatggccacaccgtccacaagatcgaaatttcaaacagatctggccattgataataggctattggaaaaagatccaaagtacaaaaaacttttcactgaaaaaagaagacgtcgaagaccagaaagctgtattaacctcatgactaaaggtaagggcactggacaaaaagataacattaatgatcaaattttcagcctaagaatattaccaggctccgatttaaactctttaaaggattctttatggataataaagatctctacccagccagatgttgaaaaaacaatcgcaagagctttttctgatttctattggttatatcatcaattacaaaataaccactggggaaaaacgattcctccgcctacaaggtccaacattcttgtagagaaggacgaatttgccataaatcatctttttatgatacgtaataatgagaagtatgatccaatttttaatttcaaaccggaatatatcatatcattgcaattgatggcaatgattaagcacatattcaatgacaaggttttacgtttggattcaaatttcatagattttattagttgggatgacgatcttcctgaaagtttgcaaatagtagtcgatgacagtaccttcacaggggataaaatactaatgacatcttctcaatttcgagaattaaaagagtttcataaacaatcaaaaaaagtggaatcaataacaaattcacatgcttcgttaatacccgtaacagaacttaccgaaatatatataagcccgaccaaattattctctagaaaagactaccaaaggctttttcaacctcaaagcacagacaacacctttaataacaatgacccgttgattcaagagtggataccaaaaagcaaaacattattcactagtttatcctttggttcaagtgcacctacttatcaagaagcgtcaactgagatacaggcatgccatgactgggtaagcatatccaaggagcaatggaaacagttactctaccatgtattacagtacattgtagacgaggcagtgaaggtgaattctgtgataaacgaatttactgagtgtcttaagcaaatttctttggacgaagtcattagagcaaactctgaactatttttgaaattttccaaactgaatgaatcctttctaaaaaaattcaaaggtgcatcgaggcaagacattctgaagctaatcatattatttgatgaaaatgtaagattttgcgaatcatttgaatccatcttaaatcaaagattgaagcttggtaaaattctaagcatcatagaagtggatctagacaagaagaaaaactttcttgacaaactatctccgggaaacaacaacagtaacaatgaagaccttaagatacgcacggcagaggatgaataccgcattgtattaaaaagatataaccgtgttaagcagagctgggagaaaattatggaagatatcttaaatgaacggaaagaatttgagaagagagaagccgccgaggttaatagttgtttaaaatcaataagagatttgaacatggatgaaaagaaacactatttacaattatggcaagactttgtaccagatgagcacataagccaatga

SEQ ID NO: 4069 - DNA, 1758 bp, Saccharomyces cerevisiae
atggaggaagtgttccgtttttactcgaactctagaaatatcttcattcataaaagcctttcattaaaaccatccaccattgatgaccccaaaagtggatatggccttttcgtagaaccttcgaagttcaagaatgatgaattgaaaagtgaaactatccaattgctccgaatccctaagcgctgcacgtttaatataaacacacttctggctctcttgggagatgaggacgaattttcttcaaaggaagaatttcaaagaactaatgacaaaattaagattgctcttcgtgaaataatggctcatccgaatttcagtgtgttcctgacagaaacaaatttactcataatttatttcatgatatttcaaactattcgtagtcgttatgagattcccgaaaatatccaatattatttagaaaatgttttaatgagcattgaagtagaaacagccatggattctattgaaaacttagctactgattatggacattatccacagatttttggccttcgagagacgctaaatttatttaaagaactgtttcacgacgtcttgaatttaagtgatatcaaacatctttattctgcaataatttcacgttgtttagagataccagaaagggccgataccaaaagtgaagaattcacggtccattctactttagtccctattgtagattttgccaaccatgaaggcacccaaaaaaatgcttattttgacatcgacccttcaaataatgacgttttacttctattggatacaaaagcggtccaaagtgaactcacaaaacctattgaagttttcattagttactcaccaacagaggatttattttccatgcttgtaacatatggattcaccccagattttagagggaattcccaattttggactgtatcctttgacaggtgctttttaagaaactatgatggaccagataaaactacaaatttaagattgttttacaaatggatgcacataaatccagtggtaccactagttaaatacgagcacaacggaaagactcgctggtttctcaatgacaccacgcctgaatttgatatgcttttgctcccattcattccatcgatagatgatggcaaaattgctcggtgggcgtacgattccacatgtcatttgatgttcacgaaaatccattgtctgataaatcccgaggccaacgaacatgcgttaatgattgcagaaaactaccgctctctcattaaagagaaagagtcaaatggtgacgatttcataaatttaccgccactagcttggtcattgcgttacaaagatacagaaaacgattgtgtacggcaaagacatatatgcagtgaagatgcggtcgctgtacttaaacaagaagaaatgcaagactcaaccaaaaccaaatcccagtttaccagtttctttcgtaaatttttagagtttcgtagatccaaaattattaggcctaccagtgattcaaaagttgcaagcatattataccagcaggaactggaaataattgctgacttagcaaaagctatcgatagcagctctaccatttttttcagcgatctgaatgttacattggacaccgaaccagaacggctcccccctctaaggtttttagatgattacatagagatctctgcggataagcaggagccaagcccaatttgtgaggatctttcttattatacacccagcaggtttactgatttttttcaagaagaggtaagccaatatgcggctttctttcaggatgactag

SEQ ID NO: 4070 - DNA, 1758 bp, Saccharomyces cerevisiae
atggatcaatttgagtatatcattactttagaatttggaaaccaaaatcaggttgaatccgcttatcaaattttcaagagtattccgaaaaagttgaaggcaaaaagtatcggggaagaaagtattaaaagtaataatcaagactggcaggattggagagtctgtgacttggaaatagacatgataactgatttcaaaaatcaaacatcaaaagaagaggaaagtgatttgattacttcacaatacttaggccatgggataataaggctattcaagctaagcaatgccaataatactcttaatgagaaggagattttgactatcccgggagatgatactatgatatgtatcctgtttgttccaacttattttaccgttcacgatttattgcatttttatattggtgatgatattgttaataagcaagtttcaaactttcgtatattacgaaatcagcagaagggaatgggttttaatttcacggtcttaattaaattcaggaatgcacttgatgcgaaaaatttcaaggaagagttcaatggcaaaagtttcagcaggatggatcccgaaacatgccatgtgatctctgtaaaagaaatagtttttcaaaaaaagctcttccaaagaccagccgctaacgaggacttcccctatctgcttactgatccattcactgttaagaaaaaaaaggaactggtaaaagtcgaactccccacatgtcccgtttgccttgaaagaatggattcagaaactactggattagtaacgatcccgtgccagcacacttttcattgccaatgcttaaataagtggaagaattcaaggtgtccagtgtgtcgacattcaagtctgcggctaagcagggaatcattattgaaacaggcaggtgattccgcacattgtgcaacatgtggttccactgataatctatggatttgcttgatctgcggtaatgttggatgcggtcgttacaattccaaacacgcaatcaagcattatgaagaaactttacattgttttgcgatggatatacggacacaaagagtgtgggattatgcgggtgataattatgtccatcgcctagttcaaaatgaagttgatgggaagttagtagaggtcggcggctccggtgacgatgacaacaatgatataggcaactccgatgaactacaaaatgttgtttacgggaacaggagcaaaaacggtgagaaatcgaactctaataaaaaagatggcgagctggcggcaaattttttaaggcatagggagtatcatctagaatatgtgcaagtcctaatatctcaattagagtctcaaagagaatattatgaactgaaattacaagaaaaagatcaaactgcgtctgattcttcgaatgttgaaagtttgaagaagtctatggaagatttgaaactccaatttcaggtcactcaaaaggagtggcagaaaagggaaatggcccagaaatctaagcttgaggaagatatgttagtaatcgaaggactacaagcgaacctagatcacttatcaaaaaaacaagagcagttagagcgagaaaacaaagcgttagaagagtctaaacaagatttggaagagcaagtcaaggacctaatgttttatctagattctcaagaaaaattcaaagacgctgatgagagtgtaaaagaaggtaccatcctaatacagcaaccacatggggcagcacaggcatccaaaagcaagaagaagcgcaacaaaaataaaaaagcagggaaatga

SEQ ID NO: 4071 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 4072 - DNA, 1758 bp, Saccharomyces cerevisiae
atgtcccatccgcactcacatagcatatatttgtctgagttgcccgtcaggaaacctcaagccttgggcaatcctcttttgaggaagattcaaagagcttgcagaatgtcacttgctgaaccagacttggcgttgaatcttgacattgctgactacattaatgaaaaacagggcgctgcccctagggatgctgccattgcacttgctaaactgatcaacaatagagaatcgcacgtggcaatattcgcgttatctctattagacgtgcttgtcaagaattgtggatacccattccacttgcaaatttctagaaaggaatttttgaatgaactggtcaagagatttccaggtcacccaccattacgttattctaagattcagagattgattttaactgctattgaagaatggtatcaaacaatttgtaaacactcaagctacaagaatgatatgggttatattagagacatgcaccgtttgttgaaatataagggttatgcattccccaaaatcagtgaatccgacctagcagttttgaagcctagtaatcaattgaagaccgctagtgaaattcaaaaggagcaggaaattgctcaagctgcaaaactcgaagaattgatcaggcgtggtaaacctgaagatttgagggaagctaacaaattaatgaaaatcatggcagggttcaaagaagacaatgccgttcaagctaaacaggctatttccagtgaattgaacaaattgaagcgtaaagccgatttgctgaatgaaatgctggaatcacctgactcacaaaactgggataacgaaactacacaagaacttcacagtgcattaaaggtagctcaaccaaaatttcaaaagatcattgaggaagaacaggaagacgatgcgttagtgcaggatctattgaagtttaatgatacagttaatcaactattggaaaaattcaacttattgaaaaacggtgactccaacgctgcttcgcagatacatccaagtcatgtttctgctccgttacaacaatcttctggtgctttaacgaatgaaatcaacttaatcgatttcaatgatttggacgaagcgccctctcaaggcaacaacaataccaacggcacgggtacaccagcagcagcggaaacatctgtcaatgacttattgggcgatttgaccgatttatctatttcgaacccttcaaccgctaaccaagcatcctttggtctgggaggcgatatcgtgttggggtcctctcaacccgcaccaccagttactactactaacaactcgaacaacactttagatcttttgggactttcaactcctcaatcgccaactaattcccaagcagtaaacagtagtgggttcgatcttttgatgggatttaatccaacaacaggtactactactgcgcccgcaagaaccctagtcaatcagtctcctaacttgaagattgagttcgaaatatctagggagtcaaactcagttataaggataaaatcgttctttacaaacttaagttcgtcaccgatctccaacttagtgttcttattagcagtccctaagtcaatgtctttgaaattgcaaccccaatcgagtaactttatgattggcaacgctaaagatggtatctctcaagaaggtacaattgaaaatgcgccagctaacccttcaaaggctttgaaagtcaagtggaaggtcaactattctgtcaactccacccaagctgaagaaactgctgtttttacgttacctaatgtataa

SEQ ID NO: 4073 - DNA, 1758 bp, Saccharomyces cerevisiae
atgttacacaggcacggttctaagcagaagaacttcgagaatatcgctggaaaagttgtccacgaccttgcaggtctgcaattgctttctaacgacgttcaaaaatccgctgtccaaagtggtcatcaaggatcgaacaatatgagagatacttcgtctcagggcatggctaataagtattcagttccaaaaaagggactacctgctgatttgtcttaccaactgattcataatgaattaacacttgatggtaatccgcatttgaaccttgccagtttcgtgaacacttttaccactgatcaggcaaggaaattgattgatgaaaatttgaccaaaaatcttgctgacaatgatgaatatccgcaattaattgagctaactcagcgttgtatttctatgctagctcaattatggcacgctaatcccgatgaagaaccaataggctgtgccaccacaggttctagtgaggcaatcatgttgggtggactcgccatgaaaaaaagatgggaacacagaatgaagaatgctggtaaagatgcttccaagccgaacattataatgtcttctgcgtgccaagtggcattagagaagtttacgagatattttgaagtggaatgccgattggttccggtatcccacagaagccatcatatgcttgacccagagtcgttatgggattatgtagatgagaacactattggctgttttgtaattttaggaaccacctacactggccatttggaaaatgtagagaaagttgcagatgtcttgtcccaaattgaggccaagcatcctgattggagcaatactgatattccaatccatgcggatggcgcttcaggtgggtttattatcccatttggctttgaaaaagagcacatgaaagcttatggcatggaacgttgggggttcaaccatccgcgtgtggttagtatgaacactagtggtcataagtttggcttaaccactcccggtctgggttgggtgctatggagagatgaatccttactggctgatgaattgagattcaaactaaagtacctcggtggcgtggaagaaactttcggtttgaatttttcaagacctggatttcaagttgtccatcaatacttcaattttgtttctctaggccattcagggtatagaacacaattccaaaattctctatttgttgcaagagcgttttctttcgaattattgaattcgtcaaaattgcccggatgctttgaaattgttagcagtatccatgaaagcattgagaacgattccgcccctaagtcagttaaagactattgggaacacccccaggcttacaaaccaggtgtaccgctggtagccttcaaattgtccaagaaattccacgaagaatatccagaagtgccacaagcaatcctttcctctttactgagaggtaggggttggataataccaaattacccactaccaaaggcaacggatggatccgatgagaaggaggtattaagagtggttttcagatcggagatgaagttggatttagcacagttgttgatcgttgacatcgagagtatcttgacaaagttgattcatagttacgaaaaggtttgtcatcatatagaacttgcctctgagcaaactccagagcgcaagagttcgttcatctacgaaatgttgctggcattggcatctccacaagatgacatcccaacgccggatgaaatcgaaaagaaaaataagctaaaggaaacaacaacgagaaactatagaggaacatgttga

SEQ ID NO: 4074 - DNA, 1761 bp, Saccharomyces cerevisiae
atgactacagctagttcttctgcttcccagctacaacagcgcctgccggaagaaaaaccttggccgcaactgagtggcagcaatgcagacgctcaaaccttcaaatgtaaatacgtaaccaaccacaactccttgggcgatgggaattttagcgtcgtgaaagaatgtatgaatatacacacaaaggatttgtacgcgatgaagcttattaagaaacaaactgtcaagaacaaaattcaacttattcaaagagagttcgaccttttgaggtcaataagcgagaaaatcagagatatggaaaaaaagaatgaacattctttggacatttttgaggggcatcaccatattttacaacttttcgactattttgagacggcagataacattgtcctgatcactcagctgtgtcagaagggagatttgtatgaaaaaattgttgaaaatcagtgtttagacctcgaaactcaagttacctcgtactgcgcctgtttggtgagcgttctcgagtttttgcattctcaaggtattgttcatagagacttgaaagcagaaaacgtcttattcagattgagagtgaacgaaaacgaaaaaaacctacagggtgaacaccacggagatttcaaatacgatctcttggcacacgacctagttctcgccgattttggtcttgctgctgaatataacacaagtaaggtaaactcgttaaaggagtttgttggaaccatctcgtatattgctccagaaatcgtcaagtgcaaaggtgtcggtgaaatgactcctgatcaagttggcaaactagacaagtatggttgtccggtggatatatgggcccttggtgtactgacatatttcatggccttcggctatacgccctttgactgtaccacagacgacgaaactctggaatgtatttcaaaatgtgactattacgtcgacgaacaaatgatgcacgaccctaaatacgaacaattttggaattttgttcaatgctgttttactattgacccggccgttaggcgttctgctaagaatttgaaacagcatccctttattaaggattattttgctacttcaaattctttgaatactaaggacacgccgaatttctcctttcatccaacaataagaagggtatcttctacagcgtccatgcacacattgaggtctccttccaaatcaagaaagacaactactctagcgtatttaaatatggatggcgggtcctctgaaacttccaccgccttcagcagcaagatggatttgcctgacctttacgttgatagaaccattaattctcgtgaaagatcattgaatagaattcgagacactctgaagaaaacattatccatgacatctcttaagcctgcaggcacattcgactatcttcacgctaacaaaaacggtacttctttatcatcatccaagtcaggcctcgtgaaaaagaattctacttttgtcttggaccctaagccaccaaagaatagcttgatgaacggttgtttcagcaccactccagaatcgcgctcaaatttcaatacccccaaaaccttatcgaggcaaggttcctctactagcgtgaagaaatatgtcaatgaagttgacttacttttaaccccacgtacggcctcgatgagcagcaatgataccacagccattaacgattatgatactactaacgataagaatcctgcaagaaaacacgcagcttcattccaggtgaatgttgatgattctgatggtgatgaaaccatgcagatatag

SEQ ID NO: 4075 - DNA, 1761 bp, Saccharomyces cerevisiae
atgctgattaggttaaagaagagaaaaatcctgcaggtcatcgtgagcgcagtagtgctaattttatttttttgttctgtgcataatgatgtgtcttctagttggttatacggtaaaaagcttagattgccggttctaacaaggtcgaaccttaaaaacaatttttacacaacactggtacaagccatcgtggaaaacaagccggcagattcgtctccggacttgagtaagttgcatggggcggaagggtgtagctttgcaaataacgttgctgcacacgactctggacacgatagtgacttaagttacgagagcttgagtaaatgctataatttgaataaaacagtacaagaaagcctacgagaagtgcacagtaagtttacagacaccttatcagggaaactgaatttttccatcccacaaagagaggcacttttctcaggttctgagggcattgtcaccattggaggtggaaagtattctgtgctcgcgtatacgatgatcaaaaagttgagggacacgggtactacattgcctattgaagtcatcattccgcctcaggacgaaggcgaggatgatttttgtaagaactggttgccgaaattcaatggtaagtgcatttatttctcagatatcgttccttcaaagccattaagcgatttaaaactcacgcacttccagttgaaagtctttgggttgataatttccagtttcaagcgtattatcttcttggacgcagataactatgcggtgaaaaaccttgaccttgcttttaacactacatccttcaacgatactggcctgatattgtggcccgatttttggagacgtgtcacccctcccgccttttacaacattataggatctagcattaacatcggcaaaagagtccgttttgttagtgacgatatttcccccgtgtcacgttatgatccatttgttagtaactcaaacgattacactccaaaggagagacaggagcatttcctgaaacatgttcccttacatgatctggacggcacgatgccagacttgagctctgaatcaggccagatggtgattgataagattcgccatttcaacactctattactggcgctatactataatgtttatgggcctacctggtattataagatgatttctcaaggcactgccggtgaaggtgacaaagacactttcgtcgctgctgcccatgccttgaatatgccatactatcaagtgaggactaactttgaatttgatggtttcttctatcaaaaagatgattacaagggtctcgccttgctccagcatgattttgaacaagattacaagcaataccaaaaggcgcagcagaaagttaaagccaacattgaggaattttccaaactggatccagattatactttggacaatggtttcttgaaaactttgatggttaatgatgacggttctgatttggatatcatgttcattcatgccagtttctacaaggcagatccatggactctttatcatgaaaacagatttatcggtccaaatggcgaacaagtacggggcttcaggaagccgcatcgctatggaatggattttgaattgtttttattcaatgatatgagggggtccttctgtaccactccgaaaagccaagttattaaattcaagtattttaccgataaagttaataccccagaatgggatgcaatgtgtgagtatttgaccaatcatgttaattatctggagagcacacacaaagaagctatgggggagaaaaactaa

SEQ ID NO: 4076 - DNA, 1761 bp, Saccharomyces cerevisiae
atgctttctgaaaacacgactattctgatggctaacggtgaaattaaagacatcgcaaacgtcacggctaactcttacgttatgtgcgcagatggctccgctgcccgcgtcataaatgtcacacagggctatcagaaaatctataatatacagcaaaaaaccaaacacagagcttttgaaggtgaacctggtaggttagatcccaggcgtagaacagtttatcagcgtcttgcattacaatgtactgcaggtcataaattgtcagtcagggtccctaccaaaccactgttggaaaaaagtggtagaaatgccaccaaatataaagtgagatggagaaatctgcagcaatgtcagacgcttgatggtaggataataataattccaaaaaaccatcataagacattcccaatgacagttgaaggtgagtttgccgcaaaacgcttcatagaagaaatggagcgctctaaaggagaatatttcaactttgacattgaagttagagatttggattatcttgatgctcaattgagaatttctagctgcataagatttggtccagtactcgcaggaaatggtgttttatctaaatttctcactggacgtagtgaccttgtaactcctgctgtaaaaagtatggcttggatgcttggtctgtggttaggtgacagtacaacaaaagagccagaaatctcagtagatagcttggatcctaagctaatggagagtttaagagaaaatgcgaaaatctggggtctctaccttacggtttgtgacgatcacgttccgctacgtgccaaacatgtaaggcttcattatggagatggtccagatgaaaacaggaagacaaggaatttgaggaaaaataatccattctggaaagctgtcacaattttaaagtttaaaagggatcttgatggagagaagcaaatccctgaatttatgtacggcgagcatatagaagttcgtgaagcattcttagccggcttgatcgactcagatgggtacgttgtgaaaaagggcgaaggccctgaatcttataaaatagcaattcaaactgtttattcatccattatggacggaattgtccatatttcaagatctcttggtatgtcagctactgtgacgaccaggtcagctagggaggaaatcattgaaggaagaaaagtccaatgtcaatttacatacgactgtaatgttgctgggggaacaacttcacagaatgttttgtcatattgtcgaagtggtcacaaaacaagagaagttccgccaattataaaaagggaacccgtatatttcagcttcacggatgatttccagggtgagagtactgtatatgggcttacgatagaaggccataaaaatttcttgcttggcaacaaaatagaagtgaaatcatgtcgaggctgctgtgtgggagaacagcttaaaatatcacaaaaaaagaatctaaaacactgtgttgcttgtcccagaaagggaatcaagtatttttataaagattggagtggtaaaaatcgagtatgtgctagatgctatggaagatacaaattcagcggtcatcactgtataaattgcaagtatgtaccagaagcacgtgaagtgaaaaaggcaaaagacaaaggcgaaaaattgggcattacgcccgaaggtttgccagttaaaggaccagagtgtataaaatgtggcggaatcttacagtttgatgctgtccgcgggcctcataagagttgtggtaacaacgcaggtgcgcgcatctgctaa

SEQ ID NO: 4077 - DNA, 1761 bp, Saccharomyces cerevisiae
atggacaaatataccaacagggatcatccggactatattcctggcacatttaacatctattcttcccaaaatttggaaaatggtattatatacgaatcaaaattgaagaaaacctcctcaggagtcgtcctaatccctcaaccatcatactcgccaaatgatccactgaactggtctagctggaggaaattggctcattttggtctaatggcctttataactgcgtttaccgccgctactagtaacgacgctggtgctgctcaagactcattgaatgagatttatgggatatcctacgattccatgaacacaggggctggtgttcttttcctaggtattggttggtccactttattcttggctccatttgctaacttgtatggcaggaagattacgtacatagtttgcaccacattaggtctctttggtgcgctttggtttgctttggccaaaagaacgagcgacacaatatggtctcagttgtttgtaggtattagtgagtcctgtgctgaagcccaggtgcaactgtccctgagcgacatttttttccagcaccaattgggctccgtattgaccgtgtatatcatgtgcactagtatcggtacgttcttgggcccattgatcgctgggtacatatctgcatttaccaacttccgttgggtcggttgggtcgcagtgatcatatctggtggccttttaataactattatatttggctgcgaagaaacgtacttcgacagaggccagtatatgacccctttgaccagctgtcaatcgggatacgaagacggtaccactttacaaaactctgacaatacggccgtgtcgcgcaggaaacgtcatcttgacgctaaattatcaactcctggagccatgggtgagaaaggtgtagacctttcagagacggctgaattcgaagttaacaatgaagaggaagttaccatacctgagactcgcgaattgattgatggttcaaaagagcatttgaaaccatacccaaaaagagtagcaatattaaccaaagctactaatttgaaaggctacggttttaaacagtatttcaaatatctaaagatcaaccttagaatgttcttattcccgccagtgtggttgtctggtatgttttggggtattcaagacgttttcctgacgttttatttgaccactcaagaaagcgcctactacgaacctccatggaactatagtgattttggtgtcgcaattatgaatgttcccacacttattggagcagtcatcggttgtatctgtgctggcattgttagtgactactttgttctttggatggctcgtcacaatagaggaattttagaggcagaatttagactatacttctctatcgcaactgcaattattgggccagcgggtttgctgatgtttggtatcggtaccgctagacaatggccttggcaagctatatacgtcgggttgggttttgttgggtttgcatggggttgttctggtgatattgcgatggcgtatttaatggattgttaccccgatatggttttggaaggtatggtttgtactgctattattaacaacacgatatcttgcattttcacctttacctgttctgattggctagctgcatctggtactgaaaatacttacattgctttagctgtcatcaactttgggattactgcatttgctttaccaatgtactactatggtaagaggataagactttggactaagagatggtatttgcaatctgtcaatttgagagacggtgtgtaa

SEQ ID NO: 4078 - DNA, 1761 bp, Saccharomyces cerevisiae
atgtcacgaagtaacagtatatacacagaagatattgagatgtatcctactcacaatgagcagcatctgacgagagaatacacaaaaccagatggtcaaacgaaaagtgaaaaactaaatttcgaaggcgcttatatcaacagtcacgggactctatccaagactaccacaagggaaatagaaggcgatttagactctgagacttcttctcactccagtgatgataaagttgatccaacccaacagataactgcagagacaaaagcgccatatactttactaagttacggtcagaagtggggaatggttgcaattctaacaatgtgtggcttttggtcttcattgggatcaccgatctattatcccgctttgaggcagttggaaaagcaatttaatgtggatgaaaatatggttaacgttactgtggttgtgtatctgttgtttcaaggtatatctcccacagttagcggtggtctggcggattgctttggacggagacctataattttagcaggtatgctgatatacgttattgcatccatcgggctagcatgtgctccatcatacggtgttattatcttcttgaggtgtattcagagtattggtatttcccccacaattgcaatcagttctggtgttgtcggggacttcactttgaagcatgaaagaggtacatttgttggcgccacctcagggtttgttttactgggtcaatgttttggtagtcttattggtgccgtcctgactgcaaggtgggattggagagctatcttttggtttttgaccattggttgtggaagttgttttctaattgcctttcttattttgccagaaacaaagcgaaccattgcaggtaacctttccattaagcctaaaagattcatcaacagagcgccgattttcctactgggcccagttagaaggagattcaagtacgataatcctgattatgagacattagatcccaccattccgaaactagatttgtcatccgccgggaagatccttgtattgccagaaattattctgtctttatttccatcagggctcttatttgctatgtggacgttaatgctttcctctatttcatccggtttatcagtggcgccatacaactatcatttggtcattattggtgtgtgttatctacccggtggtattggcggtttaatgggttccttcttcacaggtagaattattgacatgtatttcaagagaaagatcaagaaattcgagcaagacaaagctaacgggttgattccacaagacgcagagattaatatgttcaaagtccgtttagtttgtcttctgccccaaaatttcttggccgtcgtagcctatcttttatttggttggagtatagataagggctggaggatcgaatctattttaattacttcatttgtctgttcatactgtgctatgagtacattatcaacatcaactacgttattggtcgatttgtacccaacgaaatcatctacagcaagtagttgtttcaactttgttaggtgcagtttgagtaccatcttcatgggttgctttgccaaaatgaaagctgcgatgactgtaggtggtacttttacatttttatgtgcgctggtatttttcttcaacttcttaatgtttattccgatgaaatatggtatgaagtggagggaggatagattattgaaacaacaaagacagtcttggttaaacaccttggcagtcaaagccaaaaagggaacaaaaagagaccagaacgataatcataattaa

SEQ ID NO: 4079 - DNA, 1761 bp, Saccharomyces cerevisiae
atgtcggatcattctcccatttctaataaggaaaatcatctgctgccatcagactcgtcaagaagctcatccagcgatatgcattcgacgggcaccacgggaaccacaggcgtcgaacctgtagatttcaccggtgaaggtgccaaatacacaactgctacggagggcaatggtggtgcagatttagcgattcaaagaacgacgactatgaattctgctgcagaatcagaggttaatatcacgagaagattaactaaaatccttactgggtctgttaacgagcctgaccgtgtagaggttgattataccaattgtgcgcccatgggtggtgacagaccttaccctccatcgttgccgagcagagacctgtacgaggttacttttgatggtcctaacgacccactacatccatttaactggcccatgaagaagaaagtgctgctatgtctggtcttatgtctggattctattgccattgctatgtgttcttccatttttgcctctgcagtgccgcaaatctgcgagatataccacgtcatcgaagttgtcgccattttgggtatcacgctttttgttcttgggtttgcggcctcaccggttatctatgctcctctttctgaattgtacggtagaaagggtgttctggttttatctgcgtttggatttgcccttttccaatttgctgtcgctactgctgagaacctgcaaactattttcatatgtagattctttggtggttttatcggggcagcacccatggccgtcgtccccgccgcgtttgccgacatgtttgatactaatgttagaggtaaagccattgcgctattttctctaggtgtttttgtaggccccattttatcgcctgtcatgggttcttatatcgcacaaagaactacctggagatggttagaatatgttgtcggttgtttcgcttccgcagttttcgttgccatcgtattgttctttgaagaaacacatcaccctaccattttggttaacaaggccaaacagatgagaaagcaaagtaataactggggtattcatgctgctcatgaagacgtggagctatccatcaaagacattgtccaaaaaactgtgacgaggcctatcattatgcttttcgtggaaccattgctactattcgtgactatttacaactcttttgtctacggtatcttgtatttgttactggaagcctacccacttgtctttgtggagggttatgggtttactgaaaacggtgagttgccatacatcgccttgattatcggtatgatggtgtgtgctgctttcatttggtatatggacaacgattatttgaaaagatgtagagccaaggggaaattagtgcccgaggccagattgtacgcaatggtcattgcaggtaccgttttccctattggtatcttatggttctgttggacgggctactatcctcacaagattcattggatggtccccacagtaggaggggccttcatcgggttcggtttaatgggtattttcttgccatgtttaaactatatcattgaatcgtatctattgttggcagcttctgccgtcgcagcaaacactttcatgaggtctgcatttggtgcatgcttcccattgtttgcaggatatatgttccgtggcatgggtatcggttgggctggtttgttattaggtctatttgccgctgcgatgattcccgtgcctttactattcttaaaatatggtgaatctatcagaaagaaatccaagtatgcttacgccgcttaa

SEQ ID NO: 4080 - DNA, 1761 bp, Saccharomyces cerevisiae
atgttcattgaatactctagattaccaggcttcgaaagcatcaatatatcattttctagaggcatgctaagattggctaaatttactaatttcgctacatacaaacaaaaattagagtacttcaggctgttggcaggttcaaacaaatacatccaacgaatcagcgttgctgactttgagagacatccagatgaaatcaattatatttacattatactaatatccattctccaaatggaagagtgtatgccagtcctagttctatgtccaactgtttattgggtacgattccactggcctggaaaatgttccgtgaacagtttgaactttacgaatgaaacgttaaaaagcgctttccatgctgtcttcactccctattttgcactaatgaaaaaagttcttggaaggattaaaaacaacatgttgctatttgcagaacctcatgcaaatttaaataatttgtttgtcaagcatttccacgatctcatatataagagcgtaaaggatgaaaaaaccggcgaggcaattctgtatttgagaactaacgttaatgttccaaatgtttttattgacgataaaagagcagtttttcatggtgacggtatgaaaattggaaaatttaccggcaaatttttatgcttttccttcaaacgaacaataagatggtcaaaattagattcagtggattcttttgcggttacgacagtaaattatagagtatctgtaaattgggaaaagacaccaagaaagactttcctttctctagacagtgacaccaaaaatttacactatatatcgaaaaagatattgaataaaaagggaaagaacgccactacatcaaaaacaacaaaaagttcatgcacaagtgagaacgtttgcgatgataaaacattctccgtcgaattcccacttacaacgtcagcaaaaactgaatatttgttgagaagtaatttttctttagaaaaaattaatgaaagcaacaatcctacccttcaagaacttactttaaaccgtacacatcgcttataccgatcaaattttcgcaatgaacaaagcaccacacagaggaagtttgaaaaaatcggtagaactgtctctactgattcaggcaataaactgcttacgtttccggaacaaaaggccacaagagatagtaaccccttctcaatcgaattgacacatgcaacagtaatttccagcgacgaaagtgccttaaaagacactactaatcaagcgatagccgaaatgcaacgtataactcctgctattgcaaagacaatctcgagaagaacagcaaattgggtctgctcaaacccagctcctgatccgtatggggaaccttcaacgtggtccagaattttgacccctaatttgaaaataatatcggaatcatcaccatattatccagtccatctagcttcaccaaattctacctttagtagagatcaaagtgtaagaagtgttgtcatgaggagaagttctgtatgtgttgaaaaacaaaatagtttcttcagaaattacgaacatttcaaaaatatattgtcgagaagaactattaaggttaagacatcatgtcctaggctgagcgttgacgtaagtgacaacaaaagagaaaatttatcacaagaacacctcattttaccgaacaaatctagagaaaaagtcaaccgatttaaaaattgcctacatagagttgcagaagcgctcagagctgccaaagaaaactgggatcagcacaatcccaggaactctattcattaa

SEQ ID NO: 4081 - DNA, 1761 bp, Saccharomyces cerevisiae
atgttttcacttagttcgctatctagcagcggtgggcattcagagcagaaggaaagagagagaataagttattttgatattagaataaactccccgtacaaggacataattttgatccaagggtcaccgttggaactgtcgtctatacctttatcaggaaacttagtgatttcagtgaaaaatgagatcgtagtgaagaaaatttcgctgagattggtaggaagattcaaattggagtttttgcaagttggccgatataagaagaatagcagtagtttggcaagtctagttaaggaaaagcgtaagattttcgaatgctattgggacaacttattggtttcttcaaaaggggatgttttagtcggtggggaaaatgcggaaaatcaacataacagtagtagcggtcgcagtacaagcaaccaagatatggacaccagcggcaacgcaatatttctaagcaagagatcactttcgagccctgttttcaacaaaataattcgaagaaagacccattcttcccacagaaaaatactagagctaccagaaaatggtgttacaggaacccctttcgagggtttaagagaaaacgcccgtagtagaagcagtagtagtaacaccctcaataacaatagccatagttatagtaacagagacgggtctggaagttcgtacttattcctaatgaaaagaggcaactacgaactacccttcaatacaatgctccccccagaagtgtgcgaaacaatcgagggactacaaagtggtagcatactgtattcctttgaagccattatagatggacgtcagttatgggatactgatctgagcgttcatacttctcctcacggtccaatcggtagcacaagtacgagcggcaatggtatgagaacgaagaataaaattatcatcaaaaagttcaagtatctcagaatccttcgtacattatcgatggacaatcttgccatgcaagaagaaattagcgtgggtaatacttggcgtgacaagttgcaatacgaaacgtccatcccgagtagggctgttcctattggtagcacaacccccgtgaagattaagattttccccttcgaaaagaacattcgtttggataggatagaaatggcgctaatccaatattacgcaatgaaggacagcagcgcacaaatttatgatgatgaaatagccgtcatgaaaattactcatctagcggacttcggcccgctgacggacaaacttgacgtcgattgtccctttacaattccagataacctcaaacaaataactcaagactgctgtctgcaagacaacctaatccgtgtcatgcacaaattgcaggtacgtattcttttacaacgtcaagtggatggcgaatacaagaacctggagatcaaggcgcaattacctatgttattatttatttcgccgcatctgcctatgaaaggccgtctagtgttgtttgataaacacgatggcaagatccacttccgccctggcgaattagtacccctttttttaaccacttaccccgcgcagggtctgactccaggcgttgaactgaactccactacaacggcgcacctcgcgctgccacaaccgccaccgaattatcacgagagcaccaacgatcatctcatgccggcgctacagccgctcggcgccgattcggtggtactgacagtgccgtcatacgagcaggcgcaggcgcaggcatcggcatcgtcttacgtgacagggtccgtacccgcttactgcgacgatgactga

SEQ ID NO: 4082 - DNA, 1764 bp, Saccharomyces cerevisiae
atgaacaaaacggaaaacctttctattgaggagacaaatgaaataagggaaaagctgggtatgaaacctattccagtttttcaagaaaagaatacagaccataaagagtctttgtcaatcgaagagacgaatgagttgagggcgtcccttggcctaaaacttatcccaccccaacaaaatttcaattcttctccccctaatgtacataacacatccaaaatcgatgaacttcgagagaagataacaaagtttcaaaaaaaggcgaacgctcctttacgaatggcgcaccttctcgaagaaactaatgtaaatgacgacagttcatggctagaaaacatggatgcaattccttcctcacatgaatccaaacgttccagcacattgccaagaaaaggcgccacgaaggaagacgaaaatattgatctgcataatgttcaagtatcatataatatcgaggcgcttagcccaaagaaagatacgattctaactttgaaagagagcagtatttttgatgatactgattctaccgaagtgttagagaatgtgaaagctgccgaggaaaacgctgatagagagaaactacgattacgacaaatgaataaagatagaagacaaaaaaaaaaaattttaaatgtatctagcttagatattgaagaagaagaagaaggagagaaacactcaattacaactacacatctaatcatcggagcagaacagggtgttatgaaggcaccgaatactatatcagcaaaaccaccaacgggaaaagttaaagtgaatttcgatagcgcaaataatatgtcagatgaagatggtggagactttaaacctttaaaaattaaaaaacgtaagatcaaggacccaagatctactaaagctaggaagtcaaaaattactgataagatggaaattgttaagttagtagatgaagatgaaagtttatcctggatggaagaagaacagccagtcaccataataaatcccagaacaagctcaaacaatgaattgaaagggccagaggacctcgctagagaaattgaaaaggcaagagacgaagagaagcgacgcactgaaagcattttgaaaatgcgtgaaatttccaacagtattgtcgtcgacgaaaaggtaacttttttaaatactttggataccagtctctccgaacgaagtgctactgagaataaagtgaaagtgcatggtgaaggagagaaaaatatcggagatgttaccaatggacatactaaggaagggagtggaaacaatacactgactgaagcagttaataatgaaccaaactacgagggagatgctgaaaatgcaccgaactttttttctggtcttgcatcaacactaggatatcttcggaaaaagagtgttttcaccacaggagacgtcgatttgaaaccaggaaaggatgttaataatagtgaatcacttcgaagggatgtccgaaataaagagcatacgggcactggcacttatacaaaagataagctacacggactggaacaattcacatctagtgactcttccaatgcaaatactcattcaaaaagacaagatcattatgatcctgacataaaactggtttacagagacgaaaagggaaatcgactgactactaaggaggcatataaaaaactgtcacagaaatttcatggtacaaaaagcaacaagaaaaagagagcaaaaatgaaatccagaattgaagcaaggaaaaatacccctgaaaatggtagtttgtttgaatttgatgacaattaa

SEQ ID NO: 4083 - DNA, 1764 bp, Saccharomyces cerevisiae
atgaatagtcaaggttacgatgaaagctcttcctctactgctgctactagcggtcctacttctggagacccacgaatgggtaagaaacaacggtttatgaatctcataagaaccacaaaggatgtttatattcctaacctgacgtcatccatttctcaaaagacaatggatggcatcaggagcactacgaattccttcgaaggttataatgacttgcctatggaattgccacataataccacgataacatattttccaacgtataccacaactaatttggttgaccctgacggtttgagtgcgcctcggaaagattttgaaactactgtcagatgtgctgtttcttatccaggaaatcctacaagcaggagaaataggtggttgctttctctttgtaaacaatatcttagaactggaacggcggaggccgatgttgcacctgttgttccccctcatctcgaagaggattctggagatttaaacgactcccaatcaagtatagaaagttctttgtcttcaaagagcgaaaataggtattcacatatgggcatccaagaggaagatgttctgaatgagagaattcaaggattcctgtccaaaaaagttcctaatactccagtggtggttgacctattgcccaaagataagctcagaggggatacggcttccttttttggtaccacggactcttatggtaatttactaatcaaggcagaaacagattttttaccgtccaagattaatattacattagatacccctatagaaggccatgcagatcccatatctgaaacatttccggccaattatgtctcgccctacggtattggtttaatcagtgatattgacgacaccatcaagcatactggcgttacgggtgacaggagatcgatgtttcgtaatgttttcatccatgatgttcaatcgtgggtaatagatggtgttcctctttggtacaaaactttacatgatgtcgcagacgttgatttcttttatgtttctaattcacccatccaaacttttactcttttgaaacaatatatttgcgccaattttcctccgggtccaatttttttgaaacaatactctggtaatttcttttccactatcatgacttcaagtgcgaatagaaaaattcagccgattgcaaatatcttaaaggattttcccaaaaaaaaatttattttggtcggtgattctggtgaacatgacttagaagcgtataccactacggctttacaatttccgaaccagattctggctatttatataagatgttgctctaattccatgagtgatgtcccatcgcatgatgaagaagttatgaatgaagtgaacaatatcatcgaattacaacaacggcccatgcaaatgaccaagtctaccgtacgtaccaggagaagaccaccaccacctcccattccttccactcaaaagccatcgttgacagaagagcaaaccgaaagtataagaatgtcacgccgtaataaagatgagaacaatgctaaaagagttgccccaccaccgttgccgaacagacagttacctaacttagacgctaatacttactatgtaccatcctcacaaaatgactatggcatgtatggtgctttcatggataaaaaagcagatgaatggaagagaagagtaatggactcaattcaaaaattgagcaatcaagacaccacattgatgttcttttcggatccggcattaagtttggaagacagtattcgcagaattagggagaagtattcaaactaa

SEQ ID NO: 4084 - DNA, 1764 bp, Saccharomyces cerevisiae
atgagtaacaagaggacatctgtagaacagctcatatcatgcccaatttgctctagaaaagtctttttttccttaatcaactctcatcttgacatatgtggcaaggaaaagtcaaagccttcgagtaggccacaaacggtgtcaagtcttttggcaggcccaaaaaagaggaaacaagctaactcagagaaattcattgatcttgaaaataaggaccatgaaattaagccaggtcttaagagcgagagtgatgatattgagattgttgaaaatgaaagcaaaagatttaaggcagcaccatccacggattttgcgaaatcaatagtggagcctgcttcgagcagagatcaacttcacaacgattacgaaagcagatggttgcagaaaataagccatttgccacttagtgaaaaattgaggccaaaagaattaagagattatgtaggtcagcagcacattctctctcaagataatggtacattgttcaaatacataaaacaagggactataccatctatgatactctggggccctccaggtgtaggaaagacttcactagctagactattaacgaaaactgcgacaaccagtagtaatgaatcaaatgttggttccaggtacttcatgatcgaaacaagtgcgacaaaggcaaatacgcaagaattgagaggtatatttgaaaaatcaaaaaaggaatatcaattgaccaaaagaagaactgtactttttattgatgaaattcacagattcaataaagttcaacaggatttgttattgccacacgtagaaaacggtgacattattttgattggtgcaacgacagaaaatccaagttttcagctgaacaatgctctcattagcagatgtctgatttttgtcctagaaaagctgaatgtcaacgaactgtgtattgttttatcaagaggaattgcattattgaataaatgcaggaaacaagtatggaatattgaaaatcctttgaaattgtctagaagcatactggagtacgtggtagatctgtcggtgggtgatacaaggagggcgttaaatatgttggaaatgatcgaagtttcaacaagagagcgcaaggccgacgaggaagaattatctatcgatgatgtacgagacataattaagaacaacagcagcaacgggttgaatacatactatgacccaaagggagataaccattatgatacaatctctgcgtttcataaatccattagaggtggggacgaaaacgcctcactgtactatttagcaagaatgttgcagggaggagaggacccattgtatgttgcccgaagaatgattcgaatagcttctgaagatatcggattacgggatagttcattattgcccttggctgtcgcggcacatgacgcagtaatgaaagttggtttgccagaggcagaccttgcactggcgcaatgttgtgttgctttggctagggcaccaaagtcagtagaactatatagagcttggaagaaattaagggcaatgatgagcgagaacatgtacagtttagcaagcagtgagataccgatgcatatcagaaatgcgccaaccaaattgatggaggagctgggttatcataaaggctacaagtacaatcccgattatattgaaggaaaagtccaacaagactactttcccaaagaagtgctcgagaaatgtccaaataaaactgacttaaagttcctggacggcaaacatttaggagacaaagaagatcctgacttgagacagtcatatcagggttag

SEQ ID NO: 4085 - DNA, 1764 bp, Saccharomyces cerevisiae
atgagttccgtcaataaagatactattcatgttgctgaaagaagtcttcataaagaacaccttaccgaaggtggtaacatggccttccacaaccatttgaatgattttgctcatattgaagatcctctggaaagaagaagattggctttggagtccatcgatgacgaaggtttcggttggcaacaagttaagaccatctccattgctggtgttggtttcttgacagattcttatgatatttttgccattaatttgggtatcactatgatgtcctacgtttactggcacggtagtatgccaggtccaagtcaaaccttgttgaaggtttccacttctgttggtactgttattggtcaatttggttttggtactttagctgatattgttggtcgtaagagaatttatggtatggaacttattatcatgattgtctgtaccattctgcaaaccactgttgctcattctcctgctattaacttcgttgctgttttaacattctaccgtattgtcatgggtattggtatcggtggtgactacccactatcttctattattacttctgaatttgccactaccaaatggagaggtgccatcatgggtgctgtctttgctaaccaagcttggggtcaaatctccggtggtatcatcgctcttatcttggttgctgcttacaagggcgaactagaatacgcaaactctggtgctgaatgtgatgctagatgtcaaaaggcttgtgaccaaatgtggagaatccttattgggttgggtaccgttctagggttggcatgtttgtatttcagattaactattccagaatctcctagatatcaattggatgttaacgctaagttggaacttgctgctgccgcacaagaacaagatggcgaaaagaaaattcacgacaccagtgatgaagacatggcaattaacggtttggaaagagcttctactgccgtcgaatctcttgacaatcatcctccaaaggcttcgttcaaagatttctgcagacattttggtcaatggaagtacggtaagattttgctaggtactgctggttcatggtttaccttagatgttgctttctacgggttgagtttaaacagtgctgttattctgcaaaccatcggttatgccggttccaaaaacgtttacaagaaactgtatgatactgctgtcggtaatctgattttgatttgtgctggttcattacctggttactgggtatccgtcttcactgtcgatataatcggtagaaaaccaattcaattagccggtttcatcatcttgaccgctttgttctgtgtcatcggtttcgcataccataaacttggtgaccatggtctgttggctctttacgtcatttgtcaattcttccaaaacttcggtccaaacacaaccacctttattgttcctggtgagtgtttcccaactcgttacagatctactgctcatggtatttctgctgcatctggtaaggtcggtgccattattgcacaaaccgctttgggtactctaatcgaccataactgtgctagagacggtaagccaaccaactgttggttacctcacgtcatggaaattttcgccttattcatgttgttgggtatcttcacaaccttgttgatcccagaaactaagagaaagactctagaagaaattaacgagctataccacgatgaaatcgatcctgctacgctaaacttcagaaacaagaataatgacattgaatcttccagcccatctcaacttcaacatgaagcataa

SEQ ID NO: 4086 - DNA, 1764 bp, Saccharomyces cerevisiae
atgatgaatccacacgttcaagaaaatttgcaagcaatccacaacgccttaagcaattttgatacgtcatttttatcggaggatgaagaagattattgccctctttgtattgaaccaatggatattactgataaaaatttttttccttgtccctgtggttatcaaatttgtcaattttgctacaataatatcagacaaaatccagaattaaatggccgttgcccagcatgtcgtcgtaaatatgatgacgagaacgtcagatacgtcacattatctccggaggagttaaaaatggagagagccaagctcgctaggaaggagaaagaaagaaagcatagagaaaaagaacgtaaagagaatgaatatacgaataggaaacatttatctggtaccagagttatccaaaagaatttagtgtacgttgttggcatcaatcctcctgttccatacgaggaagttgcgcccactctgaaatctgaaaaatattttggccaatatggtaagataaataagattgtggttaatagaaaaacaccccattctaacaacacaaccagcgagcattatcaccatcattcaccaggatatggcgtttacataaccttcggatccaaggacgatgctgcaagatgtatagctcaggtagacgggacgtatatggatggccgcctgatcaaagctgcctacggtactactaaatactgttcttcttatttaagaggattgccatgcccaaatcccaactgtatgtttttgcatgaacctggtgaagaagctgattcttttaataaaagagaactccacaataaacaacaagcgcaacagcaaagtggcggaactgcattcactagatctggaatacacaacaatatatctaccagtaccgctggttcaaataccaatttactaagtgaaaatttcacaggcacaccttcaccggcggcgatgagggctcagttacatcatgacagccatacaaacgctggaacaccggtattaacacctgctccggtccctgcagggtcaaatccttggggagttactcaatcagcaacacctgtaacctctatcaatctctctaaaaacagcagctccataaacttgccaacattaaatgattctctgggccatcatactacccccacaacagagaataccatcacaagtacgacaactactaccaataccaatgctacaagtcactcccatggtagcaagaagaagcaatctcttgctgcagaggaatacaaagatccttatgacgcactagggaatgctgttgactttttggatgcaagactacattctctatcaaattatcagaagcgccctatatctatcaaatccaatattattgacgaagaaacttataaaaagtatccgtctttgttttcttgggacaagattgaggcctcaaagaaaagtgacaatacattagccaacaaacttgtggagatcctggctataaagccaatagactacactgcttctgtcgttcaattcttgcagagtgtcaatgttggtgtaaatgacaatattacaatcacagataatacgaaaactcccacccaaccaataagactgcaaaccgtctcacagcaaatccaaccaccattaaacgtcagtacccctccaccgggtatctttggtccacaacataaggttcctattcagcagcaacaaatgggtgatacaagctcaagaaattcctctgatttactaaatcaactaatcaacggaaggaaaattatcgccggtaattaa

SEQ ID NO: 4087 - DNA, 1764 bp, Saccharomyces cerevisiae
atggacaagtatttgaattcatttgttgaccacctttcagagtggtcatctcgtgcctttaggaacaattcatcaagcgctaaccaaagtgcgtcgaacaaggaattagaacaagtttttgaacagatcaatgctatagttgaaaaccacaataacaaattaaccactgcctttgataagatatcatatcgcgttgctcacaagattacacacttggtggaaagccattctttagtattcaactacgccactttagttctcatcgcaagtgctttggtcgttattggctcatttacgtctatttcttctattccatttacagctctacctcctacgagagaacactcattgtttgatcctacagattttgatgtggaccacgactgtcatgttatctaccgcgagaatgacgaagataaaaagaaaaagaagaaaagcaagaggtttttcgatatgatggatgaaaaacatgcgattatactgcccttaactagtggctgtactttactcgctctctattttgtgatcaagaaactacacctaaactggctaaaatatgtggtgaaaattttgaattttaatataacactgctaaatatcccagctggcacatttgtctactcctactttctcaactcacttttcagaaacctatcacatttagcttcttggaatcccctggttgttttaccaaggtatcgtgtaacaatagctgatgataacgaagacctgaacaagataggcgggtttgttaccaatttgaattacaaagatggattgaccaactcagttgttcacaagaaaacattggatgagattgaaaaagatcattggatgaagcatttttacagaagagaattagttgaaccgaaggatattaaatcgaagaggcagatcagcaacatgtatttgaatagcgcattaattgtttcgttcgttctgtccatcgtttctaccgtatatttctatttatcacccaatgattggttaatatccaatgctgtcagtatgaatatggctatttggtccattgctcaattaaaattgaagaatttaaaatcaggggccctaatcctaattgctctatttttttacgacatttgctttgtctttggtaccgatgtaatggttacagtagctactaaccttgatattcccgtaaaactaagcttaccagtcaagtttaatacagctcaaaacaacttcaatttttcaatacttggtctgggtgatattgccttgcctggtatgtttattgcgatgtgctacaaatatgacatctggaagtggcaccttgatcatgatgacactgaattccactttttgaactggtcatacgttggaaaatattttattactgctatggttagttacgttgcttctttggtatctgccatggtctccttgtccattttcaatactgctcaaccggctttattatacattgttccttccttgttgattagtactattttggtagcttgctggaacaaggattttaagcagttttggaattttcagtatgatacgattgaagtggataaaagtttaaaaaaagcgatagaaaaaaaggagaactctataacttattcgaccttcatcctatcagaatactataatgatgccgacaagtatgccttgcttggtgatgatgtaaacgaaaattttgacgatgatgaagaattcgtgcaagaggaagatctcagtgacagctctgaggaagagctttctgaagaagatctcttggatgacgaatcttcttga

SEQ ID NO: 4088 - DNA, 1764 bp, Saccharomyces cerevisiae
atggatatactcaagaggggaaatgaatcggacaagtttacgaaaatagagacagaatctactacgataccaaatgactcggatagatctggttcactgatcagaagaatgaaggattccttcaagcaaagtaacctgcatgtcattccagaagaccttgaaaacagcgaacagacagagcaggaaaaaatccaatggaaactagcttctcagccctatcaaaaagtcttgagccaaaggcacttgaccatgattgccataggtggtactttggggacgggactgttcattggtttaggttattctttggcatctgggccagccgctttgctaatcggttttttgttagttggtacttcaatgttctgtgtcgttcagagtgccgcagagctttcctgccaattcccggtttctggctcatatgccacacatgtcagtaggttcatagatgaatcggttggctttactgtggctacaaactatgctttggcttggctgatttcttttccaagcgaattaattggttgtgcacttactatttcatactggaaccaaacggttaatccggctgtttgggtggccattttttatgttttcattatggtactgaacttgtttggtgtgagaggctttgccgagactgagtttgctctgtcaatcattaaggttattgctatatttattttcatcattattggtatcgtccttattgccggaggggggcctaactctactggttatattggcgccaaatactggcacgacccaggtgccttcgcaaaacctgtcttcaagaatttgtgtaacacattcgtttctgctgctttttcctttggtggtagtgagttagtgctgttaactagtacagaatctaaaaatatttcagctatatcacgtgctgccaaaggtacgttctggagaatcgcgattttttacattactaccgttgtcattattggatgtctcgtaccttataacgaccccagactgctcagtggttcgaacagtgaggatgtatctgcctctccctttgttattgctttgagtaatacaggatcaatgggtgcaaaagtttccaactttatgaatgtcgttatccttgttgcggttgtgtcagtttgcaattcttgcgtttatgcttcttcaagactaattcaagctttaggtgcatctggccaacttccttcggtatgttcctacatggacagaaagggtaggcctttggttggcattgggattagtggtgcatttggtcttttaggttttcttgtggcctcgaaaaaggaggacgaggtcttcacttggcttttcgccctttgttccatttcatcattcttcacctggttctgtatttgtatgtcacaaattagatttaggatggctttgaaagctcaaggaagatccaatgacgaaatagcttacaaatccatactgggtgtttatggtggaattttggggtgtgtgctaaatgcattgctaattgcgggtgaaatatacgtatcggccgccccggtcggtagccctagctccgctgaagccttctttgaatactgtttaagtattccaatcatgattgttgtttattttgcacataggttttatcgaagagattggaaacacttctacatcaagaggagtgagatcgatctggatactgggtgttccgtggagaatctagagcttttcaaagcacaaaaagaagctgaggaacaactcattgcttctaagccattctattacaaaatctacagattttggtgttag

SEQ ID NO: 4089 - DNA, 1764 bp, Saccharomyces cerevisiae
atggcgaaccgtcttctcatatacggccttattttgtgggtaagtataatcggatcttttgcattagataggaacaaaactgctcaaaatgcgaagattggtctacatgataccactgtgatcacgactggaagtacaacgaacgtgcagaaagaacattcctcaccactatccaccggttctttaagaacccatgattttagacaggcctctaaagttgacatacggcaggctgacatacgggaaaacggtgagaggaaagagcaagatgcactaacacagcctgcaacaccaaggaatccgggcgattcgagtaattcatttttatcgttcgacgaatggaagaaggtcaagtcgaaggagcactcatcaggccctgaacgtcatcttagtcgagtgagggagccagtcgatccctcttgctataaagagaaagaatgcataggagaagagttggaaatcgatttggggtttttgacaaacaaaaacgagtggagtgaaagagaagaaaatcaaaaaggattcaatgaggaaaaggacatagagaaagtttacaaaaaaaaattcaactatgcatccttggattgcgctgcaacaattgtcaaaagcaatccagaagcgattggagcgacttctacgttaattgagagcaaagacaagtatttactgaatccctgttcagctccgcagcaattcattgttatagagctttgtgaagatatcctggtggaggaaattgaaattgctaattacgaattcttttcctcgaccttcaagagatttagggtgtcagtttctgatagaataccgatggttaaaaatgaatggacaatattaggagaattcgaggcaagaaattcaagagaactacaaaagtttcaaatacataatccccaaatctgggcaagttatttgaaaatcgaaattctatcccattatgaggacgaattttattgtcccatatccttaatcaaagtatatggtaaatcaatgatggatgagtttaagatcgatcaactaaaggctcaagaggataaagaacaatccataggaactaacaatataaacaatttgaatgaacaaaatatccaagacagatgtaacaatatagaaacgcgtttagagactccaaacacaagcaatctctcagacttagctggtgcattatcatgtacttcaaagctcatccctttgaagttcgatgaatttttcaaggtgcttaatgcatccttttgtccttccaagcaaatgatatcttcttcttcttcttcggctgttcctgtaattccagaagaatccatttttaagaacatcatgaaaaggctgtcacaactggagacaaattctagtttgacagtttcttacattgaggaacagagcaaactgctatctaaatcgtttgaacaacttgaaatggcgcacgaagcaaagttcagtcatcttgtcacgatattcaacgaaacaatgatgagtaatctagatctgctgaataactttgccaatcaattgaaagatcaatctttacgtatattagaagaacagaaactggagaatgacaaatttactaaccgtcatttattgcatttggaaagattggaaaaagaagtcagttttcaaagaagaattgtttatgcgtcatttttcgccttcgtagggttgatatcctatctattaataacgagagagctttactttgaagatttcgaagagagcaaaaatggcgctattgaaaaggcagacattgttcaacaagcaatcagatga

SEQ ID NO: 4090 - DNA, 1764 bp, Saccharomyces cerevisiae
atgtctgcaattaatcatctttgtttgaaacttattttggcgagtttcgcgattattaacaccattactgctttaacaaacgatggcactggtcacttagaattccttttacaacacgaagaggagatgtattacgcaacaaccttagatataggtacaccgtcccaaagtctgacagtgttgtttgataccggatctgccgatttttgggttatggattctagcaatcccttctgcttaccaaattcaaatacgtcatcctattcaaacgcaacttataatggcgaagaagttaagccttcaattgattgcaggtctatgagtacttataatgagcatagatcttccacctaccaatatctggaaaatggtaggttttacatcacatatgctgacggaacatttgctgacggtagttgggggacggaaactgtatcaattaatggaattgacatccccaatatccagttcggagttgccaagtatgctacgacacccgttagtggtgttcttggaattgggtttcctagaagagagtccgttaagggctatgaaggtgctcctaatgaatattatcctaattttcctcagattttaaaaagtgaaaaaataatcgatgtggtcgcgtattcgctgttcttaaactcacctgattcaggtactggttcgattgtttttggtgccattgatgaatcaaagttttctggtgatttgttcactttccctatggtaaatgaatatcccacaatagtcgacgctcctgcaactttagcaatgactatacaaggattaggtgcccaaaacaaaagtagttgtgaacatgaaacgtttacgacgaccaagtatccagttttgttggactcaggaacctcgctattgaatgcgcccaaggtcatagcagataaaatggcttcttttgtaaatgcgtcctatagtgaagaggaaggtatatatatattagactgtccagtatctgtaggtgacgtggaatacaattttgatttcggcgatttgcaaataagtgttccactgtctagtttgattttaagtcccgagacagaaggcagctattgtgggtttgcggtccagccaacaaacgattcgatggttctgggtgatgtgttcctgtcctctgcatacgtcgtattcgatctcgataattataagatatctttagcacaggcaaattggaacgcaagcgaagtttcgaaaaagctagtaaatattcaaacagatgggtctatttcaggtgccaaaattgctacagctgaaccctggtccaccaatgaaccatttacagtcacctctgacatttattcatctacaggctgcaagagtaggccttttcttcaatcatcgacagcctcttcgcttattgcagaaaccaacgtacaaagtcgcaactgctctacgaagatgccaggcactagatcaactactgtcttaagtaagcctactcaaaatagtgctatgcatcaaagtacaggcgctgtcacacaaacctcaaatgaaactaaattagaattatcctcgactatggcaaattcgggcagtgtctcgcttcccacttcgaattcaatagacaaagagttcgaacattcgaaatctcaaactaccagcgatccaagtgtagcagagcattctacgtttaaccaaacgtttgtacatgaaactaaatatcggcctactcataagacagtcataacagaaactgtcacgaagtattctacagtcttaataaatgtctgtaaaccaacatattaa

SEQ ID NO: 4091 - DNA, 1764 bp, Saccharomyces cerevisiae
atgttgtggaagcgtacttgcacaaggctaataaagcctattgcacaacctagaggaaggctggtgagaagatcatgctacagatacgcctcaacaggcacaggcagcaccgacagcagcagccagtggttaaaatactctgtcatcgcctcttcagctactctattcggttatttgttcgctaagaacctctattctagggagactaaggaagatttgatagagaagctggaaatggtcaaaaagatcgacccagtaaattctacgttaaagctgtcctcattggactcaccagactatttgcacgacccggttaagatcgataaggttgttgaggacctgaagcaggtgctgggaaacaagcctgaaaactactctgatgcgaaatccgatttggacgcccattcagatacctacttcaacacgcatcacccctctcccgagcaaagacctaggattatattattccctcatactaccgaagaagtttccaaaattttgaaaatatgtcacgataacaacatgccagttgtacccttctcgggcggaacgtccttggaggggcacttcctgcctacaagaattggagataccataaccgtagacctgtccaagtttatgaataacgtcgtaaaatttgacaagctggacctggacatcaccgtgcaggccggtctaccctgggaggatttgaatgactatttgagcgaccacggtttgatgtttggctgtgaccctggtccaggtgcacagattggtggttgcattgctaattcttgttcaggaaccaacgcctaccgttacggtaccatgaaggagaatattataaacatgactatagtgttgccggacgggaccattgtcaagacgaagaaaagacccagaaagtcgagcgctggctataacttaaatggtttatttgtgggaagtgaaggtaccttaggtattgttactgaagctactgtcaagtgtcatgtcaagcccaaagctgaaactgttgcggtggtatcctttgatactatcaaggatgcggccgcatgtgcttctaatctgactcagagtggtattcatttgaacgccatggagttactggatgaaaatatgatgaagttgatcaacgcatctgaatccacggacagatgtgattgggtagagaaaccaactatgtttttcaagattggtgggagatctcccaacattgtcaatgctcttgtggatgaagttaaggctgtcgcccagttaaatcactgcaacagttttcagtttgctaaagatgatgacgaaaaattggaattatgggaagctagaaaggtcgcgctatggtctgtgctagacgctgataagagcaaagacaaatcagctaaaatttggacaactgatgtagctgttcctgtgtcgcagttcgacaaggttattcacgaaactaaaaaggacatgcaagctagtaagctgatcaacgccattgttggtcatgcaggtgatggtaacttccatgcattcatcgtctacagaacccctgaagaacacgaaacctgtagccaacttgttgacagaatggtcaagagagcactgaacgcagaaggcacttgcacgggtgaacacggtgttggtattggtaaaagagagtacttgctcgaagaattaggtgaagcacccgtcgatttgatgagaaagattaagctagctattgacccaaagagaatcatgaacccggacaaaatctttaaaactgatccaaacgagcccgctaatgattacaggtga

SEQ ID NO: 4092 - DNA, 1764 bp, Saccharomyces cerevisiae
atgtttactggtcaggagtatcattccgtagactctaattccaacaagcaaaaagacaacaataaacgtggtattgatgacacatcaaagatcttgaataataagataccgcactctgttagtgatacttctgccgccgccaccaccacttctactatgaacaattctgctttaagtagatccttagatcctactgacataaactatagcacaaatatggctggtgtggttgaccaaatacatgattatactacttccaatagaaattctttaaccccacaatattctattgcagctggaaacgtcaattcgcatgatcgggttgttaaacccagcgccaattcaaactatcagcaggctgcataccttcgacaacagcaacagcaggatcagcgacaacagtcaccctctatgaaaactgaagaggaatcccaactctacggtgatattctgatgaattctggtgtcgtacaggatatgcatcagaatctggccactcatacaaatctgagccaactgtcgtctacccgtaagtccgctccgaatgattctactacagccccgactaatgcgtccaacatcgccaatacggcttctgtgaacaagcagatgtatttcatgaacatgaatatgaataacaacccacatgccttgaacgatccatccatcctggaaacattgtcgccattttttcaaccttttggtgttgatgtagcacatttacctatgacgaatccaccaattttccaaagttctttgcctggatgcgatgagccaattagaagaagaagaatatcaatctctaacggtcaaataagccagctaggcgaagatattgaaactttggaaaacctgcacaacacacagccgcccccgatgcccaattttcacaattataatggtctgagccaaactaggaatgtatcaaacaagccggtcttcaaccaagcagtgccggttagtagtattccacaatacaatgcaaaaaaagttattaatcccacgaaggactccgcattgggtgatcagagcgttatttactcgaaaagtcagcagcgaaattttgtaaacgcgccatcaaagaatactccagcggagagtataagtgatttggaaggcatgacgacgtttgcgccaactactggaggtgaaaataggggcaaatctgcacttagggaatctcactctaatcctagcttcactccaaaatctcaaggatctcatttaaatttagcggcgaacacacagggaaatccaatccctggtactacggcatggaagagagcaagattgttagaaagaaatcgaattgcagcttcgaaatgtagacaaaggaaaaaggttgcgcagctgcagctccaaaaggaatttaacgaaattaaagacgagaatagaattttactgaaaaagttaaattactatgaaaaactaatctctaaattcaagaaattctccaaaattcatttacgtgaacatgaaaaactaaataaagactcagataataatgttaatggcactaatagtagcaacaaaaatgaaagcatgactgtggattcattaaagatcattgaagaacttttaatgatcgattcagacgttacagaagtggataaagatactggtaagatcatagccatcaagcacgagccatactctcaacgtttcggaagcgatactgacgatgacgatatagatctcaagcccgtagaaggtggtaaggatccagacaaccaatcattacccaattctgaaaagataaaataa

SEQ ID NO: 4093 - DNA, 1767 bp, Saccharomyces cerevisiae
atgaagcttctaaaggacttattggtagatagaaaggaatttgaggattggaagaacaatttaacatgggctcgggatggtactctatatttgaccacatttcctgatattagcattgggcagccaaaatatgctaaagacattaattgcaacagtaagaatttatttcatgtgaaagaattcccgctagaatttgaaaataaactggatttcgagctggcgcaacagaatgggttattaaattcacaacctgtttgttatcccagagtctgtaagccatcaccaatagacgattggatggccgtattgagcaataatggtaatgtttctgtgttcaaagataacaaaatgctcacaaatctcgattcaaaaggaaacttaagtagcagaacctaccattgttttgaatggaatcctattgaatcatcaatcgtggttggtaatgaagacggtgagcttcaattctttagcattcgcaaaaattcagaaaatactccagaattttattttgagagtagtattagattaagtgacgcaggctcaaaagactgggtcactcatatagtatggtacgaagacgttcttgtagcggcgctttcaaacaattctgtattttcaatgacagtttctgcttcctctcatcaacccgtttctagaatgatacaaaatgcttcgagaagaaaaattactgatttaaagatagtggattataaggtggttttaacttgtcccggatatgtgcataagatagatttaaaaaattattcaatttctagcttgaaaacaggatctctcgaaaattttcatataatcccattgaatcatgagaaagagagcacgatattattgatgtccaataagactagttataaagttttactagaagacgaacttcatgtgacggctgataatattatcgcgccttacttagagaagaaattcaagaaatggagcacaatttggaatgaattcaataattatgaaacaactcttgtcatacacggaatatctctctctccagacggctattcaatagccatagtatacgatatggaacgggtggctttcaaatataaaatagcttcagaacaatcgtttaacatcatgttcgccccactatatcatacttggacaatttctgaacgtgctgttggattagcgtggtatcagacgtaccaaatttacaaccaatcgctgcccaaacttccagaaaatttcagtatgaacaagaaattactgaatggtaattaccctattagtctggatttccaatcatacctcaatgcattaatgaaaagtgaagagatgaggattataatgttcttgaatatgactatcgataaaccgtcaattttgtcatttttggaagccttatatgaatacgctataaacaaaaaatccgaattaacgaatagttttgatttagcttgcgtattatctatagcggcaatacttaaaagagaagcgccaatttacaacggcacgttattgatgaagaacagctttctcgaggaaacgttcaatttagaaagcttcacggctgaccctgaaactgtaacatccaccacgaataacacgtggaagaggtgtggtgtcactttgcttccaatacttacaacgcatgtaaagatatgtcccgtgagcaaacaacgggtaatagacataaaacgagatgatttgaatgattatggttggtttacaaggggtctattagaaagatttaatgaaataagcgtatattgtggaacaacgctggaagttatgtaa

SEQ ID NO: 4094 - DNA, 1767 bp, Saccharomyces cerevisiae
atggcaagaccaatcgatgttagtcagctgattgctggtataaacaagaaaaaaggactagatgaaaatacatcaggtaaaatcagcaagcctaggtttttgaataaacaagaaagatctaagcaagaacgtttgaaggagaacgaagagagtttgacgcctacgcaaagtgatagcgctaaggtggagattaaaaaggtaaactctagagatgacagttttttcaatgaaacaaatgataagaagagaaatccatcaaagcaaaatggctctaaatttcacttttcttggaatgaaagcgaagatactctgagcggatatgatcctatcgtttcaactagagctatagatttgctatggaagggaaagactcctaaaaatgctgcagaatcttcatatatggggaagcattggactgagaagtccttgcacgaaatgaatgagagagattggaggatactaaaagaagactacgctattgttacaaaaggtgggacagtagaaaatccattgagaaattgggaagagctcaatataataccaagggacttgttacgtgttattatacaggagctgcgatttccttcaccaactcctattcaaaggattactattccaaacgtttgcaatatgaaacaatatagagattttcttggtgttgcctctacaggttcgggtaagactttggcctttgtaataccgatactaatcaagatgagtaggtcacctccaaggccaccatctttgaagattattgatggccccaaagcgttaattttagctccaacaagggaattagtgcagcaaattcaaaaagaaacacaaaaagttacaaaaatatggtccaaagagagcaactatgactgcaaagtaatttctattgttggtggacactccttggaggaaatttcattttctctatcggagggttgtgacatcctggtggccactccaggacgtttaattgactctttagaaaatcacttacttgtgatgaaacaggtggagacattagtactagatgaagctgacaaaatgattgatttaggttttgaggaccaagtaacaaacattttaactaaagtcgatataaatgctgactctgctgtgaatagacaaaccctgatgtttaccgctacaatgacacccgttatagaaaaaattgcagcaggatacatgcaaaagcctgtttatgcaaccattggggttgagacgggttctgaacctttgattcaacaggttgtggaatatgcagataatgacgaagacaaattcaaaaagttgaagccaattgtcgctaaatatgatccaccaataataatttttatcaattacaaacaaactgctgattggttagcagaaaagtttcaaaaggaaaccaacatgaaggtgacgattttacatggttctaaatcgcaagagcaaagggaacattctttgcaattatttcgcaccaacaaagtccaaatcatgatcgcaacaaacgttgccgcaagaggattggatatccctaatgtttccttggtagtcaatttccagatttccaaaaaaatggatgactacatccatagaattggtagaacaggtcgtgcagcaaatgagggcactgctgtctcctttgttagtgccgctgaagatgaatcattgatacgtgaactttacaaatacgtcaggaaacatgatcccttgaatagcaatatcttttccgaagccgtaaagaacaaatataacgtcggcaaacagctcagtaatgagattatatattaa

SEQ ID NO: 4095 - DNA, 1767 bp, Saccharomyces cerevisiae
atgtcaacacttagcgatagtgataccgagactgaggtcgtgtcgagaaacttgtgtggaatcgtcgacataggttctaatggtattcgttttagtatatcttccaaggctgcacatcatgcaagaattatgccttgtgtttttaaagatagggttggtctttctctatacgaagttcaatataatacacatacgaacgcaaaatgccctattcccagagatattataaaagaggtttgttctgccatgaagagattcaaattaatttgcgatgattttggtgtacctgaaactagtgtcagagtaattgcaacagaagccacgcgagatgctattaacgcggatgaatttgttaatgctgtttacggtagcactggctggaaagtagaaatattaggccaggaagatgaaactagggtcggcatatatggtgttgtttcctcatttaatacagtaagaggtctatatctagatgtggcaggtggtagtactcagttatcatgggtaataagctcgcacggagaagtcaagcaatccagcaaacctgtatctttgccatatggagctggaactcttttgagaagaatgagaacagatgataatagggcacttttttatgagattaaagaagcgtacaaagatgcgattgaaaaaattggtatacctcaagaaatgattgatgacgccaagaaagaaggtggatttgacctttggacccgtgggggtggtttaagaggtatgggacatctgcttctttaccagtcggaaggttatcccatccaaacaataattaacggatatgcttgcacttatgaagaattctcgtctatgtcagattatctattcctaaaacaaaaaataccaggttcttcaaaagagcataaaatatttaaggtttctgatagaagggctttacaacttcctgccgttggtttgttcatgagtgctgtttttgaagcgattccccagatcaaagctgtacattttagtgagggtggtgttcgagagggttcactttattctcttcttccaaaagaaattcgtgcacaagatccattgctaattgcgtcccgtccttatgctccattacttactgaaaaatatctatatctattgagaacatcaatcccacaagaagatataccagaaatagtaaacgaaaggattgctcctgctttatgtaacttagcatttgttcatgcctcttatccaaaggagttacaaccaacagctgcattacatgttgctacaagagggataatagccggctgtcatggattatctcacagagctagagcgctgataggaattgctctatgtagtagatggggcggcaacattccggaatctgaagaaaaatactcccaagaattagaacaagtagttctacgcgaaggtgataaagctgaagcattgagaattgtatggtggacgaagtatattggtacgattatgtatgtgatttgcggtgttcatccaggtggtaatatcagagataacgtatttgatttccatgtttctaagcgtagtgaggtggagaccagtttaaaagaattaatcattgatgatgcaaacactacaaaggtaaaagaagaatccacgcgtaaaaatcgcgggtatgaagtggttgtgagaattagtaaggacgatcttaaaacaagtgcttccgttcgttccagaattatcacgctacaaaagaaagtacgcaagctatctagaggaagtgtagagagggttaaaattggcgtgcaattttatgaagaataa

SEQ ID NO: 4096 - DNA, 1767 bp, Saccharomyces cerevisiae
atgtcaagcttatacatcaaaacaccactgcatgcattatctgctggtccggattctcatgcaaatagctcctattatgacaatcttttattgccttcattttccaatttatccagtaatatcagcaggaacaatatcacaaccgataacaatataaattcagcaagtcctaggaagtattcgtttcattcgctcaatgtgtcgccaattctttccccaatatctttggctaacgaaatacttggaaaaaaatcaaatactgcaccagcatcgccacatcatatggattacaatccaatttcctcattaacaccaggcaattcaccagaattcaacaaggcaagcttatctcagattagttttacaaatccattgaactatgggtctggcttaggtttttcctctaattcacaacctcgactaccattgttagacaggctatcgtccgtctctttatctaagagaccggagcgcccacaacaaagcctaccatcactaaggcatctgcaattattacccagtcctcttttacaagaaaacgcagcacgcttccctgatacatcaaaacgtacatctaattggaaaactgatcttacccattggtgtaaggatacaaactatcaagactatgttaaaatacgcgaagaagtggctcatttcaagccattaagtatacccaacttaactaataatcaaaataatgatagtttcaattacggcaaggaattggaatcgactaggtcgtccaagttccattccccgtctaaggaatcatttgatcgtaccaaactaattccttcgattctagaagctaaagatcaatttaaagatctttccaacaatgcatggagtattactcctcccgtcacaccgccgatgagtccaccaaccaatagaaccatggagcgcacgacgcttagaggagtagaggcctctttttttgaggggaaatccagcaataacgattcaatattcaatccaattattagtgaaaaattggttcaagaagttaaacatcaaagacaattacgtggaaattcatttcccatgccaaatgccagtcacaaaaagacgaacagtttcaaagctttgcaaataaaaaaattgcttgcgaatagagacattctatcgaacaattccaaatctaatgtaaggaaaccatctaagaacaaaatctcaaagcaagcatcaaatgttttcggtaacactgcaagacaattggtgatgaaactcgacaacgctagttacagttctgtctctgcatcttcatctccatctccctccacaccgacgaaaagtggcaagatgagatcaagatcatcctcacctgtgcgtcccaaggcatacactccaagcccaaggtcacccaattatcatagatttgctctcgactctccccctcaaagccctcgaagatcatcaaattcaagcataacgaaaaagggaagtagaaggtccagtggctcatcacccactcgtcacaccacaagagtgtgcgtgtcgtgtcattcgagtgattcgccctgttggaggccatcgtggtcgccaagaaagcaagatcagctatgtaactcttgtggtcttcgatataaaaaaacacatacaagatgtttgaacgatttatgtcgtaagatccccacaaagggtgaaataaacattatgaaatccaatggaatagacaaagaattcgtccccgaacgcaactgcgaaattgaagggtaccgttgcttattttgtaattacataactgagacagtagagaattga

SEQ ID NO: 4097 - DNA, 1770 bp, Saccharomyces cerevisiae
atgactatttcttctgcacatccagaaacagaacccaagtggtggaaagaggccacaatctatcaaatttatcccgcaagtttcaaagactccaacaacgatgggtggggtgatatgaagggtattgcctccaagttggagtatatcaaagagcttggtgccgatgccatttggatctcaccattctacgactcgccacaagatgatatgggttacgatattgccaactacgaaaaggtctggccaacctacggtacgaacgaggactgctttgccttgatcgaaaagacacataagcttggtatgaaatttatcaccgacttagtcatcaaccattgctcgagcgaacatgaatggttcaaagagagcagatcctcaaaaaccaatccaaaacgtgactggttcttctggagacctcctaagggttatgacgccgaaggcaagccaattcctccaaacaattggaggtcttacttcggtggttctgcatggacgttcgatgaaaagacacaagagttttacttgcgtttgttttgctccacccaacctgatttgaattgggagaatgaggactgtagaaaggcaatctacgaaagtgccgttggatactggttagaccatggtgtagacggctttagaattgatgtgggaagcttgtactccaaggttgctggtctaccagacgctcctgtgattgacgaaaactcaaagtggcaacccagtgatcctttcacaatgaacggaccacgtatccatgagtttcatcaagaaatgaacaagttcatcagaaacagagtgaaggatggcagagaaattatgacagttggtgaaatgcaacatgctactgatgaaaccaagaggttgtatacaagtgcatcaagacacgaacttagtgagttattcaacttttcccacactgatgtcgggacttcgcccaagttccgtcaaaatttgatcccatatgaactaaaggattggaaggttgcccttgctgaacttttcagatacgttaacggaactgattgttggtcaacaatttatctggaaaatcacgaccaacctcgttcaattaccagatttggtgacgattctcctaagaaccgtgttatttctggtaagttgttgtctgtgttgttggtgtcactgagcggtactctatatgtgtaccaaggacaggaactgggtgaaatcaatttcaagaactggcctatcgaaaaatacgaggatgtcgaagttagaaataactatgatgcgatcaaggaagagcatggagaaaactcgaaggagatgaagaggtttttggaagcaattgcccttatttccagagaccatgctagaacacctatgcaatggtctcgtgaggagccaaatgctggtttttctggtcctaatgctaaaccatggttttacttgaacgagtctttcagggaaggaattaacgctgaagacgaatccaaggatcccaactcggttttgaacttctggaaggaggccttgagatttagaaaggcacacaaggatattactgtatatggatatgattttgagtttattgatttggacaataagaaactgttcagcttcacaaagaaatacgacaacaaaacattgtttgctgctttgaacttcagctctgattcgattgacttcacgattccaaacaatagctcgtcgtttaagttggaattcggaaactacccaagaagcgaagttgatgcgtcttccagaacattgaagccatgggagggcagaatttacatatctgaatga

SEQ ID NO: 4098 - DNA, 1770 bp, Saccharomyces cerevisiae
atgactatttcttctgcacatccagagacagaaccaaagtggtggaaagaggccacgttctatcaaatttacccagcaagtttcaaagactctaatgacgatggctggggtgacatgaaagggattgcctccaagctggagtacatcaaagagcttggtgccgatgccatttggatctcaccattctacgactcgccacaagatgatatgggttacgatattgccaactacgaaaaggtctggccaacatatggtacgaatgaagactgctttgccttgatcgaaaagacacataagcttggtatgaaatttatcaccgacttggtcatcaatcactgttccagcgaacatgaatggttcaaagagagcagatcctcgaagactaatccaaagcgtgactggttcttctggagacctcctaaaggttatgacgccgaaggcaagccaattcctccaaacaattggaaatcctattttggtggttccgcatggaccttcgatgaaaagacacaagaattctacttgcgtttgttttgctccactcaacctgatttgaattgggagaatgaagactgtagaaaggcaatctacgaaagtgccgttggatactggttagaccatggtgtagacggctttagaattgatgtcggaagtttgtactccaaagttgtaggtttaccagatgctcctgttgttgacaaaaactcgacttggcaatccagtgatccatacacattgaatggaccacgtattcacgagttccatcaagaaatgaatcaattcatcagaaacagagtgaaggatggcagggagattatgacagttggtgaaatgcaacatgcctccgacgaaactaagagactttatacgagtgcttcaagacacgaacttagtgagttatttaacttttcccacactgatgtggggacttcacctttgttccgttacaacttggtcccatttgaactgaaggattggaagattgcccttgctgagctgttcaggtacattaatggtacagattgttggtcaacaatctatctggaaaatcacgaccaacctcgttcaattacgagatttggtgacgattctcccaagaaccgtgttatttctggtaagttactctctgtgttgctaagtgccttgaccggtactctatatgtgtatcagggacaagagcttggccaaatcaatttcaagaactggcctgttgaaaagtacgaggatgtcgaaatcagaaacaactacaatgccattaaagaagagcatggggaaaactcagaggagatgaaaaagtttttagaagccattgcccttatctccagggaccatgctagaacacctatgcaatggtctcgtgaggagccaaatgctggtttttctggtcctagtgctaaaccatggttttacttgaacgactctttcagagaaggcattaacgtcgaagatgaaatcaaggatcccaactcggttttgaacttctggaaggaggccttgaagtttagaaaggcgcataaagacattactgtgtacggatacgatttcgagtttattgatttagacaataagaagttgtttagcttcacaaagaagtacaacaataaaacattgtttgcggctttgaactttagctctgatgcgacagatttcaagattccaaatgatgattcatcgttcaagttagagtttggaaactatccaaagaaggaggtagatgcctcttccagaacattgaagccatgggaaggaagaatatatatcagcgaatga

SEQ ID NO: 4099 - DNA, 1770 bp, Saccharomyces cerevisiae
atgagtggagtatcaaataaaacagtatcaattaatggttggtatggcatgccaattcatttactaagggaagaaggcgactttgcccagtttatgattctaaccatcaacgaattaaaaatagccatacatggttacctcagaaataccccatggtacaacatgttgaaggattatttgtttgtgatcttttgttacaagctaataagtaattttttttatctgttgaaagtttatgggccggtgaggttagcagtgagaacatacgagcatagttccagaagattgtttcgttggttattggactcaccatttttgaggggtaccgtagaaaaggaagtcacaaaggtcaaacaatcgatcgaagacgaactaattagatcggactctcagttaatgaatttcccacagttgccatccaatgggatacctcaggatgatgttattgaagagctaaataaattgaacgacttgataccacatacccaatggaaggaaggaaaggtctctggtgccgtttaccacggtggtgatgatttgatccacttacaaacaatcgcatacgaaaaatattgcgttgccaatcaattacatcccgatgtctttcctgccgtacgtaaaatggaatccgaagtggtttctatggttttaagaatgtttaatgccccttctgatacaggttgtggtaccacaacttcaggtggtacagaatccttgcttttagcatgtctgagcgctaaaatgtatgcccttcatcatcgtggaatcaccgaaccagaaataattgctcccgtaactgcacatgctgggtttgacaaagctgcttattactttggcatgaagctacgccacgtggagctagatccaacgacatatcaagtggacctgggaaaagtgaaaaaattcatcaataagaacacaattttactggtcggttccgctccaaactttcctcatggtattgccgatgatattgaaggattgggtaaaatagcacaaaaatataaacttcctttacacgtcgacagttgtctaggttcctttattgtttcatttatggaaaaggctggttacaaaaatctgccattacttgactttagagtcccgggagtcacctcaatatcatgtgacactcataaatatggatttgcaccaaaaggctcgtcagttataatgtatagaaacagcgacttacgaatgcatcagtattacgtaaatcctgcttggactggcgggttatatggctctcctacattagcagggtccaggcctggtgctattgtcgtaggttgttgggccactatggtcaacatgggtgaaaatgggtacattgagtcgtgccaagaaatagtcggtgcagcaatgaagtttaaaaaatacatccaggaaaacattccagacctgaatataatgggcaaccctagatattcagtcatttcattttcttcaaagaccttgaacatacacgaactatctgacaggttgtccaagaaaggctggcatttcaatgccctacaaaagccggttgcactacacatggccttcacgagattgagcgctcatgttgtggatgagatctgcgacattttacgtactaccgtgcaagagttgaagagcgaatcaaattctaaaccatccccagacggaactagcgctctatatggtgtcgccgggagcgttaaaactgctggcgttgcagacaaattgattgtgggattcctagacgcattatacaagttgggtccaggagaggataccgccaccaagtag

SEQ ID NO: 4100 - DNA, 1770 bp, Saccharomyces cerevisiae
atgtcattgacagccgatgaatacaaacaacaaggtaacgctgcatttaccgctaaggattacgataaagcgatagagctcttcactaaagctattgaagtttctgaaactccaaaccatgttttatattctaacaggtccgcctgttatacttctttaaagaaatttagtgacgcattgaatgatgctaatgaatgtgtcaaaatcaatccatcttggtctaagggttataatagactcggtgccgcccacttaggtcttggcgatctcgacgaagctgaaagcaactacaaaaaagccttggagttggatgccagtaacaaggccgccaaagaaggattggatcaggttcatcgtacccaacaggcaagacaggcacagcctgatttagggttgacacagttgtttgctgacccaaatttaattgaaaatttaaagaagaacccaaaaactagcgaaatgatgaaggaccctcaattagtggctaaactgattgggtacaaacaaaatccgcaagctattggccaagatctgtttactgatccaagattaatgaccatcatggctacattgatgggggttgatttaaacatggatgatataaaccaatcaaactccatgccaaaggaaccggaaaccagtaaaagcactgaacaaaagaaagatgctgaaccacaaagcgattccactacgagcaaggaaaattcctctaaagcaccacagaaagaagaaagtaaggaatccgagccaatggaagttgatgaagatgactctaaaattgaggccgacaaggaaaaggccgaaggtaacaagttttacaaggcacgtcaattcgatgaagctatagagcactacaacaaggcgtgggaactgcataaagatattacctatttaaacaaccgtgctgctgctgaatacgaaaaaggcgaatacgagacagctatttctaccttgaatgatgctgttgagcaaggtagagaaatgagagcggattacaaggtcatttccaaatcatttgcgcgtattggtaatgcctatcacaaattgggtgacttgaagaaaactatagaatactaccaaaaatcattgaccgaacatcgtactgctgacattttgaccaagttaaggaatgctgaaaaagaattgaagaaagctgaggcggaggcgtatgttaaccctgaaaaggcggaggaagcccgtcttgaaggtaaggaatattttaccaagagtgattggccgaatgctgttaaggcttacactgaaatgatcaaaagggcacctgaagatgctagaggatattctaatagagctgctgcactagcgaagttaatgtctttccctgaagctatcgcagattgtaacaaagccattgaaaaagatccaaatttcgtgagagcttatatcagaaaggccaccgcacaaattgctgttaaagaatatgcttccgctttggaaacactagatgcggccagaaccaaagatgctgaagtgaataatggttctagtgcaagggaaattgatcaactgtactacaaggcaagccaacaaagattccaacctggtaccagtaacgaaaccccagaagaaacctatcaaagggccatgaaagatcctgaagtggctgcgatcatgcaagatcctgttatgcaaagtattttgcagcaggcccaacagaatcccgctgctttacaagaacacatgaaaaatccagaagtattcaaaaagattcagacgttgatcgctgctggtatcatccggactggccgctaa

SEQ ID NO: 4101 - DNA, 1770 bp, Saccharomyces cerevisiae
atgtttgatcatgacgtcgaatatctgatcactgcactctcttccgaaacgaggatccagtatgatcaacgcctgctagacgaaatcgcggccaatgtggtatactacgtcccaagagtcaaatcccccgacactttgtatcgcttggtcggagcacttttccgatcgcagttcattgtccaattaccaccactacgccttttgcacatcgtcaaagatgttttcctttggaaactggaagtttctgagcccacgctcccaatttcgaagttttacttggtttggaatgctgttttcgaatctcaccgagccacgtggaacctttcacagttgatggttttggatggtgtactagtcacatacccgagcttcaaacaattgaacaacgcctattttattgatgaatccagcaacaaaactgcgctttattacagaaactggaaattacaactgttttcaccaatatgggcgcagctatggaatactgccattgtcagggctaatttatcgattcagcattgccttctgatagcattagctttactttttaatcagtcaaaccgaagcgcccttttgcatggagttgacgtatcatggaatttggtcacagagaaactattggaccttttggaagagtatgtacacggcattgtgcagccgatggaaattttttcgactgattcagtcttatcaaccaacttgaatcatttggccagttgcttgaccagttcaatcacgaggtcaaatgaggcaactttggtaaattcagtacgcaaactagaaaggatatgtcgatacttgtccgatactgtggcttcgttgaaagaacaacaactagatttcaagttccaaaatgtatttatcctgataatcctcgcgttaaaagaattatccgccatgaatatgacaatactgcctaaccataaagacactttttattctatgatctgtttaagccttttccacgtccacgtattgactcaaaaaatcgggacagtcggttttcccagttacgattatgtttacgataatttagtaacgtatttcattgtcatggatgacttgtctaaaatcactacagttttggaactaatgaaaagaaacaacaccaaacaagatccaaataaattagtgttttacatcaattttctaaacaaaattactaattactatgggtgtcgcattcgtttgccgtttattactgagtttatcgaacctttactgcatttcgatgtattttttagcgggaagacgggcaataccttggatattgaaatcaaagaatctatacacacattgacaatcactgtactgtctatagactcctcttattcctcacaggttgcacaatggcaagtatcccgcatactcgtctatttaaagatgtcgatggaccaatttattgcaggtaaattgtccgcaaatcaaattttacttatattcggccatctatccacacaacttccctcactacataattataacaagcatttgcttagggactctttgcacgagacgtatatcagaattgttaatgtaaaaaacccagaaaagaagaatgtattgattgaatgtctgattgtacaaatagcctttatcaacaatcctcatcatttgatcggctggttgaacatctgtctccagctaatcaatacacataacaaaaagctacttcaacaattgtgggaaatggtttcgagtctagaatcctccctagccatcgactggtggtacacaacggtcttatcaagtcaatcttctaaattatag

SEQ ID NO: 4102 - DNA, 1773 bp, Saccharomyces cerevisiae
atgaagacctgctactatgagcttttaggggtcgaaacgcatgcttctgatcttgagttaaaaaaagcttaccgtaaaaaggccctacaatatcacccagataaaaacccagataatgttgaagaagccacacaaaaatttgctgtgattcgagccgcttatgaagtactgtctgacccccaggaaagagcatggtatgactcacataaggaacaaattttaaatgatactccaccaagcactgatgattactatgattatgaggtagacgctacagtcacaggtgtcacaactgatgaattactcttattttttaactctgctctttatactaaaatagacaactcagctgctgggatatatcaaattgcaggaaaaatatttgccaagttagctaaagatgagattttaagtggtaagcgactggggaaattttccgagtatcaagatgatgtattcgaacaggatattaatagtattggctatttgaaagcctgcgataactttattaacaagacggataaacttttatatcctttatttggatattcgccaacggattatgaatatttgaaacatttctataagacttggtcagcgttcaataccttgaaaagttttagctggaaagacgagtacatgtactctaaaaactatgacagaagaaccaagagggaagttaatagaagaaatgagaaggctaggcaacaagctcgaaatgaatacaacaaaaccgtgaaaaggtttgtagttttcataaaaaagctcgataaaagaatgaaagaaggtgcaaaaattgcagaagaacagcgtaaactaaaagaacaacagaggaaaaatgagttaaataacagaagaaagtttgggaacgacaacaatgacgaagaaaaatttcatttacaaagctggcaaacggtaaaagaagaaaactgggatgaactggaaaaggtatatgataattttggagaattcgaaaattctaagaatgataaggaaggtgaagtattgatttacgagtgttttatctgcaacaagacatttaagtcggaaaagcaattgaaaaaccacataaacactaaactgcataagaaaaatatggaagagatacggaaagaaatggaagaggaaaacataacgcttgggttggataatctctccgatctcgagaaatttgattcagcagatgaaagtgttaaagaaaaagaagatattgatctgcaagcattgcaagctgaactcgctgaaattgaaagaaaactggcagaatcgtcttctgaagacgaaagtgaagatgacaatctcaacatagaaatggatatagaggtagaagacgtcagttcggatgaaaatgtacatgtgaatacgaagaataaaaagaaaagaaaaaagaaaaaaaaagcaaaggttgacacagaaacagaggaatctgaatcgttcgatgatactaaagacaaacggagtaatgagttggatgatcttttggcatcactaggagacaagggcttacaaacggatgacgatgaagattggtctactaaagcgaaaaagaaaaagggcaaacaacctaaaaagaattctaaatccacaaaaagcactccgtccttgtcgactctaccgtcctctatgtctccaacctccgcgatcgaggtgtgcactacatgcggagaatcatttgatagtcgaaataagctattcaaccacgtgaagatagcagggcatgcggcagtgaaaaacgtagtgaaaagaaagaaagtcaagaccaaaagaatatag

SEQ ID NO: 4103 - DNA, 1773 bp, Saccharomyces cerevisiae
atgacaaattcaaaagaagacgccgacatagaggagaagcatatgtacaatgagccggtcacaaccctctttcacgacgttgaagcttcacaaacacaccacagacgtgggtcaataccattgaaagatgagaaaagtaaagaattgtatccattgcgctctttcccgacgagagtaaatggcgaggatacgttctctatggaggatggcataggtgatgaagatgaaggagaagtacagaacgctgaagtgaagagagagcttaagcaaagacatattggtatgattgcccttggtggtactattggtacaggtcttttcattggtttatccacacctctgaccaacgccggcccagtgggcgctcttatatcatatttatttatgggttctttggcatattctgtcacgcagtccttgggtgaaatggctacattcatccctgttacatcctctttcacagttttctcacaaagattcctttctccagcatttggtgcggccaatggttacatgtattggttttcttgggcaatcacttttgccctggaacttagtgtagttggccaagtcattcaattttggacgtacaaagttccactggcggcatggattagtattttttgggtaattatcacaataatgaacttgttccctgtcaaatattacggtgaattcgagttctgggtcgcttccatcaaagttttagccattatcgggtttctaatatactgtttttgtatggtttgtggtgctggggttaccggcccagttggattccgttattggagaaacccaggtgcctggggtccaggtataatatctaaggataaaaacgaagggaggttcttaggttgggtttcctctttgattaacgctgccttcacatttcaaggtactgaactagttggtatcactgctggtgaagctgcaaaccccagaaaatccgttccaagagccatcaaaaaagttgttttccgtatcttaaccttctacattggctctctattattcattggacttttagttccatacaatgaccctaaactaacacaatctacttcctacgtttctacttctccctttattattgctattgagaactctggtacaaaggttttgccacatatcttcaacgctgttatcttaacaaccattatttctgccgcaaattcaaatatttacgttggttcccgtattttatttggtctatcaaagaacaagttggctcctaaattcctgtcaaggaccaccaaaggtggtgttccatacattgcagttttcgttactgctgcatttggcgctttggcttacatggagacatctactggtggtgacaaagttttcgaatggctattaaatatcactggtgttgcaggcttttttgcatggttatttatctcaatctcgcacatcagatttatgcaagctttgaaataccgtggcatctctcgtgacgagttaccatttaaagctaaattaatgcccggcttggcttattatgcggccacatttatgacgatcattatcattattcaaggtttcacggcttttgcaccaaaattcaatggtgttagctttgctgccgcctatatctctattttcctgttcttagctgtttggatcttatttcaatgcatattcagatgcagatttatttggaagattggagatgtcgacatcgattccgatagaagagacattgaggcaattgtatgggaagatcatgaaccaaagactttttgggacaaattttggaatgttgtagcatag

SEQ ID NO: 4104 - DNA, 1773 bp, Saccharomyces cerevisiae
atgccccccgtaccaatatacgtgaaaggcggtgtatggaccaatgtggaggatcagattcttaaagcggctgtacaaaaatacggaactcatcagtggagcaaagtagcatcccttttgcagaaaaagactgccaggcagagtgaattaaggtggaatgaatatttaaatccaaagttgaattttacagagttctcgaaggaggaggatgcccaacttctagatcttgcaagagagctgcctaatcagtggaggaccatagctgatatgatggccaggcctgcacaggtctgcgtcgaaagatataataggctattagaaagtgaagacagtggaggggctgcgttaagtacaggagttactgacttgaaagccggggatattaatcctaacgctgaaactcaaatggctagaccagataatggtgatttggaagatgaggaaaaggaaatgcttgctgaagctagggctcgtctgttaaatacccaaggtaagaaggctacaagaaagattagagagcggatgctcgaagaatcaaaacgcattgctgaactacaaaagaggcgtgagctaaagcaagcaggaattaatgttgccattaagaaaccgaaaaaaaaatacggcaccgacattgattacaatgaagatatagtatatgaacaagctcccatgccaggtatatatgacacgtccactgaagaccgccagataaaaaagaagtttgagcagtttgagagaaaagtcaacagaaaaggtttggatggtaataaggataagccaagtaaaaaaaataaggacaaaaaaagaaaacacgatgagaacgaacacgttgagaaagcagcactgggtgaatctactacattgacggatgagtataaaaaaccaaaacttatactatctgcaccaggaacgaaacagggaaaagtcacctataaaaaaaagctagaaagcaaaagacaaaaactaatcgaggcacaagcaactggcactgtgttgacaccaaaagaactactaccccacgactccggccaagaagataatgaacgcagtaatataaagagtggtaaacagctaaaatcacgcatacgaaaatttttagtgcaaatgttcgcatctttgcctagtcccaagaacgatttcgaaattgtattaagtgaagacgagaaagaagaagatgcagagatagcggaatacgagaaagaatttgaaaatgaaagagcgatgaatgaagaggacaacttcatagaaccaccatctcaaaatgatgcgccacgcgtctcattagtagccgttccattagcttactcaacgctacccataccagaattcaaaaacaatccgcagtccgcgattgacaataagtacaacttgctagtcgcgaacgccataaacaaagaacctcacatggtaccagaagatacggtagattttctcaaagaggtggagtcgcgtatgcagcatataacccaagggcgcacttccatgaaaatacaattcaaaacagcaatgcccccaactgaggttcttctggaatcgatccaatcaaaagtggagtctattgaacagttacagcgtaaactacaacatgtgcaaccactggaacaacagaataacgagatgtgcagtaccctctgccatcacagcctgcccgctttgattgaagggcaacgcaagtactacgctgattactacgcctaccgacaagagatacgatcgcttgagggtcgtagaaagcgtcttcaagccatgctaaattcttcttcttccatatag

SEQ ID NO: 4105 - DNA, 1773 bp, Saccharomyces cerevisiae
atgccgaagagaaaaattgctcctaacaaggaaagcagcaggcgtacggtctcccacgatgatttaaccccacaaatacaagaatttcaaaacctaatggatctcgaatcgcaaaaagtggaaaacatcagacagtcgtattcgaggcaaaactccctgctggccaaggataactccatattaaaaattaaagttaatagcttggaaaaaaaaataagccagctggtacaagaaaacgtgactctacgatctaaaacctctataagcgaagctatctacagggaacggttaagtaatcaactacaagtcattgaaaacggtattattcaaagatttgacgaaattttttatatgtttgagaacgtacgtaaaaacgaaaatttgcccagttcgagcttaagaacaatgttgaagagaacgagttccaggtcaagatcatgctcattgtcatcacccacatactcaaaaagttacactaggttatcaaatcacgagaataacctgtcgcatgaatcaagttttaacaaggacgatggtccagatcttgagcctaaggctaaaaaaaggaagagttctaggcggcaatctatgtttgtatccacgagtttagaacctgaagacgaaaccggtgaaaacgaacccatgatggaaaattcctctgtagaggtaccggcagaatcacacgagtctgcgcaagtggaggaaacaatagatgccttaaaccctgaagaggaaaatagcgattctgtcagtaattttaccaattcaattatagaatactccataccagaggagaatccgacagaacccgagcattcatcttctaaactagaaatattcaatgacagtacaaatatgctaagtacagtgccgtcaaatcctttgccgttgcctttaccaggcccatccgcaactttacctactaccactagcgatgcttcaacggtctatccttcatcaagttcttctactaattctcatccaaagaccaaaattaagcattccatgaagccgcctaggatagaactgaagaaaaaggttattgacgaagtcatgcccgtaagtaacatgagcagcaacagcgaaatatcatttacgagaactagaagaactcgtggtaaagctgtagattacactttgccttctttaagagccaaaatgaggaggccttcagaaaaacttgtggatgctactactgtgattgatatacatgatctacaggtttccaagagaaatcgggaaacttcacataaaaggaaaagtttatcccaagattcaatacccgacgaaccgcaattgagagaagtcgtcgtctcaaaggattatggaactccaaaagggaaaaaaacggaagatgaaatacacgaggataccgctcatctaatgaccacttccaacaacaacagcaacaacaaaaacgaaaaaaaactaactagcaacaatagccctaaaaaatcgtcgcctttacttgacattacaaataaatcggagaataagaaaaagtcaacaagaactaaaaaattgttcaaaaatgcaattgtcaataatttatctgatgaaaattctactacgcgaccctccaagtcgtcaaagggaaccagtaataataacaacaattacaacaatttcgacaataacaattcaaacattaataatgttaataataaatctgttagctttagactaaatgaagatgatttagcagtatttgatttatttggaaatggtaaggcagtgaaacatcaaccaaaaacatatcgcaccaaaaaatga

SEQ ID NO: 4106 - DNA, 1773 bp, Saccharomyces cerevisiae
atggctgttataagaattaaaaaacccagaggaccaggagagaaggatcaaccattagaaggcgagcctaaactaaagagaattcgcataaagacaaaggtaactgatgaagatatcaaaccaaagcctaaattaaagataaacctaaagaaaaagaaagagagtgctgacggcaaagagaagaagaattcattgaagttaaagttaaacttgaaaaaaaatgaagaaccagttaagaagatacacaaggcgccaaagctacgtctcaaacctattagaattcctggggaagcgtacgactcagaagcctctgatattgaagatgaccctctcatagagagtggtgtgatattaaggatacttccagacatacagttagagtttgtaaaaaattcgttagaatcaggtgattattctgggataagtatcaagtggaaaaacgagagacacgctgtcgtaacaataaacgatgtaatgtatggtgccattctagtagatttgcctacagttatagaagtgaacaagagcgtcgatagaaaaaacctcctgaagacatttgacgtatcacaaatgctactatgcataagacctatacaagaagaggaagaagtatatgccctagaagcccctgatacagaagatctggttgttaagcattttgaaggcatagaggatgaaatttgggagaataaagaaaccttcttaaaaggatacaatggtgcgcctttaagtgatatggaggctaaacatttgaaagaaatagctttgaagggctatgactacaaacatggaatatcaccacctttgtacaatgttcgaaatagacgatttagacggaaaatggaccctaatgaaatagactatgtagaaaaagtggttgatatgcttttgaagcaagataaacaggcagaagaggtcagctatgatctggttgataaaagtgaactgcaagcgaggcaagagcgtgtttctagttgggaaaatttcaaagaggagcctggagagcctttatctagacctgctttaaagaaagaagagatacacacaattgcttcggcagtaggaaaacaaggtgcagaagaagagggagaagaaggaatggaagaagaagaagaggaggatcttgacctaggcgctgcttttgaaagtgaagaggaaggtagcggtgccgagggagacaaggagcaacaacaagaggaagtcggtgatgaggtggatcaagacacaggcggagaagatgatgacgatgatgacgacggtgacattgaagctgctggtggggaaagtgaatctgatgacgaaaaagacgaaaacagacagcacactgaattacttgcggacgaattgaacgaactagagaccaccctggcccataccaagcataaattaagtaaagccacgaatcctcttttgaaaagcaggttcatagatagcattaaaaagctcgagaaggaggctgaactaaaacgtaagcagttacaacaaaccgaagattctgtccagaaacaacatcaacatcgctctgacgcagaaactgcaaataacgtcgaggaagaagaagaggaagaggaagaagaagaggaagaggatgaagtggacgaagacgaggaggatgacgaagaaaacgatgaggacgaggataatgtgcatgaacgggaacacatacaagagaacaaggtggtgcgcgaacttgatgaagcccccgcagaggaaacactcgaccagaacgatctcgatatgatgatgctatttggtgcagagggtgatgagtaa

SEQ ID NO: 4107 - DNA, 1776 bp, Saccharomyces cerevisiae
atgccaagaaaaaagtctgccgctaaaagagctagagaacaagcaaaaaaagaagcggccgtacctgcaacggatactgctaccataaaaacttctgaaacctctgcgacgacagttaagcctgcaatcgaagcaagcaaatcgtacgttcctagtgaagatgaggaagaagacgaagaggaagaagaggaggaagatgattacggtgaattgattactgatgaagtggaaaacggtattaatcaagtgctagatgccatcaaaaacaataagacggacaaactactagatcctaaagtcaaattcttcgaggatcccgaatctgctgctgccaaactggccaatcgtgaggggaagcataaacctatttacctaaaagattatcaccgtatgaacatactttctggtgatgccttaaaggaggatgacgaagaatacgaacatgcaactgttgacggaaagcaatctttcgtctcgcaacaacgtgaagagaaaactcagcttttaaatgaaatcaagagtgcctttagcgatgaagaaaatgaagagtctagcggagatgaagacgatgggtttttgaagaaaaaggaaccttctacgaagaaggaaggaaaaaatttaccggatccaaccgtaaatgaagaaaatttcttggaagaatttgtgaatcaacaggcctggattcctaagaagggggacaaggtgatttctcttgacctcaacaataatgaagaggacgatgaagaatttgaagatgctgcagaaaaatttgagaatgcctacaattttaggtacgaggacccaaacgcagctgaaattatatcttatgcacgtagtcaagctacactaagaagatccgatgactcttcacgcagaagaaaaagagaggaaaaaagaaaaattaaagagcaaataaaagcagagaaggagacagctcttcagaaaaagaagactaaaaaattgaataaattgactgacattttagagcaactaacaaaggaatatggtgctgaaattaatgccgacatggtgaaaaaaatcactgacaccctattgaagaacgatttcaaagaagaagagtgggataacgtggtagctgaattatttaatgaagaattttatcaacaagagggaaagcctacctggaacgaggatgacgaaataatgggtgacttttatgcagacgccgatggtgatgaccaaacagaagaaggtgaagtggaaaaagaacaaaaagaagaagacgaggaagaaggtccaaaaagaaagaagagcaagaaagaagagaaactgcaaaagaagaaagaaaagagaaaggtaaatgaattagtggaaaatgctttggaacaaaacaaactagcactaatagaggaggttgaaaaagaagaagaagaaagaaagagtagaagccgtacaaaagaggagcaagatttgaagtttcgttaccgtgaagtttctcctgagagtttcggtttgaccgcaagagagattttcgccgccgatgatactgatttaaatgaatttattggtttgaagaaatttgcaccttatcgttccaaggaactaagagcgaaggataaaaggaaagtgatgaaggcaagaagattaagagagtggaggaagaaaacttttaagaacgaaaatgggttagctccagtcgaagcagaggcaggggagaaggatgaggacaccatactgatacctgtagagaaagcctctaaaagcaaacacaagagggggcacagtcataaacataaaggccaccagaaaaagtaa

SEQ ID NO: 4108 - DNA, 1776 bp, Saccharomyces cerevisiae
atgctaaaatacaaacctttactaaaaatctcgaagaactgtgaggctgctatcctcagagcgtctaagactagattgaacacaatccgcgcgtacggttctaccgttccaaaatccaagtcgttcgaacaagactcaagaaaacgcacacagtcatggactgccttgagagtcggtgcaattctagccgctactagttccgtggcgtatctaaactggcataatggccaaatagacaacgagccgaaactggatatgaataaacaaaagatttcgcccgctgaagttgccaagcataacaagcccgatgattgttgggttgtgatcaatggttacgtatacgacttaacgcgattcctaccaaatcatccaggtgggcaggatgttatcaagtttaacgccgggaaagatgtcactgctatttttgaaccactacatgctcctaatgtcatcgataagtatatagctcccgagaaaaaattgggtccccttcaaggatccatgcctcctgaacttgtctgtcctccttatgctcctggtgaaactaaggaagatatcgctagaaaagaacaactaaaatcgctgctacctcctctagataatattattaacctttacgactttgaatacttggcctctcaaactttgactaaacaagcgtgggcctactattcctccggtgctaacgacgaagttactcacagagaaaaccataatgcttatcataggatttttttcaaaccaaagatccttgtagatgtacgcaaagtagacatttcaactgacatgttgggttctcatgtggatgttcccttctacgtgtctgctacagctttgtgtaaactgggaaaccccttagaaggtgaaaaagatgtcgccagaggttgtggccaaggtgtgacaaaagtcccacaaatgatatctactttggcttcatgttcccctgaggaaattattgaagcagcaccctctgataaacaaattcaatggtaccaactatatgttaactctgatagaaagatcactgatgatttggttaaaaatgtagaaaagctgggtgtaaaggcattatttgtcactgtggatgctccaagtttaggtcaaagagaaaaagatatgaagctgaaattttccaatacaaaggctggtccaaaagcgatgaagaaaactaatgtagaagaatctcaaggtgcttcgagagcgttatcaaagtttattgacccctctttgacttggaaagatatagaagagttgaagaaaaagacaaaactacctattgttatcaaaggtgttcaacgtaccgaagatgttatcaaagcagcagaaatcggtgtaagtggggtggttctatccaatcatggtggtagacaattagatttttcaagggctcccattgaagtcctggctgaaaccatgccaatcctggaacaacgtaacttgaaggataagttggaagttttcgtggacggtggtgttcgtcgtggtacagatgtcttgaaagcgttatgtctaggtgctaaaggtgttggtttgggtagaccattcttgtatgcgaactcatgctatggtcgtaatggtgttgaaaaagccattgaaattttaagagatgaaattgaaatgtctatgagactattaggtgttactagcattgcggaattgaagcctgatcttttagatctatcaacactaaaggcaagaacagttggagtaccaaacgacgtgctgtataatgaagtttatgagggacctactttaacagaatttgaggatgcatga

SEQ ID NO: 4109 - DNA, 1776 bp, Saccharomyces cerevisiae
atggaggactctaataatgaagccagcgatgacttcaacaacttattaaacaaagaaattgagtctgcaaaggaagtgaagttaagaaaattcgcgaacaggaataataataggaacgaaaacagttccaaagtcaaagatgcgagtggattcagactgagagttattcaaaccgatgggcacaaaactaaaaagacagaccctgattatgaagtgacaattgatggacccttaaggaagattgagccttattttttcacttataaaactttctgtaaggagaggtggagagatcgtaagttggtggatgtattcgtgagcgaattcagggatcgagagcccagctattattccaaaaccattgcagagggaaaagtatacttaaacgatgaacctgcaaaccttgataccatcattcgtgacggtgatctgatcacacataaagtacatcgacatgaaccgccagtcacatctaaaccaatagatattgtgtttgaagacgaagatatccttgtcattgataaacccagcagtattccagtgcacccaacgggcagatacagattcaataccattacaaaaatgctagaaagacagctaggttattcagtacatccatgtaatagactagacaagccaactagtggactaatgtttttagccaagactccattaggtgcagatagaatgggagaccaaatgaaagcgagggaagtcaccaaagaatacgtagcccgcgtgaagggcgagttccctataggtatagtagaggtagataagcctgtcagatctgttaaccctaaagttgcactaaacgctgtttgcgagatgagcgatgaaaacgctaaacatgccaagaccgttttccaaagggttagctatgatggacagacgagtattgtaaagtgtaaaccattgacaggtagaactcaccaaataagagtccatttgcagtacttgggatttcccatagcaaatgaccctatatactcgaacccagatatctggggtccagatttgggccgcggtggacttcaaaactatgatgacatcgttctgaaactagacgctattggcaagactaatcctgcagagagctggattcatcctcatagcgagggtgaatacttgcttggccgtcagtgcgaagaatgcgaggctgaaatgtacacagatcccggtactaatgatctcgacctctggctgcatgccttccggtacgagtcattggaaagaaattcggatacgcaaaaacctctctggagttatagaacaaaataccctgaatgggccttagagccacatcgccgatatatggaaatggccgttaaggaagctggtaagtgtggcccgacaaagactgcttttagtgttggtgccgttcttgttcatggaactcaagtacttgccacaggatattcaagagagctaccaggaaacactcatgcagaacagtgtgctttgataaagtactcgcagttacacccgaactgtcccactatagtccctatgggaacagtgctctatacaaccatggaaccctgttccttcaggctaagtggcaatgagccttgctgcgatagaatcctggccacccaaggtgccattggtactgtcttcgtgggggttatggagcccgatacatttgttaaaaacaatacaagtttgaacaagctggaatcgcacggtgtgaactacatacaaataccaggctacgaggaggagtgcaccatcattgccttcaaaggccacgataatagtgacgacaaagcttag

SEQ ID NO: 4110 - DNA, 1776 bp, Saccharomyces cerevisiae
atgggcaaatataccaagactgcgatcttgtcagtttatgataagacaggtttattagacttagccaagggattggtagagaacaatgttcgtatcctagcatccggtggtacggccaacatggtcagagaagctggttttccggtcgacgatgtttcttcaattacgcatgcaccagaaatgctagggggtagagtcaagactcttcaccctgctgtgcatgcaggtattcttgccagaaatttagagggcgatgaaaaagatttaaaagagcagcacattgataaggtggattttgttgtatgtaatctatatccgttcaaagaaactgtggctaaaattggtgttacagttcaagaagctgtagaggagatcgacattggcggtgtgactttgttgagagcagccgcaaagaaccattccagagtgactattctttcagaccctaatgactattctatctttctgcaagacctgtctaaggacggtgaaatttctcaggatttaagaaatagatttgcacttaaggcgtttgaacatacggccgattatgatgcggccatttctgactttttcaggaaacagtactccgaagggaaagcccaattaccgctaagatatggttgtaatccccaccaaagacctgcacaagcttatatcactcagcaggaggagttgcccttcaaagtgctctgcggtacaccaggatatataaatcttttggatgccttgaactcatggcccttagtgaaagagttatctgcatcattgaacttgcctgcggcagcatcgttcaagcacgtttctccagcaggtgctgctgtgggacttccattatccgatgtggaaagacaagtttattttgtgaatgatatggaggatttatcaccattggcatgcgcatacgctagggcccgtggtgcagataggatgtcatcctttggtgatttcattgcattgtccaatattgtagatgtcgccactgcaaaaatcatctctaaagaagtttccgatggtgttattgctccagggtatgaaccagaggcattgaatatactatctaagaagaaaaacggaaaatactgtattttacaaatcgatccaaactatgttcctggccaaatggaatcccgagaggtttttggcgtaacgttacaacaaaagagaaacgatgcgatcataaaccaatccactttcaaagaaattgtctccaaaaacaaagcacttaccgagcaagccgttatcgatctaactgttgctacgctggttttaaaatacacacaatcaaattctgtttgctacgcaaagaatggtatggttgtggggcttggggccggccaacaatcgcgtatacactgtaccagattagctggtgacaagacggacaactggtggttgagacaacatccaaaggttttgaacatgaagtgggccaagggaattaagagagcggacaagtcgaatgcgattgatctttttgttacagggcaaagaatagaaggcccggaaaaggtggattacgaaagcaaatttgaagaagtccctgaacctttcaccaaagaagaaagactagaatggttaagcaaattaaacaatgtatcgttatcatccgatgcgttctttcccttcccagacaacgtttatagagctgtgcagtctggtgtaaagttcatcacggctccttcggggtctgtcatggacaaagttgtcttccaagcggcggattcatttgatatcgtctacgtggagaacccaattcgtttattccaccactaa

SEQ ID NO: 4111 - DNA, 1776 bp, Saccharomyces cerevisiae
atgtctcaacaagataatgtcaaagccgccgctgaaggtgttgctaacctacatctcgacgaagctaccggggaaatggtctccaagtctgaattgaagaagcgtatcaagcaaagacaagtcgaagctaaaaaggccgccaaaaaggctgccgctcaaccaaaaccggcttccaaaaaaaaaacagatttgttcgctgacctggatccatcgcaatatttcgaaacaagatctcgccaaattcaagaattgagaaagactcacgaaccaaatccatacccacacaagtttcacgtttctatatccaatcctgagttcttggccaaatatgcgcatttgaaaaaaggtgaaaccttacctgaagagaaggtttcaattgctggtagaattcatgccaaaagagaatctggctccaaattgaaattctatgttcttcacggtgatggtgttgaagttcaattgatgtcccaattgcaggactactgcgacccagactcttacgaaaaggatcacgaccttttgaaaaggggtgatatcgttggtgtcgagggttacgtcggaagaactcaaccaaagaaaggtggtgaaggtgaagtttccgtcttcgttagcagagtgcaattattgacaccatgtttgcacatgttacctgccgaccactttggtttcaaagaccaggaaaccagatacagaaagcgttatttggatttgatcatgaacaaagacgccagaaaccgttttattacccgttctgaaattatccgttacatcagaagatttttggaccaaagaaagtttattgaagtagaaactccaatgatgaacgttattgctggtggtgctaccgctaagccatttattacccaccataatgaccttgatatggacatgtacatgagaattgctccagaattgttcttgaaacaattggttgtcggtggtttggatcgtgtttacgaaattggtagacaattcagaaatgaaggtatcgatatgacacataatccagaattcaccacttgtgagttttatcaagcctacgctgatgtttatgatttgatggatatgactgaattgatgttttcagaaatggtcaaggagatcactggttcttatattatcaaataccatccggaccctgctgatccagccaaagaactagaattgaacttttctagaccatggaagagaatcaacatgattgaagaattagaaaaggtattcaacgttaagttcccatctggtgatcaattacatacagctgagactggtgaatttttgaaaaagattcttgtcgacaacaaattagaatgtccacctccactaactaatgctcgtatgttagataagcttgtcggtgaattagaagatacatgtatcaacccaactttcatttttggccaccctcaaatgatgtctccattagccaagtactcaagagatcaaccgggtctatgtgagcgtttcgaggtctttgtagctacaaaggaaatttgtaatgcctacactgaattgaacgatccatttgaccaaagggcacgtttcgaagaacaagctagacaaaaggatcaaggtgatgacgaagctcaattagtcgatgaaaccttctgtaatgctctagaatacggtttaccaccaactggtggttggggttgtggtattgatagactggccatgttcttgaccgactccaacaccattagagaagtcttattgttcccaactttgaagcctgatgttttgagagaggaagtcaaaaaggaagaagaaaattaa

SEQ ID NO: 4112 - DNA, 1776 bp, Saccharomyces cerevisiae
atgtctcacaaacaattcaaatcagatggaaacatcgttactccctacctacttggccttgctcgaagcaatcccggccttacagtgattaagcacgacagagtggttttccggactgcgtcagctcctaattcagggaaccctcctaaagtttcattggtttctggaggtggcagtggtcatgagccaacgcatgccggttttgttggtgaaggtgccttagatgcgattgcagcaggtgccatttttgcttctccttcaactaaacagatctattctgctattaaagctgttgaatctcctaagggtaccttgatcattgtaaaaaattacaccggtgatattatacattttggtctcgctgctgaaagagctaaagctgctggaatgaaagtcgaactggttgctgtaggagatgatgtctctgtcggtaagaagaaaggttctttagtcgggcgtcgaggtctcggagccaccgtattggtgcataaaattgctggggcagccgcttctcatggactggagttggcagaagttgccgaagttgctcagtcagtagttgacaatagtgtcacaattgcggcatctcttgatcactgcacggttcctggccacaaacctgaagccattttgggcgagaatgagtatgaaatcggtatgggtattcataacgagtctggtacctataagtcttctccgctgccatcgatttctgagctcgtttcccagatgcttcctcttcttctcgatgaggatgaagaccgttcttatgtgaagtttgagcccaaagaggacgtagttcttatggttaacaacatgggtggtatgtctaatctagaattgggttatgctgcagaggtcatttctgaacaattgattgataagtatcaaattgtgcccaagagaacgattactggagcattcattactgcattgaatggtcctgggtttggtatcactcttatgaacgcttcaaaagctggtggcgatatccttaagtatttcgattatcctaccacagcgagtggatggaatcaaatgtaccattctgccaaagattgggaggtacttgccaaagggcaggttcccaccgccccctctttaaagacattgaggaatgaaaaaggttcgggtgtgaaagctgattatgacacttttgctaaaattttgcttgctgggattgcaaaaattaacgaggttgaaccaaaggttacttggtacgataccattgcaggagatggtgattgcggaactactcttgtgtccggtggtgaagcattggaagaagctattaaaaaccatacgttgcgcctcgaggatgctgctcttggtatcgaagatattgcgtatatggttgaggattctatgggtggtacgtccggtggtctgtactctatctatctttctgctctcgcacaaggagttagggattctggggacaaggaacttactgcggaaactttcaaaaaggcatcaaacgttgcactagatgctttgtataagtatacgagagcccgtcctggttacaggactctgatcgatgctctgcaaccttttgtcgaagcgctgaaagccgggaagggtcccagagccgccgcccaagctgcttatgatggtgccgaaaagacaaggaagatggatgcccttgttgggcgtgcttcttacgtggctaaggaggagctgagaaaactcgacagcgaaggtggattaccagatccaggagcagttggtcttgctgcactactcgatggatttgttacagctgctgggtactag

SEQ ID NO: 4113 - DNA, 1779 bp, Saccharomyces cerevisiae
atgaccgaagactttatttcttctgtcaagcgttcaaatgaggagctgaaggagcgaaaatctaactttggatttgtagaatacaaatccaagcaattaacatcatcctcatcacacaattcaaactcatcgcatcacgatgatgacaaccaacacggcaagaggaatattttccagcgatgtgttgattctttcaagtctcctctggacggctcgttcgacacaagtaatttgaagaggactctgaaaccaaggcacttaatcatgattgccattgggggcagtataggtactggtttgtttgtcggtagtggtaaggcaatcgccgaaggtggtcctcttggtgtcgtcattggttgggctattgcaggctctcaaatcatcgggacgattcatgggctaggtgaaatcacggtgcggttccccgttgtcggggcctttgccaattacggcacaaggtttttggatccaagtataagttttgttgtttcgaccatatacgtgctacagtggttttttgtattacccttagaaatcattgcggcggcaatgaccgtacagtactggaactcgtctattgaccccgtaatttgggtagccatcttttatgctgttattgtttccataaatttgtttggtgtacgaggttttggggaagcggaatttgcattttccaccataaaagcaataacagtttgcggattcattatattgtgcgttgtcctcatttgcggtggaggtcccgaccacgagttcattggcgccaaatactggcacgaccctggttgtttggccaatgggttcccgggcgttctatctgttcttgttgttgcttcgtattctctcggtggtatagaaatgacgtgcctggcatcaggtgaaacggaccccaaaggcttaccaagtgctatcaagcaagtgttttggaggatcttatttttctttttgatatcactgaccctggtaggattcctggttccatatacaaaccaaaacttactgggtggttcatctgtggacaactcaccttttgtcattgccataaaattgcatcacattaaagccttgccctccatcgtcaatgcggtcatccttatcagtgttttgagtgtaggtaactcctgcatcttcgcttcaagtagaacgttgtgttcgatggcccaccaaggccttattccatggtggtttggttatatcgaccgtgctggtaggccactggttggcattatggcaaattcactatttggattactagcatttctggtcaaatctggctcgatgtctgaagttttcaattggttaatggccattgccggcctggccacgtgcattgtctggttgagcatcaacctgtcacatatcagatttagactggcgatgaaggctcaagggaagtctctggatgaattagaatttgttagtgctgtcgggatttggggatcagcgtattccgctttaatcaactgtctaatcttgatagctcaattctattgttcactatggcccattggtggctggaccagcggcaaagaaagggctaaaatattttttcaaaattatctgtgtgccttaatcatgttatttatattcatcgtccacaaaatttattacaagtgtcaaacaggcaaatggtggggggttaaggcgttaaaggacatagatttggaaaccgatcgtaaagatatcgacatcgaaatagtcaagcaagaaattgccgaaaagaaaatgtacctagattcccgtccatggtacgtgagacagttccatttctggtgttaa

SEQ ID NO: 4114 - DNA, 1779 bp, Saccharomyces cerevisiae
atggccaattacacaaaaaccgcaatcctatccgtctatgacaagacaggtctacttgatttagccagaggcctcatcgagaagaacgttcgtattctcgcctccggtggtactgctcgtatgattcgtgacgctggttttccaatcgaagacgtttctgctatcacacatgccccagaaatgttgggaggtagagtgaaaactttacatcctgccgttcatggtggtatccttgctagggacatcgatagcgatgagaaagacttgaaggaacagcacattgaaaaagtcgattatgtcgtttgtaacctatacccattcaaagaaactgttgctaaggtgggtgtgactattccagaagcagtagaagaaattgatattggtggtgttactctattaagagcagctgctaagaaccatgctagagtcactattttatctgatccaaaggactactccgaatttttaagtgaattatccagtaatggtgaaatctctcaagatttgagaaacagattggcattaaaggctttcgaacacactgccgattatgatgctgcaatttcagatttcttcaggaaacaatactctgaaggtcaagctcaaattactctacgttatggtgccaatccacaccaaaagccggctcaagcttacgtcagtcaacaagacagtttacctttcaaagtcctatgtggttcaccaggttacattaatttgttggatgctctaaattcctggcccctggttaaggaattatccgcctcgttgaatttaccagcagcagcatcgttcaagcatgtatcaccagctggtgccgctgtgggtatcccattgtctgatgttgaaaagcaagtttattttgttgccgacattgaaaacttatctcccctggcatgtgcctatgctagggcccgtggtgctgatagaatgtcttcctttggtgattggattgctctttccaacatagttgatgttccaacagctaagatcatatctagagaagtttctgatggtgttattgccccaggttatgagcctgaggcgttggccattctatccaagaagaagggaggtaagtactgcatattacaaattgatccaaactatgttccagaagctgtcgaaagaagacaagtatacggtgtgactttggaacaaaagagaaacgatgccataatcaatcaatcaactttcaaagaaattgtttctcaaaataaaaatctcactgaacaagccataattgatttaacggttgccaccattgctattaaatatactcaatctaattccgtatgttatgctagaaatggtatggttgtcggattgggtgcaggtcaacaatctagaatccattgtacaagattagctggtgataaggctgataattggtggttcagacaacaccctagagttttggagattaaatgggctaaaggcgtcaagagaccagaaaaatctaatgctatcgatttattcgtaaccggccaaattccaacagaagaaccagaattgtctgaataccaatcgaagttcgaggagattccaaaaccatttactccagaagaaagaaaggaatggttgagtaaattaaccaacgtttctttgtcatcggatgcatttttcccattcccagacaatgtttacagagcagttaaatccggtgtcaaatacattgccgctccatctggttctgtcatggacaaggttgtattttcagctgccgattcattcgatttggtttacgtagagaacccaatccgtttgttccaccattag

SEQ ID NO: 4115 - DNA, 1779 bp, Saccharomyces cerevisiae
atggctttggaacctattgattatactactcactcgagagagatcgacgcagagtacctgaagattgtcagaggctccgatcctgacaccacctggttgattatttcacccaatgcgaaaaaagaatacgaacctgagtctaccggttcctcctttcacgatttcttgcaattgtttgatgaaaccaaggtccagtacggactggcacgtgtgtccccaccagggtcagacgttgagaagattattatcattggttggtgtcctgattctgcgccattgaagacaagggcctctttcgccgccaattttgctgcagttgctaataatctgttcaagggttaccacgttcaagttaccgccagagacgaggacgatcttgacgaaaatgaactgttgatgaaaatcagtaacgcggccggtgcccgttattctattcagacttcctccaagcaacaggggaaggcttccactcctcccgtgaagaaatccttcacaccttccaagagccctgctccagtttctaagaaggaaccagtcaagactccttccccagcacctgctgctaagatttcttcccgtgttaacgacaacaatgacgacgacgattggaatgagcctgaattaaaggaacgcgacttcgatcaggctcccctgaaaccaaatcaatcatcttacaaaccaattggcaaaatcgacttgcaaaaagtgattgctgaagaaaaggctaaggaggacccacgtcttgttcaaaagccaaccgctgctggttccaagattgatcctagttctgatatcgctaatttaaagaacgaatcaaaattaaagagggactccgagtttaactcctttttgggcaccactaaacccccctccatgacggaatcttcattaaagaatgatgatgataaagtcattaagggttttagaaacgagaaatcacctgctcaattatgggccgaaagaaaggcaaagcaaaacagcggcaacgccgaaactaaggctgaggcaccaaaacctgaagttccagaagatgagcctgaaggtgaacctgacgtcaaagatttgaaatcaaaatttgaaggattggccgcttcagaaaaagaggaggaagaaatggaaaacaaatttgctcctcctccaaagaaatcagaaccaactattatctcaccaaaacccttctccaagccacaagaacctgtgaaagctgaagaagccgagcagcctaagactgattacaagaagatcggcaacccattacccggtatgcacattgaagcggataatgaggaagaaccagaagagaatgatgatgactgggatgatgatgaagacgaggctgctcaacctcctttgccttcgaggaatgttgcgtcaggagcaccagtgcaaaaagaagagcctgaacaagaagagatcgccccaagcttaccttctagaaactcgatcccagctccaaaacaagaagaagcacctgaacaagcacctgaagaagaaattgaagaagaagctgaggaagccgctccacagctgccatcaagaagctctgcagctcctcctccgcctccaagacgagcaactccagagaaaaagccaaaggaaaatccttgggccacagcagaatatgattacgatgctgcagaagataacgaactgacctttgtggaaaatgacaagattatcaatattgaatttgtcgacgatgactggtggctaggggaactagagaaagacggctcaaaaggtctcttccccagcaattatgtgtctttgggcaactag

SEQ ID NO: 4116 - DNA, 1779 bp, Saccharomyces cerevisiae
atgtcggaacttgaaaacgctcatcaaggccccttggaagggtctgctactgtgagcacaaattctaactcatacaacgagaagtcaggaaactcgactgctcctggtaccgccggttacaacgataatttggcacaagctaaacccgtctcaagttacatttcccatgaaggccctcccaaagacgaactggaagagcttcagaaggaggttgacaaacaactagagaagaaatcgaagtcggatttactatttgtatccgtctgctgtttgatggttgcttttggtgggttcgtgtttgggtgggatactggtactatatctggttttgtcaggcaaacagacttcattaggcgatttggcagcacccgtgcaaacgggactacctatctttccgatgtcagaaccggtttgatggtttctattttcaacatcggctgcgctatcggaggtatagttttgtcaaagctcggtgatatgtatggacgtaagattggtctgatgactgttgtcgtcatttactcaattgggatcatcatccaaatcgcctccattgacaaatggtatcaatatttcattggaagaatcatctcaggactgggcgttggtggtattacagttttggcgcctatgctaatttctgaagtgtcgcctaagcagttgcgtggtactctggtttcatgttaccaattaatgatcactttcggtatctttttgggatattgtactaattttggtaccaagaattactcaaactctgtccaatggagggtaccattaggcttatgctttgcatggtctatttttatgattgttggtatgacgttcgttcctgaatccccacgttatctggtagaagtgggaaaaattgaagaggccaagcggtccttagcaagagctaacaaaaccactgaagactctcctttagtaactttagaaatggagaactatcagtcttctattgaagctgagagattggcgggctctgcttcttggggggaattggttactggtaagccccagatgttcagacgtacactaatgggtatgatgattcaatctttacaacagctgacaggtgacaattacttcttttactatggtactacaattttccaggctgttggtttggaagattcatttgaaactgctattgttttgggtgttgttaattttgtttcgacttttttctcgctatataccgtcgatcgttttggtcgtcgtaattgtttgttatggggctgtgtaggtatgatttgttgctatgtcgtctatgcctctgttggtgttaccagattatggccaaacggtcaagatcaaccatcttcaaagggtgctggtaactgtatgattgttttcgcatgtttctacattttctgtttcgctaccacttgggcccccgttgcctatgtccttatctctgagtcgtatcccttaagagtacgtggtaaagcaatgtcgattgcaagtgcctgtaactggatttgggggttcttgatcagttttttcactccatttattacttcagcaatcaatttctattatggctatgtctttatgggttgtatggtgttcgcatacttttatgtgttcttctttgttccagagacaaagggcttaacattagaagaagtcaacgaaatgtatgaagaaaatgtgctaccttggaagtctaccaaatggatcccaccatctaggagaacaacagattatgacctagacgctactagaaatgatccgagaccattttataaaaggatgttcactaaagaaaaataa

SEQ ID NO: 4117 - DNA, 1779 bp, Saccharomyces cerevisiae
atgttatcactgtctgccaaaaatcacttcacagtgagtaattctataactcacgttattaagtcatatcatataaggactctcacttcaagcgcagaaaaaatgccacatatcactactcctttttctacctcagccagtagtacaaagttaaaagctttcaggaaagttagacccgtcctacagagacatagctcttcctggattgttgctcaaaatcatagacgttcattatctggtcaatcttcgctaaacgacctgcgtcatttgaatcgctttccacaccacacgttgaaaacttcgaataacgagttttatcccgccgaacaattgactttggaagacgtaaatgaaaatgtcttgaaggctaagtacgccgttagaggtgccatcccaatgagagctgaagaattgaaagctcaactggagaaggatcctcaatctctgccatttgacaggattatcaacgccaatattggtaatcctcagcaactacaacagaaacctctgacttactacagacaggtcttgtctctcttacaatacccagaactattaaaccaaaacgaacagcagctagttgattcgaaattgtttaaactagatgccattaaacgtgcaaagagtttaatggaagatatcggtggttctgttggtgcttactcttcttctcaaggtgtagaaggtataaggaaaagtgtcgctgaatttataacgaagagggacgaaggcgagatatcatacccagaggatattttcctaactgctggtgcatccgcagctgtcaattacttgttatcaattttctgtagagggccagaaacgggtgtcttgattccaattcctcaatatccattatataccgctactctagctttgaacaattctcaagctttaccatactatttagatgagaattcaggttggtcaactaatccagaagaaattgaaactgtcgtcaaagaggctatacagaacgaaatcaaacctacagttctagtggttatcaatccaggtaatcctacaggagctgtcctatcacctgagtctatagctcagatttttgaagtcgcagccaagtacggtacagtagtgatagctgacgaagtttatcaagaaaatatcttcccgggcaccaagttccattctatgaagaaaattttgagacatttacagagggaacatccaggtaaattcgataatgttcagctagcttctttgcattcgacttctaagggtgtttctggtgaatgtggtcaaaggggtggctacatggaactcactggattcagccatgagatgagacaagttatcttgaaactagcctcgatttcattgtgtcccgttgtcacaggtcaagctttggttgatttgatggttcgtccaccagtggaaggggaggaatcattcgagtcggaccaagcagaacgtaactccatccatgaaaagttaattacaagagcaatgacactgtatgagacatttaactctttagaaggcattgaatgtcaaaagcctcaaggtgccatgtatttattccctaagatagacttacctttcaaggcagttcaagaagctcgccacttagagttaactccggatgaattttattgtaagaagttgttagaatctactggcatttgcactgttcccggttctgggtttggtcaagaacctggtacttaccatttaagaacaacatttttggcacctggtctggaatggattaagaaatgggaaagtttccataaagaattttttgaccaataccgtgactga

SEQ ID NO: 4118 - DNA, 1782 bp, Saccharomyces cerevisiae
atgacaatttcgaataaatcgtggaggagctacttcccacatttgagaaaactacccgaagatgatcagtacttatactcagacgatactaactccagtatcatagctgaagaggagctacatcatagcgtagataagtcctcgaagacagacgttacggcagaaactacagctgtagaacctcatcctcacaatttaaggcatgacttgccatatgaagtgagagatgaagctgggcgtaaatggtggaaatattttgatgaattcgagtatcgtgttaataaggaatacaagaaatcacgtaagtggtacgagtttttgtatcctaatcatactactcaaaccaaggctgaaagacggcttctttacaagctagacattattattgctttatacttttttatgttatgttggtccaagtcagtggatttgaataactacactaacgcatatgtttccaatatgaaggaagatttaaacatgaaaggtaatgattacgtttacacttctactattgctaatgttggtgccattgtcttccaattaccatttatgtatttgttaccaagatttccctctcatattattttgcctgtaatggacttgggctggacttggttcacatttgcatgttatagggcaaactcactagccgaactaagggcttacagatttattttaagtgcctttggcgctgcttactacccagtgtcccaatatatactaggttgttggtatgccccagatgaaattaattcaagagtctgtttattcttttgtgggcaacaattgggttccgtgacttcaggacttctgcaaagtcgcatattcaaaagtttgaacggcgtccatggtctagcaggctggagatggatgtttctgatcgatgccattgcaatttctcttcccacggctattattggtttttttgttattcccggtgtaccatctaagtgttactctttatttctgactgacgaagaaatacgaattgcaagggccagaaataagaggaaccaaatcaaagatggtgttgataaaagtaagctagccccattatggagcagaaaactttggaagaaagtattttgtactccagcattctgggtacttgttgtttttgatacatgttcgtggaataacatgactgcgtatagtggttcatatactttgtggttaaagtctaatacaaagtactccattgcccaagtgaacaacctgagtgttatacccgcatgtttaggatttgcgtatgtgattttttgtgcctttggtgccgatttatttagatgtaagtggatattcatggtttttgctgctataatgaataccgtttcttgtgccttacttatcaagtgggatattccttcgaaagctaaatggtacgctttcttcaccacgtatttcagtgtggccgcatcgccttgtctatggtcgtttattaatgacttcttaaggtttgatcctcaggtgaaggctattacatggatcgccatttattccttctctcaatccacttacgcctggattcctaccttggcgtggcctaccgtggagtcaccacgttttaagactggttacaccgtgagcttaatttttggtgctatttacggtttatggacgtttgttgtactttttttttacaagagaaacgaaaagaaacatgctctaggtaatggtatcatcttgtatgatagtaataagggtgaagagcttccagaatttgtaaagaaaaatatggaggaaagagatggttactactatttaaagcggtcctcgtag

SEQ ID NO: 4119 - DNA, 1782 bp, Saccharomyces cerevisiae
atggctctagctatctcccacgaggatactcagattttgctaaaggacaaaaatattctacaggaatcggtcttgaacaaatacagaactgctggacaaatcgcacaaactgctttgaaatatgttacttctttgatcaatgattcatatcactctaagaccacacagcgccaattaaccgtgccagagctatgtttgcttaccgattcttttattttgacccggttggaacaatattataaaaacaaagttaatgaaagaggtattgccattccaaccactattgatatcgaccaaatttctggtggatggtgccccgaaatagatgatactcaaaatttgttaaactggaataaggggaaagactccacttttgcatcatctgtcactgggactttgagaccgggggatttagtcaagattacactaggtgttcatattgatggttacacctctgaagtttctcatactatggttatttaccccgttgatgaaaccaaacctattcttcaacccactgggccactactaggtggtaaagcggatgctgtagctgctgctcacattgctatggaaacagttgttgctttattagcctgtgctctgactccagaaaagcttcctgcctcactgggaggaacttcaagtggtatcacaggccaattgattagaactatagtggatactattgccagatcttataactgtggcgttgttcctggttctcgtgtaagaaggattagaagattcctggcaggccaaaacgaaggtattgttgccgaaagggaatataagggtgttgtttggacagagtcccatcaagaagcagatttgctatctaatactgatgccaaggatttaacagtggtagatcgtggacaatcgactccattcactaatgtttctgctattccaagtgatgatttcgttgttcaatcaggtgaagtgtatttaattgatttgaaaatggcatctttggagcattgtaccaaaaagggtttagtaactttagaaaccgttgactcttacacaggtaaatctcataaggctggagaattgattgcaagacccggtgcatatgttagagattttgctcaaacccatattcttaaattaaaaacttctagacaattattaactaaaatcgataaacaaggcgtttatccattcaagttatctcatttatcttctaactttcctttcgttcacgaaaatgaagaagaactccaaagcttaaagaaagatttgaaatcatttagacttgggatgagtgagatttccaacaactacttatgtgtggaaagtccaatacaaattgctagatgggttccatgggaccatattttaaaggctaccaatccaaacggtaatttaagttatgatgcaacctctacattaacattacctgggcatgagttacctttaccaaaattgggtgtttcagccatcaagcttaaatccttaatgaattcaaccaaggaatcgatttctttaccagttgctcgtgaatgtaataccatcgtattatgtgactctagtgtaagtacaacggacagacccgaattattgagattaactggtggttctaagacctgtcaaccgagctggattcactctcagcacgaattaaatccacaagattcaattgttcaagggatctttcaattagctactttggccaaggataagaggttcggtctattattaaaggaaacgcagccaatgaagcagaagagtgttgagacatcaaatggcggagttgaagaaaccatgaaaatgtag

SEQ ID NO: 4120 - DNA, 1782 bp, Saccharomyces cerevisiae
atggtacgagacttagtgacattgccttcatcactgcccttgattactgctggttttgctactgatcaggttcatttgcttattggtacagggtccacggactcagtaagcgtttgtaagaatagaatccactccattttgaatgctggtggtaatcccatagtagtgaatccctcgtcaccaagccatactaaacaattacaattggaatttggtaagtttgcaaagttcgaaatagtagaaagggagtttaggttatctgatttaactactttggggagagttctggtatgcaaggtagtggatagagtattcgtagatctacccataacacaaagtcgcctatgcgaggagatcttttggcaatgccaaaaactgagaattcccataaatacattccacaaaccagagttttctaccttcaatatgattcctacgtgggtcgacccaaaaggaagtggtttacaaatctcagttactacgaatgggaatggatacatcttggcaaacaggataaaaagagatataatatcacacttacctccaaacatatctgaggtggtgataaacatggggtatttgaaagaccgtattataaacgaagaccataaggccttgttagaggaaaagtactaccagactgacatgtcattacctggatttggctacggcttagatgaggacggttgggagagccataagtttaataagctaattcgtgaatttgaaatgaccagtagagaacagagacttaagagaaccagatggttatctcagataatggagtattacccgatgaacaagctgagtgacatcaagttggaagatttcgagacttcatcttctccaaataaaaagacaaagcaggaaactgtcacagagggtgtagtacctcctaccgatgaaaatattgaaaacggtacaaaacaactacaattatcggaagtgaaaaaagaggagggacctaaaaaactagggaagatttctttagtcggaagtggtccaggctcggtatctatgctaacgataggtgcattacaagaaataaagtctgcagatataatactggcagataaactggtaccgcaagccattttagatttaatacctccaaaaactgaaaccttcatagccaaaaaatttcccggtaatgcagaacgagcacaacaggaattactagctaaaggtttagaatcgttggataatggattgaaagtagtccgtttgaagcaaggtgatccgtatatttttggccgtggtggcgaggaatttaatttcttcaaagatcacggatatattcctgtggttttaccgggcataagctcatccctagcttgtactgtattggctcagatacccgctactcaacgtgatatagcagaccaagtgctcatatgtactgggactgggagaaagggcgctctgcctataattcctgaatttgttgaaagcagaaccaccgtctttctaatggcactgcatcgcgccaacgttctgatcacgggattattgaagcatggctgggatggtgatgtccccgctgcaattgtcgagagaggatcgtgccctgaccagcgtgttactagaactcttcttaaatgggtaccagaagtcgtggaggagattggttcaaggccccccggtgtcttggttgtaggcaaggctgtgaatgcattggttgaaaaagatctgataaattttgacgaatcaagaaaatttgtcattgatgaaggttttagagaatttgaggttgatgtagatagtctatttaagttatactaa

SEQ ID NO: 4121 - DNA, 1782 bp, Saccharomyces cerevisiae
atgtattcaattgttaaagagattattgtagatccttacaaaagactaaaatggggttttattccagtaaagcggcaggtggaagacctgccagatgacttaaattcaacagaaattgtcactatctccaacagtatccagagtcatgaaacagctgaaaatttcatcacgactacaagtgaaaaagatcaactacattttgagactagtagctatagtgaacataaagacaatgtgaacgttactagaagttatgaatatagagatgaagccgataggccatggtggagatttttcgatgaacaagagtatcggatcaatgaaaaggaaagatctcacaataaatggtatagttggttcaaacagggtacctctttcaaagaaaaaaaattattaattaaattggatgtccttttagccttttattcttgtattgcttattgggtgaaatatctggatacggttaatataaacaacgcttacgtttcgggaatgaaggaagatttaggctttcaaggtaatgatttggtgcatactcaagtaatgtacacagttggtaatattatatttcaattgccatttttgatttacctgaacaagctcccattaaactatgttttaccaagcctcgacttatgttggtcgcttttaaccgttggtgctgcatatgtcaattctgtaccacacttgaaagcaattaggtttttcattggggcttttgaagcgccaagttatttggcataccaatatttgtttggttccttttacaaacatgatgaaatggtgcgtcgttctgctttttactatttgggccagtatatcggtattctatccgctggtgggatccagtcagccgtatattcatcgttaaatggtgtaaatggtttagagggatggagatggaactttattattgacgctattgtgtctgtcgtagtgggccttattggattttactccctgccaggtgacccatacaactgttattctattttcttaactgatgatgaaattaggttggcgaggaaaagattaaaagaaaaccaaacaggtaaaagtgattttgaaacaaaagtattcgatattaaactgtggaaaacaattttcagtgattggaaaatatacattttaactttatggaatattttctgttggaatgacagtaatgtttcatctggggcatacctactatggttgaaatctttgaaaagatactctattcctaagctcaatcagttatccatgattactccgggtttaggtatggtttatttgatgcttactggtattattgcagataaattacactctcgttggtttgcgattatttttactcaggttttcaatatcattggtaactccatattagccgcttgggacgtcgcagaaggagccaaatggtttgcatttatgctgcaatgttttggttgggctatggctcctgttttatactcttggcaaaacgatatttgtcgccgagatgctcaaactagagctattactttagttacaatgaatattatggctcaatcatctaccgcatggataagtgttttggtttggaaaacagaagaagctcccaggtatttaaaggggtttactttcactgcatgttctgctttttgtctctccatttggacttttgttgtactctacttctataaacgtgatgaaaggaacaatgccaagaagaacggtattgtgctttataactctaaacatggtgtggaaaagccaacgtcaaaagacgttgaaaccttatcagtatctgatgaaaaataa

SEQ ID NO: 4122 - DNA, 1782 bp, Saccharomyces cerevisiae
atgtcagaactctttggagtattgaaatctaatgctggcagaattattttgaaggacccctccgccacttctaaagatgttaaagcatatatagattcagttatcaatacctgtaagaatgggagtattacaaagaaagcagaactggacgaaatcactgttgatggtttagacgccaatcaagtttggtggcaggtcaaactagttcttgatagtattgatggtgatctaattcaaggaattcaagaactcaaagatgttgtcacgccttctcacaatctctctgatggtagcaccctgaactcatcatccggggaagaaagtgaactagaggaggcagaaagtgtttttaaagaaaagcagatgctctctgctgatgtttctgagattgaggagcagagtaatgatagtctttccgagaacgatgaagaacctagtatggatgacgaaaaaaccagtgcagaggcagctagagaagaatttgcggaggaaaaaagaatttcttctgggcaagatgaaaggcattcttcacccgatccttatggtatcaatgataagtttttcgatctcgaaaagttcaatagggatactttagctgcagaagattctaacgaagcttctgaggggagtgaggatgaagatatagattattttcaagatatgccttcagatgacgaggaggaggaggctatttattatgaagacttttttgacaaacccacaaaagaacctgtgaagaagcactctgacgtaaaagatccaaaagaagatgaagaattggatgaagaagagcatgattctgccatggataaagtgaaattagacttatttgcggatgaggaagatgaaccgaatgctgagggagtgggagaagccagtgacaagaacttatctagtttcgaaaagcaacaaatagagattagaaaacagatagaacaattggaaaacgaagcggttgccgagaagaaatggtctttgaagggtgaagtaaaggcaaaggatcgtcccgaagatgcattgctcactgaggaacttgaattcgacagaactgcaaagcctgttcctgttataacaagtgaggtcacagaatcattagaagatatgattagacgaaggatacaggacagtaactttgacgaccttcaaagaagaaccctgttagacatcacacgtaagtctcaacggcctcaatttgaattgagtgatgttaaatcctcgaagtcgttagcagaaatatatgaggatgactacacacgcgctgaagatgaatctgcattaagtgaagagcttcaaaaggcacattccgaaatatcagaactttatgctaacttggtatataaattggatgtgctttcatcagtgcacttcgttcctaagccagcaagtacttctttggaaattagagttgaaacacccactatatcgatggaggatgctcaacctctctatatgtcgaatgcctcttctttggctcctcaagagatatacaatgtcggtaaagcagaaaaggacggagaaattcgcttgaagaatggtgttgcaatgtctaaggaagaattaaccagagaagataaaaacagattgcgcagggctttgaaaagaaaaagatcgaaagctaatttgccaaatgtaaacaaaagatctaaaaggaatgatgttgttgacactttgtcaaaagccaagaatattactgttatcaatcaaaagggtgaaaagaaagatgtttccggtaaaacgaagaagagcagatcagggccagatagcacaaatataaaactttga

SEQ ID NO: 4123 - DNA, 1785 bp, Saccharomyces cerevisiae
atgaataactccaaaattcctaaactttcctttcatagtgatccaaacaacgtcactcgagactttccaaagacaaaacgacagaaggttcagaaaagagaaatggatatgatactaactcctaataacaacaagctaaatatattgcacagctctggatctggtatacggcgctgctacactgatgacacctccgctacgtatactaagaaactaacctttgggggggaccccaagattattgaaagggttaagaacaatgaacgtaaggttagaaaagacatagattcactactgaatgctatttctgaaattgaaaaggaatctgttcgtattcatgccagggaactacctgcaataacattagaattagatgcaaaagtcaaagcgtgcagggagctacaaaatgagattgatggactatcaacggagatggacttgaaggataatcaatgtgatcttcaaagaaagaatgttgagctatcatcaaaaaatatagtgtctatgcatgcagtaaaagtacaagagttcgaaaacgatttagaggaagagctatcgaatgccaaaagggagtggacgtataaattaatggaagtagaaaatttgaaacctgacgaaaggttaactgacgaaatgcgacagcttaaaacagaattcgaggaggtcaataggaaactattcattctacagaatgaaaatgagaacgagtgtaaaaactacaaaaaagaattggacaagaaattcgagatattcaagaaagttaagaacgatgctagaattgaattagatggggagcaagaaagactttcgaaagttttaaaagacctacaagacacccatggtgaactgaaagaaaatattaagacgtgtagagatgagtttaacgattttgaaaaaaggattggagaggcagaagtgaacttccatagcatggaacttgccgttgttcctctcaaaaagaagcttgcttctacatcacaagcattgacgcaagtgcaggaggagaagaagcaagtcgaaggagaagcaaacaattggaagaagaagtacgttaatgaactagaaaaggttcaacaggaattatacacacgacaaaatctggccacttcaattgaagaaatcaaaggatacacccgatgctttgcgtatgccaatgaacgacaaatgcctgatgaattccatatcaactatgtggatcggtgcatttgcgagaatagtggagaaaaacgggtacaagtatttgatagagtagttctcgaagaaatccataaggatcacaaacgcttatataacgaatgcattccgttcctggaaaaatacatcagcaagttaattaactgcagcattatagtggtttcgcagcaacccacagcaccaatgaaaaagactttgctaaaacagttaattgagcagtacggtgagaattataagatgacattgaacattttgcatcttgacggaagtattaaacacagtgacgttggattagataacccaacagaaattagagatctgtcacaagatgaagaatgcatgaacattttaactttagataccaagttgggaaaagatgaagagtcccattcaatgaatatatatatcggtagtatgtccacggtacagctgaatagagagcttgatgatgctccctcagtcctttcgcatattctcactaaaacaaagcagtgctttgtcttcaagattaacgctggtgaaaacatcgagaaggctctagccttagcgggaaagctgaaaagaacaataacattacctcagctagattaa

SEQ ID NO: 4124 - DNA, 1785 bp, Saccharomyces cerevisiae
atgacaatggcaacaaccgcaatgaatgttagcgtacctccaccagatgaagaagaacagttactagccaaatttgtattcggtgatacaacagatttacaagaaaatctcgctaaatttaatgccgatttcattttcaatgaacaagaaatggatgttgaagaccaggaggatgagggatctgaatcagataacagtgaagaagatgaagcgcagaacggtgaattagaccatgttaacaacgatcagttattttttgtggacgatggtggtaacgaagatagtcaagataagaatgaagataccatggacgtggatgacgaagatgactcttcaagcgatgattattctgaggactctgaagaagctgcttggatagattcggatgatgaaaaaattaaagtgcctattcttgttaccaataagacaaagaaattaagaacctcctataacgagtccaaaatcaacggtgttcattacatcaacagattgagatctcagtttgaaaagatatatccaaggcccaaatgggtggacgatgaatctgattctgaattagatgacgaagaagacgatgaagaagaaggctctaataatgttattaatggagatattaatgctctaacgaagatcctgtctactacttacaattataaagacactttatcgaattccaaactattaccccctaagaaacttgacattgtgcgtcttaaagatgcaaatgcatcacacccgtctcattccgccatacaatctctttcattccatccttctaagcctctactgttaacgggtgggtatgataagaccttaagaatatatcatattgacgggaaaacgaaccatctagtgacaagtttgcacctggttgggtctccaatacaaacatgtactttctatacttctctatcaaaccaaaatcaacaaaatatattcaccgccggtagaagaagatatatgcattcctgggacttatccttagaaaatttaactcattcacagactgccaaaatcgaaaaattttccagattgtatggacatgagtccactcaaagatcatttgagaatttcaaagttgcacatttgcagaattcacaaacaaattctgtccatggaattgtccttttacagggtaataatggttggattaacattttacattccacttccggactatggttaatgggctgcaagatagaaggtgtgataacggatttctgtatcgattatcaacctatttcacgtggtaagtttaggaccattttaattgctgtaaacgcgtatggtgaagtgtgggaatttgacttgaataagaatggccatgttataagaagatggaaagaccaaggtggcgtgggtataacaaaaatccaagttggtggtgggacaacaactacttgtccggctcttcaaataagtaagataaagcaaaataggtggcttgcggtaggtagtgagagtggatttgttaatctttacgatagaaataatgctatgacctcgtcgacccctacacctgtcgccgccttggaccagctaacaactaccatttctaatctacaattttcccctgatggtcaaatactgtgcatggcatcccgtgcagtcaaggatgctttgagactagttcatctgccttcttgtagcgtgttcagcaactggcctaccagcgggacgcctttgggtaaagttaccagtgtcgcattttcgccatctggtgggctactggccgtgggtaacgaacaaggtaaagtgaggctctggaaattaaaccactactaa

SEQ ID NO: 4125 - DNA, 1785 bp, Saccharomyces cerevisiae
atgagctatgagaaaaagtctgtggaaggcgcttatattgacgattctacaacgttcgaagcatttcatctcgactctcgtttattacaagctattaagaatataggatttcagtacccaacattaattcaatcacatgctattcctttggctttacaacagaagagagatattatagcaaaggccgctacaggttccggaaaaactttggcatacctcattcctgtaattgaaactatcctagaatataaaaaaacaattgataacggagaggaaaatggtacactaggtattatacttgttccaacaagagaactggctcaacaagtatataatgttttagaaaaactagtcttatattgttcaaaagatataagaactctgaacatatcatccgatatgtctgactcagttttgagcactctacttatggatcaaccagaaatcatagttggtacacctggtaaattattggatttgttgcaaacaaagattaattctatctcattgaacgaactaaaatttttagtagttgatgaggtggatttagtgttaacatttggttatcaagatgatttaaacaaaattggagagtacttaccattgaaaaaaaatttacaaacatttttgatgagtgcaaccctaaatgacgatatacaggctttgaaacaaaaattttgtcgttctccagctattcttaaattcaatgacgaggaaataaataagaaccaaaacaaattacttcaatattacgttaaagtcagtgaatttgacaaattcttactatgctatgtcatttttaaacttaacttaatcaagggtaaaacattaatttttgtaaataatattgacagaggatataggctcaagctagttatggaacaatttggtatcaagtcctgtattttaaacagcgagctacccgttaattcgaggcaacatattgttgaccaattcaataaaaacgtttaccaactattgattgccacagatgacaccgagtacataaaagaggaagatgacgaaatagaagaagggcacaatacagaaaatcaagaagaaaaaagcttggaaggcgagcctgagaacgataagaaaccaagcaagaaaaagaaggtccaagtgaagaaagataaggaatatggtgtttctcgtggtgttgatttcaaaaatgttgcatgtgtcctcaatttcgatttacctacgacggctaagtcctacgtgcatagagtaggtagaactgctcgtggcggaaagaccggtactgcaatttcattcgtagtcccactgaaagaatttggtaagcataagccatcaatgctacagacagcaaagaaggatgaaaggattctttcacgaatcatcaaacaacagagcaaacttggattagaattacagccttacaaattcgatcaaaagcaggtcgaggcgttccgttacagaatggaagacggtttccgtgctgttactcaagttgccattagagaagctagggtcaaagagttgaaacaagaactattggcaagtgagaagttgaaaagacattttgaggagaatccaaaagagctacaaagtttaagacacgataaagaattacatccagcaagagtgcaacagcatttaaagcgtgttccagattacttgcttcctgaatcagccagaggaaatggaaccaaagtcaagtttgttcctttccacaatgctaagaagcgccattcacataaaaagggaagagtcagtaagccaaagaatggtaaagtagacccgttgaagaacttcaaatga

SEQ ID NO: 4126 - DNA, 1785 bp, Saccharomyces cerevisiae
atgagtagtattgttaataaaagtggtacacgctttgcccctaaagtaaggcagcgtagagccgccactggaggaacaccaactccaaagccaagaacccctcaacttttcattcccgaaagtaaagaaatagaagaagataatagtgataacgataaaggtgttgatgaaaatgaaacggctattgttgagaaaccttcgctagttggagaacgctctttagaaggctttaccttaaccggcactaatggacatgataatgaaataggtgatgagggccccattgacgcctcgacccagaaccccaaagcagacgttatagaagataatgtgactctaaaaccggcacccttgcaaacccaccgagaccagaaggtaccgagatccagcagattagcttcactgagtaaggacaacgaaagtcgtccaagttttaaaccgtcatttctcgattcttccagtaacagtaatgggactgcgcgacgtttatctacaatctccaataagcttcctaaaaagataaggcttggaagcattacagaaaacgatatgaatctgaaaactttcaaaagacatagggttttgggcaaaccttcttcggctaagaaaccagcaggtgcacacagaatcagtattgtctccaaaatttctccacctacggcaatgaccgattctttggacaggaatgaattttcgtcagaaacttctacatcaagagaagctgatgagaatgaaaattatgtgattagcaaagtcaaagatatcccgaaaaaagtgagagatggggagtctgctaaatattttatcgatgaagagaattttacgatggcagagttgtgtaagccaaactttcctattggtcaaatatctgaaaactttgaaaaatctaaaatggcaaaaaaggcaaaattggaaaagagaaggcatcttagagaactcagaatgcgcgcacgacaagaatttaaaccactacactcattgactaaagaagaacaggaagaagaagaggagaagagaaaggaagaaagagataaactactcaacgctgacattcctgagtcagaccgcaaagcacatacggcgatccaactgaagcttaaccctgatggtactatggcaattgatgaagagactatggttgttgacagacacaaaaatgctagtatcgaaaatgaatataaagaaaaagttgatgaaaacccttttgccaatctttataattacgggtcgtatggtaggggttcatacacagacccgtggactgtggaagaaatgataaagttctacaaggcgctttctatgtgggggacagatttcaatttgatctcacaattatacccttatagatcaagaaaacaagtgaaggccaaattcgttaatgaggagaagaaacgtccaatattgattgaattggcccttcgatctaagctaccgcctaattttgatgagtattgctgcgaaatcaagaagaacattggtacagtagcagacttcaacgagaaactaatcgaattacaaaacgagcacaaacatcatatgaaggaaatcgaagaagcaaagaatacggcaaaggaggaagaccaaactgcacaaaggctaaatgatgctaatttgaataaaaagggatctggtggtattatgacaaatgatttgaaagtttatagaaaaacggaagttgttctgggtacaattgatgacttgaaaaggaagaaactcaaagaaaggaataatgatgacaatgaggataatgaaggaagtgaagaagagcctgagattgatcaataa

SEQ ID NO: 4127 - DNA, 1785 bp, Saccharomyces cerevisiae
atgtctgtccgtacttcttcaagatctaataagggtcagaataaatatattgagtatttgttacaggaggagactgaagcaccaaagaaaaaaagaactaaaaagaaagttgattcagccatagagaagaataagaagtctgattcttctcaggagccaaggaaagatactgaaaatgtaagaacagacgaagtagacgaagcggatgagggctatgttagatgtctgtgtggggcgaacaatgaaaactacgatgctgcagaatattcgcatggcgacatggtacagtgcgatggctgtgacacttggcagcatattaaatgtatgactgatggtaaagacaccatagatgggctaatgagtgaagattctaagtactactgtgaattgtgcgacccatcattgtatgcacatttggaaacgtcaaaggaggcagaggtttcagaggatgaagattaccatgatgatgtttacaagcccgtaaatgaccatgatgacaatgatgcagatgtctttcttgatgaggaaagccctaggaaacgaaaaaggagccccgatagtgccaaaggaattcatatcaaatccaaacaggtgaagaaatccaatgggtcaaaaaaaaggaataaaagcattgatgccgccaagtctgatactgccgaaaacgaaatgcctactaggaaagattttgaaagcgaaaaagaacacaaactgaggtataatgcagaaaaaatgttctctaccttatttagcaaattcatcgttcccgaaacaattgaggcaaaactttatgagcttcctgatgggaaagacgttatatcgatatcgcaagagtttgcgcacaatctggaagaagaactttacaaagcttgccttaacgtcgagtttggtactttggacaagatatacacagagaaagtgaggtcgttatactctaatttaaaggataaaaaaaatttggaactgaaggcacacgttgtcgagggcaaattgcctttaaataaactggtgaacatgaacgcatctgaactcgcaaatcctgacttacaagaatttaaagagaaaagggataagattatcttagaaaattttatcgtggaggtacctgacaaacccatgtacgttaagacccacaagggtgatgagctgatcgaagatatcgctgaacctcaagaggatattttgtactcaaaagacagcataagattacacaacattgacagtatcgacagcgataagagtaaaatagaacagactcatgccatttcgaaagaacccagcccaagtacaataatcaacgaagaatctttaaactgcgcatttttgtatcccggcttaggacttgagtttacaggttacctaaactacattggggcttcacaaaagttaagacgggatattttcaaggaagccattggtgacggaaaactgtatgtagaagggcgcttacctacaaccactgctgcaccatatcttaaggaaatttcttgctctagagctatattagtataccaattatttccttcgaatgatagtgaaagtaagacaacttttgccgacgttgtagactccctggaaaacaaaggtcgcattgcaggtataaagccaaaaactagatacgagaaggatttttatatcgttccatcgaagggcggtgaaattcctgaaattttgaaagatattttaggcagtcacaatgatgaaagatctgagagattttcgcgaatgaaatcagatgaaagaacattattcgcatttgttgtcgtgaaacaggaatttatccattaa

SEQ ID NO: 4128 - DNA, 1788 bp, Saccharomyces cerevisiae
atgcctaccgtctccgtgaacaagcagcaattatttgatcttctaggcaaaaactacacttcccaagagttcgatgaattatgttttgaattcggtatggaaatggacgaagacaccacagaggaggccttgaaaaccggggaggagccggaattgaagcttgatatcagtgccaatcgttacgatttgctttgtatcgaaggtatttcacagtcgctgaacgaatacttggaacgtaaagaaagacctgactataaattaagcaagccaaccactaagttgatcatcgacaaatcaacggagcaaattagaccttttgctaccgctgctgtattgagaaatatcaagcttaacgaaaaatcttacgcttcttttattgccttgcaagataaattacatgccaatctatgtagaaacagaagcttggttgccatgggtactcacgatttagattcaattgaaggtccattccattacagagctctaccaccaaaggacatcaagttcgtaccattgaatcaaacccaagagtttactggtgacaaattgatcgagttttataaatctccagaacagaaaaacaacatagggagatacgttcacattattgaggattctccagtcttcccagttattatggacagcaaagatcgtgtttgctccctgccaccattaatcaatagtgaacattcgaagatctctgtgaacacccgtaacattttgattgatataaccgccaccgataagaccaaagccgagatcgttttgaacatattaactacaatgttctcacgttattgtgacgaaccattcacggttgagcctgtagaaattgtctctgaacacaatggccaatcccgtttggcgccaaacttcaacgatagaattatggatgtctccattaagtacatcaactcctgtcttggcctagatcaatccgctgatgaaattgctcattgtctaaagaagatgtcgttgcatgccgttcaatcaaaggaagacaaggacatcttgcacgttgacattccggtaactagacctgatattttgcacgcttgtgatataatggaagatgccgctgtcggttatggtttcaataatttgccaaagggtgagaaattatccaatgccaacttcattgccaaaccattaccaatcaacaaggtttctgatattttcagagttgcatcctctcaagccacgtgggttgaggttttaccattgaccttatgttcgcacgatgaaaactttaaatttctaagacaatccgacaatggtgatttagctgtcaaattggccaacccaaagactttggaataccaagttgttagaaccactttattgcctggtatcttaaagacagtcaaggaaaacagaaaacattccttgccaatcaaagtctttgaaaccggtgacgttgtatttaaagacgacaaactagaaaggaaggcgtacaatgaacgtcactgggctgccatctacgtgggtaagaattctgggtttgaaatcattcaagggttattgggtaaaatcatgcaaacttttagaacagagtggattgcagactacggtgctgctgcttctggcagaggttactggattgaagaagacgattctgtgaaaacctacttcccaggtagaggtgccaaggtcatgttcagatccaaagaaggcgctgagccaaagcaaatcggccacttgggtgtcttgcatcctgaagtcatgatgaatttcgacgttccattcgctgcatcctttgtagaggttaatgccgaagtcttcctataa

SEQ ID NO: 4129 - DNA, 1791 bp, Saccharomyces cerevisiae
atgaaattatctgtcctcacatttgtcgtagatgcattacttgtctgcagctcaatagtagatgccggtgttacagattttccatccttaccaagtaatgaagtctatgtcaaaatgaattttcagaagaaatacggcagttcatttgaaaacgctttggatgatacaaaaggtagaacgcgtttgatgacaagagatgatgattacgagctggtggaactgactaatcaaaacagtttttattcggtggaattagatattggcacccctcctcaaaaagttactgtgcttgtcgacactggttcttctgatctatgggtcacgggttcagacaacccatactgttccactaaaaagaaggataccactggctcatcctttaaacaagtaaacaaggatgctttggctagcgtggttgagagtgtgtttactgaaattagctacgacaccactatagttaccagcgaagccactgctacttttgatagtacagcttctacatcacagttaattgactgcgctacatacgggacatttaatacctctaagtcgtctacattcaactccaataatacagaattttcgatcgcctatggtgatacgacttttgcatctggtacctggggccatgatcaattgagcttgaacgatttgaacattacgggtttatcatttgctgtagcaaacgaaacaaactcaacagttggtgtcttgggtattggtttgcctggcttggagtcaacttattctggtgtttctctcagctctgtacaaaaaagctacacttacaataactttccgatggtgctaaagaattcgggtgtaataaaatcaacagcttattctttattcgcaaatgattctgattcgaaacatggtaccattttgtttggcgctgtggatcatggaaaatatgcgggcgacctatacacaattcccatcattaatactttgcagcatcgcggctacaaggatccaattcaattccaagtcactttacaaggattaggtacgtcgaaaggggataaagaagacaatctgacaaccctaaccactacaaagatcccagtcctgctagattcaggtacgaccatatcgtatatgccaactgagctggtaaaaatgcttgccgaccaggtcggagctacttactcttctgcatatggttactacataatggattgtatcaaagagatggaagaagagagtagcatcatctttgattttggtggattctatctttctaattggttaagcgattttcagctagtcacagatagtcgttcaaacatttgtatactaggtattgcaccgcagtcagatccgaccattattttgggtgataacttcttagctaatacttacgtggtatatgatctggacaatatggagatatcaatggctcaggctaacttcagcgacgacggtgaatacattgagattatagagagcgcggttccaagtgctcttaaagcacctggttactcaagcacttggtctacatatgaaagtattgtctccggcggcaacatgttttccacggcagctaactccagtatatcgtactttgcttccacgtctcattcggcaacaagttcttccagctccaaaggccaaaaaacccaaacaagtacgacagctctctctatttcaaaatctacctcaagtacttcctcaacaggaatgttatctcccacctcaagttcatctacgagaaaagaaaacggaggacacaatctgaatcctccatttttcgccaggttcattacagctatttttcatcacatttga

SEQ ID NO: 4130 - DNA, 1791 bp, Saccharomyces cerevisiae
atgacaaaggaacgtatgaccatcgactacgaaaatgacggtgattttgagtacgataagaataaatacaagacaataaccactcgaataaagagtatcgaacctagtgagggatggttggaaccttctgggtcagtgggtcacataaacacgatacccgaagcgggcgatgttcacgtggatgaacatgaggatagagggtcttctattgatgatgactcaaggacttacctgctatatttcacagaaactcgacgtaaactagaaaacaggcacgtccagttgattgctatttccggtgtcattggtacggcgctattcgtggcgatcggaaaagctttataccgtggagggcccgcctctttattattggcatttgctctttggtgtgttccaatactttgcattactgtgtctacagcggaaatggtctgctttttccctgtaagttccccctttttgagattagcaacgaagtgcgttgacgattcattggctgtcatggctagctggaatttctggtttcttgaatgcgtacagatccctttcgagattgtttctgttaatacaattatacattattggagagatgattattcagctggtattccgctcgccgttcaagtagttttgtatctgcttatttccatttgtgcagtcaaatattacggtgaaatggaattttggttggcttctttcaaaattatccttgcactcggcctatttacattcacgttcattaccatgttgggtggaaatcctgaacatgatcgttacgggtttcgtaattatggtgaaagtccattcaagaaatactttcccgatggcaatgatgtggggaagtcttcgggctacttccaggggtttctcgcttgcttgattcaggcatcgtttaccatagctggtggcgagtatatttctatgttagcgggagaggtcaaacgaccaagaaaagtattacccaaggcgtttaagcaggtgtttgtgagattaacatttttgtttttagggagttgtctgtgtgttgggattgtttgttcgccaaatgatcctgacttgacagcagcaattaatgaagcaaggcctggcgccgggtcttcaccttatgtcattgcaatgaataatctgaaaattagaatattacctgacattgttaatatagctttgattacagccgccttttctgctggtaacgcttacacttattgctcatccagaacattttatggtatggcattagatggctacgcgccaaaaatcttcactagatgcaataggcatggtgtgcccatttactctgtggccatatctttggtatgggctttagtgagccttttgcaactgaattctaatagtgcggtcgtattgaattggttaattaacttgattactgcctctcaattgattaattttgtcgtcctttgtatcgtctatttatttttcagaagggcttaccacgtccaacaagattcgttacccaagttgccattccgttcgtggggtcaaccatacactgctattatcggccttgtttcatgttccgcaatgattttaatacagggctacaccgttttctttcccaaattatggaacacacaagattttttgttttcgtatttaatggtgtttatcaacatcggtatatatgtgggctacaaatttatttggaaacgtggtaaagatcacttcaaaaacccacatgaaattgacttttctaaagagctaacagaaattgaaaaccatgagattgaaagctccttcgaaaaatttcaatattatagcaaagcataa

SEQ ID NO: 4131 - DNA, 1791 bp, Saccharomyces cerevisiae
atgacatgcctaattttatggtatctgtggctcatatcaacttttcagttagagtttgcaacggctagtactgcaaatacaacaactacagcaaagtctggaacctcttcgtcaacggaggagccgtttcctgtactagccgtgggtaaagatggtagaggaaactactatgttaatagcacatttggcactcccggtcaacgccaacgtttgctagtggatattatccaaccgtacataaatctggtttccggaacaagcgaaagtcataacgaatactccggtgtatatcataagcatcccagctacctcatgaatgactctacatcatctgttcctgtttctcctggccaaatatatgagatttctttcattgatggtagagctgttaactgtactttggtgacagacgatatgaattttacaaatgtttcctcagaaaattcctcgaccgctttgataaccgatttaatggtaactcgagataacgtacaatttaactcggggagcctatccatttcaaacgtttccttctttgatattcagtcctcgaactttaagacttcaggcttgttaggtttaagcgggaaggtcacaaacccaggcaatgctatcgatagctcacaatacacagaacagtcttattttctatccttattgaaagatgcagatatcattgaaagttcgtcatattcactgtggttggctggagacacttccacgtacaaaacatatagagatccaatatctaattgtgggaagctacttcttggaggggtggatccttcgctgtttaccggtacactgggaaaatttgacttaattccttacgttgacccagtgagtaatgctgttagtgttgggtacccaattgtgccattaggccctatttatattgtgtctaacagcggacaaagtttgaatatgacttcgaaggactttctgagcccagccttacttgattcaacttcttcggtcagttacctgccaactagtaccattattcagattgccgttcaaattgcggccacttatgtggaatcactagataggtggctagtccaatgttctatagcagatatgggtgtctccttgggtttcaggcttcgagaattgacaattgaaatacccctacgtgatttattatcatctacttacgatacatccaccaattcttcaatgtttttcagttctggacaggaagcttgttttctaacactatacgctaatacaaatactggagtaaacatactcggagaagccttcataaaaaatatatatatggcaatggacttagaggataacactatagccattgcacaggcaaagaaggttgaagatgacgcagttactgaagagacaaatgaaactaccgcgtccactatcatcaagaagatcaaatctggttacattccttacgcaaaagtgatgaatagtagtaatacaagaaacttgactctttatccatcctataggtcaggctatatgttcactgtcccaggtcaactgacagcagcatactcaaacggtgtgattacaggtgcgggccggtcattctatgatacttcaagagcaagcacaagtgctagaccatccagtactcaattcgacagcttttctgtgtcagcctcagaagagtggtcaaattcaactaatagaaccagcagtgcttcgggagcaggcgttcgattgagcagtccttatacatttaacaaagatccagctggacatgtaactcgtatagcttccttgctactactttcgatattctcgatacttattgttctttga

SEQ ID NO: 4132 - DNA, 1791 bp, Saccharomyces cerevisiae
atgccagtgtgtaagaactgtcacggaaccgaatttgagagagatctttccaatgctaacaacgatttagtttgtaaagcttgtggtgttgtctcagaagataatcctatcgtctctgaagttacattcggtgaaacaagtgcaggtgctgctgtagtacaaggttcttttatcggtgcaggacaaagtcatgctgcatttggtggttctagtgctctagaatctagagaagccacattgaacaatgcaagaaggaaattacgcgccgtttcttacgcattacatatcccggaatatatcacagatgctgctttccaatggtataagcttgcattggctaataactttgtacaaggtcgtaggtcccaaaatgttatcgcttcatgtctttacgttgcatgtagaaaggaaaagacgcatcatatgctgatcgacttctcttcaaggttacaggtgagtgtgtattccataggagccacatttttgaaaatggtaaagaaattacatatcacagaattgccgttagcggatccttccttattcattcaacattttgccgaaaaattggatcttgctgacaagaagatcaaagtggtaaaagatgccgtaaaattggctcaaagaatgtccaaggactggatgtttgaaggacgtagacctgcaggtattgccggcgcatgtattctactagcttgcaggatgaataatttgagaagaactcatacagagatcgtcgcagtttcacatgtcgccgaggaaactttacagcaacggttgaacgaattcaaaaatacaaaggctgctaaactttcagttcaaaaatttagagaaaatgatgtggaagacggtgaggctaggcctccctcctttgtgaagaacagaaagaaagaaagaaaaataaaggactctttagacaaagaagagatgtttcaaacaagtgaagaagcattgaataaaaatccaattttgacgcaagtattaggagaacaagaactgtcttccaaggaagtcctgttttacttaaaacaattttcagaaagaagggcccgtgttgtggagaggattaaggctactaatggtatagatggtgaaaatatataccatgaaggttctgaaaacgaaacaaggaaacgcaaactttctgaagtttctatccagaacgagcatgttgaaggggaagacaaagagacggaagggactgaggaaaaagtcaagaaggtaaagacaaaaacatcagaagaaaagaaagagaacgaatctgggcattttcaagatgccattgatggttactctctagaaacagacccatattgtcctcgcaatttacacttgttacccacaacggacacatacctttcgaaagttagtgacgacccagataatttagaagatgttgatgatgaggagttaaacgcgcacctattaaacgaggaagcttctaaattgaaggaaagaatttggattggtctgaacgcagatttcttacttgaacaagagagtaaacgtttgaaacaggaggcagatattgccacaggtaacacatcagtgaaaaaaaaacgtacgagacgtaggaataatactagaagtgacgaacctacaaaaactgtggatgcagcagcagctatcggattgatgtcagacttacaagataagtctggtttacacgctgcattgaaggcagctgaggaaagtggtgatttcacaactgctgatagtgtcaagaacatgttgcagaaggcaagtttctccaagaagattaattacgacgccattgacggtttgtttaggtaa

SEQ ID NO: 4133 - DNA, 1794 bp, Saccharomyces cerevisiae
atgaacaccggtatctcgcccaaacaggacgacgcctctaactccaacttactcaacataggccaagaccattcgctgcagtatcagggtctcgaacacaacgactcccagtacagagatgcttctcaccagacacctcaccaatacttgaaccagtttcaagcccagcctcaacaacaacaacagcagcagcagcagcaacaacagcaacaacaacaagcgccttatcaaggtcacttccagcagtcgcctcaacaacaacagcaaaatgtttattatccactacctccacaatctttgacgcaacctacttcgcagtcgcaacaacaacaacagcaacaacaacaacaacagtatgctaattcgaactcaaattcaaacaacaatgttaatgttaacgcgctacctcaggatttcggttacatgcaacaaaccggatcgggccaaaactatccgacgatcaatcaacaacaattttccgagttttacaactcctttttaagtcatttaactcaaaaacagacaaacccttctgtcacgggtacaggcgcgtctagtaacaacaacagtaacaacaacaatgttagtagcggcaataacagcactagcagtaatcctgcccagctggcagcctcccaattaaaccctgccacggctgctgcggccgccgcaaacaatgctgctggcccggcttcgtacttgtctcagctcccacaggtgcagagatactacccgaacaacatgaacgctctgtctagtcttttggacccttcctctgcaggaaatgctgcaggaaatgccaacaccgctactcatcctggtttgttaccacccaatctgcaacctcaattgactcaccaccagcagcagatgcagcaacagctgcaattacaacaacaacagcagttgcagcaacagcagcagctacaacagcaacaccagttgcaacaacaacaacaacttcaacaacaacatcatcatctacaacagcaacagcagcaacaacagcatccagtggtgaagaaattatcttccactcaaagcagaattgagagaagaaaacaactgaaaaagcaaggcccaaagagaccttcttccgcttatttcctgttttctatgtccataagaaatgagttgcttcaacaattccctgaagcaaaggtccccgaattgtctaaattggcttctgcaaggtggaaagagttaacggatgatcaaaaaaaaccattctacgaagaattcagaaccaactgggagaagtacagagttgtgagagatgcttacgaaaagactttgcccccaaagagaccctctggtccctttattcagttcacccaggagattagacctaccgtcgtcaaggaaaatcctgataaaggtttaatcgaaattaccaagataatcggtgaaagatggcgcgagttagaccctgccaaaaaggcggaatacactgaaacttacaagaaaagattaaaggaatgggaaagttgttatcccgacgaaaatgatccaaacggtaacccaaccggtcactcacataaggccatgaacatgaatttgaatatggacactaaaatcatggagaaccaagacagtatcgagcacataaccgcaaatgccatcgactcagttaccggaagcaacagtaacagtaccaacccaaatacgcccgtttctcctccgatttcattacagcagcagccgctccaacaacaacaacaacagcagcaacaacaacaacacatgttattggctgaccccactacaaatggttcgatcataaaaaatgaataa

SEQ ID NO: 4134 - DNA, 1794 bp, Saccharomyces cerevisiae
atgctgcttaccaaaaggttttcaaagctgttcaagctgacgttcatagttttgatattgtgcgggctgttcgtcattacaaacaaatacatggatgagaacacgtcggtcaaggagtacaaggagtacttagacagatatgtccagagttactccaataagtattcatcttcctcagacgccgccagcgctgacgattcaaccccattgagggacaatgatgaggcaggcaatgaaaagttgaaaagcttctacaacaacgttttcaactttctaatggttgattcgcccaaggggagtactgcaaagcagtataacgaggcatgcttattaaagggtgacattggagaccgtcccgaccactacaaagatctttacaagttgtctgctaaggagctgtccaagtgtttggaactatctccggatgaagtagcaagtctgaccaaaagccataaggactacgtagagcatatagcgactctcgtctcgccaaagggtacgtacaaagggtccggtatagccacagtgggtggcgggaagttctcccttatggcatttttgatcattaagactttaaggaatatggggaccacgttacctgtggaagtcctgatccctcctggtgatgaaggtgaaactgagttttgtaacaagattctgcctaagtataactccaagtgtatttacgtttcagatattctaccacgagagacgattgaaaaatttgttttcaaaggataccagtttaaatcattggcccttatcgcttctagttttgaaaacctgctcttactggatgctgacaacttccccatcaaacccctagacaacatattcaatgaagaaccatatgtgtctacgggcttggtcatgtggcccgatttctggaggcgtacaactcacccattgtattacgacattgcaggtattgctgtggacaagaaaaagagagttcgcaattctcgagacgatatcaccccacctgctgtttacacaaaggatttgaaggatttgagtgacgtcccgctaagtgacctagacggaacaatacccgacgtgtctacggaatccggccaactgatgataaacaaaacgaagcatttggctacggctcttctatctttattctacaacgtcaatggaccaacgtggtactacccaatattttctcaaaaagctgctggtgaaggtgataaggaaactttcattgccgctgcaaacttttatggtctatcattttaccaagttagaacaaggacaggcgttgaaggctaccatgatgaagacgggtttcatggtgtagcaatgttacaacacgactttgtgcaggattatggccgttacttaaatgctatggagagcattggcaacaaatacggtggcactaaatcagctgatgcaatcaagtttgacaaaaactattccctcgaaaaatacaccgaagaatttttcgacaacgaggacttaaatgccaagaatcatgtagatgttatgttcatccattcaaacttcccaaagtttgacccatacgatttatctaaaagcaattttttgactacgaatggtaaacctgctcgttcatatacggccttaaaaaaggtaaaaaattacgatattgaactagagaatttcaaggttttaaacgaatatgtttgtgttaataagaatcctttcaaatatctcgatgaccttttagggcaggataaaacggaatggaaaagagtgtgtggttacatcaccgatagattagcatttttagaatctactcatgataaggcgattgccggtaaataa

SEQ ID NO: 4135 - DNA, 1797 bp, Saccharomyces cerevisiae
atgacaaagaggagaaacctctttatggttggttcttccttcacaatagatcatttacctccagaaatatggctttgtatttctaagctggtcgggacgtctgacctgcataacttgtgtttaattaacagaagattgtatttgacaattacaagtgatgaaatttggaaaagaagatgctatgaccgatggataaatcgagaaagcttagatattttaactggtaatgattacgattctatacccgtctctcaatggtattcttactatttaagaagagcaaaatgggagaataaaattttttgtctattatgggggttaactgaagaaacaaatccccaacatttcagagagaaatatttgcatatcctccaatttagacattacaaactggctacatttctgcataggattataaaacaaggctacatacctgataaaagaccacttgatttaatcacgtatgcaaactatctgttgaaaaatgtgcgacataagtacgtatttcctttattttatcccacaaatgccgctgaattgaaaaatcttaataatatggcctcaagggatgctgaaatgatatatttaagattatctgccattgatacgtcttttgatgacttactagatgctagagaattcatattaaatggaatatgttccgatctactacaaaagtataaaaaaattgaagagtttttgaaattacgaccggtgactagggtttccaagttaatctcaatcagtactgactatctggactgcttcacacaacctcatgattcagtgggtcaaacaaatgatagggccacaggaagggagctacatagagaggatttcatgttactaagagtatattcccgagaaggacgaggttataaaactatcattctagcaataatacaggctatcactaagagatataacgttgattcatatcttgctcgagatcatttggtggtgtctgaaccagactttccagatggacgggcatttgttaccgtgaatgaggatttccagccatacatttttgataaagaggaccttttgagcgtttggtcgaacaacttccataacgcagaaaattttgaaagtacagttttaccagcattattagaaccaatatcgatacaacatcttctgacggagttctttcgagaactgctgcgatgcaagcccaggccatttgagggatatccaaacagagcacacggattacgcgatatgtttccatacggaaaagtggaagttcccagagatgtgacgatgtattttgcatttatatacgatcttttcgatggcatgtttgaatctggaatgacaagtttacggggccagatgttgagagatttactgaactacgttaacgctaataattttggtgatttgaatatcatcattggacaaaatgctcttaaggaaccaaatgactgctggtccaacaagagggattacgttcttcttgatgacaataataagattggatatttctatacggatattgaaactgaggatactttatgtgccttaaaccaatatgaagtggacggcaaagtttttataacaacaatagatatcttgggtgatataagagtacgcctggctgaaggactaacgccttttcagggagataatgataagttgtgggagagcttttcttccgttgttccacgaactgactggggactttttttcaaaggctatgacaaagaaaggcgtagaatgcaattaaacccttacatagaggaaaagctttccaatctagcgaatgatgaacagcctttacataatttatag

SEQ ID NO: 4136 - DNA, 1797 bp, Saccharomyces cerevisiae
atgagcttcagtagtatagtctctaagtttttgagatatttagaaattcctgccaaaaataggactgccgtgaattttctgaggaaccctgatttgcaacctatcaagtctgcaaatcaaacatgggggttctggtctaatttggcgtactggggcgctgtgtcctttacagcaggtacatggatgagtggttctgctgcactaagtgtcggcctaagttacccagagaccattgtttcgtttcttctcggtaatgtcttgaccattattttcactatggccaactcttaccccggttatgattggaaaatcggtttcaccttggcccaaagattcgtttttggcatttacggttcagccttcggtatcatcattagaattttgatgagtattgtcaattatggttccaacgcttggttgggtggtctatctatcaacatgatattagattcctggtcccaccactatctgcacctgcccaatactttgtccccaagtgttgccatgaccaccaagcagttggtcggcttcattattttccacgtcctcaccgcgctctgctatttcatgaaaccctaccatatgaactaccttttaatttggtcatgtgtagctacttgctttgccatgctgggtatagtgatttacttgactaagaatgcccatggtgtcggtgaattgtttacctccacaaaatctaccgttactggttctaaaagagcatgggcttgggtttacatgatttcatactggttcggttccatttctccaggttccaccaaccaaagtgactattcaagattcggttcctccaatttggctatctggaccggtagcgtctgtgcattactaatcccagcaaccttggtcccaatcttcggtgtcattagtgcctccacctgcgacaaattatacggtaaacaattttggatgcccatggatatattcgattattggttgacaaacaactattctgcaggcgctcgcgcaggtgccttcttctgtggtctttgctttaccatgtctcaaatgtcctccaccatctccaactgtgggtttgccactggtatggatatggccggtttgttgcccaaatacgtcgatatcaagagaggtgctcttttttgcgcatgtatctcctgggcttgtttgccatggaacttctacaactcttcttctactttcttaactgtcatgagttctttcggtgttgtcatgactcctattattgctgtcatgatctgtgataactttctgatcaggaagaggcaatattccattactaatgcctttattctaaagggtgaatactattttaccaagggtgtcaactggagagctatcgttgcctgggtgtgtggtatggctcccggtctacctggtatcgcttgggaagtcaacaataactatttccacgactcaggtattgttaaattcttttatggtgattctttcttctcctttttgatttcttttttcgtttactgggggctatgtgtcttcttcccattcaaaattactgttagacatgatgacaaagattactatggtgcatttaccgacgaagaagcgagaaagaagggcatgattccatacagtgaaatttctgaggaagaaatccgtgcttacacgttaggcgaatgctacacaactggacacgaatacaaacctgagagttctgataacgaatcacctgaattgatcaaaactagctcagaaaacactaacgtatttgaaatcgttcaccaaaaggatgatgaaaagcactcctttagtaccactcaacaagttgtctga

SEQ ID NO: 4137 - DNA, 1797 bp, Saccharomyces cerevisiae
atgagtttcggtagtaaagtctccagggctttgagatttttggaaattcctgtcaaagacagggcatctgtgagtttcttgaagaacccggatttgcaacctattaagtcggctaaccaaacatgggggttctggtctaattttgcatattggggtgttatgtccttttcagtgggtacatggatgagtgcctcttctgcactaggtgttggattaagttacccagaaaccattggtacatttatcgtcggtgatgtgttgaccattattttcacattggcaaactcgtgtcctggttacgactggaaggtcggtttcactttggcccaaagattcgtctttggtatttacggttctgccttcggtatcatcatcagaattttgatgagtattgtcaactacgggtccaacgcttgggtgggaggtctttgtatcaatatgatcttggattcatggtctcaccattatttgcacctgccaaacaccttatcttcgaaagttgccatgaccactaaagaattaattggttttatcatcttccacgtccttactgcattctgttacttaatgaaaccctaccacatgaactacattttaatttggtcgtgtgttgctacatttttctctatgttgggtatggtgatctatttagctaaacaggctcacggtgttggagaattgtttacctccactaaatccactgccactggctccaccaaagcttgggcttgggtttatatgatctcgtactggttcggttccgtttctccaggttccaccaaccaaagtgattactcgagatttggttcctccaattgggctatctgggccggtaccatctgtgcattgttaattccaaccactttaatcccagtttttggtgttattggtgcctccacctgtgacaaactatacggtgaacaatattggatgcctatggatatcttcaaccattggttgacaactaactattctgcaggtgctcgtgccggtgcgttcttctgtggtctttcatttgtcctatctcaaatgtcctacaccatctccaactgtgggtttgccagtggtatggatttggccggtttattacccaagtatgtcgacatcaagaggggtgccctttttgccgcatgtgtctcctgggcttgtttgccatggaacttctacaactcttcttctactttcttgactgtcatgagttctttcggtgttgtcatgactcctatcatttctgtcatgatttgcgataacttcttgatcagaaaaagacaatactccatcactaatgcctttattctcaagggtgaatactatttcactaagggtgttaactggagagctattgttgcctgggtttgtggtatgacccccggtctacctggtattgcttgggaagtcaataatgactatttccacaacactggtattgtcaatttcttttacggtgactccttcttctcgtttttgatctcctttttcgtctattggggactatgcctcctcttcccattcaaaattactgtcaaacatgatgacaaagattattatggtgcctttactgacgaagaagcaagaaagaagggcatggttccatacagtgaaatttctgaagaagaaatccgcgcttacacattaggcgaaggttacactaccggccacgagtacagacctgaaggctccgacgatgaaatacctgagttggtcaaaactagctctgaaaacaccaatgagtttgaaatagttcatcataagaataatgaaaagcaatcctccaccgccagtgaaaaagctgcttag

SEQ ID NO: 4138 - DNA, 1798 bp, Saccharomyces cerevisiae
atgaccgatgtgttgagaagcctagtgcgaaagatttccttcaataactcagataaccttcagctaaaacacaagacatctatacagagtaatactgccctagaaaagaagaagagaaagcctgatacaatcaaaaaggtaagcgacgttcaagttcaccatactgtacctaatttcaataacagttcagagtacatcaacgacatagagaatcttataatatctaaactgatagacgggggaaaggagggtattgcagttgatcacattgaacacgccaatatctcggacagtaaaacagatggaaaagttgccaataagcacgaaaatattagtagcaagcttagtaaagagaaggttgagaaaatgattaattttgattataggtatattaaaaccaaggaaaggactagtatgtataattattttttattttttttttttatgttcttgccagtggaggaatgtttctttcgtcacaaccggagtgaatagtggaactactgtcagttcatagtatcgcgacacaaaaaaaaataattaaaagaaaaaaaaagagagtgtaaaataaagatttatgaaattgcatccctaatcttagaaacttgcttacgaaatatcaggaagcatagcggaacatttttccatattacatcaactaccattttttatgggaatcacattatatactaacataggtttagttcataaacgggtttataaacatgaccgcaaaactgatgtcgaccgaaaaaatcatggaggaactatcgacatcagttatcctacgacagaagtggttggccatggttcatttggtgttgtagtcacgactgtaataattgagaccaatcaaaaagttgccataaagaaagtactacaagatagaagatataaaaatagggagctcgaaactatgaagatgttgtgccatccaaatactgtgggtctacagtactacttttacgaaaaggacgaagaagatgaagtatacctcaatctggttttggactacatgcctcagtcgttataccaaaggcttcgtcattttgttaatttgaaaatgcagatgccgcgtgttgaaattaaattctatgcataccaactattcaaagctttaaactatttgcataacgttcctcgaatctgtcacagagatataaaaccgcaaaacctactggtggatccgacaactttttctttcaagatttgcgattttggcagtgccaaatgcttgaaaccggatcagcctaatgtgtcttacatctgttcaaggtactatagggctcccgaactcatgtttggtgccactaattactcaaaccaggtcgacgtgtggtcaagcgcttgtgtcattgctgagttgcttttgggcaagcccttgttctctggtgaaagcggtatagatcagttggtggaaattattaagataatgggcatacccacaaaggatgaaatttcaggaatgaacccaaattatgaagaccatgttttccccaatatcaagcccattactttggctgaaatattcaaagccgaagatcccgatactcttgacttgttaacaaaaactctgaagtatcacccttgcgaaagattggtacctctacaatgtctattatcaagctattttgacgaaaccaaacgttgtgataccgacacttacgtaaaagcacaaaacctgcgtatatttgacttcgacgtggaaactgagttgggccatgttccacttgtggaacggcccgccattgaagaacggttgaaacattttgtttctgcaccttcatcgtctttgtga

SEQ ID NO: 4139 - DNA, 1800 bp, Saccharomyces cerevisiae
atgagcggatttcacaatgttggaaatatcaatatgatggctcaacagcagatgcaacaaaatagaataaagattagcgtgaggaactggcagaatgcaaccatgaacgatttgattaattttataagccgcaacgctcgagtagctgtttatgacgctcatgtggaaggacctttagttattggatatgtcaactcaaaggcagaagcagaatcgttaatgaaatggaacggtgtccggtttgcaggcagtaatttaaagttcgaacttttagataacaatggggcctctgcgggaacttcagacaccatttcgttcttgaggggggtgctccttaagaggtatgacccacaaacaaaattactaaatttgggcgctttacattcagatcccgagctaattcaaaagggcgtctttagttccatctccacccagtctaagatgtttccagcaatgatgaaactggcttctacagaaaaaagtttgatagtggaaagtgtcaatcttgctgacaaccaacttaaggacatctcagcaatttccacattggctcaaacatttcctaatttgaaaaacctctgtctggccaacaatcagatttttagatttagatcgctagaagtttggaagaacaaattcaaagatctaagagagcttttgatgacaaataacccgataaccaccgataagttgtatcgcactgaaatgttaagattatttccgaaattggttgtactagataacgtgattgtgagagacgaacaaaaattgcaaaccgtttactcattaccgatgaagattcaacagttttttttcgaaaacgatgcattagggcaatcatctacagactttgcaactaactttttgaatctatgggataataatagagaacaactgttaaatttgtattcgccccaatcccagttttctgtttccgtggattctactattcctccatctacggtaacagattcggaccaaactccagcatttggttattacatgtcgtcctcacgtaatatatccaaagtgtccagtgaaaaatctatccagcagagattgtcaatcgggcaagagtccattaatagtatattcaagactttgccgaaaacaaagcaccatttacaagaacaacccaatgaatactcaatggaaacaattagttatcctcaaataaatgggttcgttattacgttgcacggattttttgaagagactggcaagcctgaactggaatccaataaaaaaacggggaaaaataactatcaaaagaatagaagatacaatcatggttacaactccacatcaaataataagttatccaaaaaatcctttgatagaacctgggtaattgttccaatgaataatagtgtcataatcgcatctgatctgttaactgtaagagcgtattccacaggcgcttggaaaactgcatctattgcaatagcacagcctccacagcaacaggcctcggtcctaccacaggtcgcaagcatgaacccaaatataacgacaccaccgcagccacaaccttcagtggtaccaggagggatgagcattcccggcgcaccccaaggagccatggtcatggctcccactttgcaactacctccagatgtccagtcgcggctaaatcccgtacaactcgagctgctgaataaactacatttggaaacgaaattgaatgcagaatacacgtttatgttggccgagcaaagtaactggaactatgaagttgccataaagggttttcagagtagcatgaatggcatccctagagaagcatttgtgcagttctaa

SEQ ID NO: 4140 - DNA, 1800 bp, Saccharomyces cerevisiae
atgagtttcggtacgagaatctccagggctttgagatttttggaaattcctgttaaaaatagggcctccgtgaattttttaaggaaccctgatttgcaacctatcaagtctgttaatcaaacgtgggggttttggtctaattttgcgtattggggtgttctgtccttcaacgttggtatgtggataggcggttcgtctgcattaactgttgggttaagttactcagagaccatcggtgcgtttattattgctgatttgttgaccatcctgtttgctttagccaactcttgtcctggctatgactggaaggtcggcttcactctagctcaaagattcgtctttgggatttacggttcagctcttggtatcattatcagaatattgatgagtattgtctattatggttccaacgcttggttaggtgggctttgtgtaaacatgatattagattcttggtctcaccactatttgcatctgcccaatactttgtcctcgaaagttgccatgaccaccaaggaattgatcggcttcattatcttccatatccttaccgcgttctgttactttatgaagccataccatatgaactatattttaatttggtcgtgtgttggtactttcttcgccatgttgggtatggtaatttacttaactaagagcgcacatggtgttggtgacttgttcacttctactcattccacagttactggctctaaaaaggcttgggcttgggtttatacgatctcgtactggtacggttctgtttctccaggctgtaccaatcaaagtgacttctccagatttggttcctctaattgcgctatctggactggtactatagttgctttactaataccagcaaccttgatcccagtattcggtatcattggtgcttctgcttgtgaaaaattatacggtcaaacattttggatgcctatggacatctttgacaactggttgacaactaactattctgcaggcgcgcgtgcagctacattcttctgtggtttttgttttgtaatgtctcaaatttcatataccatctccaactgtgggtttgccagtggtatggatttggctggtttattaccgaaatatgttgatattaagagaggtgctatttttgccgcatgcgtctcctgggcctgtttgccatggaacttttacaactcttcttctactttcttgactgttatgagctctttcggtgtcgtaatgacacctattatcactgtcatgatctgtgataatttcctcatcaggaagagacaatactccgttaccaatgcctttgttctaaagggtgaatactattttaccaagggtgtcaactggagagctatcgttgcctgggtgtgtggtatggctcccggtctacctggtatcgcttgggaagtcaataatgactatttccacaacactggtattataaattttttctatggtgattctttcttctcctttttgatttcctttttcgtctattggggactatgcctcctcttcccattcaaaattactgtcaaacatgatgacaaagattactacggtgcgtttaccgacgaagaagcaaggaagaagggcatggttccatacagtgaaatttctgaagaagaaatccgtgcttacacattaggcgaatgcttcacaagtggacacgaatacaaacctgagagctccgatgatgaactacctgagttgacaaaaactagttcagaaaacacaaaagtgtttgaaattgttcatcagaaagataatgaaaaggaatcctctacttccagtgaaaaacaaattgcctaa

SEQ ID NO: 4141 - DNA, 1800 bp, Saccharomyces cerevisiae
atgatagatatcaacgttaataacatattttttagatcttattcagttgatcctaactctggtcacgcaatttatgtctttgattcgacttatttgccagcatctgatgaaattggcgataagcaagtttatgacttgcttattaatgccctcatggatcgattggtaatgaaattgccacaggcaccatattcactggtgattttttcatctgggttttcccagagaaaaataagctgggtttacggtattaaaatgtttgcaaagttacccaaagagaccaagttctatttacaaaagatttttattgttcatgagtcattcttcgttaggtcggtctatcaagtaatttcaaacgctatgaactttaacttcttggactcaaaagatagtcagcatgattttccaagtttagttcatgtcttggacctgacttctttatccgagctaatagatattacgcgacttagaatatcgttgaacgtgtacttatatgattaccagatacgcgaacatataaatgtcccggaggaatattataacagattgacccctctggcaataagacagtataggcagttagtattcgataaaattttcaagaaattacagaatgacgctctgttgtgtgaattgatattccagaagccgggaaactataaaaaggtaaacatttttttggatattatcaaaagaaacaactacattgatttatctcaatgggatatttattctttggcatccgtgtggttgaattacttcattaagaataaagccaaacctctaatcccaattgaattaattccgttaccaattgttgatgatctaaagttcacaagtgaaacattccgcaaaattattaaattcaaccaataccaggacctctttatggtcataattcctttttttaataggatcatagcgcatggtgaatcgactaaacatgattcaaggaccctaagtaaagctttaactccggcgttatgtaaggaaaaactttccatgatgactaatgatcgtttagctattgggtcgagatatattaaaaatttactggactttttccccgaaatcgcgaaggaaatatcatcacctccttcatccgtatcatcgtcttctactatccctgttttgcctaagccaaggaagtcgtcgccaaccagatacagtgaactaggctgcttaacccttcctagaagtcgaagccctagtccacaaagatctgttacgtctccaacgtacacacctgtcgcattacaaaatacaccagtcttgaaacctaagtcttcaagcagaaatgtttcatccccatcattcaatgccaaacctccacttcctattaaggcagttacacgaccacaactgtctctaacttccaattctaatacagatttggcattagcttcttcttctacagatacattatcctcaccgacgaagactccatcagcagactcgcttccattgagtaacagcagcaccgatttaacgatatcagataatatcaaagaaatggttaaggacgagccagcaaaggataaaaattctgtggaaacagatatattcgtacaacagtttgaaagtttaaccctcgtccaaaacgcgaagattaagaagttcgacaaagaactacaagaaaagaagaagaaaaatgaaactacttcaaagacagcagataaattctctcaaaagggatattcagatattaaagcaagcaacaaggttagcaggctagctgcattgtacgaagaacgtttacaaggtttacaagtaatgaatgaaatgaaacaaaggtggtaa

SEQ ID NO: 4142 - DNA, 1800 bp, Saccharomyces cerevisiae
atggttgcctattctccaatcattgccacctatggtaatcgtgcagaacagtttttagaaacagactcagacttcgctaagtatcatgcgaaattgaataaaaagttgcaacacttgaggagccgttgccatttggtcaccaaggatacaaagaaatactcaagtaaaaataagtatggcgaaattaactccgaggattatgataataaaactaaattgattggtgttttgattttactacacgctgaaagggacttggcactggctgaaactttgaaattgagagctcgtcaaagaggaaagttaaagaaaagtgaagaaaaggttttatccacaagattgaagaaggcctgcaagactgctgataaattggttaacgtcactcaaaatgaacagcaatggataactcgtgcccaatatttagcgttcgctaaattggtacattcagagtacctaattaatggaaaaaggttcaagaggaaggacaatgccaaaatttcgaacaacctagccctcgttttcgccgcattggaacacttgaagaatctaagcttattagctgaagaagttgtagataacattgttaataaataccagtactctctcaagcagtacgcgggaaatttaattacaacgcccgaaataaataactttatcgtggaaagagttcaatctgatgagaacaaggacgatgagcttgtgaaattgttattagacaatggattcaatatgaaaaaaattacaacctcaactgaagatcaaaaggttaccactaacataaactggagatctttcaacgccaagataatcgatgctgaagttgctcaatttttggaacaaggtctatctatccacccaactcagattactcaatatacacagaggctatcaaaattggagaaagctttagaccgtcatgaatttttcatcgcaaaccacgacgatcaagatgacatagacgagatggttgaaaatagttctgaaaacaatcagataattttagcctacattaaatataatattcttttgacctctatatctcgtgaaagagatttgtttactcatttatggaatcaatggctgaaattaaatacttcattaccatcgaagttaaccaaatataaagaaatggaacgtattgtgaagaatttgacaaaatatttatcggacataatggagctacctggtgtgtattcagatgacgagctgctaagccaattagacttatgcaagctgtatttccagttatttctgaatacgggctgcctgagtgttttatatcagtcgaaaggcagatatatggaggcgttagctctatatgtggacgcttaccgaagattagaaaacaaattatctgaaattgaatctctagacgaaatcttacttccagcaaatcttttgtcattgaattctgtccgaagcttacaaaagagaatcgaaaacggtggtaatagtgtcattactttggcggaatacgaaaaaagaaatcatggtggcagcttagggaaatatgatttgacagtgattgaaaaattggatagtaaaaaaatactgccaacggacatacaattgaaaaatttattccctctcaagccaaaaatgctgcccattcctagtaaaccaacactttttgatttggccttcaactacataacatatgataagcaagagccctcagcttctcaagtgaaagattcagtcacagaaaccgagagcatctctcaaacaccaatttctaatgagcagacggaaggagagcctaaaaagaagcgtggtttcttgggcctatttggtcgttaa

SEQ ID NO: 4143 - DNA, 1803 bp, Saccharomyces cerevisiae
atgaagatcacagaaaaattagagcaacatagacagacctctggcaagcccacttactcattcgagtacttcgtcccgaagactacacaaggtgtacagaacctgtatgaccggatggaccggatgtacgaggcttctttgccccaatttattgacatcacctggaatgcaggcggtggacggttgtcacatctgtccacggacttggttgcgacagcgcagtctgtgcttggtttggaaacgtgcatgcaccttacctgcaccaatatgcccatttcgatgattgacgacgctttagaaaacgcttatcactccggttgccagaacatcctagcgctgagaggagatcctcctagggacgcagaaaactggactcccgttgaaggtggcttccagtatgccaaggacttgattaagtatatcaagtccaagtacggtgaccatttcgctatcggcgttgccggctacccggagtgccatccggagttgcctaacaaagacgtgaagcttgatctcgagtatttgaagcagaagatcgacgccggcggcgacttcatcatcactcagatgttttacgatgttgataatttcatcaactggtgttcccaagttagagctgcgggcatggacgtgcccattattcccgggatcatgccgatcactacctacgcggccttcttgagaagggcccaatggggccaaatctccatccctcaacatttctcgtcccgattggatcctatcaaggacgatgacgagttggtccgtgatatcggaactaacttgatcgtggaaatgtgtcaaaaattgctcgacagtggttacgtttctcacttgcacatctacaccatgaacttggaaaaagcgcctctcatgattctggaaagattgaacattctacctacggaatcagagttcaatgcacatccattggccgtgttgccatggagaaaatctttgaatccaaagcgtaaaaacgaggaagtcagacctatcttctggaagagaagaccttactcctatgtcgcaagaacctctcaatgggccgtggacgaattccccaacggtagattcggtgattcgtcttctcctgcgttcggtgacttggatctgtgtggttcagacttgatcaggcaatcagcgaacaaatgtctcgaattatggtccacccctacttccatcaacgacgtcgccttcttggtcatcaactacttgaatggaaacttgaagtgtttaccttggagtgatatccccatcaatgatgaaataaatccaatcaaagcacacttgattgagctgaaccagcattctatcatcactataaactctcaacctcaagtcaacggcattaggtccaatgacaaaattcatggttggggacccaaggatggttacgtttaccagaagcaatatttggaatttatgttgcccaagactaagttgcccaagttgattgacaccttgaaaaacaatgagttcttgacctacttcgccatcgactctcaaggtgacctgctaagtaatcatccagacaactccaagtccaacgctgtgacttggggtattttccccggcagagaaattcttcaacctaccattgtcgagaaaatttcgttcttagcgtggaaggaggagttctatcatatcttgaatgaatggaaactaaacatgaataaatacgataaaccgcatagtgcccaattcattcagtccttgattgacgattactgcttggtcaatattgttgacaatgactacatttctccagatgatcaaatccattccatcctactaagcctataa

SEQ ID NO: 4144 - DNA, 1803 bp, Saccharomyces cerevisiae
atgattaacgataaactagtacattttctgatccagaattatgatgacatcctaagagcaccgctttctggacagctcaaagatgtgtattcactgtacatcagtggcggatacgatgatgagatgcagaagttgagaaacgataaagacgaggtcttacagtttgaacagttttggaatgatcttcaggatattatatttgcaacgccgcagtccattcaatttgaccagaatctattagtggcagataggccagaaaaaattgtttacctggacgttttttccttgaaaattctctataacaagttccatgccttctactatacattaaaatcgtccagttcttcatgtgaagaaaaagtgtcgagtttaacaacaaaaccggaagctgattcggaaaaagaccaactgctgggtagactgcttggagtcctgaactgggacgttaacgtcagcaaccaggggttaccacgtgaacaactgagcaatcgcttacaaaatttattgagggaaaaaccatcatcttttcagcttgctaaagaaagagccaaatacacgaccgaggtcattgaatacatcccgatatgtagtgactattcgcatgcatctctattgtccacctcggtgtacattgtcaataacaaaatcgtttctttacaatggtccaaaatatccgcatgtcaggaaaatcacccaggattaattgagtgcattcaatcaaaaattcactttatccctaatatcaaaccacaaactgatatttcgttaggagattgttcctatttggatacctgtcataaattaaatacgtgtcgatacattcattacctgcaatatattccgtcatgcttgcaagagcgagctgatcgtgaaactgcgagtgaaaataaaagaatacggtcaaacgtttccattccattttatactctgggcaattgctccgcacattgtatcaaaaaggctttacctgcacagtggatccgttgcgatgtgcggaaatttgattttagggttcttggaaagttttcggtagttattgcagatcctgcatggaatatccatatgaacctaccatacggtacttgcaacgatattgaactattaggtttgcctttgcacgaactacaagatgaaggtattatttttctttgggtgacgggtagagctatagaattgggtaaagagtctttgaataactggggttacaacgtgataaatgaagtttcatggataaagacaaaccaactgggtagaacaattgttacaggtcgtacgggtcattggttaaatcattctaaggagcatttattggtgggcttaaagggtaatccaaagtggatcaacaaacatattgacgtcgatttgatcgtatcaatgaccagagagactagtagaaagcctgatgaactgtatggtatagcagaacggttggcaggcacccatgccagaaaactagagatattcggaagggatcacaatacgcggcctggctggtttaccatcggaaaccagttgacaggaaattgcatttacgaaatggatgtcgagaggaagtaccaggagtttatgaagagcaaaactggaaccagccacactggtactaaaaaaatcgacaaaaagcaaccttcaaaattacagcagcagcatcagcagcagtattggaataatatggatatggggagtggtaagtattatgctgaggccaagcagaatcctatgaatcaaaaacatactccctttgaatccaaacagcaacaaaaacaacaattccaaacactaaataacctatattttgctcagtaa

SEQ ID NO: 4145 - DNA, 1803 bp, Saccharomyces cerevisiae
atgttgtgttcagtaattcagagacagacaagagaggtttccaacacaatgtctttagactcatactatcttgggtttgatctttcgacccaacaactgaaatgtctcgccattaaccaggacctaaaaattgtccattcagaaacagtggaatttgaaaaggatcttccgcattatcacacaaagaagggtgtctatatacacggcgacactatcgaatgtcccgtagccatgtggttagaggctctagatctggttctctcgaaatatcgcgaggctaaatttccattgaacaaagttatggccgtctcagggtcctgccagcagcacgggtctgtctactggtcctcccaagccgaatctctgttagagcaattgaataagaaaccggaaaaagatttattgcactacgtgagctctgtagcatttgcaaggcaaaccgcccccaattggcaagaccacagtactgcaaagcaatgtcaagagtttgaagagtgcataggtgggcctgaaaaaatggctcaattaacagggtccagagcccattttagatttactggtcctcaaattctgaaaattgcacaattagaaccagaagcttacgaaaaaacaaagaccatttctttagtgtctaattttttgacttctatcttagtgggccatcttgttgaattagaggaggcagatgcctgtggtatgaacctttatgatatacgtgaaagaaaattcagtgatgagctactacatctaattgatagttcttctaaggataaaactatcagacaaaaattaatgagagcacccatgaaaaatttgatagcgggtaccatctgtaaatattttattgagaagtacggtttcaatacaaactgcaaggtctctcccatgactggggataatttagccactatatgttctttacccctgcggaagaatgacgttctcgtttccctaggaacaagtactacagttcttctggtcaccgataagtatcacccctctccgaactatcatcttttcattcatccaactctgccaaaccattatatgggtatgatttgttattgtaatggttctttggcaagggagaggataagagacgagttaaacaaagaacgggaaaataattatgagaagactaacgattggactctttttaatcaagctgtgctagatgactcagaaagtagtgaaaatgaattaggtgtatattttcctctgggggagatcgttcctagcgtaaaagccataaacaaaagggttatcttcaatccaaaaacgggtatgattgaaagagaggtggccaagttcaaagacaagaggcacgatgccaaaaatattgtagaatcacaggctttaagttgcagggtaagaatatctcccctgctttcggattcaaacgcaagctcacaacagagactgaacgaagatacaatcgtgaagtttgattacgatgaatctccgctgcgggactacctaaataaaaggccagaaaggactttttttgtaggtggggcttctaaaaacgatgctattgtgaagaagtttgctcaagtcattggtgctacaaagggtaattttaggctagaaacaccaaactcatgtgcccttggtggttgttataaggccatgtggtcattgttatatgactctaataaaattgcagttccttttgataaatttctgaatgacaattttccatggcatgtaatggaaagcatatccgatgtggataatgaaaattgggatcgctataattccaagattgtccccttaagcgaactggaaaagactctcatctaa

SEQ ID NO: 4146 - DNA, 1806 bp, Saccharomyces cerevisiae
atgctcaaccatcccagccaaggctcagatgatgctcaggacgaaaagcaaggcgacttcccggtcatcgaagaggagaagacccaggctgtaacgctgaaggattcgtatgttagcgacgacgtcgccaactccacggaacgctacaacttgtccccttctccggaggacgaagacttcgaaggccccactgaagaagaaatgcagactttaaggcacgttggtggtaaaattcctatgaggtgttggttaattgctattgtagagctttccgagagattctcctactacgggctttccgcaccattccaaaactacatggaatatggacctaatgactccccaaagggtgttctgagcttgaacagtcagggtgccactgggttgtcgtattttttccagttttggtgttacgttacaccagttttcggtggttacgttgcggacaccttctggggtaaatataatacaatttgttgcggtaccgctatttacattgccggtattttcattctatttatcacttcgattccctccgttggtaacagagacagtgctattggtgggttcattgctgccattattctgatcggtattgccactggtatgattaaagctaacctttccgtgttgattgccgaccagcttcctaagcggaaaccctccatcaaagttttaaaatcgggcgaaagagtcattgtcgattcaaatattactttacaaaacgtttttatgttcttctatttcatgatcaatgtcggttctctatcattaatggccactactgaattggaatatcataaggggttctgggcggcctatctattgcccttctgcttcttttggatcgctgttgtcactttgatttttggtaaaaagcaatacattcaaagaccaatcggagataaagtcatcgctaaaagttttaaagtttgttggattttaactaagaataagttcgacttcaacgctgctaaaccttctgttcatccagaaaagaactatccatggaatgacaaatttgttgatgaaattaagagagctttggcggcttgtaaagtctttatattctacccaatttattggacccaatacggtaccatgatttccagtttcatcactcaggccagtatgatggaattacatggaattcccaacgatttcttacaagcattcgattccattgcgttgatcattttcatcccaatttttgaaaaattcgtatatcctttcattagaagatacactccactaaaaccaattacaaaaattttcttcggtttcatgtttggatcttttgccatgacatgggctgctgttctacaaagtttcgtttacaaggctggtccatggtataatgaacctctgggtcacaacaccccaaatcatgtccacgtttgctggcaaatacccgcatatgtcttgatttctttttcagagatctttgcctctatcactgggttggaatacgcttattccaaagccccagcttccatgaaatcgtttattatgtccattttcttattgactaacgcctttggttctgcaatcggttgtgcattgtccccagtgaccgttgatcctaaatttacatggttattcactggtttggctgttgcctgctttatttctggttgtttgttctggttgtgcttcaggaagtataatgatacagaggaagaaatgaacgctatggactacgaagaagaagacgaatttgatctcaatccaatttccgcacctaaagctaacgatattgaaatattagaaccaatggaaagtctaagatccaccaccaaatattag

SEQ ID NO: 4147 - DNA, 1808 bp, Saccharomyces cerevisiae
atgagctacatagttgacctacaagtgcgaggatcatctctgagggttatcaaatgtatgtttagagaggatgagcaaatttcttctctacattctggttctgactcgaaacaaaacagcaacaaaaagctgggagaatttttgaatctgttaaaagcagtggtcaagaggaagttggaaagtttcccaaaagaccgtttaaagacttcgattataactggccaagaattaatgagagaggggcaaggaagtattgaaattaaggatccaccaacggaggcgcaacaacatttgattagaagcctagcaaaagttttattacaccagttttcaagcataaatggcaaagttaacacagtaaatgaaggacaagataatttgtttctatccttattcgttaaaaaaatttctatagagcaacagtccacatcacacgtctctattaaattgaactttcatgagaaaataaatttgggtcagcacatagattctattttagattcagaggagaccaacgagtcggacacttatcacatgggatctgttgacgagttcattatatatcccttttgctgtctggaagagcaagatgagctgaaaaatggcagcatactgtccacagagttcgacaagattgacttagaactagacgaggatgatggttttgagggagaaactttaaacaattgtatcaattcggtgggaaattttgacattccactaagtaagcaaacactaaacttagtaaatatatcatatcttccaggcacaactttcgagggccaatgggaatcgttgtattttggtaacaatattaaagaaaggttatatagctacgcaactatatctctcaagatagcaagattcaaacaaactggagactccaatcaagaagacattacaacgctaatcacaaataataaattactccttgtccatggtcctccgggaacaggtaaaacaacgttatgcaaagcactttgccaaaaattatctgtgaggcgggaattttcagacggttccgataccattgatactaattataaggggataataatagaattgtcttgtgcacgcatcttttctaaatggtttggagaatcgtcaaaaaatatatcaatagtattcaaagacattgaggagcttttaaaggtcaatgagggacgagggatctttatatgccttttgatagatgaggttgaagcaatagcaagttcaagaacaaatttgtcaagtagaaatgagtcaacagatggaatccgagttgtgaacactttacttacgcaacttgacaggctgaaaaaataccataactttttagcattagccacgtctaatttattagattcattagatgatgcttttgttgatcgagcagatggagttttttatgttggaaatccaacagctgagggcatcctccacattctaaaggtttgcatagaggagatgataacttcaggtataattctttttcacgcaagatcaactggagtcaagttcttcaataaatatcaggacattttgcggaaaattgctatcaaatgctcggtatgtttttttcttttattctacttttacgattctttttctttctttccttcttcataaaaaagcactttcactaactgtctttgtcaaacataaatatgcgatcaatatagaccgttgatatcagtggtagaacaataaggaaattgcccttgatgtgtctgtctgaatacttccggacatttcctgtagacgacgatgagtttgttctggcattagctatgtcagcgcggaagctgagcgcagcgcggaagtga

SEQ ID NO: 4148 - DNA, 1809 bp, Saccharomyces cerevisiae
atgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaaccccccctaaagacgtctctcataacgaccccaagggagatatcgaagcttccattgcagaggaatag

SEQ ID NO: 4149 - DNA, 1809 bp, Saccharomyces cerevisiae
atgaacttgctaattgaccggatggagaatcccggatcgaggaactgtaccctgttacctccttcattcccaagaggcttttgtaagggaagaagggcttccagtggcgacgcagtgaagataaaagaatccggtctacagccgcagccgcagccggaacctctacaagctaaaacaaatgttgcacacttttcgaaatcatcttctagattacctgtcatagcagtgaatgataatccggtggtcccaagaccaagcactgaagtaaacttgggatcgttgttacaaaaggaaagggagaaagaaaaggaggaacagcctgcgctgcatgataggagacatttatatgtgacaaagaatagggcacatggggtacgacaacgttcattggaaatgactagcttacctgtcctgggatcgaccaaaaccgggaagtttagcgattttttgtttgaagatgacatcgataacagagtaggtcgacacagtagatcatatagtggggcatccagtttggatgatccattcagagtgtcgccgaaaaccgacttcaactctaatagggccagattgtcttgccttagtaaaggacgtcgtggttcgatgtccgttttccaaagctgtcatactgggctagctttcaatcaaatacagggttcctcctcttcgcaacgtagatcatccgctggttcttttgattatgagaggaaacgattggttaaccaatttttacagccttctttgggaaattcagacccatttgatacgttgagggagtcggtagtgtttgagccctcatccaccgctggcggcattaaattagggaatatgcattctcaatcacaaatttccgtaaactcctcccccagcacatctttgttttatcatgatttggacggttctgctgtcaacgattcttcgtcatttctgtattcccgttctaatgtaccagcatttttgtcgtcatcagccttttcgtccacgtcatccacctcatcagattcagaagatgtggatagaagaagtttaaacggtgtatatccctctttaggatatttgactaaccagaggaaaccaaggaattcatcaggctcttccactgcacctggcaccgataccttgggatttaagtatttactgaataggcagaagtcagcggattcttccactaggttcaagagtgtactgaaggtgaacaataataatggctccgcagccactcctgattctagctcaaactctatttcgaagagcaactcaaatttgaatgataacattgatgaattgaattattatcaaaatcatatttcgacacttctagtgaagatcgagaatgagatgagaagaaatttaaacgatacaataatcaagaatgaaaacaacgttcaaaaaactatccaaaagtatgatcttctatcaggagagttaacccttttattagacgaaatgaccaccttgcgaaccacggtgattaatcaattcttggtcaagttgaaatcagactttgacgaggatgacaataaggcgtttattaatgaattaaagatatcagtcgaagaaagtgtagcgcaattacaaggattggaaaggagaatggaggtttgccaagagagattaaataaacaaaagtcctctctaagggaaatggatagtttgatagagctgaaaaacgtgttaaataaatcgaagaacaacacgaaatccatctacctgtataggtatttcatcattgacattattgcatttcttttgatgggcggctttatcgtttacgtcaagaatttgttaactcgtttttttactcgttaa

SEQ ID NO: 4150 - DNA, 1809 bp, Saccharomyces cerevisiae
atgagtaatacttcttcgtacgagaagaataatccagataatctgaaacacaatggtattaccatagattctgagtttctaactcaggagccaataaccattccctcaaatggctccgctgtttctattgacgaaacaggttcagggtccaaatggcaagactttaaagattctttcaaaagggtaaaacctattgaagttgatcctaatctttcagaagctgaaaaagtggctatcatcactgcccaaactccattgaagcaccacttgaagaatagacatttgcaaatgattgccatcggtggtgccatcggtactggtctgctggttgggtcaggtactgcactaagaacaggtggtcccgcttcgctactgattggatgggggtctacaggtaccatgatttacgctatggttatggctctgggtgagttggctgttatcttccctatttcgggtgggttcaccacgtacgctaccagatttattgatgagtcctttggttacgctaataatttcaattatatgttacaatggttggttgtgctaccattggaaattgtctctgcatctattactgtaaatttctggggtacagatccaaagtatagagatgggtttgttgcgttgttttggcttgcaattgttatcatcaatatgtttggtgtcaaaggttatggtgaagcagaattcgtcttttcatttatcaaggtcatcactgttgttgggttcatcatcttaggtatcattctaaactgtggtggtggtccaacaggtggttacattgggggcaagtactggcatgatcctggtgcctttgctggtgacactccaggtgctaaattcaaaggtgtttgttctgtcttcgtcaccgctgccttttcttttgccggttcagaattggttggtcttgctgccagtgaatccgtagagcctagaaagtccgttcctaaggctgctaaacaagttttctggagaatcaccctattttatattctgtcgctattaatgattggtcttttagtcccatacaacgataaaagtttgattggtgcctcctctgtggatgctgctgcttcacccttcgtcattgccattaagactcacggtatcaagggtttgccaagtgttgtcaacgtcgttatcttgattgccgtgttatctgtcggtaactctgccatttatgcatgttccagaacaatggttgccctagctgaacagagatttctgccagaaatcttttcctacgttgaccgtaagggtagaccattggtgggaattgctgtcacatctgcattcggtcttattgcgtttgttgccgcctccaaaaaggaaggtgaagttttcaactggttactagccttgtctgggttgtcatctctattcacatggggtggtatctgtatttgtcacattcgtttcagaaaggcattggccgcccaaggaagaggcttggatgaattgtctttcaagtctcctaccggtgtttggggttcctactgggggttatttatggttattattatgttcattgcccaattctacgttgctgtattccccgtgggagattctccaagtgcggaaggtttcttcgaagcttatctatccttcccacttgttatggttatgtacatcggacacaagatctataagaggaattggaagcttttcatcccagcagaaaagatggacattgatacgggtagaagagaagtcgatttagatttgttgaaacaagaaattgcagaagaaaaggcaattatggccacaaagccaagatggtatagaatctggaatttctggtgttaa

SEQ ID NO: 4151 - DNA, 1809 bp, Saccharomyces cerevisiae
atgatactaaagcttgtacactgtttagttgctcttacaggattaatctttgcaaagccgtatcaacaacaacaggcagttttagcgccgtcgcaggatgtaccattaagagatatccatataggggatataaattttatccatacaaccgatactcatggctggttggggtcccatctatcacaaaacgactatgatgctgactggggagatttcgttgcatttgtagatatacttagagaaaaaattttacgacagtccagagacgtaatagtcatcgacactggcgacaaacgagacggtaatggtttgagtgatgctacttggccccccggcctacgaagctcggagatattcaacatgatggattacgatcttttaacgttaggtaatcatgagctatatacagctgaaagtgccatactagagtatagaggaacttctcagtcctcaaaattcaaagacaaatatgtttgcagcaacgtagaatttattgaagatgacggaacaagggttcctttcgggaataaatacattacattcgagactcccataatgaaacaaagagtcctggcattatcatttttgtttagttttcaaagagcaaataacagagccatcgtaacaccaccattggaagaaataactcaaaaaagctggttccaaaatatggttgagacaaacagagaggaggaaatcgacctaattattgtctttggtcatttgcctgccactgaccctacagagcgtgaaatgcacaaaattcatgctctaataaggaaatactacccaaatactgttatacaatattttggagggcacactcatatcagggattttgtacagctggactcaaaatctacttgtttacaaagtggtagatttgcggaaactgtgggattcttgtcaattaatatgactgaccctgtggacgccgaaagtcctattttctcaagaaggtatattgactttaacaaggaagctttcaaataccatttgagcaaactagggcatgactcgaatgttccagtctcaacgaaaaagggtaaaactatttctcgtttggtgaatgatctgcgccatgaactaaatttgaacgagaaactggggtacattcctcaaacttactacgtttcaacaaggccattaaactccgaagagaatctttatcatttgatcacgcataagattttacccaatttaattcctcccaaaaactatgaaccttcgatgagtcgtttcattttgattaacactggctctgtcaggtacgatctttacaaaggcccatttacaaaggatactgagtatatagtgatgccattcaataatgattggcgcttcatcacagttccattggtcgttgcctccagggtggaaacctatttgaacaagggccctgtcattgcctcattaggaataccatcatcgtctcatcacaaacagcattttggcggttttcagaagtgtcccttcatcaataatccaaatttaagcgaaggctacaccacagaagacgatttcgggtgtcatggtgatgacacacctcacaattcacaaagagaatacgatatccccaatgtagtgcaatgtaaagaggtgaagaaagtgcaagaagaggaagctgatccgtcgaagatggttcatgttatcttctattcctttatggaactcgatatattaaacgccgtaaattctatcataaatgatttaggattacgtatggagaacttgaccaccaatgactgctcccattatggtggtgattcaaccaaaaagttattacgggattacttttctcaattttag

SEQ ID NO: 4152 - DNA, 1809 bp, Saccharomyces cerevisiae
atgcctgagcaagaaccattgagtcccaatggccgtaagcgctctgaggttcactatatctcaatcccattgaacagaggttccgcattctcaccagatgattctgtatcacagtttcagtctgacgggttcatgacacgtaggcaatccatattggaccatcctgtgggctcatttaagggagttaattctttaagtcgatttgcgacttcgttgaggagagccaattcgtttcgtaatatcgagctaaatgcggataatgaaagatcctttttcaaagagagtaacgatgaaacctacgatccggatactttagcaccagctttggacggtagaagattatcagtaactttaaataatgctggtcgcccgcgcattactaatttggctaacaacgatagagttagtacagccagcatggctattcacgatgatgattatgggtccatccaaaattcaacaattggggattctgggtcaatattacgccctactgcctccttaacagaaatgatgagtggtggagcggggagaaggtttacaaataatgacatggattcaattgtagtgaagagagtggagggtgtagatggtaaggtagtaactcttcttgctggtcagtcgaccgctccacagaccatattcaactcaatcaatgtactgattggtattgggctcctggcgttacctcttggtttgaaatacgccggctgggttataggacttactatgcttgcaatcttcgccttagcgacattttgtactgctgaacttttgtctaggtgcctagatacagatccaactttgatatcttacgcggacttgggatatgcagcatttggtacaaaagggcgcgcactaatttctgctcttttcacacttgacctactgggtagtggggtgtccttggtgattctcttcggagattctttaaatgctctatttcctcaatactccaccacttttttcaaaatagtttcattttttatcgttacacccccggtttttataccattgagtgttctatctaatatctcgcttctgggaatcctttcaacaaccggaactgtgctagtcatttgctgctgcggactatacaagtcgtcttctccaggttcattagttaatccgatggaaacgagcatgtggccgatagatctaaagcatctctgtttatctataggtttattgagtgcctgctggggaggacatgcggtttttcccaacttaaagacagatatgaggcatccagataaatttaaagactgtttgaaaactacctataagataacatcggttacggacataggtactgcagttattggctttttgatgtttggaaatcttgttaaagatgaaattactaagaacgttttgctgacggagggatatccaaaattcgtttatggtctgatttcagcgcttatgactatcattcctatcgcaaagaccccattgaacgcaagacctatcgtttctgtattggacgttctgatgaatgtgcaacacatagatgaagcggccagcgccataaaaagaagagctgcgaaaggccttcaagtattcaataggatctttattaatgttgtcttcgttttgatagctattaatttccctgaatttgataagattatcgcatttctgggggccggtttgtgttttacaatttgcctaattttgccgtgttggttctatttaagattgtgcaagacaacaatcaaaccatgggagagagtggcttgtcacgtaaccatatgtattagtgtcgtgttgtccacattaggtgttggtgctgcaattatttcataa

SEQ ID NO: 4153 - DNA, 1809 bp, Saccharomyces cerevisiae
atgcgctcagtcactaatgcatttggcaatagtggagaacttaacgatcaagtggatgaaacaggttataggaagtttgatatccatgaaggaattttgttttgcattgaactatcagagacaatgtttaaagagtcctctgatctagagtataaatcaccattgttggaaattctggaatcactagatgagctaatgtcacaattggtcataacaagacctgggacagctattggttgctatttttattactgtaacagagaggatgccaaggaaggtatctatgaactttttccattaagggatataaatgctacatttatgaagaaattgaacgatcttttagaagatttatcatcggggagaataagcctatacgactattttatgtttcaacaaactgggagtgaaaagcaagtgcgcttatctgtattattcacattcatgcttgacacttttttggaagagattccgggtcaaaagcaattaagcaacaagagagtgttcttattcactgacattgataaaccacaagaggcgcaagatatcgatgaacgggcaagattgagaaggcttacaattgatttatttgataacaaagtgaattttgcaactttttttattggctatgccgataaaccatttgacaacgagttttattcggacatactgcagttgggttcacatacaaatgagaatactggtttggattctgaatttgatggtccaagtacaaagcctatagatgctaaatacatcaagtccagaatcctaaggaaaaaggaggtaaagaggataatgtttcaatgtccattaatcttggatgagaaaacaaattttatagtcggagtcaagggttacactatgtatacccatgaaaaagctggagtcaggtataaacttgtttatgagcatgaagatatcagacaagaagcatattcaaaaagaaaatttttaaatcctataacaggagaagacgttactggtaaaactgtcaaggtttatccttatggtgacctcgatatcaatctatcagatagtcaagatcagatagtaatggaggcttatactcaaaaagatgcgtttttgaagattattgggttccgttcatcgagcaaatcgatacactatttcaataacatagacaaaagttcgtttatcgtaccagatgaagcaaaatatgaaggttcgataagaaccttggcttctttattaaaaattttgagaaaaaaagataaaattgcaatattatgggggaagcttaaatcaaattcacatccttcactatatacgttatcaccctcaagcgtgaaggactacaacgaaggattttatctctacagggttccattcctagacgaaattcgaaaatttcctagtttactatcctatgatgatggctctgaacataaactagattatgataacatgaaaaaagtaactcaaagtataatgggatactttaacttgagggatggatataacccatccgatttcaaaaacccactattacaaaaacattacaaagttttacatgattacctgttgcaaattgaaaccacttttgacgaaaatgagacacctaatactaaaaaagacagaatgatgcgtgaggacgattctttaaggaaactatattatatacgaaataaaattttagaatctgagaagtcagaagatccaatcatccaaaggctaaataaatatgttaaaatctggaatatgttctacaaaaaatttaacgatgataacatttcgataaaagaagaaaagaagccctttgataaaaagccgaaattcaatatataa

SEQ ID NO: 4154 - DNA, 1809 bp, Saccharomyces cerevisiae
atggacgaggttgacgatattctaattaacaaccaggtggtggatgacgaggaggatgacgaagagatgctgagtgggctggaaaacgactcaaagcaggacctcgaggggaatgatgacggtggtgaagatgaagaggatgacgatgatgatgatgaggacgatgatgatgacgaggacgaacgagaggacgacgatgaacaggaggacgacgatggtgaggacgacgccgcaagaatggataagactgctacaccgacgaatgagcaccagcatgatgagcaaaaggctgctgctgctggtgctggcggtgcaggcgatagtggcgatgctgttactaagattggatccgaggatgtgaaattgagcgatgttgatggaggagtggggtccagggaagcatcttcctctacacacgaagcctctgctaatggagaggtttatgagtactataagcacatgttgaatgccgcacagattgcggattcgtacaatatctaccccacggcagccatacccatccagacgcacgtcaatgcgttggccgtgtccaggggtctcaagtacctgtttttgggcggtagcgatggatacataaggaagtacgacttgctgaacacgcttgaggggaaactttctctaactatcctgcagaagcattcgttggctgagtctattcagaacgcgggtatcttgcagtcgtactgggaaaatgagatcccgcagaaaaaatcagaaatgaaactctccgctaataagacagattacgagcccaaagttagccccgttcattctttggaagtccaaagcgaatgcctctttatactgagcgggctacagaatggtgggattaccatgcagggcgttcgctacatggaggggagcattgcgcactattttaagggcaggaatggacatacccaaatcgttaacatactgagattaaacggtcaagaggacaggtttttgagtggttcctgggataagcgtcttttggaatgggatttgcagacgggtgacatagttaatgagtttaaaaaatcaaggtctgaattgtcatctttggaaatgcggccgctgtactcgtccgtggatgtgtccggtaacgtcaacagtggtaaagagaatgaaaatgcagatgacgatatggattctctgtttggtgatgaagacgaagacgaaaagcaagatgctggcaacgaacccgtcgagacgggggatggttctaatggtgaagagaacaaagaacagatatctgaagaatctttgaacatagtctatgatgaatccgtttttatgacctcagggttgaacggttccgtgcatatttgggaccgacgcatgacgcagtcgccagcattgtctctggagagaggtgcaggcgtcccaccgtggtgtttgtccgcatgttggggtgtagatggtgatcatgtgtatgcagggagaaggaatgcctgtgtggagcagtttgacttgaagatgccctcgaaacctatccataatttgaaactgccttctatttcagggcctgtctcttgtgttaaagccatgcctaataacaagcatttactatgtgcatcgcgggataatatcagattgtacaacgttgaaattgcagtagatgcttcgaattcgactacaaagagttctaaagtgccgttcctcatcgtgccgggccatcacggtggtattatatcaaacttatacctcgaccccacttcaagatttataataagcacaagtggcaacagaggctggcaggggaattctacggacacgacccttatttacgatatagacttagaatag

SEQ ID NO: 4155 - DNA, 1812 bp, Saccharomyces cerevisiae
atgactggtatgaatgataataatgccgctattcctcagcaaactccaaggaaacatgcgctatcttctaaagttatgcaactttttagaagcggttcaagatcatctaggcagggaaaggcctcatcgaatatccagccaccttctaatataaacacaaacgttccatcggcgtctaaatcagccaaatttggtttacataccccaaccactgctactcctagggtagtttctaatccttctaatactgcaggtgtgagtaaaccgggcatgtatatgcccgaatattaccagtcggcatcaccatcgcactctagttcatccgcatcattaaacaaccatattgatattaacacctctaagtcatcatcagctgcttctttaacttcgtcagtatcagctttatccttatcacccacatcagccataaatattagctccaaaagtttgagcccaaagttctctcatcatagtaacagcaatactgctattacacccgcgcctactcccactgcttcaaatattaataatgtaaataagataaccaatacaagtgcacctatttgtgggaggtttcttgtgcataaagatggtacccatgaacatcacttaaaaaatgctaagagacaagaaaagctaagcacaatgattaaaaacatggttggtgcgagcaaattacgtggtgaggcaaaatctgctgtccctgatataataatggatccaaagacgactttaaaatccaacaagaatcctcctactctttttgcaggcttcatgaagcaggtcgtggatatggatgataaatatccagaaggcgctcccacaagtggcgctttaaattgtcctgaaagggatatatacaggtcagatcaaaaagattccaaaaataatacgcataatatcactactactaaaaaagataggcaatgttttgccgaaaagtatggtcgctgtcaagaagtccttggtaaaggtgcttttggtgtagtaagaatatgtcaaaagaaaaatgtttcttctcaagatggtaataaaagtgaaaagctttatgcagtgaaagagttcaagcgtagaacatccgaatcagcagaaaagtattctaagaggttgacttctgaattttgcatttcttcttcattacaccatacaaatattgttactacactagatcttttccaagatgccaaaggcgagtactgtgaagtaatggaatattgtgcaggtggcgatctattcactttggtcgttgccgccggaaaattagaatatatggaagcagattgtttcttcaagcagcttattagaggtgttgtttatatgcatgaaatgggtgtttgtcatagagatttgaagcctgagaacttactgcttacgcacgatggtgtgctaaaaattacagactttggtaacagcgaatgtttcaagatggcatgggaaaaaaatattcaccttagtggaggcgtttgcggttcatcgccgtacatcgccccagaggaatatatcaaagaagagtttgatccaagacccgtagatatatgggcatgtggtgtcatttatatggcaatgagaactggtagacaattgtggagttctgctgaaaaagacgatccattttatatgaattatttaaaaggacgtaaggaaaagggaggctatgagccaatcgaaagtttaaaaagagccaggtgtaggaatgttatatattcgatgttagatcccgttccgtacagaagaattaacgggaaacaaattttgaacagtgaatggggaagggagataaaatgctgccataatgggcgcgcattgaaataa

SEQ ID NO: 4156 - DNA, 1812 bp, Saccharomyces cerevisiae
atgatacaatcagacgaagataatttggactcttctgaaacgacagcatcaacttcatatagtggtacttcctctgtatcatccagactacaactaagaacatccttgttttttgaaaatcttaatggagcacatgggaaccccgatgcggagacagagatggctactgttgcctatgaaaccacaagtagaggtcaaggatttgctgtatacatcaacaatgaaaggttttctcaaataatgggagcatccacaagctctagctctagtagcaactcgtcctctattacacaatttcacgatacccaagataataatataccaagcaacactactgtaaggccaacttcacttcgacgagacaacgaggataccgtaccgttaaggaacgtaactccttcacaaaacgcggcggtacggccagaaagagcagtgaattcaccatcttcgcagagattaagttgcgcactgacaatatcaacttcagttcttatgggagaagatgttgaaggaagccctatagagcaagagcatagtagggtcgtatcttcattatactcatctttggcgaatcgcgggaacgacgagtcaaagaatggaacacctccacgtcctacctcaattgaacctaatgaaacaacggaacactcatttttctcataccattacgatgacaccttagaaccagatgttgaagaggcagtgaggctaacgaagaataaaacttctaatgttaattttataagctcaactggcagtaaaggtgaaggcgagaccgaggatgaagtcatagatcaatacgaacctgtgaatgaatcaaaatttataccgcacaaactaaaaattccagagaaggctggatcaataaagtcgtcgacaagtgatgattcgcattcgccaggtgcgccaggtacgtcggcaaggaagattaaaattcctcagagtccatcgttaattggtaacatattgattccttcacacaatagtgacagtagtaacgaaagttctcctaaagaccatatagggcataataatgaagaaaaattcagttcaaaatctacgcgcaagccctccacatccctagaagaagaaggtccaccaattggactaccttcaattcccgtattaagaagtgtgtccggaccaagcaaatggacgaagacacctttacgcttagaatctggaaattcaactaagtctgatccattttcacgctatgaaggacacaagacgccctctccattgaccaagatgaacaagaagaaaaataaaacgttgccagaacatggacaacccctcgtgctagctccaattaaatctcaaagctcggagtcagacacgggacagaactccattatagaaaagccagctcgaagcatacgacgaaagcaacaagaaaaaactgataataggaaagaagacaggcacgatgctgaaaatatagacctggaggcgagaatgccaattcaacatatcgataccgcttccattcattcgtttgattcaggtcaaaatggattcagggacgtttacagcatcgaaaacatcattgtgatcctcctatgttgtagtatagtgccgccattattttttattattggctgcagctcaagaaggaaattagtttcagactatagattaatgaggttgcttatgaataaagaacaccgagcggctttgctgcaaggattcatatgggacgttgatttaaggtggttccggatgttttgtctgatcttaggggctgccgaaacagtgattgtgatggccggtattgctattggatttggtgtgggtataacacgtgaataa

SEQ ID NO: 4157 - DNA, 1812 bp, Saccharomyces cerevisiae
atgcctagaaacccattgaaaaaggaatattgggcagatgtagttgacggattcaagccggctacttctccagccttcgagaatgaaaaagaatctactacatttgttaccgaactaacttccaaaaccgattctgcatttccattaagtagcaaggattcacctggcataaaccaaaccacaaacgatattacctcttcagatcgcttccgtcgtaatgaagacacagagcaggaagacatcaacaacaccaacctgagtaaagatctatccgtgagacatcttttaactctagctgtcgggggtgcaataggtactggtttatatgtgaatacgggtgctgctttatctacaggtggtccggccagtttagttattgattgggttattatcagtacatgtctttttactgtgattaactctcttggtgagctgtccgctgcttttcccgttgttggtgggttcaatgtttacagtatgcgttttattgagccttcatttgcattcgcagtgaacttaaactatttagcacaatggctagttcttctacccttggaattagtggccgcatctattactataaaatactggaatgataaaattaattccgacgcctgggttgctatcttttatgccaccattgcactggctaatatgttggatgttaagtcatttggtgagaccgaatttgtattgtccatgattaaaatcctctccatcattggctttactatcttaggtattgttttgtcctgtggtggtgggcctcacggcggttacattggtggtaaatactggcatgacccaggcgcttttgtagggcacagctcgggaactcagtttaaaggtttatgttcagtttttgttaccgctgccttttcttattccggtattgaaatgactgctgtctccgctgctgaaagtaaaaatccaagagaaaccattcccaaggcagcaaagagaactttttggctgattaccgcctcttatgtgactatattgactttgattggttgcttggttccatccaatgaccctaggttactaaacggttcaagttcagtggacgctgcctcatctcctctggttatcgcaattgaaaacgggggtattaaaggtctaccatcattaatgaacgccattattttgattgctgttgtttccgtggctaacagtgctgtttatgcatgttcaaggtgtatggtcgccatggctcatattggtaatttaccaaaatttttgaaccgtgttgacaaaaggggtagaccaatgaatgctatcttgttaactttgttttttggtttgctttcctttgtggcagcaagtgataagcaagctgaagtctttacatggttgagtgccttatctggtttatcgacaattttctgctggatggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttga

SEQ ID NO: 4158 - DNA, 1812 bp, Saccharomyces cerevisiae
atgttaagtcctgaacgtagaccatccatggcagaacgccgcccatcatttttcagttttactcaaaatccaagtcctctagttgtcccgcatttagccggtattgaagaccctttgccagccactacaccagataaagttgatgttttaatcgcagggactggtatggtagagagtgtattggctgctgcattagcttggcaaggttccaatgtccttcatattgataagaatgattattacggtgacacttcagccacactaactgtagaccaaatcaaaagatgggtaaatgaagttaatgaaggctcagtaagttgctataaaaatgcgaagttgtatgtatccacgctaatcggtagtggtaaatattcttcaagagatttcggtattgatctttccccgaagatcctatttgcaaaatctgatttattatccatcttaatcaaatcaagagttcaccagtatttagaattccaatctttatctaatttccatacttatgaaaatgattgtttcgaaaaactaacaaatacaaagcaagaaatattcacggatcaaaacctaccactaatgacaaagaggaacttaatgaaatttatcaaattcgtactcaactgggaagcacaaacggaaatatggcaaccctacgcggagaggaccatgtctgattttttaggggaaaagtttaaattagaaaaaccacaagtcttcgaattaatcttctcaattgggttatgttatgatctcaacgtaaaagtaccagaagctttacaaaggattcgtcgatatctaactagtttcgatgtttatggaccattccctgcactatgctccaagtatggtgggccaggagaattgtcgcaagggttttgtagatctgccgctgtaggtggcgctacttacaaactcaatgagaaattggtatccttcaaccctacaactaaagtggccacattccaagatggatccaaagttgaagtttcagagaaagtgataatatcgcctacgcaagcacctaaagacagtaagcatgtccctcaacaacagtaccaggttcatcgtttgacctgtatagttgaaaacccctgtactgaatggttcaatgagggtgaatcggccgccatggtagtcttccctcctggctctttgaaatctggtaataaggaagtagtacaagcctttattctcggtgctggcagcgaaatttgtccagaaggaactattgtatggtatttatcgaccacagaacaaggcccacgtgctgaaatggacattgatgccgctctagaagctatggaaatggccctgctaagggaatcgtcttcaggtttagagaacgacgaagaaattgttcaactaacgggaaatggtcatacaatagtaaattcagttaagttaggccaatcttttaaggagtatgttcctagggaaagattacagttcttatttaaactttattatacccaatacacatccacgccaccctttggtgtagttaactcctccttctttgatgtaaatcaagatttggaaaaaaagtatattcccggtgcgagtgataatggcgtcatatatacaaccatgccttctgctgagatatcgtatgatgaagtagtcaccgcagccaaagttttatacgaaaagatagttggcagtgatgatgacttcttcgatttagattttgaagatgaggatgaaatacaggctagcggcgttgctaatgcggaacaatttgaaaatgccatagacgatgacgacgatgtcaatatggaaggttccggtgaatttgtaggtgaaatggagatatga

SEQ ID NO: 4159 - DNA, 1815 bp, Saccharomyces cerevisiae
atgagtgccaatagcccgacaggaaacgatccccatgtatttggtattcctgtgaacgcaacaccatccaatatgggttcgccaggcagtccagttaatgtaccacctcctatgaacccagcggtagcaaatgtaaatcatcctgttatgaggacaaacagtaatagtaatgccaatgaaggtactaggactttaaccagggagcaaatacagcaattgcagcaaagacaacgattattactacagcaaagactactcgaacaacagagaaaacagcaagcactccaaaactatgaggctcagttttatcaaatgcttatgaccttaaacaaaagacctaaaagactttacaattttgtggaagatgcagactcaattttgaaaaaatatgagcaatatttacacagttttgaatttcatatttatgagaataattataagatttgcgctcctgcaaatagcaggttacaacagcagcaaaagcaacccgagctgactagtgacggtttaatattaaccaaaaataacgaaactttgaaagaatttttagagtacgtcgcaagaggaaggattcctgatgctattatggaagtcttaagggactgtaatatccaattttacgaaggaaatcttattttacaggtttatgaccatactaatacagttgatgtcacccccaaagagaacaagcctaatttgaacagctcttcttccccttcaaataataatagcacacaggacaattccaagattcaacaaccatccgaacctaatagtggtgtggcaaatacaggcgcaaacacagcaaataagaaggcatccttcaaacgacctagagtatatcgaacattgttgaagcctaatgatttgacgacgtattatgacatgatgtcttatgcagataatgccaggttttctgatagcatttatcaacagtttgaatctgaaattttaacacttaccaagaggaacttgtcactaagtgtgccattaaatccatatgagcaccgagacatgttggaggaaacagctttttcagaacctcattgggatagtgaaaaaaaatccttcattcacgaacatcgtgctgagtctacgagagaaggcacgaagggcgttgtagggcatatcgaagaacgcgatgaatttccgcaacatagttcaaattatgaacagttgatgttgatcatgaatgaacgcacaacaacgataaccaactccacgtttgctgtttcgttaaccaagaatgcgatggagattgctagctccagttccaacggggtacgtggagcttcgtcctcaacttcgaattccgcatcaaatacaaggaataacagtttggctaatggcaatcaagtagctttggcagcggcagcggctgcggctgcagtgggatctaccatgggtaacgataataatcaatttagcaggctgaaatttattgaacaatggagaataaataaagaaaaaagaaaacagcaggctttaagtgcaaacatcaatccaacccccttcaacgctagaatatcgatgacagcaccattgactccacagcaacagctacttcaaagacaacagcaggccttggagcaacaacagaatggtggagccatgaaaaacgcaaataaacggagtggtaacaatgccaccagtaacaataataataataataataatttagataaaccaaaggttaagcgacctagaaaaaatgcaaaaaaaagcgagagcggtacaccagctcctaaaaagaaaagaatgactaagaagaaacagagcgcaagtagcacgccctcttctactacaatgtcataa

SEQ ID NO: 4160 - DNA, 1815 bp, Saccharomyces cerevisiae
atgagtggcacagctaatagtaggaggaaggaggttttgcgcgtgcctgtgatagatttgaatagagtttcagatgaagagcagctgttgccggtggtgagggcaattttgctacagcatgacacctttctgttaaaaaattatgctaacaaggctgttctagatgcactactagcggggctcacgacaaaggacctgcctgacacgagtcaaggttttgatgcgaactttacgggtacattaccgctagaagatgatgtttggctggagcagtacatatttgacactgatcctcaattacgcttcgatcggaagtgcaggaatgagtcactgtgctccatatatagtaggctgttcaaactgggtctgtttttcgcccaactgtgtgtgaaaagtgtggtttctagcgcagaattgcaagactgtatcagcacctctcattatgcgactaagctgacccgttatttcaatgataatggtagtacacacgatggtgcagatgcaggtgctaccgtgctgcccactggcgacgatttccagtacctgtttgaaagggactatgttacttttcttccgacgggcgtgttgaccatcttcccctgtgccaaggctataaggtacaagccatcgactatggcgacgacggacaattcttgggtgagtattgatgaacccgattgtcttctgttccacacggggaccctccttgcgcgctggtctcaaggtatgcacactacctcaccactccagatagatcctcgtgcgaacattgtttcgttgaccatctggcctccacttactacgccaatctcgagtaaaggagagggtacgattgccaatcatttgttggagcaacaaattaaggctttcccaaaagtcgctcagcaatactacccacgggagcttagtattctaagactccaagacgcaatgaagtttgttaaggagttgtttactgtttgcgagactgtattgtctttaaacgctctttccagatccacgggcgtcccaccagagctgcacgttttgttaccccagatatccagcatgatgaaaaggaaaatagtgcaggatgatattttgaagttattgaccatttggtctgatgcatacgtagtggaactgaactctagaggggagctgaccatgaatctacccaaaagagacaatctaacaacgttgaccaataagtctaggactttggcattcgtggaaagggcagagtcgtggtaccaacaagtgatagcttccaaggatgagattatgactgatgtacccgctttcaaaataaataaaagaaggtccagctctaattctaaaacagtcttgagcagtaaagtgcaaacgaagagctctaatgctaatgccttgaataactcaagatatttggcgaatagtaaggaaaatttcatgtacaaagagaagatgcctgattcgcaagcaaaccttatggacagactgcgtgaaagagagagacgttcggccgcattgctttctcaaaggcaaaaacgttaccagcagtttctagcgatgaaaatgactcaggtatttgatattcttttttcgctgaccaggggccagccttatacagagacatatctaagctcgctaatcgtagatagtttacaagatagtaataatcctatcggtacaaaagaagcaagtgaaattttagctgggctacaaggtatcctaccaatggacatatctgttcatcaagtggatggtgggttaaaagtttatagatggaacagtttggataaaaacagattttctaagctgttgcaaatccacaaatcaaaacaacaagattga

SEQ ID NO: 4161 - DNA, 1815 bp, Saccharomyces cerevisiae
atgcatttccccaaaaaaaagcattccggaaatctctccgtggtggaattgccgaaggaagctctccaagattctttaactgctgctcagattactttcaagagatatgcccaccccaatggcaatgccggtagcgcagagaggccgagacatctaaaggtggaatctgcgcctgtcgtgaaatctgagccttctttgccgaggatgagacaaccggaaccgagaagtataaatcatcaatactctagggaaacgcttccaggccattctgaagccttttccgtaccgacgactcctctgcagacaatccattatgatgtaaggaataaagcgtcaaattcgccaagtagtatagcagctgcagagacagctgcatacctagcccacacaaattcatttagtaacagatcatccggtgtcggcagccgggatccagttatggatactgaaacaaaaccgccacgtgctccttcagccttgaaaaatgagctgcaattgaacagaatgaggatacctccgccgtcatatgataataatgttcgttcacgatctatttcgccacaagtatcctactctacctcgctgtcatcatcgtgttccataagttccgatggagaagaaacttcttatagagaaaaaagcaccgatgaggcatttcctcctgaaccttccatgtcttcttatagtcttgcgtccaaagcctcagcaaaggcttctctaacggacccctcacagcggcagcaagagtcagactatacggcaatgaataaactcaatggaggaaatataatatataaaggcactttacccgacctaataccgcgaagccaaaggaagacaagtaaacccaggttcaagcacaggcttttacgatcacctgagcagcagcaagaaaacttatcacgtgtgtattcggaccaaacgcagaatggtagggcaatcataaacacgcagcaaaatgtaaagttaaagacaactatgaggcgcgggaagtacgcaattacagacaatgatgaaacttttccctacgacagaaagtctgtatcatcagactcagacacagatgaagattctaatgtgatggaaatcaaggacaagaagaagaaaagtcgtcgctctaagataaagaaggggttgaaaacaacagcagctgtagttgggagtagtacctctgtccttccgttccctcatcaccatcatcatcaccatcagctccataacccgaattctcatcacttacacacgcaccatcatacaagttctcacaaattcaatgaagataaaccgtggaaatctcatagagatctcgggtttattaccgaacaagaaagaaaaagatacgagtctatgtgggtatcaaacagatactcgtatttgcgcttgctgccgtggtggccctctctcgcgaatgaagacgacgagtctcacttacagcccttaaatttaccgcaagacggcctgatgcttaacttagtcgtaaaagatatatggtatcgatcaaacctacccagggatcttctagtgcaaatatacaatatggtcgacacaagaaaagacggtaccttagacagaaaatcgtttatagtgggcatgtggctggttgatcaatgtctctatggccgaaagctaacgaatgagctggaccagagagtttggaatagcgttgacggctatgttctcggtacaattaacgtgaagcctgccacttccgatcactatcacaacgctaataaccctctagataagccatcaaagctttcagtccgacaggaattgaaaaacatcaaacgcgatctcagaaatgtcagaatatga

SEQ ID NO: 4162 - DNA, 1815 bp, Saccharomyces cerevisiae
atggctgaactgagcgaacaagtgcaaaatttaagcatcaacgacaacaacgagaatggttatgttcctcctcacttaagaggaaaaccaagaagtgccagaaataacagtagcaactacaataacaacaacggcggctacaacggtggccgtggcggtggcagcttctttagcaacaaccgtcgtggtggttacggcaacggtggtttcttcggtggaaacaacggtggcagcagatctaacggccgttctggtggtagatggatcgatggcaaacatgtcccagctccaagaaacgaaaaggccgagatcgccatatttggtgtccccgaggatccaaatttccaatcttctggtattaacttcgataactacgatgatattccagtggacgcctctggtaaggatgttcctgaaccaatcacagaatttacctcacctccattggacggattgttattggaaaacatcaaattggcccgtttcaccaagccaacacctgtgcaaaaatactccgtccctatcgttgccaacggcagagatttgatggcctgtgcgcagaccggttctggtaagactggtgggtttttattcccagtgttgtccgaatcatttaagactggaccatctcctcaaccagagtctcaaggctccttttaccaaagaaaggcctacccaactgctgtcattatggctccaactagagagttggccacccaaattttcgatgaagccaagaaatttacttatagatcctgggtcaaggcctgcgtcgtctacggtggttctccaattggtaaccaactaagagaaattgaacgtggttgcgatcttttagtcgctactccaggtcgtttgaatgacttgttggaacgtggtaaaatttctttggccaacgtcaagtatttggttctagatgaagctgatagaatgttggatatgggtttcgaacctcaaattagacatattgtcgaagactgtgatatgactcctgttggtgaaagacaaactctgatgttctcagctacttttcccgctgatatccaacatttggcccgtgatttcttaagtgactacatctttttgtctgttggtagagtcggttctacttcagaaaacattactcaaaaagtcttatacgttgaaaatcaagataagaagtcagccttattggatctattgtctgcatccactgacggtttgactttgatctttgtcgaaactaagagaatggcagatcaattgaccgatttcctgatcatgcaaaactttagagctaccgccattcatggtgaccgtacccaatctgagagagaacgtgccttggccgccttcagatctggtgccgctactttattggttgccacagctgtcgcagctagaggtctagatattccaaacgtcacccacgttatcaactacgatttaccaagtgatgtcgatgattacgtccatagaattggtagaactggtcgtgccggtaacaccggtcttgccactgcctttttcaacagtgaaaacagtaacattgttaaaggtttgcatgaaattttgactgaagctaaccaagaagtcccatcattcttgaaggacgctatgatgagtgctccaggtagcagaagcaacagccgtagaggcggtttcggtcgcaacaacaacagagattaccgtaaggccggaggcgctagcgcaggcggctggggctcttcaagaagcagagataactctttcagaggcggtagtggctggggtagcgattccaagtcttctggctggggtaacagcggtggttcaaacaactcttcttggtggtga

SEQ ID NO: 4163 - DNA, 1815 bp, Saccharomyces cerevisiae
atggtaaaacattcgttcatagcgctagctgagcatgctagtaaactaagaaggtctatcccacccgtcaaactgacttataaaaatatgctacgggacccatcggtaaaatatagggcgtttgctccaccaaaaatggtcaagaggatttggcctgacaaaactattcaaaaggctccacgttggctgtctactgacttgagggacggtaatcaatctttaccggacccaatgtctgtggctcaaaagaaagaatatttccacaagttgatcaacatcggtttcaaagaaatcgaagtgtctttcccctctgcatctcaaacagatttcgacttcaccaggtatgctgtagaaaacgctccagatgatgttggtattcaatgtcttgtccaatctagagaacacttgattaaaagaaccgtggaagcattgactggtgctaaaagggctaccatacatacttacttggccacaagtgacatgttccgagaaattgtcttcaatatgtctagagaggaagctatttctaaagctgtagaagccaccaaactggttaggaaactaaccaaggatgacccttcccagcaagctactcgttggtcctatgagttttctcccgaatgtttcagtgatacgccaggtgaatttgctgtagaaatttgtgaagctgttaaaaaggcttgggaacctaccgaggaaaatccgatcattttcaacttaccagctactgtagaagttgcctctccaaatgtttacgctgatcaaattgagtacttctctacccacattactgagcgtgagaaggtctgtatttctacgcattgtcacaatgaccgtggttgcggtgtcgccgccacagaattaggtatgcttgcaggcgctgatcgtgtagaaggttgtctatttggtaatggtgaacgtacaggtaatgttgatttggttacagttgccatgaatatgtatacccaaggtgtttctcctaatttagatttctcagatttaacttcaatttctgaaattgtccatcgctgtaacaagattccaattcccccaagagccccatatggcggtgaattggttgtttctgccttttctggttctcatcaggatgcaattaagaagggatttgcaatccaaaacaagaaacaggctcaaggagaaactcggtggagaattccatacttaccattggatccaaaggatattggacgtgattacgaagccgtcatcagagtcaactctcaatccggtaagggtggtgctgcttgggttattatgagatctctaggattagatgtaccaagaccaatgcaagttgatttctccaatactctacagaaaaatgcagatgccttaggaagagagttaaaatccgaagagattacaaaattgttcaaagaaacttacaactacaacaacaatgaacatatatacgtcaccttgttgaattacgaagttaagaaattgaacccagagcgtagagctttagtgggccaggtagaaatcaacgataaggttgtcaacatcgaaggctacggaaatggtcctatctcttctttggtggatgcgctatccaatttactgaatgttaagttgagcgttcaaaactactctgaacattccttgggttctggttctgcaacccaagcggcatctttcataaatctttcctacataaaggacatcaataatcatgctactagtaatatgtggggtgttggtgtctccgaagacactggggatgcatctattaaggcggtatttgctactgtcaataatattattcattccggggatgttctactggcagagtaa

SEQ ID NO: 4164 - DNA, 1815 bp, Saccharomyces cerevisiae
atggtagaactggaaaaaagaagacggccccctccgcaactgcaacattctccctatgttagggatcaatcgaattcgcagggaatgacaaagacgccagaaacgtcaccgcctaagaggcccatgggaagagctagatcaaactcgagaagcagtggatcccgttcaaatgtcgatatagatcagtataccataccaccaggcttagatttgttgcctaccgcttcatctccaccttccgtccatcaagtttcacaacagcaacaattatccccaatattagccaacaaaatccgttctccatttgaaaatcaaagtcaggatcaaaatgacaattcaatagacccaacaccggctggacaagtaacaattcctgtagaagccgtatctccaccggcactggacgaattatcgaaattccaaaatggttcaactgagacattatttagaactggatcaccccgtaagaagcatacacatattattatactcaaatccttaaatgcaacttttgagaccaagtttcttgttgtaccatttaaacctgacggacttaaattaggtcgaccagttaccaatagcgtaaacaagaataattcaggatcgaaaagagatttattttcgcaacaagttagaccagataacggaaattttgactcaagagttctttccagaaatcacgcttgtctcagttgtgatcctacatcaggaaagatatatattcgcgatctaaagtccagcaatgggacatttgttaatggggttaaaatacgccaaaatgatgtagaattaaaagttggtgatactgtggatttgggaactgatattgactcaaagtttgaacatagaaaaatcagtgcgtatgtggaagagatttcagtaattcccttaatgaacactgtatctgatcccacaaatttggtgatgaaaaaacaagatcatactaataagaataatgggaactccactaatataaacggaataaagatagacagaggtcatcataatcaacacattccaatacgatctcatttaaaggaaaattataccgaagctggtgtaacatctgcaacaacggctcaaagggcagcctttgaggcagctatgtttggagatattaataactcagaattagatgatgatattttaggtccagaaactgaggttctcagtggaatttttatcaacaattcagcaggtacaagcataaatttgataaatatgataaaaactttgactactgagctgtccttagaaaaacaagagctggaaaaattacattccatgcaaaactttatgcaaaactatacgataaaccttgatttcatcaataagcacatgattgatatgaatgaaaagcatttactgaaactgagcacggctttacaaaaaactctatcagaaaataatgatgcgctactcaaagaatcggaagatcaattaaaagaaatcaaacaacaaaataataaagtaaaatctgcatgtagcttgaaggaaaaacaaaaccatgaaaagctacaggagctcgaaagtgaattaagagagctgaaccttcaaatagaagaagagaggggaaaaaatttagttttaacacaaagcaattttaatggtggtattaacaatgacaataacgctaaagtaaaacaaaatgattcaagagaagaaaaaaaggataccgaagatacattaataagcactgaagaactaggagtcgtcgaaggcaagagaacaagagttagtaagggaatgctctttggagtagttgccatttcattcggtttagttgcgacggccgttaagcaattgccacaataa

SEQ ID NO: 4165 - DNA, 1815 bp, Saccharomyces cerevisiae
atgtcagatcctatagtaacgtcttccaaaatggaaaaaagtgcagagtttgaagtaacagactctgctttatataataacttcaatacatcaacaacagcttcactaactccggagattaaggaacattctgaggaatctcgcaatgggttagttcacagattcgtcgactcattcagaagagccgaaagccaacgtttagaagaagacaatgacttggaggatggtaccaaatcgatgaaatctaataaccacttaaaaaagtcaatgaaatctagacatgttgtaatgatgtctttaggtacagggataggaacaggtcttctagttgccaacgccaaaggtttgagtcttgcaggcccggggtctttagtcatcggttacgttatggtgtccttcgtcacgtattttatggtccaagcggctggtgagatgggtgtcacttatccgacgcttccaggtaacttcaatgcatacaattcaatctttatttcaaagtcgtttgggttcgcgaccacttggttattttgcattcagtggttaactgtgctaccgttggaattgattacttcttccatgaccgtcaagtactggaatgacacaattaatgctgatgtattcattgtcattttctatgtgtttttattgtttatccacttttttggtgttaaggcatacggtgaaacggaatttatcttcaattcctgtaagatattgatggttgcaggattcattattttatcagtcgtcatcaattgtgggggagccggtgtggacggctatattggcggcaaatattggcgcgaccctggttcatttgcagaaggcagcggtgccactcgtttcaaagggatatgttatattctagtatctgcatatttctccttcggtggtattgaattatttgttctttccatcaatgagcagtctaaccctagaaaatccactcctgtagccgcgaagagaagtgtatatcgtattttgatcatttatttgctgacaatgattctaattgggttcaatgttcctcacaataacgatcaattgatgggttccggtggctccgcaacgcacgcttcaccatatgtcttggcagcctctattcacaaggttagggtcatcccccatatcattaatgctgttattttgatatcagtcatctctgttgcgaactctgccctttatgccgcaccgagattaatgtgttccttggctcaacagggctatgctccaaaatttttgaactatattgatagggagggaagacctttaagggccttggtagtgtgctctcttgttggtgtcgttggcttcgtcgcctgttctccacaggaagagcaagcatttacatggttggcagccattgcaggtttgagtgaacttttcacatggtcaggcattatgctttcacacattcgattcagaaaagcgatgaaagtccaaggaagatcacttgatgaagtcggctataaggccaataccggtatatggggttcatactatggggtttttttcaatatgcttgtctttatggcccaattttgggtcgcactgtctccaataggaaatggcggaaagtgtgatgctcaggcattcttcgagagttatctggctgccccgctatggatattcatgtatgttggatacatggtttacaaaagagattttacctttttaaacccactggacaagatcgacttggactttcatagaagagtttacgaccctgaaataatgaggcaggaggacgaagaaaataaagaaaggttaaagaactcttcaatattcgtcagagtctacaaattttggtgttag

SEQ ID NO: 4166 - DNA, 1815 bp, Saccharomyces cerevisiae
atgtcttcagacgctataagaaatactgagcagataaacgccgctattaaaattatagaaaacaaaacagagcgtccgcaatcgtccacaacccctatagattcgaaggctagtacagttgctgctgctaattccacggccacagaaacttccagagaccttacacaatataccctagatgacggaagagtcgtatcgacaaaccgcagaataatgaataaagtgcccgccatcacgtcacatgttcctacagatgaagagctgttccagcccaatgggatacctcgtcacgaattcctaagagatcatttcaagcgcgagggcaaattgtcggctgcgcaggcggccaggatcgttacacttgcaacggaactcttcagcaaagaacccaaccttatatctgttcccgccccaatcacagtttgcggtgatatccatggccagtactttgaccttttgaagctattcgaagttggcggagatccggccactacatcgtatttgttcttgggagactatgtcgacagagggtccttttcgtttgagtgtcttatttatttatattctttgaagctgaattttaacgaccatttctggctactgaggggtaaccacgaatgtaagcatctaacgtcatatttcactttcaaaaatgaaatgctgcacaagtacaatctagatatttacgagaaatgctgcgaatcgtttaacaacttgcccctggctgcgttaatgaacggacagtatctttgtgttcatggtggtatatctcccgagttaaactctttacaggacattaacaacctaaatagattcagggagattccctctcatggcctgatgtgtgatctgttgtgggctgacccgattgaagagtacgacgaagtcttggataaagacttgactgaggaagacatagtgaactccaaaaccatggttcctcatcatggcaagatggcaccttcaagggatatgtttgtcccaaactcagtaaggggctgttcatatgccttcacgtatcgtgctgcgtgccattttctgcaagagactggcctgttgtccatcatcagggcacacgaggctcaagacgctggttatagaatgtacaaaaataccaagactttgggctttccctctcttttgacccttttcagtgcgcctaactacttggacacctacaataataaggctgccatattgaaatacgaaaataatgttatgaatatcagacaattcaacatgactccacacccctattggttaccagatttcatggacgttttcacgtggtccttgccatttgttggtgaaaaagttacagagatgcttgtcgcaattctaaacatctgtactgaagatgagctggaaaacgacacccccgtcattgaagaattagttggtaccgataaaaaattgccacaagctggtaagtcggaagcaactccacaaccagccacttcggcgtcgcctaaacatgcttccattttagatgacgaacatcgaaggaaagccttacgaaataagattctggccgtcgccaaagtttccagaatgtattctgttctcagagaagaaaccaataaagttcagtttttaaaagatcacaattcaggcgtgttgccacgtggcgctttatctaatggtgtaaagggtttagatgaagccctgtctacctttgaaagggcaagaaagcacgatttaattaatgaaaaattaccgccttcactagacgaactgaaaaacgaaaataagaagtactacgaaaaagtttggcagaaagtacatgaacatgatgcaaagaatgatagcaaatag

SEQ ID NO: 4167 - DNA, 1818 bp, Saccharomyces cerevisiae
atgagaatcaagaagaaaaacaccagaggtaacgcaagaaactttattaccagatctcaagctgtgagaaaattacaggtttctcttgctgatttcagaagattatgtatattcaaaggtatctatcctagagagccaagaaataaaaagaaggcaaacaagggctctactgcaccaactactttttactatgctaaggatattcaatatctaatgcatgagcccgttttggctaaatttagagaacacaagacttttgctaggaaactaacaagggctttgggtaggggagaagtctcttctgctaaaaggttagaggaaaacagagatagttatactttagaccatattatcaaggagcgttatccaagtttcccagatgctataagggatattgatgatgctttgaatatgttatttcttttctctaatttgccctctaccaaccaggtttcctcgaaaattatcaatgatgctcagaaaatctgtaatcaatggttagcctatgttgccaaggaacgcttggttcgtaaagtgtttgtatccattaaaggtgtttattatcaagccaatattaagggtgaagaagttagatggttagttccattcaagtttccagaaaacatccccagtgacgttgatttcagaattatgttgaccttcttagaattctactcgactctattgcatttcgtcctatataagttatacaccgatagtgggttgatttatccgccaaaattggatcttaaaaaggataaaatcataagtggtttgtcatcatatattctagaatccagacaagaagacagcctactaaaacttgacccaactgagattgaggaagacgtaaaagttgaaagtttggacgcatcgacattaaagtctgccttgaatgccgatgaggcaaatactgatgaaacagaaaaggaggaagaacaagaaaagaaacaagaaaaggaacaagaaaaggaacaaaatgaggaaacggaactagatactttcgaggataacaataagaacaagggtgacatcttaatacagccaagtaagtacgattctcctgttgcttctttgttttctgcatttgttttttacgttagcagagaagttccgatcgatattcttgagttcttgatcttatcttgtggtggtaatgtcatcagtgaagctgctatggaccaaattgaaaataagaaggatattgacatgtccaaggtcactcatcaaattgttgacaggccagttttgaaaaacaaggtagctggcagaacgtatattcagccacagtggatatttgattgtatcaataaaggcgaattggtacctgccaacaaatatcttccaggggaggctcttccacctcacttaagcccatggggtgatgctattggttacgatccaactgctcctgtcgaagaaggcgaagaagaagaaagtgaaagtgaaagtgaaagtgaagatcaagttgaggaggaagatcaagaagttgttgctggagaagaagatgatgacgatgacgaagagctacaagctcaaaaagagcttgaattggaagcacaaggtatcaaatattctgaaacttcagaagctgataaggatgtcaataagtcaaagaacaaaaagagaaaggtggatgaagaagaagaagaaaagaaattgaaaatgataatgatgagtaacaaacaaaagaaactttacaaaaaaatgaagtattctaatgctaaaaaggaggaacaagctgagaacttaaaaaagaaaaagaagcaaattgccaaacaaaaagctaaactgaataaactagattccaagaaatag

SEQ ID NO: 4168 - DNA, 1818 bp, Saccharomyces cerevisiae
atgcagacgtcaatggtgagcgcaaaagttagtatatggctagtatgtagcgttatatgcagtagcctggtacgggctacgcaatctgtgtgttcgtcgcaaaacacagcgaccactgacggtgtacgaaatcaatttcagagtaatggttggtgttcaaataactgtgctggtcatcagtttgccatcgtacaggggttcatgtgctggtgcagtgattcggaaccgagcactcagacatcggtgggagactgcagtggcacttgtcccggttatggctacgaagattgtggtaatgcggataaggatctttttggttatatatatctggggcaaaccccgctaagttctgtacagagtgtggaaacgtcaacagagtccagtgtgtacgtttcaagtagctctatcacgagtagtagtagtacgagtattgtggacacaaccacaatctcgccgactctgacgtcaacgagtacgaccccattgacaaccgcctcaaccagtacaacaccatcaactgatataacatcggcactgcccacgactacaagcacaaagttgtcaacatccattcccacaagcacgacatcgtcaacctctaccaccacaagtacctcatcgtcgacttctacgaccgtaagtgtcacatcatcaacatctaccaccacaagtactacgtcgtcaaccctcatttccacgagcacatcatcatcatcatcatcaactccaaccacaacatcgtcagcccccatttctacaagcacgacgtcgtcaacttccacttcaacaagtacaacatcgccaacttcttcttcagcacctacaagctcgtctaatacaacaccaacgagcacaacgttcactacgacatcacccagtacagccccttcaagcactacggttacttacaccagtaccacagcatctccaataacgtccactataacttctgtaaacctgcagacctccttaaagtattctgtgataacagtgacttcagtgcacaccatggacactaacatttcggaaatcacctcgagatatctcaccatgaaaaaagtaataacgcagatttactcttccaccctcggggctactcctacttctgcagtggctactacgtctgccagcgtaggtggtagaataacaaacaataacaatagtaacaccaccaacagcaatacaccaactaacaagtctacagaaaagaaagggtactgggattcgcccgggaaaatagccgctactttcgtcgtggttggagtggtatgtttggtaattatatgcatactaatatacttaatacatcattatagaacaagacccgctcggaaggctcaagattttgagaatgaatatcagagtaagttttaccagtccaagtacccaaatgaagttaccactaccacgttacacacgccttcaccatcttcaaattcaactttctcgaccccaagattaatatacactgatgaaaagggacaaattatgtctgaatcaccatccccacgtcaatctacgtattccttgactgcaggcagtccaccaaatgacccaagcacgttggcaagcccatttcacgatcccattcttcccagaagaacttctacttttcttcattcgcccattcaaaagcaacacgaaaaaatggaatcaaacgttactctaggtgaagacacggtactggtggatcagaggctagacccaagtaagatgcttaacactttagcaaatgacgatgccacaaaccactctaccatttcgttatcagacaacgtagactactccaggagggttctgcggctaatgaacgaataa

SEQ ID NO: 4169 - DNA, 1818 bp, Saccharomyces cerevisiae
atggagacgccgcaaatgaacgctatacaagaggaggacaatttgtctccggaagttgctttccagactcctaaattgaatgattccgatgcttcatcgttttctttgtccaatatgaacgctgtcgggaatgtagacggtataccatcccaaaacaggacattttttgcatcacctaggcccagttccctattttattctgccaaggaaggtaacaattccagttctagtatcatctacaatccttcgttcacttttggtgaaaacgcttctagtaatgctaatatcaatgaagctgctttgatgaagggaaaaggcaacgaaggacgaaggcaatcactcaaatatataccagcaccaaagctggtgccgcctcctcccagaacaagatcaccggtaagaggcatttcccccgatgctggcagcagtaagaggtcttctatgaccttggattctccctttaattttacgacatcaacgctgcaaccgcatcaacagacaccaccctcttcagctgcatcaaggacctcatttcgtaaggggcatcgttataagcattcctctgtatccatgaatttttttcaagagcctgaggtgaaaattcctttgaacattgccaaatctcttcccattccagatttcaatgatttgctgtcaaatttgccatggccaaaggcttatattcagttatctattgccgctctacaaatctttgcatgtctgattactttccaagtcggacacctgtactcatggagtaattttattacactatcgcattttattacttacgatatcatcggttcgctggtaatcatatttgtggaaaatttgtctcagttccaggtatggtttacaggcactatcacatttccattcgggttaaatagaatagacgttctactaagttttgcgcttgccgtttcgttatgctttgttgggctggaccttttattccatataattgaagaattcatagtcctctttgtagaatctggtagttctttgacgaataaccatgatcacgatgaaattaatgagcaaattcctcattcccacattgccaatgccaatgattcacaaaacgagaatattaccttatggtatagcatactaatgatcaatttagtgttatcgacgttatcactttataagacgttttatgctaacaaatacagtaatttaaagacgaagaacccgattattaccatcacttatacagcatacctattcatttatcccctactattggatctgttatcgagtatatccgattaccttgctactttggttatttcgagtttaattctatggcatgggctgactatagcacggtggacctcgacagtgttactaatgggattttccaccacatctttatccaattcagcgttattcaataataatgacagcactgatacgaccgcccatactcaacaagtcgagtctaaagctgctaaagaaaaaccatctgtacgaccaagatcaatgagctcactacctatagcaacaaagaatacaaagatacggaaaactgggtttttgaattctgcaggtttcactgaaaatccaacaaccattaagaacatgatcaaggaccaaatcgagagattaagtgagtttaaatccagatacatcctaaattacgatgatatagtaataagcaaagtgaattttacgctttatgtggtactgatcaagataacaatgaaaggaggctccgacgatgacgaattgatgttaaggttagccattgacaagtgcattcaaacgagcattccaacgtgtgaaactacaatagacatagaccgaatataa

SEQ ID NO: 4170 - DNA, 1818 bp, Saccharomyces cerevisiae
atgtcgtcaagcctttttatcctggatgaaaatctggagccattggtatcgaagaatattagagcactaccgaatctatcgtcggttctttcaagtttcaaacaatgttatcatgacgggtcgcctccaattctctcccaaaacgattggttctttatacatttgaagagagactttctgcatttcgtttcagtgatacataccacagacaaaccaaatatagacttaatgactatactagcctttttggaacaattttatcatcttttacaaaaatattttgaaatcgaggtcttaactaagaatgtcatactggacaacatcttacttgtcctggagttgattgatgaatgtatagactttggtatcgtacaagtgacggatccaagtatcatcaaggactacattcgtgtgaaggtcaacgtaccaagagttacagtagacaatgaggagtggagccctggtgaagagagcagtagtagtagcggtagcgatagcgatagcgagtacagcaatactaataagaggaaggataagaagaagaaaaggaagaagaaaaagggcactaaagggaaaagcgtgggcaaaagtaaattaaaaagtataatggtaaacaataaagaaaataggggcataaacgtggtggaaactgtcaaggagacactaaggaacaagaatgataccggtaaagaagccgctaatgacgagctccccaatgacggtaatgatttatacatcaatggcgatattgcgaagacgattataatgcccatatcatggagaacaaaggggatacattacgccaaaaacgagttctttcttgatgttattgaacgtgttcagtacttgatggattttgaaaaaggagtgattaggaaaaatctgatacatggagagattgtgtgcagatgctatttatcagggatgcccaaactgaaaatatccataaacaagatactgaacagggacccccagttcatgtcgaattccagctttcatcagtgtgtttcactagattccataaacactattgaaaaagatgaagaaaagaatagtgacgatgatgctggtttgcaggccgccacagatgcaagagaaatcgaatttataccgccggatggcgaatttgttctttgccaatacgagttgaagagacatgtaaaggatgcgccgatggtgaggttgaaagattttgaaatcaaacctaaactgaagaagtttaaaatccaaattgtaaccaaaattcaaacaaattttaaacccaccaactcaacgtcgaagctaaacgtgagaattcccctgacaaaagtcttccaggaatataaaatagacctcagcaagcaaattagattcaaggcaaacatcggcaaggtcgtgtttaacttgagtgacgattttctcctctgggagatacaaaccatgaaggggcaccgagaacatagcacaaacaagagctcacagtacaacagcgacgaagatgatccaaatacgtgtgcatccatggtggcagagttccccctcttcaaccaggaagaatatgaccgcctgcaagaagaaatgaaaacctcaatgaatccgccgcccttgcgcacgggacccaggctggaagaactatatagacaagtgcacgaccaacaaacttcccacgttactcctcgagataagttggtcaacattgatttcgagattccgtactgtacatgcagtggcctgaaagttgagtacttgaaggtcgaagagccacaattgcagtaccagtctttcccctgggtcagatacaagaccgtcagcgacgaagagtacgcatatattgtttga

SEQ ID NO: 4171 - DNA, 1818 bp, Saccharomyces cerevisiae
atgtctaataaacaactagtaaagccaaaaacagagacaaagacagaaataactactgaacagtctcaaaaactgctccaaacaatgctcacaatgtcttttggttgtttagcctttctcagggggttgttccctgatgatatatttgttgaccaacggtttgtaccggagaaagttgaaaaaaactacaataagcaaaacacgtctcaaaataactctatcaaaatcaagacattaattaggggcaaatcggctcaagcagatttattactggattggttggagaagggagttttcaaatccattcgtttaaagtgtttaaaagccctatcattaggtatatttctagaggatcccaccgatctcctagaaaattacatttttagttttgattatgacgaagagaataatgtcaatattaatgtaaacttgagtggcaataaaaaagggagcaaaaatgccgacccagagaacgagacaatttctttactagattcgagaaggatggttcaacagttaatgagacgatttatcataattacccaatccctggaacctttaccccaaaaaaagttcctcactatgaggttgatgtttaatgataacgtcgatgaagattatcagccggagttgttcaaagacgcgacttttgacaaaagagcaactttaaaggtccccacaaatttagacaacgatgctattgacgtcggtactctgaacacgaagcatcataaagttgctctttctgttttgtcggcggcaacatccagtatggaaaaagctgggaacacgaactttattagagtagacccctttgatttaattttgcaacaacaagaagaaaataaacttgaagaatctgttcctacaaaaccccagaattttgtcacaagccaaacaaccaatgtgcttggaaatcttttaaattcttcgcaagcaagtatacaaccaactcaatttgtttcaaataacccagtcacgggcatttgtagttgcgaatgtggattggaagttcccaaagcagccaccgtgttaaagacttgtaaaagttgccgtaaaacactacacggcatctgttatggcaattttctacattcgtcaattgagaaatgctttacttgcatttttggaccttccttggatactaaatggtctaaatttcaggatcttatgatgattagaaaggtttttaggttcttggtgagaaaaaagaagggatttccggcctctataacagaactcattgatagttttatcaacgtcgaagatcagaataacgaagtaaaagagagagttgcattcgccttatttgtatttttcttagatgaaacactatgcctcgataatgggggaaaacctagccaaactattaggtacgttacgagctctgtactcgttgatgtaaagggaattgtcataccaaatactagaaagcaactgaacgtaaatcacgaatataaatggcactttaccaccagttcccctaaagccgagagcttctatcaagaggttctgcctaactcaagaaaacaagtcgagtcgtggttacaggatatcactaacttaagaaaagtctattctgaagctctttctccgtcgtcaaccctacaggagcttgatcttaactcaagcttgcctacgcaagatccaataatttctggccaaaaaaggagacgttacgatcttgatgagtacttagaggaagataaaagctcagttgttaatgatacgataaaagcaaaagattttgatgaaagtgtaccagcaaagattcgcaaaatcagcgtctctaaaaagactttgaaaagtaactggtag

SEQ ID NO: 4172 - DNA, 1821 bp, Saccharomyces cerevisiae
atgaatacattaaggtgtttgacacaagcactatccaaaagtgggagagaagctccaaaactatatcagaaagtaatatttccaggcctgttcagagagggtataccaattgcaaatgtcaagaaagttgatgaaaaaataatagatagcccaacatcaacgtcagttaatggagaggcaaaaaaaatagtacggcatggtgtgaagtatgaaagggagcaagttaaggaatacctttcaagcctgccgactttaacgctttctaggaaacaaattagggatgactatgatgaggaacgtgcaaaacgaatgtatatgttctctaaacaaacgaattcctcgaataaattccagaaacttcttacagcaaagtctcaagagtttactagagaactattgacgctactgatagattgcacatcgaatgagaagaattcagggccagaacgcttcactcgtaagtttcttaagtttagtaatgacgagatccctcctctccctgacttttcaaagaaccctcaattgtttgaaaattatattggaatactaagtcatacaaagttcaattttcgttcatcttccaaactaaatggtattgtgcgtaagatgctgcggcacctacttcatccaaccaataagacgactctgccgttgcgttctgctcaagtttataatgactcaatatactttttcagtgagcacttcgactttgcgtcttgtagagaaatatttgcacaaatgaaggctgaggggactaaaccaaatacaatcacttttaatcttttactgcgtaatgtagtgaaaaactcgcatattagaaaaacgaagcaccctgacgatgaggtccttttttatcttagaagtatgcgtaatcatggagtttttgcagatgtaataacttggacgacatgttataactttcttcgtgatgaagtttcgagacaattgtacattgttcaaatgggtgaacatttaggaaattttaacgtaaattttgtttatactgtgctaaggaacggagattatagagcagaggactgtttaaaagttttagcagcaaattcactaccgatttcccgtaagacgttctatctgtgcatagaacgactactaaacgaggaacaacttgaaaccgcatctaaattacttgactatggttttcagcacttgaaaagtaattttaagttggactcggaggcaatgaatcatttcatgcgggtatttgctaataagggaagaagtgatttggcattcctttgctataatacttgtcgtaagatttacaaaattaaacctgattctcagacgttcgaaatgttatttaaagcgttagttaggaatggcaacaccaagaattttggggcagtcctacagtatatcaaagacttaaaggttagtgaaggatttggattgcggacaagttattggagaaccaaagcagactcaattttcaaatttggtagtcctaatacgctatcagaaaagtcaattgaaaaagcaagaaaattgttgggcaacctgattgcttccgagggtgagttctcttggaaaatttggaaagaaagtgattcttcacaaaaaaaaatactacgttttttgggttgtatccccactactttacgctgcaccaatacagcacaagatcatcagaagcccacaaacctaccctcaaacatttcccagaaaaaaagagaatatcgaaatcgggttaaagcaatagccacaaaggctgctttggaaaaaagaatggcgtatatcaaagacaatgatgtagctttcaaaaaagagctagtaaagaggagaatagttggggaggtttga

SEQ ID NO: 4173 - DNA, 1821 bp, Saccharomyces cerevisiae
atgctggaaactgatcactctaggaatgacaatttagacgataaaagcactgtctgctacagcgaaaagacagatagcaatgttgagaagtctaccacgtctggcttgcgccgtatagacgctgtcaacaaggtcttgtctgactacagctctttcacagcttttggagttacgtttagttcactcaagaccgccctactggtggctctgtttttgcagggttactgtactggactcggagggcagatttcgcaatcaatacaaacctatgccgctaacagttttggaaagcattctcaagtaggatcgatcaataccgtcaaatcaatagtagcctctgttgtcgcagtgccatacgcacgtatatctgatcggtttggacgtatagaatgctggatttttgcgcttgtgctctatactattggagaaattatttctgctgctactccaacgttttccggactttttgcaggtattgttatacaacagttcggttattctggatttcgtcttcttgctacagcactgactggtgatctgtctggattgagagatcgtacatttgcgatgaacatatttctgattcccgtgattataaacacatgggtaagtggaaatattgttagctcagttgctggtaatgttgcaccatataaatggcgttggggctatggaattttttgcatcattgtgcccatctccaccctaatattggtccttccctatgtgtatgctcagtacatttcctggcgcagcggtaagttaccaccattaaaattgaaagaaaaaggacagaccctgcgtcaaacgctctggaaatttgcggatgacataaacttaattggagtcattcttttcactgctttcttagttttagtattattacctctcacaatagctggtggagccacctccaaatggagagagggtcacattattgcaatgattgtggttggtggctgcttaggttttatctttctaatttgggaattaaaatttgctaagaatccatttatcccacgagtatatctaggtgatccaaccatctacgttgcattgctaatggaatttgtatggcgtctaggtttgcagattgagttagagtatttggtcaccgtgttaatggtagcattcggagaatcaacattaagtgcgcagcggatagctcagctttacaattttctacagtcatgcactaatattgttgtcggcattatgctgcatttctatcctcatccgaaagtctttgtagtcgctgggtcgcttcttggtgtcatcggaatgggtcttttgtacaaatacagggtggtatatgacgggatttcgggtcttattggcgctgagattgtggtcggtatagctggtggtatgatacgttttcctatgtggacgctagtgcacgcttcaaccacccacaatgagatggcaactgtcactgggttactaatgtccgtttatcaaatcggagacgcagtaggtgcttccatcgctggtgctatatggactcagcgtctggcaaaggagttgatacagcgactcggctctagtttagggatggcaatctacaaatcaccactcaattatctaaaaaaataccctattggatcagaggttcgtgttcagatgatagaatcctattcgaagattcaacgcttattgataattgtgtccatttcgtttgcggctttcaatgctgttctctgttttttcttgcgtggctttactgtaaacaagaagcaaagtctttccgcagaagaacgagagaaagagaagctcaaaatcaaacaacaatcatggctccgtcgtgtaattggatattga

SEQ ID NO: 4174 - DNA, 1821 bp, Saccharomyces cerevisiae
atggagcaacatctcaaatcaattcctctacaggacgacactaagaaaaaaggcatactatcttttttccagaatacaactacggtaaagagtaataagtttctcacgaaagagaaggatgtcatcactctagatgatcctaaagaggatgtcagtggacctatgatagaaactgttaaacaagaaaccatgaaaagcatcaataaagagtgtgcagatgaaatgaaaacgacacctaagaaggccaatgctgaagacaagcttttatgctacaaaaattcacccatacaaagtacaaaatacgatagaaacaccaacaaacaagtacccaatggaaatataatagctatcgagacaaaaagcagaagctcttctccatgctctaagagagaactttcctcatcgaaaaaggaagaagctaaaagagaaaaggaactaaaaaagcagcaacgtgcagaagagaaacacagaaaagagttattacgacaagaagagaaaaagaaaaaagagctaaaggtagaagaggaaagacaaaggcgtgctgagctgaaaaagcaaaaggaagaggaaaagcgtagaaaggaagaagccagattagaagccaaaagaagaaaagaggaggaaagattgaaaaaggaggaggaaatacgtttgaaagaagaagccaaggaaagagcacaatcccgtattggtaacttctttaaaaaactaagcgattctaatacgcctgtggttgaaaagtcggattatgaaaaattttttctacctttctatgctaaagatggagttagagtcagtaataagtggaaactaacaaaagtggagctggaaggtagcaaaagaaaaatagatgatgaattactgaacagtaaagataaaacaagtagtgacgacttattgaattggttacagtctagaagattacctagaggacataaaattaaacgtaaagctgttgacgttctacagcaaatgcctttgaaggagaaaacagacgatgagctccaatctttacttgcacaagttccgcacaaatatataaaattctacgaaaatgttagacctccgtttatcggaacctattctatggactttactttgccaccaaacgatcccttttctacgaaaggtactggattcaattatgattacgattctgacgttgaatgggttaatgaagaagaagaaggcgaagtcgataacttagaaagtggtgaagaggaggaggaggaggaagatgatgaagacgtacctagcgaaggagagtttgacgggtttctagacagcgaagaaaacagtgatttggatggcctaccctgcgccaagagaaaatttgtaggcccattgataccaacaatatgcctaaaatccaattttgaaaacttatcagaggaaaataaacgatacttacaacaactcaaggccgaagttatcatagaaaccgacgggccaatcgatccattcaaagaacccaaaacatcgtctctaccatccaaaagaagtaattccgacttacaggcacagaccgctagccaatctcaaagtcccgaaaagaaacaaaaagcaatgattacagaccccatggacttacttcgactttttgatggggttcaagacagcacgttttctttgggtactgtgactgaaatagcacagaaaaatttgccgcaatacaacaaacaaacaattaaaaacaccataaaggaatatgccataagaagttctggaaagggtgatttgccccgcaaatgggtaatcaaagacgcacaaaactgggagaatcttcgagccaatgcaaatatgccaaccccgtctttgtaa

SEQ ID NO: 4175 - DNA, 1821 bp, Saccharomyces cerevisiae
atgtcaaagtcattggaatgggataatctcgggttttctttacttccctggataaggacaggactcgatgttatgggttttgagaccatgactccagtccaagcatcgacaattcccatgcttgctggcaacaaggatgtagtagttgattctgtaacaggctcaggtaagaccgctgcgtttgttatacctgtactagaaaaagttgtaaaggaagaagcgaatacatcaaaattcaagaaagcacacttccactcgttaattattgctccaacaagagaattgtcacgccaaattgagtctgtcgttctatcatttctggaacattatccttccgacttgttccctattaaatgtcagctcctggttggtactaatgaagccacagttagagatgatgtaagtaattttctgcggaatagaccgcagattctgattggaacacctggtagagttttggactttttacaaatgccagcagtaaagacgtcagcatgcagtatggtagttatggatgaagcagacagattgttggatatgagttttattaaggataccgaaaaaattctgaggctattgcctaaacaaagaaggacgggtctattttctgcaactatgcgtagcgccggatcagatatctttaagacagggcttagaaatcctgtcaggattaccgttaactctaagaaccaggcgccctcctctttgaaattaaattactgtgtcgtaaatcctgccgaaaaactacaacttttggttagcattttgaataactacaaattcaagaaatgtattgtatattttccaacatgtgtgtcagtctcctacttctactcatttatccagtatttgggaaagaggaatattctcgtgaatgaagtagaaatattttccttgcatggaaaacttcaaacatcggcaaggacaaaaactctaacagcttttactgattcgctaagtaattctgttttattcacaacagatgtggctgctagaggtattgacatacccgacgttgatctcgtcatccagcttgatccccctaccaatactgatatgttcatgcatagatgtggtagaactggtagagcaaatagagtgggtaaagcaattacgtttcttaatgaaggcagagaagaggattttattcctttcatgcaagttaaaaatgtggaacttgaagaacttgatttggaagtaaagggcataacaacaaacttttacgaggactttagaaattggatactagaagatagggatagatttgataaaggtgttaaagcatatgttgcctttattaaatactactcaaatcattccgcaacttcaatttttaggcttcaatctttagattatgttggtattgcgaaattgtatggtcttttccgcctgcctagaatgcctgagataacaaagtacttagccaccgaaaaacaagaagggattttcccagggaattggttggtcgatcccccagttaatatggatgaatataaatacaaggacaaaaaacgtgaaaaggagagacaagaaacattaaaaaatataagcctgattaatgataaaaagaagctgaaaagtgagttgaagaagaagaatttagcgtggtcagataaaacattgacgaaagaacggaaactcgagagaaaggaaaagatgagtttaaaaaggaaggctatagaggaagaattgaaagcagaagagctcgatgaaaatgctgaagaagagcgtattaaagaggattggaaagaaatcgttttacagaataaacggaagaaagtttccagcaaagctatccaaggcaattttgacgacttataa

SEQ ID NO: 4176 - DNA, 1824 bp, Saccharomyces cerevisiae
atgagtaacgaagcttaccagcatgatcataccgtaaatcctcaccagaagatagttgtgaacagctacgattggttacagttccgtgatgagcaagatcactgtaaaagtaagaacccgataacgcacgcttctccaggggtcggttcgaatgcacagaattcagacatagcggaggcccctcaggtattccacccttcctatcaatctctggtcaacgtaccgtccgagagcccgcgacctgatcagacttcagggtccaatcctgccgttggactgcttcataatgcagaggacaaagcgtcagggcaagaagaagaaggaagtcaatatgagattcaatattcggtatttcgtccgctgcatgcatatccaaccaagggcctagcatatgagcagctccgaagaaaagaagaacaagaacagagggaaaacttcaaccatttggtttctgactgtattgaggctgtagagacatttggacgcgaactcgagagaatccaaactggctcaagtgggtcgtactttgtgtatggaacacgggccgacgaaagcgttccggtgggggtcttcaagcccaaggatgaggaaccatatggcccattttctcccaaatggaccaaatgggcacaccgcacgtttttcccatgtctgtttggcagaagttgtctgattccaaacctcgggtacatctgtgaaagtgcggctagtttgttggataggcgactggaaacgcatctagtaccctatacagatactgcatctatagagtcttttaatttttatgataatagaaaaaaatgggtattgggatacaaccttcagaagaagaaacaaaaaaagctgggttctttccaactttttttgaaggagtacatcaacgccgatgagttctttcataaatacccattacctgggatgtattcagatgttaaacattcatttcatcgtaagtcatccggcgaagatatcaatcataaaccagagacaaccaggaacctaacagatgagacagaaccgtccaagcaaataaattcctctccaatttcgacggaatctgaagaaaattcgaaatttgaatggacagaatcaagtttgagtcagttcagattggaactagaaaaactaattatccttgattatataatgagaaacacagatagaggtctagacaattggatggtgaaactaatcaaactttcaaacaataagtggagactcaagttagccgccatcgacaatgggttgtcctttccctggaagcatcctgatgagtggcgtctgtacccatatggctggttgtatttgcctctgcaactactagccaaaccattttctgagcaaatgagatctcatttcctaccgatattgacaagcactaattggtgggaagagtcgtaccaagaattcttggccctatttagcagggaccaagattttaacgtccgaatgtggaagaagcaatgggcagtattaaaaggacaggcgttcaacgttgtcgaaacattgaaagacccacgacaaggccccttggaattggttagaaggacaaggtgccaggtaatagatgagaagatgcaagttccctgttgcccacctccagtttctattttcaaaaacgccatagacgaacctattggatcatattccacttcaccaatggtactccctagcaccccaagcacaattccatttcatgcacataaccaaagcaatagtaatcctgtatactatgattccactctgcacccatttgctaataaaacagtgatagcagagcggctacaaatagtcaattccacccccgtattcacctggtgttga

SEQ ID NO: 4177 - DNA, 1824 bp, Saccharomyces cerevisiae
atggacagatctaaggacgctagaaagagatctattagtttggcctgtactgtgtgtaggaaacgaaagttgaagtgcgatgggaacaagccatgtggaagatgtataaggctaaatacaccaaaagaatgcatttataatattgataaaaggaaagacaagagaaaaatcaaaaacgggtcgaaggtttttttattcaagaataatactatcgataacgggaataactctatactagagaacaaaggactaaatgaagacctttcttctcatatatatgagaaagaagcgccaaaattcgattcagatattgatatatcaagatttggcacaaatgatgctgtgatttttaataatgacgggtgggacacttctcttccgatcgattttgatttcgatgagtttaacactgagacaacagatttcgatgactttttaaaactattaggcgataattcaccttcaaaggaacaaaaaagtctttcctattcacctactgctacaggcttaagcggtgtggttaaagaaactgagagcgaagataacgctcctacgaggtctcggctaatcgatgtcttgtttgagaacaagcttcactccgtaccaggaatatcaaaatggcatctatatgagctggaatcccaatacccaaatttggaatgtacagaaggaaatagtgatgaaaagtttttactttcaactgtattgtgcctggggtcgttgaccatacgaaaaagggaactattgaatcattcgaacatagacaatcgtccacttttgccggagaatagtatttcaaaactgaccactgatgcttttaagtactataatgctgcgaaaacgcttgttcccgacttgttatctcatcccacaatcgatggattttgcggcctcgttctaatggcaaatttcatgacgatgatgatatccttagagcaccaattatatttgagtataaatgctttacaacttgctgtggctttaaacttgaacaacaatacaaaatgcaaggaattacttgagtcgaacagcgacggaattggtgtgatcttgcttttttggaacatttggtgttcttcttgcatgttggcaacaattcatggaaaaaatccttttatcactttggaacaaattacaacacctctgccgtgtgaaatatccccccgcaataaaactaataaacttttgatagatttcatgcaaatcagaatcaagctagccactctacaaagtaagatttttcaacggctatatacttccagcaccgcaaacgaggtaccattcgtaaacttagaaagagaatttgaggaggtttcactccagattaccaggttaaaaggctttccgatattcgaagaacatcttttttacaggagcagagtcttaatgttagagctatcatgtttaagagctcaagcttcttttctattatatcgtccgtatctgatcactggagaatccttacaagcagtaaccatggcaaaatcaataattcacgaaatatggagtcaatacactaaacagtttcccgataacgaaaaggaaaggcatgaacgtttggattggaatttttgttatcctttaagaacagcgtcactgacattatgtatttcatgtattatactcctaaggtataagcaggtggtgcagttccttaaaggtactgaactatttgaatacattctagcattggaaatattgcaagatttagttcaggtacttcctattgaacaaaaccttattgatataatcaaatatccgatcagtccagtacagctgagtggtgatagctttgtcgaattttggggtcgcatactttactaa

SEQ ID NO: 4178 - DNA, 1824 bp, Saccharomyces cerevisiae
atggagctgatactaaacagcctcatttctgatgatttaacagaggaacaaaaacggttaagtcttgatttcctacaggatatcctacaatctaacacgaaagactatgaaagttatttttcatctagggctgttcctggtagcataactgaagacatagcagaaattgatgctgaattatctgcccttgatagaaagataaggaaaacactactagataatacgtctcagattatcggaaatattcttgaaaacgatgatagggctcaattggatgatatagccaagtctttggagcaattatgggaattggatactaatattaataaggcagccgatcgaaacgttacaaatgacgatataaacaatgaaagcgtttctattgatgactttttggaagacgataaagaagacaacgacacaggtcgcatcatgacgactgagagtaacaatctggcaagaaagaagaaggaggatgagtttcacaaggcattaagtaggttaagaaacagaatttcaactaaagaagatgacaaggacgacattagatctgacacattagtcactgtactagaaaatttggatagcattacggatttgatggaactaccatttttggcccgcacatgtatcagaacaggtcattaccaggaggccgtcatgctatacacacacactacttccctgaggtcaagattccctggttcaaccattgtggatgaagtttgcgaaaaagttttaaacgaaattagtactaccatgttatccgggctggtaaaattactgtctactaatgtatcagtaaactcactaaagaaaatactacagtacttgaattcaattccaccatttgatggaaagactaataaatcattattaagtgtgtttttagccatgagatacaaattcattaccgatgaaatagcatcatatcctttggacgttgagtcttctaatgaatctttaattgaaatgatggttaagaggaaaattgaagtcctcagggaacatgtctacatgtccttgaatgtctttctgaaaagcttcttgtatgatacaaatgacttagagattcctttcccagaggaactagaaagtactgtgctaaggataaatgggactaacgaagagaaagaaattgaagaaaaggagaaagaaacaaagaaggaagaatatcaaaaacaagatagcgtagcgaacaatgaagaagatgtgacagaaaataaatcgatagaagatgtacaagaggaagtacaaggcaaagtggaaggcgaagatgatggagcagaaaggaaaacagaaaatgagatagaaaatgaaacagtaaacaaaacagaagacaaggctgaaaaagaaaaagaggaagaagtaaataccaaagataacaaggcagaaaaagaggaagaagaaattaataaggttgaggtgaccccagaagagccaagcaaaagcatagataacaaggcagaaaaagaagaagaagaaattaataaggttgaagtgaccccagaggagccaagcaaaaagattcggacttcaaaaagggaaaacaaaatacctacaaatgcagtcatgttgcaattcgttgataagtgcataacatacgtattaaaagacctcactcgtgggttaaatagcatcaagctgagtgactccgtttgcctgcagttggtgtactgttcattccgtctttgcgacctgaatcgaaactaccaccacctcttcctaaaaaaaatcaatgacactagcttgtttacgaccgagcagctcgcccgggcaattgacaagagagcagaactggcctctaaatatatatactcctag

SEQ ID NO: 4179 - DNA, 1824 bp, Saccharomyces cerevisiae
atggctagcacagcaaatatgatttctcaactaaagaaactatctatcgcggaacctgcggttgccaaggattctcatcctgatgtaaatatcgtggatttgatgagaaattacatttcacaagaattaagcaagatttccggcgtagactcgtctcttatttttccagcattagaatggacaaatactatggagagaggcgatttgttgattcctatcccaagattgagaatcaaaggtgccaatccaaaggatttggcagtccaatgggctgaaaaatttccatgtggagatttcttggagaaagttgaagcgaatggcccgttcatccagtttttcttcaaccctcaatttttagcaaaacttgtcatcccagatatcttaaccagaaaggaggattatggttcttgcaaattggttgaaaacaagaaagttattattgaattctcctctcccaacattgccaagccatttcatgctggtcatttaagatccactattattggtggctttttggccaacctttatgaaaaattaggttgggaggttatcagaatgaactacctgggtgactggggtaaacaatttggtcttttagctgttggttttgaaagatacggtaatgaagaggctttagttaaggatccaattcaccacctgttcgatgtttacgttcgtatcaacaaggatattgaggaagaaggtgacagtattccattagaacaatccaccaatggaaaagctcgtgaatatttcaagagaatggaagatggtgacgaggaagctttaaaaatttggaagagattccgtgaattttctattgaaaaatatattgacacatatgcacgtttgaacatcaaatatgatgtttactctggtgaatctcaagtttctaaagaatccatgctcaaagctatcgacctgttcaaggaaaagggcttaacacatgaggataagggtgcagttttgatcgatttgacaaaatttaacaaaaagttaggaaaggctattgttcaaaaatcggacggtactacgttatatctaactagagacgttggtgcagctatggaccgttatgaaaagtatcattttgacaagatgatttacgttatcgcttctcaacaagatttgcacgctgcccaattcttcgaaattttgaagcagatgggctttgagtgggctaaagatctacagcatgtcaactttggtatggtccaaggtatgtcaacaagaaaaggtactgttgtcttcttagataatatcttggaggaaactaaggaaaaaatgcacgaagttatgaaaaagaatgagaacaaatacgcgcaaattgagcatccagaagaagttgccgatttagttggtatctctgccgtcatgattcaagatatgcaaggtaagcgtatcaacaactacgagtttaaatgggaaagaatgctttcattcgaaggtgacactggtccataccttcaatatgctcactcaaggttaagatcagttgaaagaaatgcttctggtatcacccaagaaaaatggataaatgccgatttttcgttattaaaagaacctgccgcaaaactgttgattagactgctaggccaataccccgatgttttgagaaatgcaatcaaaacccacgagccaacaaccgtggtcacatatttattcaaattgactcaccaggtttcttcttgttatgacgtcttatgggttgctggtcaaactgaagaattagcaactgcccgtctggctctatatggtgctgcaagacaagttttatacaacggtatgcgcttgttaggtttaactcccgtagaaagaatgtaa

SEQ ID NO: 4180 - DNA, 1827 bp, Saccharomyces cerevisiae
atgaagatgcctctaaagaagatgtttaccagcacgtctcctcgtaactcttcttctcttgacagtgatcatgacgcttactattcgaaacaaaatcctgacaatttccctgtaaaggagcaagaaatctataacattgacctggaagaaaacaatgtgtcctctcgttcatccacctctacatcaccttcagcaagggacgactctttcgcagttccagatggtaaagacgaaaacacgcggttgaggaaagatttaaaggcaagacatatttctatgatcgccattggtggttcattaggtacaggtctgcttataggtacaggtaccgccttattgacgggtggtccggttgcgatgttaattgcatatgcctttgtcggccttttagtcttttacaccatggcctgtcttggtgaaatggcttcttacattccattggatggttttacaagttatgcctcacgttacgtggatcctgcattaggttttgctattggttatacttaccttttcaaatatttcatcttacctcccaaccaacttactgctgctgctttggtcattcaatattggatcagcagagaccgtgttaaccctggtgtgtggattactatattcttggttgttattgtcgctatcaatgtcgtcggtgtaaaattctttggtgaatttgaattttggttgtccagtttcaaagtcatggtaatgttgggtctaatcctgttactatttattattatgcttggtggaggtcctaaccatgaccgcctagggtttagatactggcgtgatcctggtgcgttcaaagaatattcgacggctatcactggtggtaaaggtaaatttgtttcgttcgttgctgttttcgtttacagtcttttcagttacacgggtattgaattgacaggtatcgtttgttctgaagctgagaatccaagaaaaagtgttccaaaggcaattaaattgacagtttaccgtatcattgttttttacctatgcaccgttttccttttgggtatgtgcgttgcatacaatgaccctcgtttactttccacaaaaggtaagagtatgtctgctgcggcatctccattcgtggttgccattcaaaactcaggtattgaagtcttacctcatatcttcaatgcttgtgtcttggttttcgttttcagtgcttgtaactcagatttgtacgtttcttccagaaatttatatgcgttggcaattgatggtaaagcgccaaagatcttcgctaagacaagtagatggggtgttccttacaatgctttaatactctccgtgctgttttgtggcttggcgtacatgaatgtgtcttcaggatcagcaaagattttcaactactttgttaacgttgtttctatgttcggaatcttgagttggatcaccattttaattgtttacatctacttcgataaagcctgccgtgctcaagggattgacaaatcaaaatttgcttatgtcgctcctggccaacgttatggtgcttattttgctttattcttctgcattttgattgctttaatcaaaaacttcactgttttcctaggtcataaatttgattataaaacattcatcaccgggtatattggcctgcctgtctatatcatttcttgggctggttacaaattgatatacaaaaccaaagtgataaagtctaccgacgtggatttgtacacatttaaggaaatatacgatagagaagaagaagagggaagaatgaaggaccaagaaaaggaagagcgtttaaaaagtaacggtaaaaatatggagtggttctatgaaaaatttttgggtaatatcttctag

SEQ ID NO: 4181 - DNA, 1827 bp, Saccharomyces cerevisiae
atgaaggtcattctccttaagccggttcagttgccaatgctactcttaatactattaaaatttattatggccgctaaggaaggcaaaatacatgtcttagaattcaatgcgagcagtgaatacacgcttgataagagaagagttatctccataaatggctacagcgctacatttggcccagaaattcgagttaaatccggtgacactcttaacttgaaattgactaactggatatgttcagaagaagaagctagtaaagacagtgatgtttggaaggattactgttcaacagctttacattttcatggggtggtacctttagcaaatgaatttgatggaattccaggtttaacacagcccactattggatatggagaaagttattggtataattttaccattgatcaatcaacctgtggtactttttggtaccattcgcattcatcagtacaatacggtgacggtatgagaggtgttctgatagttgaatgcgatgattatgataatcatgtggcaaatactattaattctgtgagagacatagagacactagatgacggtgttgttacaatgaaaaaagataaacacacgaaggaattgacggattatgaagttcaagaaaggattatcactttgagtgattggtataccaattggaatttggacattttaaacgacaaggttttgtcatctaccgggggtacagatcccaaatttgatggatcattaataaatggaaaatcatctgacggtgaaactatcaaaataggatttaacaccgagtatcttcttttgagaatcgtaaactcaggaatgtctggtactcaagtctttcaccttgatggattccaattaattgttctagaagccgacgggattatgattaaaccgttcattgtacaaacgataaatttagcggtcggacaaagatatacaattttggtcaaactaaagtctgacactagttttattcgtatgattaatggctgtaacaaaatgatgggttatataacaaaacagtggtggttttacaaagaaggcgctcatttggacctaccaaagaaccccaatgacgtttccatcgaacacttgcctggtttcactaaggccgagctttatcgcgacatagaaccaacgcaagaagagaataaaaagttacgcacaaaggctgatcctgttgcagttttcgaattcgattatgcttattacaaagatgaaagcacgaaacaaaagtatgggactgggatgtataaggtgaacgaacggacattcagcgagtacgtaaaagacccggtaaggttcggattcaacgaaacatatgatattgtaatcaactcactggaccacatgagacacccatggcatatgcatggccatcacttccagataatatctcttggcaataaaggtgatggcccatttcacaaagacgtacaagagggcaaggcatggagccgctatcagaacgatttacgtcacctggcccgaaccggaaaggcaccgatggtaagggatagcattaacattgcaggaaattcttacgcggttttgagaattaacaccgagatgcccggaaaatggcttttacattgtcatgtggagtggcacatgatgaaggggcttggcattgtctttgaggttccgacaacaaccgaggacagtaccaaacaagcaactacagctgtattatcgtaccctaccaaggaacctgaccctaacactgttgtccatacagccgcacttgaacaaaataagtccaaggtaatagccgtctacatcctaatcatgtgtgcggttgatgctatcttctactggttgctcatgtaa

SEQ ID NO: 4182 - DNA, 1827 bp, Saccharomyces cerevisiae
atgagtgataaaaacagtcgtatcgctatcgttagcgctgataaatgtaaaccaaaaaagtgtcgtcaagagtgtaaacgttcgtgtcccgttgtgaaaactggtaaattatgtattgaagtcactccaacttcaaaaatcgcattcatttccgaaatcttgtgtattggttgtggtatttgcgttaagaaatgtccatttgatgctattcaaattatcaatttgccaactaatttagaagcccatgtaactcaccgttactctgccaatagtttcaaactgcacagattgccaacaccaagaccgggtcaagtccttggtttagtcggtaccaacggtattggtaagtctaccgccttgaaaatcttagccggtaaacaaaaacctaatttaggtcgttttgatgatcctcctgaatggcaggaaattattaaatatttccgtggttctgaattacaaaattacttcaccaagatgctggaagatgatatcaaggctataatcaaacctcaatatgttgataacattcctcgtgctattaaaggtccggttcaaaaagttggcgaacttttgaaattgagaatggaaaaaagtcctgaagatgtgaaacgctacatcaaaattttacagttggaaaacgttttgaaaagagatattgaaaagttatctggtggtgaactgcaaagatttgccattggtatgtcatgtgttcaagaggctgatgtttatatgttcgatgaaccttcatcttatttggatgttaagcaacgtttgaatgccgctcaaattattagatctttactagctccaactaaatacgttatttgtgttgagcacgatttgtcagttttggattatctttccgatttcgtttgtatcatatatggtgttccatctgtttacggtgttgttacattaccagcctctgtcagagaaggtatcaacatattcttggacggtcatattcctgctgaaaacctgagattcagaactgaagctttacaatttagaatagctgatgctaccgaagacttgcagaatgactctgctagtcgcgccttctcttacccaagtttgaagaaaactcaaggtgattttgttttgaatgttgaagaaggtgaattctccgattccgaaatccttgttatgatgggtgaaaacggtaccggtaagaccactttgatcaaattactagctggtgctttgaagccagatgaaggacaagatattccaaaattgaatgtttctatgaaaccacaaaaaattgcaccaaagttcccaggtactgtcagacaattgtttttcaagaaaattagaggacaattcctaaatccacagtttcagactgatgtcgttaaacctttaaggattgacgatattattgatcaagaagtccaacatttgtctggtggtgaattacaaagagtcgccatcgtcttggcattgggtatcccagcagacatatacttgattgatgagccatctgcctacttagattccgaacaacgtattatctgttctaaagttatcagaagattcatcttacataataagaaaactgcgtttattgtcgagcacgatttcatcatggctacttatcttgctgataaggtcattgtttttgaaggtattccttccaagaatgctcacgcaagagcccctgaatctttgttgactggttgtaacagatttttgaagaatttgaatgtcaccttcagaagggatccaaactccttcagaccaagaattaataagctagattcccaaatggataaagaacaaaaatcatcaggaaactactttttcttggataacaccggtatttaa

SEQ ID NO: 4183 - DNA, 1827 bp, Saccharomyces cerevisiae
atgcacactaactcacccttacgagcggataaccaagatctagaaactcaaccactgttgagaccaaacactgaagaaagccaactcctcaatgatgaagtgagaatcaacgttgcaaatgagacccttattaaatctcgttggcggagtataaagtgcttaattatatatctgctaggtattgttttattaagtttctttggcgtcagcatagtgcagtatattaggggacatgtgccgcccacagatgtgatagaaaagaatctagttcaagtaacaaatttcaaactggtggagtttcagcttgatggttggaaagataatatgggctctgacctgaacaatgatacaggtaagtatttgcaggtgtctatacactctcaaatttggttcgattatgacaaatggccaggaacggaaaatgactcggacgccagaagccaacgtgactggatacggtacatcaatgaaaaagttcttaaaaccatttgtatagatctgaataacgtgaccacattcgatggagatctagtgttcaagaataaactgggagatgttgttggcatggaacccatttgttttaatttggctcaccgacagattaataacctacagttcaaaattttagttaaaccgtctatttggaaaatcgtaaaagttttgaaaaaattttggaatagggattttgaatccttaaatataaaatcgaatttagatatgactatcttcaagagaaaatttggcacgaggtttaatttattgaaacttaatgacgaaatcttagattggaaagatattattgattgggaaaaaatatcggcaacgccccttcggatgattcaaaatatgatcgatggaatatctcttcaaggatttacattgcgggactccagttctgatggatttcatgccgatatgagactgaatccgatcacgattcttggaggggtggactggcttcaccttccgccaggcacgtcaatccctttcatcaattgggaaatcaagctaccggactgtaacggtgagcctgctatcgcaattccaaccttgtcttgctttaacgaaccgattaatctgcaccacgacaaggataatatcgtcgtctgtttacaaaatgaaattgaaggtcctctgcccgatgaactactataccaagaatgtcctcaaaatagtcttacaccaatgagccaaatagtgaatgcggtcctgaaccagaacgagactgttacgttcgcagcaagaggccatgtccttgaagatggtatagataataactcattgattccagcagacatgctggaggatattttccaagaagcatcgtttattcccattactaccaatgctacgtttaactccagtgaattgattcaagagtttcagatcaacgatcttcagctacggtgggcagcgcgcaaaaagctcagtcttgtggggacatttttaggattctttgatctatccttctacgagacgcaccagcaagaccgagttcgcatcgataccattcggggacagatcgatctgtaccataacgacatcaatttcttaaacttacccatgaagcaatggatcaactcttcatcgcacattctgcacgatgaggacacaggaaatacgcagatgaagcttcaatttgatctagaaaatgacgacatggaagtcgtcaatagcttggaactaacacgaaccctgaacgaaatactattccagggttttacagttattcactttaatgcgacgatagatgcgtcacttacgacggcattgggcccgtgggttctcaccgggttagccggagagggtgacactttggtcacgtga

SEQ ID NO: 4184 - DNA, 1827 bp, Saccharomyces cerevisiae
atgtttaaccgtaccactcaactgaaatccaagcatccctgttccgtgtgtacgaggcgaaaagtcaaatgtgatcgtatgataccgtgtggaaactgcaggaagagaggacaggactccgaatgtatgaaatcaacaaaactaataacggcttcatcttccaaggaatatctccctgacctattgttattctggcaaaattatgaatattggataacgaatattgggctgtacaaaacaaaacaaagagatcttactagaacaccagctaatttggatactgatactgaagaatgtatgttttggatgaattatcttcaaaaagaccaatcattccaattgatgaactttgctatggaaaacttaggtgctttgtattttggttccattggagatatcagtgaattatatttgagggtggaacagtactgggatagaagggcagacaagaatcacagtgtagacggcaaatactgggacgcactaatatggtctgtctttaccatgtgcatttattatatgccagtcgagaagttagcagaaatattttcagtatatcctctccatgaatatttgggtagcaacaaaaggctcaattgggaagatggtatgcaattagtcatgtgccaaaattttgcacgctgctcattattccaattgaaacaatgtgatttcatggcgcatcccgatataaggctcgttcaagcatatctgattttagccactacaactttcccctacgatgaaccgttgttggcaaattcgctcctaacacagtgcatccatacctttaaaaattttcatgtggatgactttagacctttacttaatgatgaccccgttgaaagcatcgctaaagtaaccttgggaagaatattctatcgcctgtgtggatgcgattatcttcaatcggggccacgcaaaccaattgcacttcatacagaagtatcctccctattacaacatgcagcatatttgcaggatttgcctaacgttgatgtttacagggaagaaaacagcacagaggtcttgtattggaaaatcatctcattagacagagatttagatcaatacttgaacaagagttctaaacctcccttaaaaacattggatgctataaggagggagctcgatatttttcaatacaaagtagattcgttggaagaagattttagatcaaataacagcagatttcaaaaatttattgcactttttcaaatatctactgtttcctggaaattgtttaagatgtatctcatttattatgataccgcagattcactactaaaggttatacattattctaaggtaatcattagtcttattgttaataacttccatgcaaaaagtgagtttttcaacagacatccgatggtgatgcaaaccattacgcgcgtggtctctttcatctccttttaccaaatttttgtggaatcggctgctgtcaaacaacttttagtagatctaactgaacttactgcaaatctgcccacaatattcggttcaaaactagataaactagtttacttgaccgaaaggctcagtaaattaaaacttttatgggacaaggtacagcttctagattcaggtgattcgttttaccatcctgttttcaaaatactacaaaatgatattaagataattgagttgaaaaatgatgaaatgttttctctcataaaaggactcgggtctttggtaccgttgaataagcttagacaagaatcgttgcttgaggaagaggacgaaaacaatacggaaccaagtgacttcagaactattgtagaagagtttcaatccgaatataacatttctgacatactttcctaa

SEQ ID NO: 4185 - DNA, 1830 bp, Saccharomyces cerevisiae
atgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaacccccctaaagacgtctctcataacgaccccaagggagatatcgaagcttccattgcagaggaatagcaatgtatcccatcacctatga

SEQ ID NO: 4186 - DNA, 1830 bp, Saccharomyces cerevisiae
atgaagaattcgacagctgctagttccagatggacgaagagtcgtctctcccatttctttccctcgtacactaatagcagtggtatgggggccgcctcaactgatcaatcttctacgcagggagaagaactgcaccataggaagcactgtgaagaagacaatgatggtcaaaaaccgaaaaagtctcccgtatccacctctacaatgcaaataaaatctagacaggatgaggacgaggatgacggtcgaattgtcattaaaccagttaacgatgaagatgatacatcagtgattataactttcaatcagtcaatatccccttttattattacattgacattcgttgcgtccatttctgggttcatgtttggttatgatactggttacatatcgagtgcgctaatttctatcaatagagatttagacaacaaagttttaacttatggagaaaaagaattaattacggccgccacatcattgggcgctttgattacaagtgtgggcgctggtactgctgctgatgtgtttggaagaagaccatgtttaatgttctccaatctgatgtttttgatcggagcaattttacaaattaccgcgcacaagttttggcaaatggcggccggtagactgattatgggtttcggtgtcggtattggttctttgatttctcctctttttattagtgaaattgctcctaagatgatcaggggtaggttaaccgttataaattccctatggctgacaggtggtcaattgattgcttacggttgtggtgcgggcctgaaccacgtcaaaaacggttggagaatcttagttggtttgtccttgatacctactgttttgcagttttcttttttctgttttttgccggatacaccaagatactacgtaatgaaaggcgatttaaagagagcaaaaatggttctcaaacgaagttacgtaaacactgaagatgaaataattgatcaaaaagttgaagaattatctagcttaaatcaatcgataccaggaaaaaatccaataacaaaattctggaatatggtcaaggaattgcacactgtgccttcaaatttcagagctttgattattggttgtggtctacaagccattcaacaattcacaggttggaattccttaatgtatttctccggtacaatatttgaaactgttggattcaaaaattcttctgccgtttctattattgtctcaggtactaattttgtgttcacattaatagcatttttctgtattgataaaatcggccgtaggtacattttactgattggactacctggtatgactgtggcgctggttatatgtgctatagcgttccatttcctaggtattaagtttaacggtgctgatgcagtagtggcatctgatggattttcatcttggggcattgtcattatcgtatttattattgtgtatgcagccttttatgccctcggtatcggcactgttccatggcaacaatcggaattatttccacaaaacgtcagaggtgtagggacatcctacgctactgccaccaattgggcaggttctttagtcattgcgtctacgttcttgactatgttacaaaatattacaccaacgggtacattttcattctttgccggtgtagcatgtttatcaaccattttttgttacttttgttatccagaactatcaggattggagttagaggaagttcaaacaattttaaaggacggattcaatatcaaagcctctaaagctctagctaaaaagaggaaacaacaggtggccgaaggtgctgcccatcataaactcaaattcgaacctacacaggaaattgtagaaagttag

SEQ ID NO: 4187 - DNA, 1830 bp, Saccharomyces cerevisiae
atgaattctagctatacacagagatatgcactgccgaagtgtatagcaatatcagattatcttttccatcggctcaaccagctgaacatacataccatatttggactctccggagaatttagcatgccgttgctggataaactatacaacattccgaacttacgatgggccggtaattctaatgagttaaatgctgcctacgcagcagatggatactcacgactaaaaggcttgggatgtctcataacaacctttggtgtaggcgaattatcggcaatcaatggcgtggccggatcttacgctgaacatgtaggaatacttcacatagtgggtatgccgccaacaagtgcacaaacgaaacaactactactgcatcatactctgggcaatggtgatttcacggtatttcatagaatagccagtgatgtagcatgctatacaacattgattattgactctgaattatgtgccgacgaagtcgataagtgcatcaaaaaggcttggatagaacagaggccagtatacatgggcatgcctgtcaaccaggtaaatctcccgattgaatcagcaaggcttaatacacctctggatttacaattgcataaaaacgacccagacgtagagaaagaagttatttctcgaatattgagttttatatacaaaagccagaatccggcaatcatcgtagatgcatgtactagtcgacagaatttaatcgaggagactaaagagctttgtaataggcttaaatttccagtttttgttacacctatgggtaagggtacagtaaacgaaacagacccgcaatttgggggcgtattcacgggctcgatatcagccccagaagtaagagaagtagttgattttgccgattttatcatcgtcattggttgcatgctctccgaattcagcacgtcaactttccacttccaatataaaactaagaattgtgcgctactatattctacatctgtgaaattgaaaaatgccacatatcctgacttgagcattaaattactactacagaaaatattagcaaatcttgatgaatctaaactgtcttaccaaccaagcgaacaacccagtatgatggttccaagaccttacccagcaggaaatgtcctcttgagacaagaatgggtctggaatgaaatatcccattggttccaaccaggtgacataatcataacagaaactggtgcttctgcatttggagttaaccagaccagatttccggtaaatacactaggtatttcgcaagctctttggggatctgtcggatatacaatgggggcgtgtcttggggcagaatttgctgttcaagagataaacaaggataaattccccgcaactaaacatagagttattctgtttatgggtgacggtgctttccaattgacagttcaagaattatccacaattgttaagtggggattgacaccttatatttttgtgatgaataaccaaggttactctgtggacaggtttttgcatcacaggtcagatgctagttattacgatatccaaccttggaactacttgggattattgcgagtatttggttgcacgaactacgaaacgaaaaaaattattactgttggagaattcagatccatgatcagtgacccaaactttgcgaccaatgacaaaattcggatgatagagattatgctaccaccaagggatgttccacaggctctgcttgacaggtgggtggtagaaaaagaacagagcaaacaagtgcaagaggagaacgaaaattctagcgcagtaaatacgccaactccagaattccaaccacttctaaaaaaaaatcaagttggatactga

SEQ ID NO: 4188 - DNA, 1830 bp, Saccharomyces cerevisiae
atgccaaattacattttctggccatacgaatccttgttcgagaattccgcagctcaaggacctcaggtagctttggcaatttcatttgagaagacgcattttgttgtcttaggtgtttgcgaacctcagtatttagaagaagtaagcatacggcccccttattcagtggtagctactaagaacaatggagcggagggttggaactacaaagttgctgatccctgtaatgtccattttagaatacccaagctgaaatttatgcaattctattcttctgatcccatctcgctcatcataccagaaaaagaagttggtcttcatagtagtgtgggtgaaactctgaactattctaaattagagcaacatccaagatacaagagagataataagaaattgagtgaaactttgaacatcattaatctattccccgcatattgtaaagcattaaatgagctttacccgtttattcaaacatcacaggaaaatttgaggggtactatgcttaatagtgtcgcagcttggtgttcatctacttgtatttataaaatggtcgcaaaaattggtttttatttgacttttgtgatctgctctattgctagtctcgtatcctcgttattaaattattcgcactttcagttggtaaattactcggcatttgtccagcaaatcgatcttcgttgtcaacaaatttgctatttcccagtacagtatgagcgtattaataagaaggataacatacagaatgttggctctatggtggaaaaagataattctaatagtcaattctcacattcatatatgccttctaaattctatcccgattatattttattgtataatacaatttggcttattattaatgacatttcatttggtttaatattgggggccatacttattgagaatcgagatttcttggtgtcggcatcccatagagtattgaagttttttttatatgattcattaaaaacaataactgaaacgttagcaaataacccccttggcatcaaattaaatgcagaacttgcgaactttttgagcgaattatttctttgggtgatagaattttcttataccacattcataaaaagactcattgatccgaaaaccctatcatctttgctcacgttaacgatatatatgatgtttctcgttggcttttcttttgctgtttccctagcgattgatttttttgcaattttaagttttccaatatatgttttttatcgtatcagcagtaaactgtaccattgtcagttgaatattatggctagtctttttaacctgttctgcggtaaaaagaggaacgttttacgaaataggattgaccataactattttcaactagatcaattgctattgggaacattattatttattattctagtgttcttgactcccacagtgatggcattctatatgtcatacacagttttgagaatgctaacaataactatcgaaatattctcggaagctgtcattgcactcattaaccattttccattgttcgcattattacttaggttaaaagatcctaaacgtctacccggtggcatttcaattgagctcaaaaccacggtttctaacaagcatacaaccttagaacttcaaaacaatcctattaaattcaagagtatgttcagaccatacaatctattgttgtcgcaaatgaggacaaattatttctcgtttgctactgtacgaaagattgtccgaggggagtctataatggtcaatagaaataagctgtactatgttctttattcttcactgcctagtaagccattgagtgtaaaggatttatacaaaaggctgactattcaggcataa

SEQ ID NO: 4189 - DNA, 1830 bp, Saccharomyces cerevisiae
atgctatcttcagaagattttggatcttctgggaaaaaggaaacttctcctgattcgatatcgatacgttcctttagtgccgggaataatttccaatcatcatcaagtgagaaaacttattctaagcaaaaatccgggagtgacaaacttatacatagatttgcggattcattcaaaagagccgagggtagcactacaagaactaagcaaataaatgaaaatacgtctgatttagaggatggcgttgagtctatcacgtcggattccaagttgaaaaagtccatgaagtcgcgccatgttgtcatgatgtctttagggacaggtattgggactggtcttttggtagctaatgcaaaaggtctacattacggtggtcctgctgcgctaataattggttacatcttggtttctttcgtgacgtacttcatgatccaagctgcaggtgagatggcggtaacctatccgactttaccagcaaatttcaacgcatactcctccatattcatttccaaatcatttggattcgccacagtatggctttactgtttccaatggctaacggttttgcctttagagttaataaccgcgtctatgactattcaattttggaatgataaaataaatccggacatttatattcttattttctatgttttcttagtattcattcatttcttcggtgtaaaagcctatggtgaaacggaattcatcttcaattgctgtaaaattttaatgattgcaggtttcattattctttctattgttatcaactgtggtggggccggaaatgacggttatatcggggccacttattggcataatccaggtgcttttgcaggtgacacatcgattggtaggttcaaaaacgtttgctatattttagttactgcttacttctcctttggtggtatggaattatttgcactaagtgttcaggaacagtctaaccctagaaaatctactccggtggcagccaagagaagcatttatcgtatcgttgtgatttatcttttgactatgatcctcattggattcaatgttccatataatgatgaccaactaatgggcgcaggcggatccgctacacatgcatctccctatgtcttagccgcttctattcacggtgtgaaaattgttccacatattatcaacgctgttattttgatttctgtggtttcagtggcaaattcctctttgtatgctggtccaagactgatttgctctttggcccaacaaggctacgcacccaagtttttagattacgttgacagagagggcaggcccttgagagctcttattgtgtgttgcgttttcggcgtcattgcttttgttgcagcttcatcaaaggaagagatcgtgtttacatggttagcagctatcgcaggcttgagtgaattattcacatggacttccataatgttgtcccatctgcgattcagacaagcaatgaaagtacagggaaggtctctagacgagttgggatacaaggccacaacagggatttggggttccatatacggtgtcttttttaatattttagtctttgttgcccaattttgggtagcattggcccccttaggtaatgggggcaaatgcgatgcggaatccttctttcaaaattatttagcttttccaatatggttggccttttacttcggatatatggtttacaaccgtgattttacgctattaaatcccctcgacaagattgaccttgacttccacagacgcatttatgatccagagctaatgagacaagaggacgaagaaaataaagaaaaactaaggaatatgtctttgatgagaaaagcttatcatttctggtgttaa

SEQ ID NO: 4190 - DNA, 1830 bp, Saccharomyces cerevisiae
atggataatattttaaaggcatcaaatatggaagggacttcaacaatgacagttacctcgcgtagttctgaagactctagttgtatctcaaatcatgaacaagataccgatacacataaggacggcgacacaagtggtctggaaaacagtaaaatttcgaagagaaagtggatgaaagagttttttaaactttccaaatctccagcttccaaaagcagccggagtataggttccatgaaaagtaaccagagcctcgtttcaatgaaaagtagtgacgatggcaacagttataaaaatgattactcttctatctgtggtaacagccttccatctgcaggcttgagtcgttcgaatagtgtgaaagaattaaaattagattcaactggaagtcagagatcaaaaaataatgttgccatgttagcacgttcttctacaacatctcagacaacgtgctcttcttcttcatcatcatcttcttataactctataaaaggaaatgaaaatgatattttattgcagaataacaatcactttaggcataacaaagaaattcctcaaagtaaagggagctccaacattaacaccgcatcgattatgagccaatacaatgtcgatacgcaagcaaccgctataatgagcgatatgcaaaagcaatacgactcgcaacagatgacatcaccatttgtaaacgaagacttgcatttcgatccaaatggtgaagtttcacacgtaataaaagcaatttttaaagaaattggttataaatacgatgatttcagtgatattcctgtttttcaattaatgcaagaaatgtatcaactagtgaagaagaattccagcgctagaagaacaaagataacagactatgcctctaaacttaaagaaaaagaagcgcaattaaaaagtcaaaatgacaaaattttgaagttagaaacaacaaacaaggcctacaaaactaaatacaaggaggtctctctggaaaataagaaaataaaagaggctttcaaagaactagacaatgagtcatacaatcacgatgaggaattactaaaaaaatacaaatatactagggaaaccttagatagggtcaatagagaacagcaattaatcattgatcaaaacgagtttttgaagaaaagtgtcaatgaactacaaaatgaggttaatgctaccaacttcaagttctctttatttaaagaaaaatatgcaaaattagctgatagcatcactgaattgaatacctctacgaaaaaaagagaggccctgggagaaaacttaacttttgaatgcaatgaattaaaagaaatatgtttgaaatacaaaaaaaacatcgaaaatatatcaaataccaataagaatttacaaaattcgttcaaaaatgaaaggaaaaaagttttagatttgagaaatgagagaaatttgttgaaaaaggaaatactgttgattgaatgtcatggttcatattctctactccttgtatctaatattctgacatgttatcggttcttactgccaagtgatactattattgaaactgaaagcttaattaaggagctactcaacatgaataattcactttcgaaccatgtgtcttcttctgacgagcctccagcggagtactcgaaaagattagaattaaaatgtgtagagtttgaggaaaagttactttatttctatcaagaacttgtgacgaagaaaattatagacgtcatttacaagtgctttattaattattacaagaaaagtaggcaaactgaccaaaaatccaatcagaactccagcactccgtataaacaaagccaaagacaagttccgcactccatcaagtga

SEQ ID NO: 4191 - DNA, 1830 bp, Saccharomyces cerevisiae
atgtccagcttagccgatacagtagagggtagcgaggccaaacgcggcagattttccaacaatgcattaacctccgatactggtattttacagaaaaatagtacattaagaaactggtttttaaaaccgacagcagacctaaaaaatagttgcgaagatagagttgaagatgacgtcaatgatgtctacttaaatgacaaaaactcacaaaaatctgttgaagaaagaaaactaggaagaaaagttagatcttttttcaaacaaacaaactcaaataaggacgagtctgtgttggaagatgaagatgatgcgttagtttggaagaaaactagcaataagtgtgcaaaaaaggaaaattcccatgacatccaaaaaggaagtttcacaaaaaaaatcagaaacagtattttcaagagtgcaaatgacgtgaaagaattcaggaatgaaaataacttactattgcccgttgaactttcttctgatgatgagaatgagtctcatttcactgatgctaactcacatgttatgcaatcaaaaagtcccgagaaaataccttccaaggatcaatgcttgactaaaggcgctaagaataaaggtctgaaaaaggaatatgaaaaaagttttgaagagtatagcgacgacagtgacgatgaattttctcctgctactccaccggagaatgttcttgaaggtccttacaaatttgtgtttcagacaccaaacacatttacatctcagcctaatataacagtagaaaatgattttcacaaaggtgggagacatgtgattgactatctgaacaaaaaattggctactatgaacattgatattgatttgacttcaggggggaaacaaaacgtatcttgggaggaagagctcgaccaattgagcgaccacgttatagaaagtattactaaccacatttcaaagggtagaatgcacgcacaagagaagcaagatgagttggaaaagttaaaattggagaatttgaacttgtcaacattaaagcaagaaaatctccaacataagcaggaaattaactcattgaaagacaaccttgaatccattagtaaaaaaaacaatgatcttatattggaaatgaacaaattgaaaaaaaaaagtacgaataataaaacaaatgagtacatatctacggatgaaaacgaaaatgaggagattaccaaatccaatatgggtcctggcattttagaactgaacgtcaacgaaacttcaaaaaaattacagcaatccacattcaaaccctcgaaatatcttccaagagaaacgagaaacaatgaaaatagattaaaacacttggaaaagagaatatttggcttagaaaaatctcttgaaaaaaaaaaaaaacaggtaagggctgacagcgttagattagacttgaatagatatactatcgaccagtttttgacattactgaaaagcctcagcgaggttttgcaattccacaatgtttatggcaatgatttgaaggaaaacgacgataatattataaagattgaaacctgctgtagtgcgctaaacatgaaaaattgtttcgaagactcctcatttcgtttacaagaaaacagcttcaagaggcaattgggccctctgttcgcaaacatcaacttctccttaatcgaccaactgacaatgaacttcaggttctacgagagatctgccaatttccagaaggaaacaataggtgggttaagaatgatgctacaagataaggataactatatcaaaacactgatgcaacatttgaagaaaaaagagagtacaaagttgataaaagacagcaagaatggcgcctccaccttaacatcttaa

SEQ ID NO: 4192 - DNA, 1830 bp, Saccharomyces cerevisiae
atgtcgatgttaagaatctggagttgcatcgtacatttcttttccgtgcaggcacttgattcacgaataaagccagacattgaattcaaaaggcgacaaaggatatttatcaattcatctaaagaagagaatggttcatcttctagtgccgttactgttacccgtaaccctgtgctcagctctaatagcccatctcctccgctatggaatacatgggaatttagactatattatttggcgttcaccgtagtagttcctttcatgataaaggcggcattggctacgagctccgagtctaatccaaactactataaattcagcggactgctagcccatggttggattctgggccgcaaagtggataacagcgatcctcagtataggttttttagatccaatttttttttgttggccatcttaatattactacaaattatattaaaaaaggtttttgttaaatttagtaaaattccgaaaacaaaattcgattttgcgtgtggattagtttttgtctgtttcatgtacgggatcaattctgttaagctctttacgcatgcttttattttcttcactttggcacattcgctaaagagaaagcgtttgatagccgcttttgcgatttggtcctatggtatctttacactattcatcaatcaaaaaatgaaaaatctcccctttaataatattgctatcatcctaagtcccatggatcaatggtataagggtatcgttcctcgatgggatttttttttcaattttacattattgcgtttgttaagttactccatggattttttggaaagatggcatgaacaattgagccgccaaccttcgatagattacgatgatagacgacctgaattcagaaaaagtttatctggttctactctacaaaccatttatgagtcaggtaagaatgttctggaggaaaaggaacgactggtagcagaacatcacatccaggattacaactttatcaattttatcgcttatattacttacgcgccattgtttttagtgggcccaattatcacttttaatgactacctttatcaatcagaaaataagcttccttcgctaacgaaaaaaaacataggcttctatgccctcaaagtattttcgagtttgcttttgatggaaattatcctacattatatctatgtgggtgcaatagcaaggaccaaggcatggaacaatgatacacccttgcaacaggctatgatcgcgctgttcaacttgaacattatgtatttaaaacttttgatcccatggaggctctttcggctgtgggccatggtcgatggtattgatgcacctgaaaatatgctacgatgtgtggataataattatagtacagtgggattctggagagcctggcatacaagttttaacaagtgggtaatccgttacatctatgttccatttggcgggtccaataacaaaatattaacgagctttgccgtattctcatttgtagcaatatggcatgacatccaattacgagtgttgttttgggggtggttaacagtccttttattattaggcgaaacctacattactaactgttttagtagatatagattcagaagctggtacaggtttgtttgcggtatcggtgctgcaataaatatttgcatgatgatgattattaatgtctatggattttgcttgggtgcagagggaacgaagcttctattgaagggcatatttaacaattcacatagtccggagtttttgactgcggtaatggtaagcctatttattgctgttcaggtaatgtttgagattagagaagaagaaaaaagacatggcatcaacttgaaatgttga

SEQ ID NO: 4193 - DNA, 1833 bp, Saccharomyces cerevisiae
atgacggagactaaggatttgttgcaagacgaagagtttcttaagatccgcagactcaattccgcagaagccaacaaacggcattcggtcacgtacgataacgtgatcctgccacaggagtccatggaggtttcgccacggtcgtctaccacgtcgctggtggagccagtggagtcgactgaaggagtggagtcgactgaggcggaacgtgtggcagggaagcaggagcaggaggaggagtaccctgtggacgcccacatgcaaaagtacctttcacacctgaagagcaagtctcggtcgaggttccaccgaaaggatgctagcaagtatgtgtcgttttttggggacgtgagttttgatcctcgccccacgctcctggacagcgccatcaacgtgcccttccagacgactttcaaaggtccggtgctggagaaacagctcaaaaatttacagttgacaaagaccaagaccaaggccacggtgaagactacggtgaagactacggagaaaacggacaaggcagatgcccccccaggagaaaaactggagtcgaacttttcagggatctacgtgttcgcatggatgttcttgggctggatagccatcaggtgctgcacagattactatgcgtcgtacggcagtgcatggaataagctggaaatcgtgcagtacatgacaacggacttgttcacgatcgcaatgttggacttggcaatgttcctgtgcactttcttcgtggttttcgtgcactggctggtgaaaaagcggatcatcaactggaagtggactgggttcgttgcagtgagcatcttcgagttggctttcatccccgtgacgttccccatttacgtctactactttgatttcaactgggtcacgagaatcttcctgttcctgcactccgtggtgtttgttatgaagagccactcgtttgccttttacaacgggtatctttgggacataaagcaggaactcgagtactcttccaaacagttgcaaaaatacaaggaatctttgtccccagagacccgcgagattctgcaaaaaagttgcgacttttgccttttcgaattgaactaccagaccaaggataacgacttccccaacaacatcagttgcagcaatttcttcatgttctgtttgttccccgtcctcgtgtaccagatcaactacccaagaacgtcgcgcatcagatggaggtatgtgttggagaaggtgtgcgccatcattggcaccatcttcctcatgatggtcacggcacagttcttcatgcacccggtggccatgcgctgtatccagttccacaacacgcccaccttcggcggctggatccccgccacgcaagagtggttccacctgctcttcgacatgattccgggcttcactgttctgtacatgctcacgttttacatgatatgggacgctttattgaattgcgtggcggagttgaccaggtttgcggacagatatttctacggcgactggtggaattgcgtttcgtttgaagagtttagcagaatctggaacgtccccgttcacaaatttttactaagacacgtgtaccacagctccatgggcgcattgcatttgagcaagagccaagctacattatttacttttttcttgagtgccgtgttccacgaaatggccatgttcgccattttcagaagggttagaggatatctgttcatgttccaactgtcgcagtttgtgtggactgctttgagcaacaccaagtttctacgggcaagaccgcagttgtccaacgttgtcttttcgtttggtgtctgttcagggcccagtatcattatgacgttgtacctgaccttatga

SEQ ID NO: 4194 - DNA, 1833 bp, Saccharomyces cerevisiae
atgagtgaaagtggtcaagaacaaaacagaggcacaaatacatcaccaaataatgctgaaaataataataattcaaatgcagcttccggtccactcaatggtggtgctgagcaaacaagaaacataaccgtttccattcagtattcctatttcactccggagagattagcacatttgagcaatatatctaataatgataataacgaaaacaacagcgcagcatccggtagcacgattgccaacggtactgggcccagctttggcatcggaaatgggggccatcaacccgacggtgctcttgttttatcttttcgtgatgttcctgcgtctactccacaagaccgtttgaacagcttcatatctgttgctgctcagcttgcaatggagagattcaacagactattaaatagaccaaaaggaatatcaaaggatgagtttgataagctccccgttctgcaagtttctgatctacccaaggccgaagggcccttatgtagtatatgttatgacgaatatgaagatgaagttgattcaactaaagcaaaaagaaaaagggattctgaaaatgaggaggaatctgaaggaacaaaaaaaaggaaggataatgaaggtgcgcccctacgcacaaccgccgataatgacagtaacccatcgattacaaatgctacggttgttgaaccgccttctattcctctcactgaacaacaacgcactctcaatgatgaagaaacaaatccaagctacaaacactcaccaatcaagttaccttgtggccacatttttgggagggaatgtatctacaaatggtcaagattagaaaattcttgtcccctttgtagacaaaagatcagcgaatctgtaggtgttcaacgtgcagcccaacaagatacggatgaagtagcagctaacgaagctgcttttgaacgtattagacgagttttatacgacccaactgcagtgaatagcactaacgaaaatagttccgccccatccgaaaacacgtccaatacaacggttcccactatcggaaatgcaagttctggcgaacagatgttatcaagaacaggcttttttttagtgcctcaaaacggccaacctttacacaatccagtccgtttaccgcctaatgatagcgatagaaacggtgtcaacgggccgagctcaactactcaaaatccaccctctaattctggtggttcgaataacaatcaaagtccgcgctgggttcccatccctttgactttgttccaattccacagtccaaatccgaatccttccgcttctgattcttcggcaagcccatcagcagcgaacggtccaaactcaaataacactagtagtgacgctacagaccctcaccacaacagactaagagccgttttggatcacatattcaacgttgctcagaggggaacttctgatacctctgcaacaacagcacccggagcacaaactgttcacaaccaaggacgtaatgactcatcgtcctctgatacaacgcaaggaagttcctttttggaaaatatttcacgattaacaggccattttacgaatggctcaagagacaacaataacgacaataaccatagcaatgatcaacaacgaggtggaagtactggtgagaacaacagaaataacttgttttcctccggtgttgccagttatagaaatcaaaatggtgatgttactaccgtcgaactacgcaacaacaattctgctgcctttcctcctacagacgaaaatccctctcaaggccaaggttcaagcagttcggacaccaccattcataacgacgtccctaatgataacaatgagcaacgatcatcacaataa

SEQ ID NO: 4195 - DNA, 1833 bp, Saccharomyces cerevisiae
atgatcctcacactggcctatttcatgctgggcactctactactgggtgtgttcgcagaagacacggtgtcgcagattggtataaatgacagtttatggtatccgtacgacgaagcactggtgttgaagccgctgcccaacaatgatctgctactctcatttgcattccaactgcaatcggaaccgtttgacccggccgtatcatccatgtcatatgatgcgtatgagcactacacgactttcccacgggccatcccaccattgttggaatctactgccacgcgtcagtttcatttaagatttaccagaggattctgggatgccctgtcgtggggacagttgccacatgctggaaaagaggcaggtgcctcaggtgtggaattgtggtcgcaagtgcaggccatggatcaggaacaggcgttccataattggaaaaaactgtccaattcattgagcggattgttttgttcttctttaaattttatcgacgagtcaaggacgacctttccccggcggtcatatgcttctgatataggagctcctcttttcaatagcaccgagaaactgtacctgatgcgagcatcgttgcccaatgaacccatctgtaccgagaacttgacgccgttcataaaactattgcctactaggggcaaatccggtttgacatctctcttggatggtcataaattgttcgactctctatggaatagtatttccttggatattgccactatttgttctgaagatgaagatgctctttgtcactacgagatggacgcacgcatagaaatggtaacacacgttccctccgccttggcaagaggtgagagacctatccccaaacctttggatgggaacacattgcgttgtgacacggataaaccctttgattcttaccaatgcttccctctaccggaaccttcgcagactcacttcaagctgtctcagctgtttgccagaccaataaacaatggcaacctgtttgctaataggcccacaagaatttgtgcagaagttgaccgttctacctggactgcgtttttgtcagttgacgatactattttcagcacacatgataattgctttgacttatcaaacgatcaaaatgagggtggttcgggctacgactttattttagaatcgacggacactactaaagttactcccatagttcctgtcccaattcacgtaagcagatctctgactggtaatggacaagatcgtggtggaatgcgtattgttttccataacgacaatgatacccctgtgaagttgatttatttcgaatcattgccatggttcatgagagtttacctatcctctcttcaaattacttctactacctctccgcaattgcaagaaaacgatatcatcttagataaatactatttacaagcggccgatagaaaaagacctggccacttggagttcacgatgttaattccagctaatacggacattgtaatgacttatcaattcgataaagctcttctgcaatttgccgagtatccaccagatgcaaaccatggttttgaaatcgatgcagctgtaatcaccgtgctatctttggagtcctcatcgtctctttatgaaatgagaacctctaccctattgttatccctgtctacaccggattttagtatgccgtataacgtcatcattctaacatctacaatcatgggactcatattcggtatgctatacaatttgatggtgaagagaatggtcaccgtcgaagaggccgataagattacgttgcaatctggcttaaaatacaaattgctaaagctaaaggaaaagttcctagggaaaaaaaagactaaaacagactaa

SEQ ID NO: 4196 - DNA, 1833 bp, Saccharomyces cerevisiae
atgccaccagtatctgcgtcaaaggccaagagagatgctaagaaagctgaaagagaggctaagaaagccgctgccggtaaaaccatcagaaagctaggtagaaaaaaggaggctgctgctgaagaatcggaggtagatgcagccgctagagaaatcaagatgatgaagttgcaacaagataaggatggtctttcagatcgtgttgtcactggtgttttgagttcattggagacttcccgtgatatcaagctatcttctgtttctttactgttccacggtaaagttttgatccaagattctggtttagaattaaactacggccgtagatatggtcttctgggagaaaatggttgtggtaagtcaacattcttaaaggctcttgctactagagaatatcctattcctgagcatattgatatttatttattggacgaacctgcggaaccaagtgaattgtcggccttggactacgttgtcactgaagctcaacacgaattgaaaagaatagaagacttagtcgaaaagactatcttggaagatggtcctgagtccgagttattagagcctctatatgaaagaatggactctttggatccagacacctttgaatctagagctgctatcattttgatcggtctaggtttcaacaagaagaccattttgaagaaaaccaaagatatgtctggtggatggaaaatgcgtgttgcgttggcaaaagctcttttcgttaagccaactctattattgttggatgatcctactgcgcatctggatttggaagcttgtgtttggttagaagaatatttgaagagatttgacagaactttagttttggtgtcccactctcaagatttcttgaacggtgtttgtaccaatatgattgacatgagagctcaaaaactaactgcttacggtggtaactatgattcttatcacaagacaagatccgaattggaaaccaatcaaatgaaacaatacaataaacaacaagaggaaatccaacatattaaaaaattcattgcatctgctggtacttatgctaacttggtgaaacaagctaaatctagacaaaaaattttggacaagatggaagcagatggtttagtccaacctgtcgtccctgacaaagttttctcatttagattcccacaagtggaaagattgccaccaccagttttagcattcgatgatatttcatttcattatgagagcaacccatccgaaaacttgtacgaacatttgaactttggtgtcgatatggactcacgtattgcccttgtcggaccaaatggtgttggtaaatccacattgttgaagattatgaccggtgaattgaccccacaatctggccgtgtttctagacatacccatgtcaagttgggtgtctactcgcaacactctcaagatcaactggacttgacaaaatctgctttagaatttgtccgtgacaagtactctaacatctcacaagatttccaattctggagaggccaactaggtcgctacgggctaaccggggaaggtcaaaccgttcaaatggctaccttgtcagaaggtcaacgttctcgtgtcgtctttgctttattagctttagaacaaccaaatgtcctactattagatgaacctaccaatggtttggatatcccaaccatcgactccttggccgacgccatcaacgaatttaacggtggtgtcgtcgtcgtttcgcatgatttcagattattagacaaaattgcccaagatattttcgttgtggaaaacaagaccgctaccagatgggacggatccattttgcaatataagaacaaattggccaagaacgttgttttgtaa

SEQ ID NO: 4197 - DNA, 1833 bp, Saccharomyces cerevisiae
atgccagaaagctctagagataagggaaatgcagcaattagcggtaaccgttctgtactttctattgcgtccccaacaaagctaaacatactatcttccgattggtccagaaaccaaggtaaagtttctaaaaattcgctaaagagatcaagttcactgaacattagaaactccaaacgtcccagtttacaagcctctgccaattctatttattcaagacctaagattacaattggggcaccaccgttaataagacgagattcttcatttttcaaagatgaatttgacgctaaaaaagacaaagcaacgttttcggcatactcttctcgttcatatccaacaattggatctgagagcgtagtttcccaaacatctttatcgcaaccgacaacatctagagaagttgatgagcaatttacagtagctgcggatagatatattccaattctacagggagcttcgcaaaacaaggtcgatcctgaaaccttacacgaggcattacctccgccaaacgcgtcgccaatttcacacttaagggcccagactaagattgtcttcaaacaaaatgtagctgaagcgtgtgggttagatatgaataaaagaatactacaatacatgccggaaccaccaaaatgctcttccttgagacaaaaaagctatatcatgaagaaaagaacacattatagttatcagcaggaacaaaaaattcctgatttaattaaattaaggaaaatcaataccaatccggaaagaattcttgatgcacctggtttccaagacgacttttatttaaacttgttaagttggtccaaaaaaaatgtcttagctatagcactagacactgcattatatctgtggaatgccaccactggggatgtttccctgttaacggatttcgaaaacaccacaatatgcagcgttacgtggtctgatgatgattgtcatatctctatcggtaaagaggatgggaacaccgaaatttgggacgttgagaccatgtcattaattagaactatgagatcaggcttaggtgtccgtatcggttcattgtcttggttagatactttgatagctacaggcagtcgtagtggagaaattcaaatcaatgatgtcaggatcaaacagcatattgtatctacatgggcagagcacacaggcgaagtctgcggtttgagctataaaagtgacggattgcaacttgcatctggtggtaatgataacactgtaatgatttgggataccagaacgtccttgcctcaattttccaagaagacgcatactgctgctgtaaaagcactaagctggtgtccatattcgccaaatattctagcctctggaggcggacaaacagataaacacatccatttttggaacagtatcacaggtgcacgagttggctcaatcaataccggatcccaggtgagctctttacattggggccaaagtcatacgtcaaccaatggtggtatgatgaataaagagattgttgccacaggaggtaatccagagaatgcaatctctgtttataattatgaaacaaaattcaaagttgcagaagtagttcatgctcatgaagcaagaatatgctgttctcaattgtcccctgacggaaccacattggccacagtgggaggagatgaaaacttaaaattttataagatatttgatccaagatgtacaggaagatcgagagaagacggattgatggatggtatgctaggacttattggcaaggaaggttgtcgaacaaatgataaggagaatcgttccaaaaattcgagtgagattcatacaaggaggccctctagtaccagccaatatttgatcaggtga

SEQ ID NO: 4198 - DNA, 1833 bp, Saccharomyces cerevisiae
atgcttaaaataaaggcccttttctcgaaaaagaaaccggatcaggcagatttgtctcaggaatctaaaaaaccattcaagggtaagaccaggtcaagcggtacaaataacaaagatgtttcccagattacttcttcccctaagaaaagctttcaggacaaaaatatagttcagtacccgagtgttgtcgcagatgaccatcatatgaagtctttaaccgatgaattagtaaccacgatagactcggactcttcaccgagtgataatattaccacggaaaatgtggaaacagttacttccgtgccagctatcgatgtccatgaaagtagtgaaggtcaattaagttccgaccccttaatatctgacgaatctctttcggaacaaagcgagattatcagtgatatccaggatgacagtactgatgatgacaatatggaagatgaaattccggaaaaatccttcctcgaacaaaaggaattgataggttacaagctgatcaataaaatcggtgaaggtgctttttcaaaagtctttagagccatacctgctaaaaatagttctaatgaatttttaactaaaaactataaagctgttgccattaaagttatcaaaaaggcagatttatcctcgattaatggtgatcatcgtaagaaggacaaagggaaggacagcactaaaacttcttccagagatcaagtcttgaaggaagttgcactacataagacggtttccgctggttgttcacaaattgtcgcgttcatagacttccaagaaacagatagctattattatattattcaagagttactaaccggtggggaaatcttcggcgaaattgttaggttgacctatttcagtgaagatttatcaaggcatgtaatcaaacaattagcactggctgttaaacatatgcattcactaggtgtagtgcatcgtgatataaaacctgagaatcttctttttgaaccgattgaattcacacgctctataaaaccaaaattgaggaaatcggatgatccgcaaacaaaggcagacgagggaattttcacaccaggagttggtggtggtggaattggtatagtaaaactagctgattttggtttgtctaaacaaatattttccaagaacaccaagactccttgtggtacagtcggttacactgcccctgaagttgtcaaagatgagcattattctatgaaagtggatatgtgggggattggttgcgttttgtacacaatgttatgtgggttcccgccattctatgatgagaaaattgacactttaactgaaaaaatatcaaggggtgagtatacctttctgaaaccttggtgggatgaaatcagcgccggtgccaagaatgccgtggctaagctattagaactagagccgtctaaaagatacgacattgaccagtttttggacgacccatggttaaatacattcgattgtttaccaaaggagggcgaatcttcacaaaagaaagcaggtacttccgaaagacgccatccgcataagaaacaattccaactatttcaaagagactcctcgctactgttttcaccagctgctgttgctatgcgtgacgcctttgatattggtaatgctgtgaaacgtaccgaagaagaccgtatgggaacacgtggaggattaggctcgcttgctgaggacgaagaattggaagatagttacagtggcgcccaaggcgatgaacagctggaacaaaatatgttccaattaacgctggatacgtccacgattctgcaaagaagaaaaaaagttcaagaaaatgacgtagggcctacaattccaataagcgccactatcagggaatag

SEQ ID NO: 4199 - DNA, 1833 bp, Saccharomyces cerevisiae
atggtacgcaaaggctcaaacagaactaagacctctgaagttggggatgagattaatccgtatggtttaaacgaagttgatgattttgcttctaaaagggaaaaggttttacttggacaatccacctttggcgacagtaataaagatgatgaccattctctgttagaagacgaagatgaggaagaagtcttagccatggatgaagatgatgagtcaatagatgaaagagaagatgaggaagaagaagaggaagaggaactagatggtgctgcagcctataagaaaatatttggtagaaacttagaaactgaccagcttcctgaggaagatgaagagaatggtatgttagacaacgagaatgcctgggggtccacaaaaggagaatattatggggctgatgatttagatgatgacgaagctgctaaggaaatagaaaaggaagctttacgacaacaaaagaagcatctggaagaacttaatatgaacgattacttagatgaagaagaagaagaagagtgggtcaaaagtgccaaagaatttgacatgggtgaatttaagaactcgaccaagcaggctgatactaaaacttccataacggatattctaaatatggatgacgaagcaagggataactatttaaggacaatgtttcctgaatttgctccactttcaaaagaattcacagaattagctccaaagtttgacgaattaaagaaatctgaggaaaatgagttcaataaattaaagctaattgcacttggaagttacctaggcacaatatcatgttactatagtatcttgttgcacgaactccataataatgaagatttcacatctatgaagggacatccggtcatggaaaagattttaacgacaaaagagatttggaggcaagccagcgaattgccatctagttttgatgtgaatgaaggagatggttctgaaagtgaagaaaccgcaaacattgaggcctttaacgaaaagaagctgaatgagttgcaaaacagtgaagattctgatgcagaggatggaggaaaacaaaagcaagaaattgatgaagaagaaagagaaagcgatgaagaagaagaagaagaagatgttgatattgacgattttgaagagtacgtagcacaatcacgtctgcattctaaaccgaaaacatcatcaatgcctgaagctgatgatttcattgaatctgagattgctgatgtggacgcacaagacaaaaaagctcgtagaagaactttgcgtttctatacttcgaaaattgatcaacaagaaaataaaaagacggatagattcaaaggtgatgatgatattccatataaggaacgtttatttgaaaggcagcaacgtctgttggatgaagctcgtaaacgtggtatgcatgataataatggtgctgacctagacgataaggattacggttctgaagatgaagctgtgtctaggagcatcaacactcaaggcgagaacgattattatcaacaggttcagagaggtaaacaagacaagaaaatatctcgtaaagaggctcataagaatgctgttattgctgcaagggaaggaaaattggcggaattggctgaaaatgtctcaggtgatggtaagcgtgccattaattatcaaattttaaagaacaagggtctaacgcctaaaagaaacaaggataacagaaactctcgtgtcaagaagagaaagaaataccaaaaggcacaaaagaaactcaagtcggttcgtgcagtttattctggtggtcaatctggcgtctatgaaggtgaaaagacaggtatcaagaagggtttgacgaggtctgttaaattcaagaattaa

SEQ ID NO: 4200 - DNA, 1836 bp, Saccharomyces cerevisiae
atggagatattcaaggaagaagaagaagaagctttttcggcgatagaaggtataatatatgcctgtgaggtgtatgaccctgtaccccgtcatttacataaaagcaaaacaaagatcatcaatgctgctaaattaattatagaaacgcatctttcatattatacaatactcaataacatttcagatatacaagcctatctttctacttggcttagggatcttggaacgacaggtccataccaaacaattctttcagaaagtatttctctcatgtttgaccgcactgtatctatcttcaggaaatgtacgatagagggaggttttccacatttgatcgcacgtctttatctcagattgaaaagctaccagaagctcttaaacgatgcaggattaaagaattttttttcaagctacgattatgctttcggggttgcatacaaccttgtaaattgctctgaatacaggtatgacgaagttcattacatatcgaacggcacttactcattagttgcatcgatgaagatagatcctgctgaagtcattaaaagggaacattttaggcttacaattccgaaatttaacatatctaatatattaattgaaatttttcatttgctcgatggattagcattttttaaggtgaaccctgatagtttatctatatctacagcttcagcagaaacaatctttcgcagtatctccgaaggtaatcatcaggtcctagaattggggagaagtttaatgtttccattgttgaggactggagattttgaaatctgtcgtattgacgacgcgggagctgtcataacatttacagaagcgaaggatgtaaaactagaaataatcagtctggatgaagtttcctgggtaatgcagtggaaatcttgtcttcaaaattatgagagaagggcagcaaatgacagttcatttatcaaaacacacctacaatttaagaaggccaacaatttcaatgaagataataatgggctaggactaattgtagacagaaatattccaacagatgattttacgctagcttctacaaaccgtcaaagtcccccgccttcaaatactggttgttcattacacaggtctaaacccttgcatatccctttatcatctgttattcgtgaagacttttatgatagctctctaaatgagcgtatatctaaagacggagatagcagttgtgaatccttcagtggcgccgaaagtatcttatcagactacgattttcatgataatgaattttttaacaaccagtcacctcattatttttcagaacacatagacaataactcgagagaggtggtaataacagatgaaaatacgataatatctttggaaaatacccaagtaagtcggtggtcaaattactcatggcaaaaaatttcaccgcatcaattacaggtctctattatccaactgcgcatgggaaacttcattgtggcttatgattctgattataaccttcatcagttcaaaattcgtttgtgtgacgatataaaatgtatacaatccacagagcaagacatacaaatacgtgtcccgctcggcgcaataatgtgcagcgtcactggtatcttgaatattaggacgaaggacgctgacaagttgcttcgggtattaagcttttataccactgaccacacggaagctgtatcgcactcaaacaatcaagatgctactgcaagtccactttcgtcagtttcatcagcaatggatctcaagcattcattacagaaatgttcctctacaataatgccccaagagttgacgcaggacgtcatcggttcaaaatcagacctaatcagtaatattcgtcaaaaaatataa

SEQ ID NO: 4201 - DNA, 1836 bp, Saccharomyces cerevisiae
atggcgcgtcaaaagcttactttcaaagaacaaatggatggtttcccctgggtccaacttgttgttgtgtccttagttaggttcagcgaaccaattgcgttttcgtcactatttccttatgtttatttcatggttagagattttaatattgctcccaatgatgctcaagtgtccaaatattcaggttatttatcttcatcatttgcgttatgccaagtcatatctgcgtaccactggggtagattctctgaaaagcatggcagaaaaataacattgacttgcgggcttataggaacatctgtatcattgttaatactgggattttcacgcaatttctatcaggctttggtggcaagaagtttaatgggattgctaaatggtaacgtcggcgttattagaaccattattggtgaaatagcaactgaaagaaaacatcaggctttagctttcagtactatgcctttattatttcaatttggtgccgttgttgggcctatgatcggtgggtttcttgtatttagagatggaacaatgaatgaagtgccactatggtttccacattttgcaaaaagaataattaggtcatatccgtacgccttgccaaacgtggtagtgtgcatgtttttgatgtttggtttaactaatgcaacattgtttttggaagaaacacatcctgcttttaaagatagaagagattacggtttagaggtcggtgattttattaagaagaatatatttggtatacagccgaaaagaagaccctggcaaaagcgcattcaggatgattcggaaaacattcaccaccgtaatgagaatgtgaacagcattcgaggacaagatagtgaagaggatgaaaatagtcccctagtgaatactaccaatgacgatgatactgaaagcatacaatcgattgatcctattttaacaagaagacagtctgtaggcctgattaggacatattctctgcatgaaccaacagacgctgtgcatgccaatatagatacagctccagacggttgtaaagaaagtagtatatttcatcacgtttttcatacaaaagtattttaccctatatcggtgaattttattatggctttacatttgattgtatacaacgaatttttgcctgtttttttagcttatgatttagccgtagatccagaaaatccaaagaagctggcttcaaaatttccgtggaaaatatctggcggtataggttatgaaccagaacaaaccggtactcttttgtcgacaacaggtatctttggttgttttgtggttattttcatttttcccatagttgatcgaaatttcgattgtttaacaattttcagaactttagtcaagctgtaccctattatgtacgttatggttccttacgttgtttttctacagaatgaacggattcctagctggtatactgtcgtctacttgtacataatcacagggataaaaacattttgtggcgctttaacgtcaccacaaattatgttattaattcataattcgagtcccttgagttgtagatcagtcatcaatggcgccaccattagtatttctgcctctgctcgtttcataggtcccttagtatggggctatattatgtcttggtcccagcaaaatgacgtcgcctgggtcagttggtggtcgttaagtcttttttgtatggtagctctttatcaaagttataagatagcaccaattgatgataacgaaaatgagcttcatggacagggtagtgaagatgcctacaattcgcagtcacagtcttctgatttaagaatggctcatcgatctagtttaagcagcttaagtaaccaacgctgtaccacatga

SEQ ID NO: 4202 - DNA, 1836 bp, Saccharomyces cerevisiae
atggcttacagtgactacagcgatggagcagacgacatgccggactttcacgacgaaggtgaatttgatgattatttgaatgacgatgaatatgatctaatgaacgaggtatttcctactctaaaggcgcagttacaggattaccaaggctgggataatctttcacttaagctagctttgtttgacaacaatttcgatttggaaagcacgctggcggaattgaagaaaactttgaagaagaagaagacaccaaagaagccaattgctgctgctaatgggagtgcgaatgttactcaaaaactggcaaacatctcaatttcgcaacaaaggccaaatgatcggcttccagactggcttgacgaggaagaaagtgagggtgaacgcaatggtgaggaagccaatgatgaaaagacagttcaaagatactataagactacggtgccaacgaaaccaaagaaacctcatgatatttctgcatttgttaaatctgccttacctcacttaagttttgttgttcttggtcatgttgatgcgggaaaatcaactctaatgggcagactactttatgatctgaacattgtcaaccaatcccaactgagaaagctacaaagagagagtgaaactatgggtaagtcatccttcaaatttgcatggattatggatcagacaaatgaagagcgcgaacgtggtgtaacagtgtcaatttgtacatcgcatttctctacccatagggcaaattttactattgtggatgcgccaggccatagagattttgttccaaacgctataatggggatatcacaagcagatatggctatactttgtgtagactgtagcaccaatgctttcgaatcaggatttgacttggatgggcaaacaaaggagcatatgctactggcatctagtcttggaattcacaatctgattattgctatgaataagatggataatgttgactggtcccaacaaaggtttgaagagattaaatcgaaattgttgccatatctggttgatattgggttttttgaggataatattaattgggtacctatcagtggcttttccggagaaggtgtttataaaattgaatatacagatgaagtgagacaatggtacaatggtcctaacttaatgtctactttggaaaatgcggcgttcaagatttcaaaggagaatgaaggaattaacaaagatgatccgtttttgttttctgtgttggagatcatcccatcgaaaaaaacaagtaacgatttagcactagtttcaggaaaattggaatcaggttctattcaacctggtgaatctttgacaatatatccgtcggaacagagttgtattgtggataaaattcaggttggttctcaacagggccaatcaacgaatcacgaagagacagatgttgccattaagggtgattttgtcactttgaaattgcgcaaagcctatccagaagatattcaaaatggtgatttggcagcatcagttgattattcgtccattcattcagcacagtgttttgttctggaattgaccacctttgacatgaaccgacctttgctgccaggaacaccgtttattcttttcatcggagtcaaggagcaacctgctcgaatcaaaagattgatttcatttatagacaagggcaatactgcaagcaagaaaaagattagacatctaggctctaaacaacgagcatttgtagaaatagaactaattgaagtaaagaggtggattcctttattaactgcccatgaaaatgaccgtttgggaagagttgttcttagaaaggacggtagaaccattgcggcaggtaaaatatccgaaataactcagtag

SEQ ID NO: 4203 - DNA, 1836 bp, Saccharomyces cerevisiae
atgggcaggtttagtaacataataacgtccaataaatgggacgagaaacaaaacaacattggcgaacagagcatgcaggaattaccagaagaccagatagaacatgagatggaagcaatagatccaagtaataagacgaccccatactctattgatgagaaacagtacaacacaaaaaagaagcatgggtcattgcaaggtggcgcaattgctgatgtaaattcgataactaattcgttaacaagattgcaagttgtctctcatgaaacagatattaacgaggatgaagaagaagcccactatgaggataaacacgtgaagagagccttgaagcaaagacacattggtatgattgcactaggtggtacaatcggtactggtcttttcgttggtatctccactcccttgagtaatgctggccctgtggggtccctgattgcttacattttcatgggcaccattgtctacttcgttacccagtcacttggtgagatggctacgtttatccccgtgacatcatctatcactgtcttttcgaagaggttcttatcacctgcattcggtgtttctaacggctacatgtactggttcaattgggctattacttatgctgtggaggtttctgtcattggccaagttattgaatactggacagataaagttccattagcggcctggattgcgatattctgggtaattattactttgatgaattttttccctgtcaaagtttatggtgaatttgagttctgggtggcctctgttaaagttttagccattatgggttacttgatatatgctttgattattgtctgcggtggatcccaccagggccctatcggtttcaggtactggagaaatccaggagcctgggggccaggcatcatctccagtgataaaagtgaaggccgttttctcggatgggtctcctccttgattaatgctgcatttacgtaccaaggtactgaactggttgggatcaccgctggtgaagcggctaacccaagaaagaccgttccaagagctatcaataaagtcgtctttagaatcgtactattctatattatgtctttgttctttattggtctactggttccatacaacgattcccgtttatctgctagttctgctgttattgcatcatcacccttcgttatttccattcaaaacgctggtacttatgctcttccagatattttcaacgccgtggtgttgattactgttgtatctgccgctaattcgaatgtttacgttggttcccgtgttctttactctttagctaggactggtaacgcaccaaagcaatttggatacgtcaccagacagggtgttccatatctcggtgttgtttgcactgctgcattgggtcttttggcattcctggttgtcaataacaatgcaaacactgcatttaactggttgatcaacatttccactttggctgggttatgcgcctggttattcatctctttggcacatattaggttcatgcaagctttaaagcaccgtggtatttctcgtgatgatctgcccttcaaggccaaattgatgccttatggtgcctactacgcagccttttttgtcaccgtcatcatattcatccaagggttccaagcgttctgtccgttcaaagtttctgagtttttcacatcttacatctccttgattcttttagccgttgtgttcattggttgccagatatactacaaatgcagatttatttggaagctagaagatattgacatcgattccgacagaagagaaatcgaagcaattatttgggaagacgacgagcctaagaatttatgggagaaattctgggctgctgttgcatag

SEQ ID NO: 4204 - DNA, 1836 bp, Saccharomyces cerevisiae
atgtattctatttcaaacaaaaaaccttctatactcagtatggttcccctgaatattttgaaaaaccaggatttgaaagtaaaaaaagatcaagaaaagaaaatatcatttaaccccgtagttactcctattaggccagacgactaccacgaaaaaacatccagatcgtcaagttcgagccattctgattcacctgaatttttgagaattaacaacaacaaatccggtcacaagaatggaaaattgaaaagttttgaaagtaaaaaactagttccgctattcattggtgacctccatgaaacagttactgaagaaactttaaaagggatcttcaaaaaatatccctcttttgtctctgctaaagtttgtcttgattcagtgacaaaaaaatcactgggccatggttacttaaattttgaagacaaagaagaagctgaaaaggctatggaagaattaaattacacgaaggttaatggtaaagaaattaggattatgccatcattgaggaatacaacgtttagaaagaatttcggcactaatgtctttttctctaatctacctctaaataatccattattaacaacaagagtattctatgatacgttttctagatatggtaaaattctatcatgcaaattagactctaggaaagatataggatttgtttactttgaggacgaaaaaactgcgagaaatgtgatcaaaatgtacaataataccagtttttttggtaagaaaattctatgtggaatacattttgataaagaggtcagaagtgttccaaattttgaaacacaaaaatcacgattagatgcggaaacaattattgaaaaagagcaatctttgaatgagaaacactccaaggggaatgataaggaatctaaaaatatttactcttcatcccaaaattctatattcatcaaaaaccttccaacaataactacaagggatgatattttaaatttcttcagtgaagtgggtccaattaagtcaatttatctatccaatgccactaaagttaaatatctttgggcatttgttacatataaaaatagcagtgactcagaaaaggcaattaaacgctacaataatttttatttcagaggtaaaaagcttttagtaaccagggcacaggataaagaagaaagagccaaatttatagaatctcaaaaaatatctacacttttcctggaaaatttaagcgctgtctgcaataaggaatttcttaaatatttatgtcaccaagaaaatattagaccgttcaagattcagatagatggatatgacgaaaattcttctacatattctgggttcatcaaattcaggaattttgaagatgctacgagaatatttaactttttgaataaccgtttagtaggaggaagcatcgtcacgacatcttgggaaagacaaaataatgcacctaaatatcatgatggttatggaatgcgcaatatacacacctcttctcatccacaaattaccccatattaccagtactcacatgcgaatagtttgaactccccacacatgagagatctttcgtcaatgaatagcagcacaagatcactaataaagaataaaaatttcaataagaaagttttggaaacattcgaaaagcaagtaagaagaggtatagatttcatgagatttccaagtgccactagagacgaaaatgtgcacggaatagctgagtatatattcgacacttattggaatcgcgatgtgttaatattggacaaatttttatcgttgctaaatagtagtccatatcatgaaggtgtattgcaaaaacaaattgaagaggctgcaagctcgttaggatttaaaagatga

SEQ ID NO: 4205 - DNA, 1839 bp, Saccharomyces cerevisiae
atgtctacatctttccaggagttcaaggccttctgcaacaaggttgggctagactttcaatggcttaatttgcaatcctccaagtctgttcccgaaaacggttcctctgaaggtttctcagccgtcagtgataccgtacaagaaaacatcagaccagctacggaaccacttaacgtcaaccagtccaaagatcctgtcagcaactttttttatgatgtcaagaatgctccactctggaacgtgtataagaggaatcattccggtcattcttctgctgaggcttgttctggagtaagttcaaggcaggcgccaaaaaacatacccgaggcaatggtaaaagagacagtcctttctaatcacgacaatgtcaccataataaacgaattactgccaacttcttctgccatgcatcaggaagaaagcaccgctatgacaacctcctacctcttatcccactccgtaaacgatacttgcaacgtgatgttttcttcctcctcccacaaccgtgctatgctcccatcttctcttgtgcaaagaaataacgctaccacatctcccacaacagactctgcatcagaaaacaacgaatcggtaccctcactaacctcatctgttagcacatcctcatcagtttattcgtcatggaatcctcctcattctccacacatatcgtcatttccagacggcaatttcgcatcgcttaacgcagaagtgacttgctttgatttccgccgcaccaaggactccagaacaaaagagacgaatgaatctatcattccaactgaaatttactgcccaacaaattccactgatcaccacaaacattatccaagccgaaaatctaaacaagatgcctgcgctcctgctccctgcaatcaaaatataagctgcagcgtcgtgtccacagcggaattttcccagtctaaccacacgttgactactgtagttccttcatacatgcaacagtaccttgacaggccacagaactggtttgaaagcaaaatgggaaaatactgtccactctttctgagaagtacaaagaacattgactacgattccctcgaatttaaatttgagcgcaagatgatagctgttcaatacctgcttttagacgaacaatctgagcccagaaggtactacaacccttcaaataaaagtattccattctggaagagacccttcaacttcgatacaatgcccagctacgaccaacttatggaggaagcagagtgccgtttttattcataccaatacaaatacgaaggtttccagaggattgagccctactccatttcttgtccctggaaaaacacacaaagagaaatagatctggttcttgatcacattcatttttctctcgatgtcggcgagaagaagtctttaaaccgaaaaggaaacatcactctcgatactttagacagtaaggtcgatcctaacattcagatcaagccgtatcagatttttccgtccaacaacctagtatacgaaggcttaccgcatcccgccgaacaatccttaattttgagtcctgacacctccctcattgagagggcgtttcaggcactgatagacatatgcaaggaatccattccatcttctaatgactgtagtacccgcaataataatagcgctcctcagcttaccgtgccagaaccatctaaaccatgccggctgctacttgttcgtgagtctcgcacagcaactgaactaaaaactaataaaaagctctggctccactcacaaagaaggaatatcgaagtgaccgtaccaatgcatccttctgagcgtgggacaaaaagctggttacgaaaatggctctcaacttttgtacatcagtga

SEQ ID NO: 4206 - DNA, 1839 bp, Saccharomyces cerevisiae
atgaataaattctgtctactacctttccatggcaagaggataggcgtggccaatattccttttaccatattattcaaaaagggcccttattttcttcatagtcacatcacagcagtttattactcgacaaagggcaaaaatgacagtcatgaacaaagtcgtgtatccaaaaagtctacttttacccctctggaaacaccttggtacctcaggattgttgacaatgaaaaggaactaatggaaggtaagaaaaataaccaccacacgatgaacaaagaattggagatacctaaaacctctccaaactcattaagaaaaatagcagacctcctaactggtaaacttggtctggatgacttcctggttttcgatttacggaagaaaagcccaaactctgtttcagccgttaataagttgggtgacttcatggtcatatgtacagcaagatctaccaaacattgtcataaaagtttcttagagttgaacaagtttttgaagcacgaattctgtagtagtgcatacgttgaaggaaactttaatgagcgacaagaaagtagaagaaaaagaagattagcaagaaaatccaaccttagtaaactattaggtagaagctctgaatgctctgcaaaagacttaaatagtgaggcttggtatatgattgattgtcgtgtcgatggtatttttgtaaatattttgacacagagaaggcgtaatgaattgaatttagaagagctgtatgcacctgaaaatgagaaatctaagttccaaaatatagattcaggtaatgtccctactatttcaggggtaaatgaaatttcaagcaacaataatattcttttaggcctaagaagactggcccagcaaaggagaaggtattcaactatcaacccaaacgggctaagtaatttaagatactttctacaaaaggaagacttcaaaggagccaataagataattcagagtagtagtggtactgaaactcacaatatacgtactttggagcatgttaaaaatactttaaaggatttggtaggacaagagaggaaagtagatgttgttcaatggaagtccttatttgacgaacattcaacttttttaaccataaatcaatcggctgcatattggccactacgactagaatatgcgatacttctaaacaaagcagacccacaattttattcagatcgtgttttcctcaaggattatctacttttaaaaaaatcgttggggcaagagttaataagggaagatctaatcgctcttttagaaatggttttgaaaacgcagcattctagtcattcatactttaacctagtaaagcaaaatagggtgattatcagagctttgaacctatttaaaggtctacaaacagaggacgatggctcagttgtttacgatgaagtggtaatatcccttcttttaaattccatggtcgcggatgaacgggtaaaattgagatcactctacgagacaatagaccacattttccaaacatttggagataagttgacttcaggcatgattgtctcaatattgcaaaacttggccaaaatcaaagactggaataagctacttcaagtctgggaagctatcacaccaacggaaggggaaggtcaggacaaaaggccctggaatgaatttataaatgttatcaatcaaagcggtgatagtcacgttatatcgaaaatcgtaaataatggtcatttgctatggatcagacgtttaaatgttaacgtaactccggagttatgcaactccattaaagcgttattaaaaaccgctggaatggagaattccacattggaagaattcctagtccgtggaacaaacaatcaatag

SEQ ID NO: 4207 - DNA, 1839 bp, Saccharomyces cerevisiae
atggacgtaggaagttgctcagtgggaaataatccgcttgcgcagttgcacaaacatactcagcagaacaaatcgcttcagtttaatcagaagaataatgggcgtcttaatgagtcacctctacagggtaccaacaagccaggtattagtgaggcttttatatccaatgttaatgctatttcacaagaaaacatggcgaatatgcaaaggttcataaacggagaaccactgatcgatgataaaagaagaatggaaatagggccatcctcaggcaggcttccacctttttcaaacgtacattctctacagacttcagcaaacccaacccaaattaagggagtgaacgatatatctcattggtcacaggaatttcaaggtagtaatagtattcaaaatagaaacgcggatacaggaaattcagaaaaggcatggcagcgtggctcaacaaccgcatcaagccggtttcagtaccctaataccatgatgaataactatgcttatgcttctatgaacagtcttagtggatcaaggctccaatcgcctgctttcatgaatcaacaacagtctggtcgttctaaagaaggagtcaatgagcaagaacaacaaccctggacagatcagtttgaaaagctggaaaaagaagtctcagaaaacttggacataaatgatgaaatagagaaggaggaaaatgtgagtgaagtagaacaaaacaaaccagaaactgttgagaaggaagaaggagtatatggagatcagtatcaatctgatttccaagaagtgtgggatagcatacacaaggacgctgaagaagtcttgccatccgaattagttaatgatgacctcaatctaggagaagactacttgaaatatctcggcggtagagtaaatgggaacatcgagtatgcttttcaatctaacaacgaatattttaataatcctaatgcttataaaattggctgcctactgatggaaaacggagccaaattgagcgaggcagcgctagcatttgaagctgctgttaaagaaaaaccggaccatgtggatgcatggctaagattgggtctagtacaaacccagaatgaaaaagagttgaacggcataagcgccctcgaagaatgtttaaagttagacccaaagaatctggaggcaatgaaaactttagcgataagttatataaacgaaggttatgatatgagcgccttcacaatgctggataaatgggcagaaactaagtacccggaaatttggtcaaggatcaagcaacaagatgacaaatttcaaaaagagaaagggtttacccatattgatatgaacgctcatatcacaaagcaatttttgcaactagcaaacaatttaagcacaatagatcctgaaatacaactatgcttgggtctcttattttacacgaaagatgattttgacaaaaccatagattgctttgaaagtgcgttgagggtgaatcctaatgacgaactcatgtggaatagattaggggcttcattggccaattccaatagatcagaggaagcaatccaagcctatcatagggcactacaactaaaaccttcttttgttagagctcgctataatctggcggtatcatccatgaatataggctgtttcaaagaagcagcaggctacttattaagtgttctaagtatgcatgaagtgaacactaataataaaaaaggagacgttggatctctcttgaatacgtacaatgatactgttatagagactttgaagagagtttttatagcgatgaatagagatgatttacttcaagaagtgaagccaggcatggacctgaaaagatttaaaggagaattttcgttttga

SEQ ID NO: 4208 - DNA, 1839 bp, Saccharomyces cerevisiae
atggctagacaattattcactcctccgataaccaatccaaggtttgaccctaatcaatccatcagggaatcatacaagaacacaactggcggcatgcaatttcaacaaaatctacatgaggatcaaaatgacaatgagagaagtagctgtgatggtgatgaaaactctacaacaggagaaaggctagaaaacaataagtctcctatattgacaaaacaagaaattgacgaagcgttgaacactgtcaccaatttacctccagaattatcaaaattaattgacatttttattgatgacctaaagcagccaaagtacgtacggccactatcagtactgcaattgtctagtcttttccaaagcttttacataaaatttgataaagcatcattccagcacgtcagttcagcgaataataatggctattatttttctggcgggggctctagttcattcttggctgccaaagaaacgttaagtagtggtcttagcggaatttttggcagaagtaggagtagtagtggaaattcacttatgaggccaagaagatcttcatcgcttttcagtaatgagtcaatatcaaattcaactaatgccacacaaatgttgtcacctgaagagataaaaaagcaattgaaaatcaacgaattaaacaacatgaaaatcgaaaaatatatggaactttgtgaaagagatgtttttaagaaaattcttatagtaggcacatccgtatcttcaccgaataaaatgaaaaccttcaaaccacaccaattacaaactttcaaggttggaaatctatttagaaacagtgttgaattcacagaatacaataagttgttgaatgaaaaaatcctctgtttgtccaaactctcaacaatgaataaaatcaatttgataaagtttctgagtcttaataatggcattgatccggaaccaaagtttgaagagatcaaagatattttatatgagtttacttatcattcgatttcaccatgtgaaaagataaaggccctactgaaactacatgaaatcatgacatattcccaagaaatgtctaatgatgattatctttcgttgctaatctactacattattacgattgttccacgggatattttcttgaatgccgaattcatcaggctgttcagatataagaaaaagctggtcgaaacagaatcctttgcattaaccaatctagaagctgcattagtttttgttgaaggcttaaccaaaaatgatttttcaaatgagctacaagataaattgactgtaaatgaaagtaaaattttagaaaattcaatcagcagtagagtctcattgccatcaaaaactgctataatgcataaaaacaacggtaataacggcagtaacctaggtgacatcgtgactcctactatccaaaggccagatgttacaagatcgaattcgtatgatggcttcaggaccgtttttgattcatcattaaaaaatatcatcggaaaaattaggtcatatactccaccacatcctaacaatactagcaataataaccttcacagtagcaacaacttaaacataccacgaagttcgtctcaattatccatggaattgagcaatagagatacaacagagatgtctagggatggctcacgatcaacttcatcatcttcacgatcttcagcatctttagagcacggaaatcgcgaatttaccggcgatttgacagtaaccgctagcattaacggtgctgataaaaaggagtttcagaaatcgtggaaaaaatataaaggctataaatttgaagatttgactatttgcgaactaagagatctttttgagatatatcaaaagatgatgcaatga

SEQ ID NO: 4209 - DNA, 1839 bp, Saccharomyces cerevisiae
atggtggtttcttataacaataataataacaataacaataacaataacaataataatatcagtaataataataacaataataacatgttccctccttttccttcttccgatgactttgcaatgtatcaacagtccagttcttccggcccttaccaagaaacttatgcgagtggccctcaaaactttggcgatgctgtgtatcctatgaatggtaattttactcttttaccatccgactttacacgagagcctaatgattcgttcttttacgagaatgacggaatttttgattatcagcgtattcaacagcaaccaactcaattccagacaaagcagcgaaatgattcacaacagcaacggttttcacaggaacaaaatttcgaaattgataacgaagttgtccacaataacaatcgttattatgaatatgaaaggtcatcaaatgaagtctctccttttgatgatgagaatccaaatgtgttatctgatggcatgtcacccactattatggcaactgcaactgcagtaaccaacgcaaatgcgcctttaccagttaatgcacaagccaataatcctttgaattttacatcggccccaagtagaactgtttatttgggtaatgtgccaccaaacctaagcgttaaagagttattggatcatgtcagaagtggtgtcgttgaagacgtcaaaatcatacctgaaaagatgtgtgcattcgtttcgtttatagatgaaagtgctgcactattgttccattcagacgcaattttaaagcgcttgaacatcggtgacagggatatcaaaatcgggtgggggaaaccaactcgaattgatcctattgtagcggctagaatctctacggacggtgccacaagaaatgtatacattggccgtatgacgattgaaggcgaagaatcacatttatctgaggagcaattgagggttgatttagaagaatatggtgaaattgactgtataaaaattatcaaggaaaagggaatcgcctttattcattttgcgtctattttaaatgctataaaagtggttacgaatctgccaattagaaatccatactatcaaaataagagaatattttatggaaaggacagatgtgcatttattaccaaaactcaacaacataatgcggctcaatttctaggtgtacaacctggtatggaacatatgatagagttttctgatcgtgaatttatatctaacgctttgttacaacagtctgctgctgctgctgcaattgctacatctgcgggcggccccaataacttgggtaacaggactgtttacctgggcagcttgcctaaggatgttaaaattgaagaaatatgtaatgcagttcgtggaggtttattacaaagtataaaactattgaacgatcgatacgtctgttttgtaacattcattgatcctactgctgctgcgcagttttatgcaatgagttctttgtatggattcacagtccagaaaaaacgttgcaaagtcggctggggtaaacactccggcccattaccaaatgcgctcgccttggcagtcagtaatggtgcctcaagaaatgtttatgtgggtaatattgattttgtcggcgattccctaagagatgaacgtgtcttcaccgaaagcaacttaagacatatctttcagcaatatggggaagtggaacaaatcaatttcttgcctgagaagaactgttgtttcatcaattatactaacatcagtaatgctattttagccttagacaagattaagtctaacccctatttcaaagatctcaaaataaactttggcaaggatagatgtggtaacgtcccccaccaatcacgttaa

SEQ ID NO: 4210 - DNA, 1839 bp, Saccharomyces cerevisiae
atgtcatttaaggcaactatcaccgagtcggggaagcagaatatctggtttcgtgcgatatatgtgttatctacaattcaggatgatatcaagattacagtgacaacaaatgagttaattgcttggtcaatgaacgagacagatactactctttgtcaggttaggtttcagaaaagcttttttgaggagtatgagtttaaaccacatgagattgtatttggagaaaatggggttcaagttatagaagatacgtacggcaatagtcataagttatactccttccgtgttaatggaagacacctaacaactatatcaagaaagccggatggtgatggcatcaaatcattcacaattgcggtaaacaacacttctacctgtcctgaatcacttgcaaatagattgattgtggtgattgaaatggattcgttaatagtcaaagaatactgtccccaattccagccaataaaatacgatcccataataatcaaccttaagtacaaaaggaggtttttggatgtttttggaactgctgcctccgatcggaatccacaggagcccttggaccctaagctattggacgtttttacaaatacagagcgtgagctaacatcagccttatttaacgaagaagtggaatcagacatacgtaaaaggaatcagttaacggctgctgatgagattaattacatttgttgtaattcaactttattgaagaattttttagacaactgcaatgttaatgtaaccgatgaagtaaaattggaaattaacgtacataggctaagcataactgcattcaccaaggccgtctacggcaaaaataacgaccttttaagaaatgcgttaagcatgagtaacactatcagtacgctcgatcttgagcattattgcttatttacaacaatcgaagatgaaaaacaagataagcgatcacatagtaagcgtagagagcatatgaaaagtataatattcaaattgaaggacttcaaaaacttcataacgataggtccatcctggaagactacccaggacggaaatgataatataagtttatggttttgccacccaggggaccctattcttatgcaaatgcaaaaaccgggcgtaaaattagaattggttgaagttactgacagtaacattaacgatgatattttagaaggaaaattcataaaaacagcaatctctggctccaaagaagaggccggactgaaagacaacaaagaaagctgcgaaagtccattaaaaagcaaaactgctttaaagagagaaaacctgccacactctgtggctggaactcgaaacagtcctttgaaagtgtcgtatctgacccctgataatggaagcacagttgctaagacctatagaaataacacggcaagaaaattattcgtggaagaacaaagccaaagtacgaattacgaacaagataagcggttccggcaggctagttcagttcatatgaacatgaatcgggaacaaagttttgacattggtacgactcatgaagtggcctgtccacgtaatgagagcaattctttaaaaagatccatagcagatatttgtaatgaaactgaagaccccacccaacaatctacatttgcaaaaagggcagacaccactgtgacatggggaaaagcgttaccagctgcagatgatgaggtttcatgcagcaatatcgatagaaaaggaatgctcaagaaagaaaaattgaagcatatgcaaggtctgttgaattcccagaatgacacaagtaatcacaagaaacaggacaataaagagatggaagatgggctgggtctaacacaagtagaaaagccaaggggtatatttgactaa

SEQ ID NO: 4211 - DNA, 1842 bp, Saccharomyces cerevisiae
atggctgaaggtgttttccaaggtgctatcggtatcgatttaggtacaacatactcttgtgttgctacttatgaatcttccgttgaaattattgccaacgaacaaggtaacagagttactccatctttcgttgccttcaccccacaggaaagattgatcggtgatgctgccaagaaccaagctgctttgaacccaagaaacactgtttttgatgctaagcgtttgattggtagaagattcgacgacgagtctgtccaaaaggacatgaagacctggcctttcaaggttatcgacgtcgatggtaacccagtcattgaagtccaatacttggaagaaaccaagactttctccccacaagaaatttccgctatggtcttgaccaagatgaaggaaattgctgaagctaagattggtaagaaggttgaaaaggctgtcattactgtcccagcttactttaacgatgcccaaagacaagctaccaaggatgccggtgccatttctggtttgaacgttttgcgtatcatcaacgaacctactgccgctgctattgcttacggtctaggtgctggtaagtccgaaaaggaaagacatgttttgattttcgatttgggtggtggtactttcgatgtttccttgttgcacattgctggtggtgtttacactgttaaatctacttccggtaacactcacttgggtggtcaagatttcgacaccaacttgttggaacacttcaaggctgaattcaagaagaagactggtttggacatctccgacgatgccagagctttgagaagattgagaactgctgctgaaagagctaagagaaccttatcttctgtcactcaaactaccgttgaagttgactctttgtttgacggtgaagatttcgaatcctctttgactagagctagatttgaagacttgaacgccgcattgttcaagtctactttggaacctgttgaacaagttttgaaggatgctaagatctctaagtctcaaatcgacgaagttgtcttggttggtggttctaccagaattccaaaggtccaaaagttgttgtctgacttctttgacggtaagcaattggaaaaatctattaacccagatgaagctgttgcttacggtgctgctgttcaaggtgctatcttgactggccaatccacatctgacgaaaccaaggacttgttgttgttagatgttgctccattatctctaggtgttggtatgcaaggtgacattttcggtattgttgtcccaagaaacacaactgttccaaccatcaagagaagaaccttcacaactgtcagtgacaaccaaaccaccgttcaattcccagtctaccaaggtgaacgtgtcaactgtaaagaaaacactttgttgggtgaattcgacttgaagaacatcccaatgatgccagctggtgaaccagtcttggaagctatcttcgaagttgatgctaacggtatcttgaaggttactgccgtcgaaaagtctaccggtaagtcttctaacatcactatctccaacgctgtcggtagattgtcttctgaagaaattgaaaagatggttaaccaagccgaagagttcaaggctgctgatgaagcttttgctaagaagcacgaagctagacaaagactagaatcctacgtcgcttccatcgaacaaaccgtcactgacccagtcttgtcttctaaattgaagagaggttccaagtccaagatcgaagctgctttgtccgatgctttggctgctttgcaaatcgaagacccatccgctgatgagttgagaaaggcagaagttggtttgaagagagttgtcaccaaggccatgtcttctcgttaa

SEQ ID NO: 4212 - DNA, 1842 bp, Saccharomyces cerevisiae
atggctgaaggtgttttccaaggtgctatcggtatcgatttaggtacaacctactcttgtgttgctacttacgaatcctccgttgaaattattgccaacgaacaaggtaacagagtcaccccatctttcgttgctttcactccagaagaaagattgattggtgatgctgccaagaaccaagctgctttgaacccaagaaacactgtcttcgatgctaagcgtttgattggtagaagattcgacgacgaatctgttcaaaaggacatgaagacctggcctttcaaggttatcgacgtcgatggtaacccagtcatcgaagtccaatacttggaagaaaccaagactttctccccacaagaaatttccgctatggttttgaccaagatgaaggaaattgctgaagctaagattggtaagaaggttgaaaaggccgtcattactgtcccagcttactttaacgacgctcaaagacaagctaccaaggatgccggtgccatttctggtttgaacgttttgcgtatcatcaacgaacctactgccgctgctattgcttacggtctaggtgctggtaagtccgaaaaggaaagacatgttttgattttcgatttgggtggtggtactttcgatgtttccttgttgcacattgctggtggtgtttacactgttaaatctacttccggtaacactcacttgggtggtcaagatttcgacaccaacttgttggaacacttcaaggctgaattcaagaagaagactggtttggacatctccgacgatgccagagctttgagaagattgagaactgctgctgaaagagctaagagaaccttatcttctgtcactcaaactaccgttgaagttgactctttgtttgacggtgaagatttcgaatcctctttgactagagctagatttgaagacttgaacgccgcattgttcaagtctactttggaacctgttgaacaagttttgaaggatgctaagatctctaagtctcaaatcgacgaagttgtcttggttggtggttccaccagaattccaaaggtccaaaagttgttgtctgacttctttgacggtaagcaattggaaaaatctattaacccagatgaagctgttgcttacggtgctgctgttcaaggtgctatcttgaccggccaatccacatctgacgaaaccaaggacttgttgttgttagatgttgctccattatctctaggtgttggtatgcaaggtgacatgttcggtatcgttgttccaagaaacactactgttccaaccatcaagagaagaacctttactacatgtgctgacaaccaaaccaccgttcaattcccagtctaccaaggtgaacgtgttaactgtaaagaaaacactttgttgggtgaattcgacttgaagaacatcccaatgatgccagctggtgaaccagtcttggaagctatcttcgaagttgatgctaacggtatcttgaaggttactgccgtcgaaaagtctaccggtaagtcttctaacatcactatctctaacgctgttggtagattgtcttctgaagaaattgaaaagatggttaaccaagctgaagagttcaaggctgccgatgaagcttttgccaagaagcacgaagctagacaaagattggaatcctacgttgcctccatcgaacaaactgtcactgacccagtcttgtcttctaaattgaagagaggttccaagtccaagattgaagctgctttgtccgatgctttggctgctttgcaaatcgaagacccatctgctgatgaattgagaaaggctgaagttggtttgaagagagttgtcaccaaggccatgtcttctcgttaa

SEQ ID NO: 4213 - DNA, 1842 bp, Saccharomyces cerevisiae
atgaaaggcgaacctaagacttacagcatgagcgacctctcatactacggtgagaaagcacaacaacagaacgagaaacagcaaaaacaatatgttgtgagacgaaattctacgcagtcaacatcaaaacaaaacgtgagcgtggtgctcgaggacaacgccagcgaaagtaatgaactacctaaagggtttatcttgtacgcatctttgatagcattggctttgtcgctgtttctggcagccttggatatcatgatagtttctacaatcattgaagaagtagctaaacagtttggatcgtactctgagatcgggtggttatttaccgggtatagcttaccaaacgctctgttggcgttgatatggggaagaattgccacacctatcggattcaaggagaccatgctatttgctattgtcatttttgaaatcgggtcgctgatctctgctttagcaaattcaatgagtatgctcattggtggtagagttattgctggagtcggcggttgtggtattcaaagtttatcgttcgtcattggttcaaccctggtagaggagtcgcagagaggcatactaattgctgttttgagttgttcgtttgctattgcatctgttgttgggcctttccttggaggagttttcacctccagcgtcacatggagatggtgcttctatgttaatttaccgatcggtggcctagcatttttcttattcctgttcttttataacccaggtttaagtacatttcaagagacaatggataacatccgcaaatttccatcacagtttatcgaaattgttcggaatgtagcatatcatttattgaaaatcaaagggtttagcaaacttaatgggtggagaaagccgttcatggaattgattttcatgtatgatattatcgagtttgtgttttgttcagctggattcacatgtattctattggctttcacatttggcggtaaccggtatgcttggaactctgcatccatcattattcttttcatcatcggtatagtcctggtagtgttagcaggtatctatgatttccttgtcttccccaaatttaatatagtgaaagcaacaccacattaccaaccattaatgtcatggacaaatatcaagaaaccaggtattttcacggttaatatagccttgtttctcacttgtgcaggatatatcagtcagtttacgtatattgtgcaatacttccaattaatttacaatgattccgcctggagagccgctgtacacctggttgcttgcattatttctacagtcgttacagcaatactttgcggtgctatcaccgacaaaacccgccaaatcaaaccgattattgttatttcaagcatttttggtgttgttggtgcgggtatattaaccctattgaacaataatgccaataactctgctcacatcggccttttgatattacctggcgttgctttcggtggtttggcacaaagttccatgctcgcttctcaaattcagttagacaagaagagcccaacttttcgatcagattttgtctctattaccacttttaacacattttgcaaaaatctaggtcaagcactgggaggtgtcatctctaacactgttttcagtgctgctgctatcaagaaattaaccaaggctaatattcagctcccagatggtaccacggtagacaatctggtaatctataggcagaccaatttcgatggctctcattccaaattgggcaatataatttctgaatctctcactgacgtcttttacatggcattaggattttatgcattatctctcatttttgctgtttttgcttcaaataagaaagtcacagcaagcctgagataa

SEQ ID NO: 4214 - DNA, 1842 bp, Saccharomyces cerevisiae
atgacacacatcacactgggacaagccatctgggcctctgtcagaccaatcatcaaaatctatctgattattggtgtaggcttcggtttatgcaagatgaacatcttaaccgttcaggccacaaggtccatctctgatatcgttttaacaattctgcttccttgtttatcattcaataaaatcgtagcaaatatagaagataacgatatcaaagatgtcggcattatttgtctgacgtctgttatactgttcgcaactggcttggggtttgcctttattgttcgcagtgtgctgcctgttcctaagagatggcgtggtggtatacttgcaggaggtatgtttcccaatatcagcgatctacccatcgcctatttgcaatccatggaccaagggtttatatttacagaagcagaaggtgagaaaggtgttgccaacgttatcatctttctggccatgtttttgatatgtgttttcaatttaggtggtttcagactaattgaaaacgatttccattacaaaggtgatgacgatgaagaaaatacgttgaccaatgatgattctgcccaacagccaacacaaccaattgaaggcaattcttcttcttcatccaaccaagatatcctgaaagagcccaacgagtctaccgttcctaacagttcacaagcaagctacatttctgagaaaaataaaaaagaaaaaactgaactctctgtccccaagcctacacatactgcccctccagcaatagatgacaggagctcgaactcatccgcggtggtctctatcgatagcattacacactcactacgcacaaaccatgtggatgcccaatctgtaagcgagcttaacgatcctacttacagaactagaagtcaaccaatagcatacactaccgagtcaagaacatcacatgttcataataaccgcaggaattccatcactggctccttacgttccatcgatatgcgtgaactacccgcggaaggcatgtcggatttaattcgtgaatactccaatgttgatcaatacggtagaagaaggaaaagttctatcagctcccaaggagcaccctctgttttgcaggcagacggtactatttctccaaatttgactagaacctccactttacaaagagtcaaaacttccaacctaacaagaataatcacctcagatgccactgttagtaagaaagatattgagacttccggttcctctttaccaaaatggctacagaaatttcccttaacaaaatttttcgtcttttttctaaaaaattgtctaaggccttgttccatggctgttatcctggctttgattatcgcttttattccctgggtaaaagcccttttcgttacgaccagtaatacaccaaaaatcaaacaagccccagataatgcacctgctctaactttcattatggattttacatcttatgttggagccgcttcagttcccttcggtttgattcttttaggcgctactcttggtagattgaaaattggaaaattataccctggtttctggaaatccgcagtggtattagtctttctcagacaatgtatcatgccgatctttggtgtcttgtggtgtgaccgtctagtgaaagcgggatggctaaattgggaaaacgacaagatgttattgtttgttaccgccattacttggaacttaccaacaatgaccaccttaatctacttcactgcaagttatacccctgaggacgaaactgaacccgttcaaatggaatgtacctctttctttttgatgcttcaatatcctttgatggtcgttagtttaccatttttggtgtcttatttcatcaaagttcaaatgaaattataa

SEQ ID NO: 4215 - DNA, 1842 bp, Saccharomyces cerevisiae
atgtctaagcagtttgttcgttctgcaaagaacatgatgaagggctactcatccacacaagtgcttgtgagagatgccacggcgaacgactcgaggactccatcgatagacactctcgacgatttggcacagagatcttacgattcggtggacttcttcgagattatggatatgttagacaagaggctgaacgataagggcaaatactggagacacgttgccaaatcgctgaccgttttggactatcttgttcgtttcgggagtgagaactgtgtgctatggtgcagagagaatttttacgtaattaagacattaagggaattcagacacgaaaatgagtccggatttgacgagggacaaattatcagagtaaaggctaaagaactcgtctctttgttgaatgatgaagaaaggctacgcgaagagaggtctatgaatacaagaaacagaagggcgaacagagctgctaggccaaggccaagaagacaaagaacaaggagcaacccacacgattcttctccctcttaccaggacgatttggaaaaggccctagaggagagcagaattactgctcaagaagatgaacaacgtagaagagaactggcccagtacgacgatgaagatcctgacttccaagctgccttacaactaagtaaagaagaagaggagttgaagcaattgcaggaactacagagattacagaagcaacaacagtctctgtctcaatttcaagctcctttacaacaacaacaaccacaacaacaaccagcgtactacgacattttcggtaatccaatctcccaagatgaatacttacagtatcagtaccaacaggaccaggaacaagcaatggctcagcaaagatggctggaccagcagcaagaacaacagcagcttgctgaacaacaatattttcagcagcaacaacaagctgcggccgccgcttctgccttgcaacagcaacaaacagccgctaatatgcaacaacaacaacaacagcccgctgattttcaacaacctttgcctacaggttctaataatccgttttccatggataatcttgaaagacaaaagcaggagcaacagcatgctcaattgcaaagacaacaagaagaagctagacaacaacaagaacaattgaagctacaacaattgcaaagacaacaacaagaggaagctcaattacaccagaagaggcaagaagaagcccaattacaacagcagcaagcccaattgctacaacagcaagcccagttccagcaacaacaacccttgaagcaaacaaggactgggaaccagtctatatcggataaatacagcgacttgaataccttgttagcaactggtacagggatagatacttttggtaacactggagaggcacgtattcctgcacaacatacaaagacaggcacatttataaattctcagggtacaggctacaaacaggttactaatgaacccaagaacaaccctttcttaagcaaccaatacactggtttaccaagcacaaatatcgtgcccacgcaaacagggtacgggtttggtaaccaacctcaaagtcctcctactaattctcctcagcaaaatcctactggtataagctactctcagccacaacagcaacaacagccacagcaacaaccgcaatacatgcaaaatttccaacaacagcaacctcaatacgcccaaaacttccaacaacaaccacaatacactcaaaattatcaacaacaaccacaatacattcaacctcatcaacaacaacagcagcagcagcagcagcaacagcagcaacagggatatactcctgaccaaggtgtaagcttaattgatctttga

SEQ ID NO: 4216 - DNA, 1845 bp, Saccharomyces cerevisiae
atgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcttgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggagctttctatgccctgcctgtttttcaaaaaaaatatggttctttgaatagcaatacaggagattatgaaatttcagtttcctggcaaatcggtctatgtctatgctacatggcaggtgagattgtcggtttgcaaatgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttgaccgtttcttatgcttctgaaatttgtcctttggccctaagatactatttgacgacttattctaatttatgttgggcgttcggtcaacttttcgctgctggtattatgaaaaattcccagaacaaatatgccaactcagaactaggatataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttatatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaataccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaaacacctcatctgttgtgaacaaatga

SEQ ID NO: 4217 - DNA, 1845 bp, Saccharomyces cerevisiae
atgagtgatcaagaatctgttgtttcattcaactcacaaaacacttccatggtggacgttgagggccaacaacctcaacagtatgtcccctcaaaaaccaactctcgtgcaaatcaacttaagttaactaagactgagaccgtcaagtctttacaagatttaggtgtcacttcagccgccccagtgcctgatatcaatgcgccacaaactgctaagaataacattttccctgaagaatataccatggaaacaccatctgggctggttccagtggctaccttacaatctatgggtagaaccgcctctgccttatctcgtactagaacaaagcaattgaaccgtaccgctaccaattcctcatccacaggtaaagaagaaatggaagaggaagaaactgaagaacgtgaagaccagagcggtgaaaacgagctagatccagagatcgaattcgttacttttgttactggtgatccagaaaaccctcacaattggccctcatgggttcgttggagttacactgtcctgttgtccatcttagttatttgcgttgcctacggttctgcttgtatcagtggtgggttgggaaccgttgaaaagaaataccatgtaggtatggaagccgctattttatcatgttctttaatggttattgggttctcgctgggtcctttgatttggtctcctgttagtgatctttacggtagaagagttgcttactttgtttctatgggtctttatgtcatcttcaatatcccttgcgccttagctccaaatctaggttgtcttttagcttgtagatttttatgtggtgtttggtcatcatctggtttgtgtttagttggtgggtctattgccgatatgttcccaagtgaaacaagaggtaaggctattgctttcttcgcttttgctccttacgttggtcccgttgttggtccactagttaacggttttatttccgtttctaccggacgtatggacctgattttctgggtcaatatggcctttgcaggtgttatgtggatcatatcttctgccatcccagaaacgtacgctccagttatcttgaagagaaaggctgctagattaagaaaggaaactggtaatcccaagattatgactgagcaggaagcgcaaggtgtcagtatgagtgaaatgatgagggcttgtctgttgagacctttgtacttcgctgtcactgaacctgttctagttgccacttgtttctacgtgtgtttgatttactctctactatatgcgttcttctttgccttccctgtcattttcggtgaactatatggctacaaagataaccttgtgggtttaatgtttattcctattgttatcggtgctctttgggcgttagccacaactttctactgtgaaaacaaatatttacaaattgtcaaacagcgtaaacctactcctgaagatcgtttgctaggtgctaagatcggtgctccatttgctgcaattgctctatggatcctgggtgctaccgcttataaacatattatttgggttggtccagcttcagctggtttagcttttggtttcggtatggtgttgatttattattcattgaataattacattattgattgctacgtccaatacgcatccagtgctctggctacaaaggttttcttaagatccgccggtggtgctgccttccccttgtttaccattcaaatgtaccacaaattgaatttgcactggggttcttggttgttggctttcatctccactgctatgattgctttaccttttgcattttcttactggggtaagggcttgagacataagttgtccaagaaggactattccatcgacagtgttgagatgtaa

SEQ ID NO: 4218 - DNA, 1845 bp, Saccharomyces cerevisiae
atggccttattggagaagttgcatcgaaggattgttgatatggggcttgtcccgcgtataatcgccttattaccagttatttccatgctatgcgctctatttgggtttatttctatagctattctgcctatggatggacagtacagaagaacatacatttctgagaatgcattgatgccttcacaagcgtatagttactttagagaatctgaatggaacattttgaggggctatcgatctcaaattaaagaaatggtaaacatgacttctatggaaagaaacaatttgatgggttcttggttacaagaatttggtactaagactgctatttacgaaaatgaacaatatggagaaacattgtacggtgtaatgcacgctcctaggggtgatggaacagaagcgatggtgcttgccgttccatggtttaattcagatgatgaattcaatattggcggcgcagctttgggtgtatctttagcaagatttttctcacgttggccagtatggtccaagaatataattgttgtcttcagcgaaaatcctcgtgcagcattaagatcatgggttgaggcataccatacttccttagatttgactggtggttccattgaagctgctgttgtgttggattattcgagtacggaagatttcttcgagtatgtagaaatctcatacgacggtctgaatggtgagctgcccaatttggatcttgtcaacatcgctatatccattacggaacatgaaggtatgaaagtttctttgcacggtctacccagtgatcagttaactaataataatttctggtcaagattaaaaatattatgcctgggaataagggattgggcgttgtccggtgttaaaaagccccatggtaacgaggcatttagcggctggaggattcaatctgtaacattgaaagcacatggaaacagtggtcatgatattactacatttggacgtatacccgaagcaatgtttcgctctattaataaccttttggaaaaatttcaccaatcgttcttcttttatttgttattagcaccacgtcagttcgtatccattagtagttatttgccaagcgctgtggctttatctatagcattcgccataagttcattaaatgcatttataaacaatgcttatgcaaatatatccttattttccgagtataatttggtagcgttgttggtttggttcgtgtcattggtgatatcatttgttgtttcacaagcgtttcttctaataccttcatcgggattattgatgacaattagcatggcatcttgttttttacctttgatactttccagaaaaattcacatctcagaaccactatcatacaggttgaaaaatgttgcttttttatatttcagtttggtttcaacatctttgctaatgataaactttgcaatggctttactgatcggcacattggcatttcctatgacatttgtgaagaccattgttgaaagttctagcgaacatgaggtgacaactcaatcctctaacccaataaaaactgagccgaaagatgagatagagctcgtcgagaatcacatggatacaacgccagcaaccccccaacaacagaaacaaaaactaaaaaatttagtactattaattttgacaaatccatttatttcaataaccttattcggactattttttgatgatgaatttcatggatttgatataataaacaaactggtttcagcatggttggatttgaaatgttggagttggtttgtactttgtataggttggcttccatgttggctattgatattagcgtcatcgtttgaatctaaatctgtcgtagtaaggtcgaaagaaaagcaaagttag

SEQ ID NO: 4219 - DNA, 1848 bp, Saccharomyces cerevisiae
atgagttctagtgttgttggtgcctcaagtaataaaaaaagtggaattaggcagtcctgtgagattattgagcgagaacgtcactcaaacgatgacacgtactctatgacatcgaccttttttaagctcaaagaaaacgaaattatgtctgcacagtttgattccttgaaatataaaattctactgataagtaccgcgtttgtatgtgggtttggaattagtttagactacacacttagatcgacctatacgggctatgcaacgaactcatattcagaacactccttactttcaactgtccaagttatcaatgctgttgtgagtgtcggatcccaagttgtctactctagactctctgaccacttcggaagactaaggctttttttagttgcaactattttttatataatgggaaccatcattcaatcacaggcgacccgtctcaccatgtatgcagcaggatcggttttctataactgtggatacgtcggaacaaatctgctcctgacattaatactctcagatttctcctccttgaaatggagaatgttttaccagtacgcctcatattggccatatatcataataccatggatttcaggcaatattatcacagcagcaaatcctcagaaaaactggtcctggaatattgcaatgtgggcttttatttacccactctctaccttgccaattatatttcttattctttatatgaagtacaaatcttcaaagactgctgagtggagatctctcaaagaacaggctagaaaggaaagaacgggcggattatttgagaatttggtgtttctattctggaaactcgatattgttggcatattattaataactgtgtcgctagggtgtattcttgttcctttgacgttggctaatgagacatcacaaaagtggcacaattcaaaaataattgccactttagtttcaggtggctgtttatttttcatttttttatattgggaggccaaatttgccaaatctcctcttctaccgttcaaattactaagtgatcgtggaatttgggcaccccttggtgttacttttttcaattttttcacctttttcatttcgtgcgactatctgtatcctgttttgctggtatcgatgaaagaatcgtccacttcggctgctcggatagtaaaccttcctgactttgttgctgctactgcatctccattctacagtttgttggtggcaaagacaaggaaactgaaactttctgtaatcggaggttgtgctgcatggatggtgtgcatgggccttttttacaaatacagaggaggatctgggtctcatgaaggtgttatcgctgcatctgttatcatgggtttgagcggtctcctatgcagcaattcagtgatcgtcatactgcaagccatgactacgcatagtaggatggctgtaataaccggcattcagtataccttttcaaagctaggcgctgctatcggtgcctccgtttctggtgccatatggacacaaaccatgcctaaccaactctacaagaaccttggaaacgatacattggcagaaatagcatatgcatcaccttatacattcattagtgattatccttggggctcaccggaaagagatgctgtggttgaatcttacagatatgttcaacgaataataatgacggttggcttggcatgtacggtaccgttctttacgtttacaatgttcatgagaaacccggaactaatagacaaggcgacacacgaagaattcactgaagatggtttggttgtcttgccagatgaggaaaatattttctctcaaatcaaggcactttttagacataatcgaagtaacaagaaatcaggatgttga

SEQ ID NO: 4220 - DNA, 1848 bp, Saccharomyces cerevisiae
atgagttctagtgttgttggtgcctcaagtaataaaaaaagtggaattaggcagtcctgtgagattattgagcgagaacgtcactcaaacgatgacacgtactctatgacatcgaccttttttaagctcaaagaaaacgaaattatgtctgcacagtttgattccttgaaatataaaattctactgataagtaccgcgtttgtatgtgggtttggaattagtttagactacacacttagatcgacctatacgggctatgcgacgaactcatattcagaacactccttactttcaactgtccaagttatcaatgctgttgtaagtgtcggatcccaagttgtctactccagactctctgaccacttcggaagactaaggctttttttagttgcaactattttttatataatgggaaccatcattcaatcacaggcgacccgtctcacaatgtatgcagcaggatcggttttctataactgtggatacgtcggaacaaatctgctcctgacattaatactttctgatttctcctccttgaagtggagaatgttttaccagtacgcctcatattggccatatatcataataccatggatttcaggtaatattatcacagcagcaaatcctcagaaaaactggtcctggaatattgcaatgtgggcttttatttacccactctctgccttgccaattatatttcttattctttatatgaagtacaaatcttcaaagactgctgagtggagatctctcaaagaacaggctagaaaggaaagaacgggcggattatttgagaatttggtgtttctattctggaaactcgatattgttggcatattattaataactgtgtcgctagggtgtatccttgtccctttgacgttggctaatgagacatcacagaagtggcacaattcaaaaataattgccactttagtttcaggtggctgtttatttttcatttttttatattgggaggccaaatttgccaaatctcctcttctaccgttcaaattactaagtgatcgtggaatttgggcaccccttggtgttacttttttcaattttttcacctttttcatttcgtgtgactatctgtatcctgttttgctggtatcgatgaaagaatcgtccacttcggctgctcggatagtaaaccttcctgactttgttgctgctactgcatctccattctacagtttgttggtggcaaagacaaggaaactgaaactttctgtaatcggaggttgtgctgcatggatggtgtgcatgggccttttttacaaatacagaggaggatctgggtctcatgaaggtgttatcgctgcatctgttatcatgggtttgagtggtctcctatgcagcaattcagtgatcgtcatactgcaagccatgactacgcatagtaggatggctgtaataaccggcatccagtataccttttcaaagctaggcgctgctatcggtgcctccgtttctggtgccatatggacacaaaccatgcctaaccaactctacaagaaccttggaaacgatacattggcagaaatagcatatgcatcaccttatacattcattagtgattatccttggggctcacccgaaagagatgctgtggttgaatcttacagatatgttcaacgaataataatgacggttggcttggcatgtacggtaccgttctttgcgtttacaatgttcatgagagacccggaactaatagacaaggcgacacacgaagaattcactgaagatggtttggttgtcttgccagatgaggaaaatattttctctcaaatcaaggcactttttagacataatcgaagtaacaagaaattaggatgttga

SEQ ID NO: 4221 - DNA, 1848 bp, Saccharomyces cerevisiae
atgagactttcgtttggtaaacagcgttatcatggcggtacaacagtaactttgactgaacaaggagcttcagattcccttcgcgctgcgcaagctatcttccagaaccattccaatgaggtcagcagtccatgccctccagtaacggtgagcaggaatcctcaaactaggttatcagagccatcgctacaaaagtcagggcggaaacaagaacaaaagaaggcacgcatacgaacaaaacaggtacctaagattaaaacaacggcgcctaatgatgttgagttgtctaagaaacacaggtcaagccctgcaggtaaagataatgttagtagtactgctcaaatggcagctgctttagcgcattcacaatcgaaacttagttctgacaataactcctcccattcttcggcattggatacactaaaagttctagaaactccgaacttgaatggcttgctgggcattcattcacgctcaagctcaagaaacggctccaatgaatcactgacgcctggccaaagaactcccgacaatagatctcaagagaatttacttacttcctttagtagcggtagaaggctatcctcgagctctatggagcctgcaactaataaagacagcaacaaagctctgcccaaacgcaggccgtctcctcccttgcaatcatcacttgtcggcagtggtcagcttcatgaaaatgaaaacctatcatcaattagcatcgattccagacatagtctcaatccggacacttcagacgttatttctaataggtcacaaacaagtctatctcaaacaattaatcaactctcgttatgtgaatcagagccatctattgcaagctcaaacactactactacaacgagcaaccagggaagtggtttgcccaacttggttccgaactattcatccgatatgaggaagaagaagcttgttaacaagttcaaaaggaaagtatttggtagtaagcccaagcacttatcttcacaatatgaaatggatgcaagcagcgaagaactgggacaacatgaacaacaaccgagtatgagatttaaaacaacattacgtaaaacctctgtaagtacaaacgcagaaaatgatcatgcatcctctctacatgagggaaatctgaggtataagtacaatccgtccaacgacacgtatgatgtgtatgacgatactgattctgattctgaatctgatcagaaccaggacgccttgaccaagccacgcaaaagagatagaattaagagaaagatcaggaattctgccaataaaactgcacatcataggcctatccaccgcacgagagatcggaaattcaatgaggataaaccctggaaatcacatacagatataactttcgtaacagacaacgaaaggaagcgttacgaaagcatgtgggtaagcaacagacaccgtcatttgaacctgttgagctggtggccctctataacgggtgattccggagcaattaatactttacccgaagatggattgatattgggtatcatagtccgtgatatctggaagcggtctaacttgcccaatagtctattggcagaaatttacacgaaggtagacacaagaaaagatggtactttagataggaaatcttttattgtgggtatgtggctggtcgatcagtgcctgtatggcagaaaacttcccaatgttgtcgagcaatgcgtttgggatagcgtagatagatatgcttccaccacggttgtgccagtgagtacgctaaaggcgatggccaaacaaaagagaaaacagatgaaagaagaaatcaagaatatcaagaaggaaaaccgtgtagttcttgtagaccacaatagctcgtcgtga

SEQ ID NO: 4222 - DNA, 1848 bp, Saccharomyces cerevisiae
atgctaagctatttccaagggtttgtgcccatacacacaatattttactccgtgttccatcctacagaaggttctaagattaaatacgagtttccgccaaataatttgaaaaatcatggtattaatttcaacacatttaaaaactacatcataccgaagcctatattatgccacaagttgatcacttttaagtatggtacatataggattgtatgttatcctgtgacaatcaattctccaatatatgctaggaatttttttagttttaattttgtatttgtattcccatatgattgtgagacgtctccctacgaaccagctattactaggctgggcaaaatgttcaaagttcttgaagaacaaaatcaattgctatccaaatcggaaagagatccagttttcttcgatttgaaggtgttggaaaactccacaacaacaccctccactgcaggtccttcatccacgccaaatcctagtagtaacaccacaccaactcatcctacatccgaaaaggatacaaaggatatgagaagcagcagatacagtgaccttatcaaggatttgggccttccgcaatccgcattttccatacaagatttattgatgagaattttccaagacctgaataactattccgaatgcctcataccaattgatgagggaaatgcagtagacataaagatttttccgctgttgagaccaccgacaacttgtgtctcattagaagatgtgcccctgtcgtctgtaaatttgaagaagattattgatgtcaactgggatccaaccatgatgagtatagtcccttacattgatggcttaaacagcattgccaaaatttctaaactaagcaacagtgatcctggcctagtgatagagtgcatacgtcacttaatatactataagtgtgttacattatcagatattttccaattttctaacatatacgctccttcttcattaattaggaattttttgactgatccactaatggctagtgactgtcaatcttatgttacgttcccagaagtgtctaaaatatcgaacttgcccttaaacaaaagtctgggttcaggtgaccaagactcaccatcattttctgtacgaagaaaatccaaatcatctagcataccgtcaaacccggattctagaactacatcttttagttctaccagtagagtttctcaaaactcctccttaaattcctctttttcatcaatttataaagactggaggcaatcacaaacctcctgctcgagttcaaatattcatgtcatcaacaatcgtaaccgattcctaccaacaagatcatgcctatttgacctttataggtcactttcacaaggtcaaacgctgaaaacatggtatgagtcgaaatatatgattttaaaagaaaataacattgatataagaaggttcataacgtttggcctggaaaaacgtatcatttacaggtgctactcttttcctgtaatgataaatgcaggttcacgtgaaccaaaagaaatgacaccaataataacaaaagatttagtgaataatgataagttacttgaaaaaagaaatcacaatcatttgctttcagccacagggtctagaaatacggcacaatccggcaacttgaaaccagaaagaccatcaaaggtttcatttgaaatgcaaagggtaagttcgttggcaacaggcaaaagtactatgccgaaactcagcgacgaagaagaaggtattcttgaagagtctattaggaatgccgaaacatttgataaaatttgcgttttactgagcaagcctaaattagaagtcgaaagctacctaaacgaattaggagaatttaaggtaattaatagctga

SEQ ID NO: 4223 - DNA, 1848 bp, Saccharomyces cerevisiae
atgtcatctatctctttgaaggaaattataccacctcagccttcgacacagcgtaactttactacgcatttatcgtatgaccctacaaccaacgcaattgcttacccatgtggaaaatctgcatttgtacgttgtttggacgatggagacagtaaagtacctccagtagtacaatttactggtcatggctcttcggtagtcacaacggtaaagttctctccaattaagggttcccagtacctatgctccggtgacgaatctggaaaagtgattgtttggggatggacatttgacaaagaaagcaattctgttgaagtgaatgttaagtctgaattccaagttttagcaggtccaatcagcgatatctcctgggattttgaagggcgaagactctgcgttgtgggagaaggtcgtgataactttggtgttttcatatcctgggattctggtaattccttaggtgaagtttcaggtcactcacaacgcatcaatgcttgtcatttgaagcaatctagacctatgagatctatgacagttggagatgatggatctgttgtcttttatcaaggacctccatttaagttctctgccagtgacagaacacaccacaaacaaggctcatttgtcagggatgttgaattttcacctgacagcggtgaatttgttattacggtagggtctgacagaaagatttcttgctttgatggcaaatcaggtgagtttcttaaatacatagaggatgatcaagaaccagttcaaggtggtatatttgcactatcgtggcttgattcccaaaagtttgctaccgtaggagcagacgctaccattagggtttgggacgtcacgacttcaaaatgcgttcaaaaatggaccttagacaagcaacaactgggaaatcaacaagttggtgttgttgcaacaggaaacggaaggattatttctctttcactggatgggaccttaaacttctatgaacttggacatgacgaggttttaaaaaccattagtggtcataacaagggtattactgctttgacagtcaacccactaatcagtgggtcatatgatggtaggattatggaatggtctagctcttccatgcaccaagatcactccaacttgattgtatcattggataatagtaaagcgcaagaatactccagtatttcttgggatgatactttgaaagtgaacggtattactaagcatgaatttggatcgcaaccaaaggttgctagtgcgaacaatgatggcttcactgcagtactaacaaatgatgatgatttgttgatattacagtcttttacgggcgatataatcaagagtgtaagactgaactcaccaggctctgccgttagcttgagccaaaattacgttgcagttggtttggaagaaggtaatactattcaggtattcaaattatcagatttggaagtcagttttgatttaaaaacacctcttcgcgcaaaaccctcgtacatatcaatttcgccatctgaaacatacatcgctgctggagatgttatgggcaagatattgctatatgatttacaatcaagagaagtgaaaacttcaagatgggctttccacaccagtaaaatcaacgccatttcatggaaacctgctgaaaagggagcaaacgaagaggaaattgaagaggacttagttgccactggttctttagacaccaatatttttatttactccgtcaaaagacctatgaaaatcattaaggcgttgaatgctcacaaggacggtgttaacaaccttttatgggaaacaccatctaccttggttagttctggtgcggacgcttgcattaaaaggtggaatgttgtcctcgagtga

SEQ ID NO: 4224 - DNA, 1851 bp, Saccharomyces cerevisiae
atgaaaaatatcatttcattggtaagcaagaagaaggctgcctcaaaaaatgaggataaaaacatttctgagtcttcaagagatattgtaaaccaacaggaggttttcaatactgaagattttgaagaagggaaaaaggatagtgcctttgagctagaccacttagagttcaccaccaattcagcccagttaggagattctgacgaagataacgagaatgtgattaatgagatgaacgctactgatgatgcaaatgaagctaacagcgaggaaaaaagcatgactttgaagcaggcgttgctaaaatatccaaaagcagccctgtggtccatattagtgtctactaccctggttatggaaggttatgataccgcactactgagcgcactgtatgccctgccagtttttcagagaaaattcggtactttgaacggggagggttcttacgaaattacttcccaatggcagattggtttaaacatgtgtgtcctttgtggtgagatgattggtttgcaaatcacgacttatatggttgaatttatggggaatcgttatacgatgattacagcacttggtttgttaactgcttatatctttatcctctactactgtaaaagtttagctatgattgctgtgggacaaattctctcagctataccatggggttgtttccaaagtttggctgttacttatgcttcggaagtttgccctttagcattaagatattacatgaccagttactccaacatttgttggttatttggtcaaatcttcgcctctggtattatgaaaaactcacaagagaatttagggaactccgacttgggctataaattgccatttgctttacaatggatttggcctgctcctttaatgatcggtatctttttcgctcctgagtcgccctggtggttggtgagaaaggatagggtcgctgaggcaagaaaatctttaagcagaattttgagtggtaaaggcgccgagaaggacattcaagttgatcttactttaaagcagattgaattgactattgaaaaagaaagacttttagcatctaaatcaggatcattctttaattgtttcaagggagttaatggaagaagaacgagacttgcatgtttaacttgggtagctcaaaatagtagcggtgccgttttacttggttactcgacatatttttttgaaagagcaggtatggccaccgacaaggcgtttactttttctctaattcagtactgtcttgggttagcgggtacactttgctcctgggtaatatctggccgtgttggtagatggacaatactgacctatggtcttgcatttcaaatggtctgcttatttattattggtggaatgggttttggttctggaagcagcgctagtaatggtgccggtggtttattgctggctttatcattcttttacaatgctggtatcggtgcagttgtttactgtatcgttgctgaaattccatcagcggagttgagaactaagactatagtgctggcccgtatttgctacaatctcatggccgttattaacgctatattaacgccctatatgctaaacgtgagcgattggaactggggtgccaaaactggtctatactggggtggtttcacagcagtcactttagcttgggtcatcatcgatctgcctgagacaactggtagaaccttcagtgaaattaatgaacttttcaaccaaggggttcctgccagaaaatttgcatctactgtggttgatccattcggaaagggaaaaactcaacatgattcgctagctgatgagagtatcagtcagtcctcaagcataaaacagcgagaattaaatgcagctgataaatgttaa

SEQ ID NO: 4225 - DNA, 1851 bp, Saccharomyces cerevisiae
atgagcgaccttaaccaatccaaaaagatgaacgtcagcgagtttgctgacgcccaaaggagccactatacagtataccccagtttgcctcaaagtaacaaaaatgataaacacattccctttgtcaaacttctatcaggcaaagaatcggaagtgaacgtggaaaaaagatgggaattgtatcatcagttacattcccactttcatgatcaagtagatcatattatcgataatattgaagcagacttgaaagcagagatttcagaccttttatatagtgaaactactcagaaaaggcgatgctttaacactattttcctattaggttcagatagtacgacaaaaattgaacttaaagacgaatcttctcgctacaacgttttgattgaattgactccgaaagaatctccgaatgtaagaatgatgcttcgtaggtctatgtacaaactttacagcgcagctgatgcagaagaacatccaactatcaagtatgaagacattaacgatgaagatggcgattttaccgagcaaaacaatgatgtatcatacgatctgtcacttgtggaaaacttcaaaaggctttttggaaaagacttagcaatggtatttaattttaaagatgtagattctattaacttcaacacattggataacttcataattctattgaaaagtgccttcaagtatgaccatgttaaaataagtttaatctttaatattaatacaaacttgtcaaatattgagaaaaatttgagacaatcaaccatacgacttctgaagagaaattatcataaactagacgtgtcgagtaataaaggatttaagtacggaaaccaaatctttcaaagctttttggatacggttgatggcaaactaaatctttcagatcgttttgtggaattcattctcagcaagatggcaaataatactaatcacaacttacaattattgacgaagatgctggattattcgttgatgtcgtactttttccagaatgccttttcagtattcattgaccctgtaaatgttgattttttgaacgacgactacttaaaaatactgagcagatgtcctacattcatgttctttgtcgaaggtcttataaagcagcatgctcctgctgacgaaattctttcattattgacaaacaaaaacagaggcctagaagagttttttgttgagtttttggtaagagagaacccgattaacgggcatgctaagtttgttgctcgattcctcgaagaagaattgaatataaccaattttaatctgatagaattatatcataatttgcttattggcaaactagactcctatctagatcgttggtcagcatgtaaagagtataaggatcggcttcattttgaacccattgatacaatttttcaagagctatttactttggacaacagaagtggattacttacccagtcgattttcccttcttacaagtcaaatatcgaagataacttactaagttgggagcaggtgctgccttcgcttgataaagaaaattatgatactctttctggagatttggataaaataatggctccggtactgggtcagctattcaagctttatcgtgaggcgaatatgactatcaacatttacgatttctacattgcgttcagagaaacattaccaaaagaggaaatattaaatttcataagaaaagatccctccaacaccaaactcttagaactagcagaaacaccggacgcatttgacaaagtagcactaattttattcatgcaagcaatcttcgcctttgaaaacatgggtctcattaagtttcaaagcaccaagagttacgatctggtagaaaaatgtgtctggagaggaatttag

SEQ ID NO: 4226 - DNA, 1851 bp, Saccharomyces cerevisiae
atgatcatcaataggcgtattttgaaatcttttgaagagataagtcattcattagaggaatcactacgagaggttgcatttgattcacagcaacaattgattcaagacgtacgtgaggaaaatgaagaactaagtaggttacaagatcaattacaattgatcaggtcaattgttgaaaaaatctgcatttcaatcaaaactgacaatattgactcttattgttcggtgccttttgatttgctatacaatatttgcaaggacattgctgatccctcatcctttgaagacggagatttgcaatatcttgttagccaagccatatttgagtacattatattattgtgctactattctgtgaccaacgaatgcgtccaaggtttacctgccgtgtatgaagctgaacagtactacaaaacagtaagtgattcaatcctaaagtcttttctttactgtttacaaaattcagtatcgacaatacgtcttttatctcaaactgttttgaaggatgtaaataagaaaaaactgtcgcatcaaaaatggtccctaaaggccttgtcagttgatttactagaaaaaatacgcccaagaataaacaaatttatggtgattcggaacttcaggtttgtcgggctaccgaagaaaccaattgaaatagcttcattggtttctgatatacctcgcggtatagtgcacgaaagacttgatatggtcactcaatcatcaaagtattatactattaaactggggcagttgatcactgaattcgatcaacaaccagaagaaaatggtatgttcaccgaagtacatttaccgaactacgaaagacgtctaaaatctttacaggacttctttggattagccatgtctgattcgaatttactagatgtgatccgatgctcagcgaaatttcataaagatcatcctttaagaaggttcactaaaccaagtatattgactagatactggccttcaattttgttgtgtcttttatatggaccatcttctgttatgtcgttgtggaattcccggtattttattcaagatttcattaagaccaatgtcgttgactttgcgaaagggctgatcttgaactggttatgggcacccctgaaacaggtttggtctactgttaagcatgacgagggaagcgccatttcagtgacatcacaggagacattaaactctgacatggattctcttaccagaatgattgttagttttgttgtggataatagtgattcgacgtctaacagccccatagaccctattctattgagtactaaagtcgaacatggtgatttgaccgaatttatggaaatatatgaaacacaactacatcatccgataaagaatatagctacgggtggattagtcaggtctttattgattcaactgcaaaaaacaaaagtcgatggatctatggcattgaatggcattgataaaatgctgaaatcgcaacagttggtgtttggagttgtagcattatctccggctttagtgatactatattcttctatagtggcgttaaaaagatttgtcaaactaggcaatgtctggtctaatgaaaaacggtatagggagcaaataagtataagtttgaataatgtggaaagagttttgaattattctaaacaaggtgcggacgccgatgaggaacacttaaaccagggtctactagtgattgaggtttctaacttatacaaattgggaagttttttgatcccgcgttcaagaaagaaagaatggtttagggacgttgaggaactggtggataccaatcttgactccggagctcatataaatgtcgtcaacaggatataccacgtatatggcaggtttttaatccattag

SEQ ID NO: 4227 - DNA, 1851 bp, Saccharomyces cerevisiae
atggctcacgaggttcatagaataaaacctaaactaggacggacccaaatattttgggtttttctagcctttagagtactgaatgcagttctgacgagaaccttctttcaggctgatgagttttggcaagcattggagccggcacattggaaggctttcaagtatggtgaactgacttgggaatggaaattcggagttcgtagctatttatttccgatgatttttgagctgacttatagattggtttctctatcgtcaatccttcttcactatgcacttcttcttctctcaacgatagggtctgatttattaattttactactgccgaaatatgagttaagttggcaagtcgctgaagacttgaagaggcttccttttgatgtcacacggtcgttcgaatattatggtgtgatatatgcgccaaaaatagttatggcagtactagcttccataggggaatattatatcgtaagatttgttcaaaagctctatttacttacacttgataagagaaacgagaaggaggaagaggagagacgcagcggtttatccgagattacgaagtttgcactgcttttaagtttaactaatttttttaattgcttttttattacaagaacgttcatcaactcttttgaaatgattttaacttctattgccctctactactgggactggacaggcggacaaatgataaaagagtcatcttttactaagtcgcttatttttgcatttctggcatgtttgcaaagacccagcagtggacttatttgggtaattcccagcatttccctaatattaaacttggtaggcaaaaagcagtatcatttacttttcatcacattttccaaagttttacggtctttttttctggtatttactgcaaatgcaattatcgacatgtatttttatgaaaaagtaacgtttccctttttccgatttctaaaattcaatttcacaacaccattatcaaagttttatggggtagctccttggcattttcatttctttcaaagcttacctatcgtattaggtgcaagtattcccgcttttgcatttggattattttttccactaagcaaaaggagtttcccaaagaagtatttaaacccgtttttccaagtgaaactcactatcttgttgaatctgttggtgtactctacgttacctcataaggaatttaggttcatcttcccattacagccacttttcatattaatatcatcatttggccttttgagacttgatagagattattggaaaagactatctggcctaaaatctttactctggcttgttccattcgtgtcggtgttcatcgcattacttttggacacattccacgaatctggatctatcgaagttatgaaatttttacatgaagagccagaaatagatagtttgggattcataatgccctgtcattcgacacctggtcaaagctatttacaccgcagtgacattcaagatctgtggtcgattacttgtaaccctccattgcatttacttggagacccagaggcttactccaaactagagacctacatggatgaaagtgaccatttgtatgacgatatatcggcattcatttacaaaaatttcccaccgccttttcgtaaggatctaaggagtccaggtaaaacatacagccacgaatggccaacatatttggttgttttcgagcacatggaaaacgcatttctaaaggatttcctgaaagattcatcatacattgaatacaatagattcttcaactctcttgcgcactgggattcaagaagatcaggagacataataatttattataaattaccattcgattatagcgatattccagcggcagatatttaa

SEQ ID NO: 4228 - DNA, 1851 bp, Saccharomyces cerevisiae
atgtataagaagctggctattgccacattgctctattccgcagattatttaccaggtgtgtttgcccttggtcaccaagtgaataaattgttagaggaagcaggcaaaaaaggcgacattgaaacatgccttattgtgacgacctctctatttaatggcactttaagcgagctagccaagaatattttacaatcaatatacaccaaaattgtgttggtagagcctttaaattgccaagaagaaagcatacagaagaatagtgagaatttagctcttttggaaagacctgaattatcctttgccttaatcaaagcaagactatgggaattaactcagttcgaacaagttctttacttggattccgacactttacctctgaataaagaatttttaaagttgtttgacattatgtctaaacaaaccacgtcacaagtgggtgctattgctgatatcggctggcctgatatgttcaatagcggtgtcatgatgctaataccggatgctgatactgcatccgttttacaaaattatatttttgaaaacacttcaattgatggttctgaccagggcattttaaaccagttcttcaatcaaaattgttgcactgatgagctagttaaagacagtttctctcgagaatgggtacagttatcatttacgtataacgtaactattcctaatttaggctaccaatcttcacctgctatgaattactttaaacctagcattaagttgattcatttcattgggaaacacaagccatggtcattgtggtcccaaaagaatttcattaaaaacgagtatcatgatcaatggaatgaggtatacgaggaatttaaggaagaacatcaattaaataacgaagtttcgaagccaaagattagtgattccgataaaactgagactcctgaaacgataaccccagtggatgcccctccatcgaacgaacccactacgaatcaagagatcgacacaattagtacagtggaagaaaacgtggacaaccagaacgccgagcctgttcctaactcggatcatagccctgctcctaaccctgtcccattggattttaccaagtggttaacaacctttattaacaaagatcacttgactaatcagccagtaaatgaaagcagagaatattcgaaagagaatgataacaatataatcaatagcagttcaaaccgcgaccaagaaagtcctccaaatagtactcaggaactaaacagctcttatagcgttgtgagtactcaagctgatagcgatgagcaccaaaatgcagaagaggaggatagtacgacagataacgcttcaaattctggagaagaaagccacctcgatgatataagcacggccgcttcttccaataacaatgtaagtaatcaaccagatggcaaaaattttagcaattctaaagaaaataatatcagtgtcgaatctagcccttcaaatccagaacagaaaaggtcaactgacaatatacaaaaaccaagtgtttctactaatgacttaccagacgacgtagaaccacatacctctgttgatgacaatatacagtacttagaaaaagacaaggaaggttatgaagaatttcttccggacgtgtacgagtcaaatgcaatcgataacgaagaagaattttttgatgacgatgcaagagatgctaccgaaggagaaacgaagacgagtgcagttgcagataaacaggaggatatgaaacttacagcagaggaaaccaaccaaccgcaacaagaaatgcccaacttcaaatttgactgggaggactctgattatctatccaaagtagagaggtgtttccctgatgatatttttgagtatgcagtagagtaa

SEQ ID NO: 4229 - DNA, 1851 bp, Saccharomyces cerevisiae
atgtcgtcgtcaattacagatgagaaaatatctggtgaacagcaacaacctgctggcagaaaactatactataacacaagtacatttgcagagcctcctctagtggacggagaaggtaaccctataaattatgagccggaagtttacaacccggatcacgaaaagctataccataacccatcactgcctgcacaatcaattcaggatacaagagatgatgaattgctggaaagagtttatagccaggatcaaggtgtagagtatgaggaagatgaagaggataagccaaacctaagcgctgcgtccattaaaagttatgctttaacgagatttacgtccttactgcacatccacgagttttcttgggagaatgtcaatcccatacccgaactgcgcaaaatgacatggcagaattggaactatttttttatgggttattttgcgtggttgtctgcggcttgggccttcttttgcgtttcagtatcagtcgctccattggctgaactatatgacagaccaaccaaggacatcacctgggggttgggattggtgttatttgttcgttcagcaggtgctgtcatatttggtttatggacagataagtcttccagaaagtggccgtacattacatgtttgttcttatttgtcattgcacaactctgtactccatggtgtgacacatacgagaaatttctgggcgtaaggtggataaccggtattgctatgggaggaatttacggatgtgcttctgcaacagcgattgaagatgcacctgtgaaagcacgttcgttcctatcaggtctatttttttctgcttacgctatggggttcatatttgctatcattttttacagagcctttggctactttagggatgatggctggaaaatattgttttggtttagtatttttctaccaattctactaattttctggagattgttatggcctgaaacgaaatacttcaccaaggttttgaaagcccgtaaattaatattgagtgacgcagtgaaagctaatggtggcgagcctctaccaaaagccaactttaaacaaaagatggtatccatgaagagaacagttcaaaagtactggttgttgttcgcatatttggttgttttattggtgggtccaaattacttgactcatgcttctcaagacttgttgccaaccatgctgcgtgcccaattaggcctatccaaggatgctgtcactgtcattgtagtggttaccaacatcggtgctatttgtgggggtatgatatttggacagttcatggaagttactggaagaagattaggcctattgattgcatgcacaatgggtggttgcttcacctaccctgcatttatgttgagaagcgaaaaggctatattaggtgccggtttcatgttatatttttgtgtctttggtgtctggggtatcctgcccattcaccttgcagagttggcccctgctgatgcaagggctttggttgccggtttatcttaccagctaggtaatctagcttctgcagcggcttccacgattgagacacagttagctgatagatacccattagaaagagatgcctctggtgctgtgattaaagaagattatgccaaagttatggctatcttgactggttctgttttcatcttcacatttgcttgtgtttttgttggccatgagaaattccatcgtgatttgtcctctcctgttatgaagaaatatataaaccaagtggaagaatacgaagccgatggtctttcgattagtgacattgttgaacaaaagacggaatgtgcttcagtgaagatgattgattcgaacgtctcaaagacatatgaggagcatattgagaccgtttaa

SEQ ID NO: 4230 - DNA, 1854 bp, Saccharomyces cerevisiae
atgaagagcttcattacaaggaacaagacagccattttggcaaccgttgctgctacaggtactgccatcggtgcctactattattacaaccaattgcaacaacaacaacaacgaggaaaaaagaacacgatcaacaaagatgaaaaaaaggacacaaaggactctcaaaaggagactgaaggtgctaagaaatctacagccccatcaaatcctcctatctacccggtttctagtaatggcgaaccagatttttccaataaggcaaatttcaccgctgaagaaaaggataaatatgcattagcgttaaaggacaaaggtaaccagttctttagaaataaaaaatatgacgatgctattaagtactataattgggcattagaattgaaagaagacccagttttctactcgaatttatcggcttgctatgtttctgtgggtgacttgaaaaaagttgttgaaatgagtactaaggctcttgaattaaaaccagactactcaaaagttttactgagaagagcttctgctaacgaagggctaggaaaatttgcggatgcgatgttcgatttgtctgtattgtctctaaatggtgacttcaatgacgcctctattgaaccaatgttggagaggaacttgaataagcaagctatgtctaaattgaaagaaaagtttggcgatattgacaccgctactgctactccaactgaattatccacccaaccagctaaagaacgcaaagacaagcaggaaaacttgccttcagttacatccatggcctctttctttggtattttcaaacccgagttgacttttgccaattatgatgaatccaatgaagctgataaagagttaatgaacggtttaagtaatttgtacaaaagatctcccgaaagttacgacaaggctgatgagtctttcacgaaagctgcaaggttatttgaagaacaattggacaagaacaatgaggatgaaaagttaaaggaaaaattggccatctcattagaacacacaggtattttcaagttcttgaaaaacgatccattgggagctcacgaagacatcaagaaagctattgaattgttcccaagagtcaattcatatatctacatggcattaatcatggctgatagaaatgactcgactgaatattataactacttcgataaagcgctgaaactggactcaaacaattcttctgtttactatcaccgcggccaaatgaatttcattttacaaaactatgatcaagcaggaaaagattttgataaagctaaggaattagacccagagaatatcttcccttatattcaattagcatgtctagcgtaccgtgaaaacaagtttgatgactgtgaaactttgtttagtgaagctaagagaaaatttccagaggcaccagaagttccaaatttctttgctgaaattttaacagacaagaacgattttgacaaggctttgaagcagtacgatttggctattgaattagaaaacaagttggatggtatttatgttggaattgcgcctttggtcggtaaagccactttgttgacaagaaatccaacagtagaaaattttattgaagccacgaatttattagaaaaagcgtccaaactagacccaagaagtgagcaagctaaaatcggtttagctcaaatgaaattgcagcaggaagatatcgatgaagctattacattattcgaagaatccgctgatttggctagaactatggaagagaaattacaagccattacttttgctgaagccgctaaagttcaacaaagaattaggtctgatccagtattggctaaaaagattcaagaaactttagctaaattacgcgaacagggtttaatgtaa

SEQ ID NO: 4231 - DNA, 1854 bp, Saccharomyces cerevisiae
atggcagacttgccacagaaggtatctaatttaagcatcaacaacaaagagaatggtggtggtggcggcaaatcatcttatgtcccaccgcacttgagaagtagaggaaaaccatcattcgaaagaagtaccccaaaacaggaagataaggttacgggtggtgattttttcagacgtgctggaaggcaaactgggaacaatggcgggttttttggcttttctaaggaaagaaatggagggacgagtgcgaactataaccgcggaggcagctcaaattacaaatcatctggaaatagatgggtaaatggcaagcatataccggggcctaagaacgcgaaattagaagccgaactgtttggtgtacacgacgatcccgattaccattcatctggtataaagtttgataattacgataatattcccgtagatgcatctggaaaagatgttcctgaacctatactagattttagttctccccctctggatgagctgttaatggaaaatatcaaacttgctagtttcaccaaacctactccagtacaaaaatattctattccaatagttaccaaaggtagggatttgatggcatgcgcacaaacgggctcaggtaagacaggtgggtttttgtttccgctcttcacggagctattcaggtctgggccctctccagtacccgagaaagcacagagcttttattctagaaagggatatccatctgctttagtacttgcaccaactagagaattggctacccaaatttttgaagaagcaagaaaatttacgtatagatcttgggttaggccatgcgttgtttatggtggcgcgccaatcggtaaccagatgagggaggttgaccgcggctgtgacttattggtggctacaccagggcggctgaatgacttattagaacgcggaaaagtttctttggctaatatcaaatacctggtattggatgaggctgatagaatgctagatatgggattcgaaccccaaattcgccatatagttgaagaatgtgatatgccctctgtggaaaatagacagaccttgatgttttccgccacattcccagtagatatccagcatttggcacgcgatttcttagataattatatttttttatcagtaggaagagtcggttccacctcagaaaatatcacgcaaagaatattatatgtcgatgacatggacaaaaagtctgcgttgttagatttactgtctgcagagcataagggattgacattgatttttgttgaaacgaaaagaatggcggatcaactcacagattttttgatcatgcaaaatttcaaagctacagccatacatggtgaccgcacacaggctgaacgtgaacgtgccttatctgctttcaaagctaacgtagctgatatcctggtcgcaacagctgtagcagcgagaggtttggatataccgaatgtcacacatgtcattaattatgatttgccctccgacatcgatgactacgttcacagaattggtagaacaggccgtgctggtaacacaggcgtggctacttcattcttcaatagtaataatcagaatattgtgaagggtttgatggaaattttaaatgaagcgaatcaagaagttcccacgtttttaagtgacctgtcaagacagaattcaagaggtggaagaactaggggaggaggaggttttttcaatagtcgtaataacggttcaagagactaccgtaaacatggtggaaatggctcatttgggagcacgaggccaaggaatactggaacatcaaattggggttcgattggaggtgggtttagaaatgataatgagaaaaacggttacggaaatagcaacgcttcatggtggtaa

SEQ ID NO: 4232 - DNA, 1857 bp, Saccharomyces cerevisiae
atgaccaaaaaactaccttcagagttgaaacagacgagaaagtctatccagacagcttgtgaattctgtcataccaaacatatacagtgtgacgtagggaggccatgtcaaaactgtttaaaaagaaatattgggaagttttgcagagataagaaaaggaaatcaagaaaacgaattgagaagcatggaacacaaccatacttgaatttggggaagaggctggtaatacatgatgtgccgtcgaagacggtatccccctcaagcgtacatctgcagcgagattttctatcttcagatcaggaaaaaccaggcaaaacacctgcccacaatacgaatatccaatatacgtataatataaatgataactttcaaagcgctggatctattccacgtattacgaacttcaatacgaataaccgccagaccgtcttagaaaatacttctaataatatatcagcttcacaagcagtacatttaatgaatgaccccatcatacccaccgtacggaagagtactctcaatttaaagtcgcatttcctagagcaacataaagcaatgcagcagccgctggctaccaattgtttggttgctacttcaaacgttcctgtgcactctggaatggacgatagtaataagagtgacgatgatgtcgatgacgaaactaatattcactttgatagtatgtggtgcaatgacgaatacatgaaattaaaggatatagtagatatttcaacgccgtttttaccgaataactcccagatattttccctccaagaatcagaatatcccaatcctagcgcatctacacggggaaattcgtcattgcatttaacgaaccttttaaactcgacaaaaagcgtgaatgaccaaaaggactcctcgatcggccattccacttctactttcaatacatatgatgaagtagtgtctaggccctttatatctttagacatgctgcatttgaatcgtggagcaaacgctaatacacacccatcacataacgccaaactggaaagcgaatgtgacagttctagtcactccgatgcagatctggagaaacatgataccgatttcatatcaccttcaaagtttcgtgaattagtaaagactcctcaagacctatatgacaataaatgtttaataaaaccgcataattacaagctcgcatacaccaaactgctaactactttaagaaaaaaatttcttgaaggagctgaaattgataaatctgcctcagtaaaagacgaacacagtacccaaaagcataatttgagatatgatttagaagttataatacgctctatactagaaagatatgctccaattttcatttcgttaacatccaatatgattgaagaggatttgctattacaggaagttaccttgcaaagggctttattagatttggagaacatggcaaaattagtaagctgcacaccgatgtgcatctggagaagatcaggcgagatttgttttgtcagtaacgaattctattctttaacaggttttaacaaaaatttactattagaccgcacctcctttatttttgaatatctggatcataaaagcgtttcgaattactttcaaatatttaacgaattgctggcatttggttacaatgatatcaataaaaggaaaaaactattgatgttgaacgcatgttcttctacctcgtcaaaaattacagaagggttttcttttactacggatggaaaagcaatctttactaagtgcaatttattattaagtaacggtctttatttgaagtgtgcctgttgttggacagtaaaaagggactcgtttaatatcccaattctcgtaatgggacaatttttaccaatttttgaaatggactga

SEQ ID NO: 4233 - DNA, 1857 bp, Saccharomyces cerevisiae
atgccagagtatacgctactggctgataatataagggagaatatcgttcatttcgatccgaatggtttgtttgataacttgcacaccattgttcatgaagatgacagtcaagagaacgaggaggccgagcatttcaattatgatcaggtgttggataaatcgttattgtcaagaggttctattgtcggtctcggtttaggactaatgagtcccgttttaggaatgtgcactagtatggccattgggctaattaatggtggtccgttaactataatgctaggttttttaatcagtggagtgtgtatatggttttcgtcgctttctcttggtgagattgtttcaaaatttccgatggaactgcatgttgggagtgccatgttggccccggagaaattgaaattagtatgttcgtggtacactggctggttaatgctcatagggaattggactatgagtaccagtattacttttgcaggcgctcaacttaccatttctttgattctgatgacgaactccaacctaatatccgaggcacacttgattttttacacagtcattgtattttacttagttgtgactgttgtaggcctcgtgaatttgaaatttgcaagatttattgaaacaataaacaaagtctgtgtttattggatcatatatgccattatatttattgatattcttctactagtattccacaaaggtaaatttcgatctttgaagtacgcgctatttcactttgataataatctatcagggtataaaagcgcatttctttccttcatcattggattccaacagtctaatttcacgttacaaggtttcagtatgttacctgctttagctgacgaagtcaaagttcctgagaaggatattccacgtggtatgtcgaatgcggtattgttatccgcgttctctggagtcatttttcttataccaataatgttaatcctgccagataatgatttgctttttaccaatcataaggttctaccaatagtgaacatttttacaaaatcgactgattcggtggtcttgtctttttttttagtgctcctaattttaggaaacttactgttttccggaattggctcgattactacatcttctcgtgcggtatatagttttagtcgtgaccaggctataccatactacgataaatggacctacgtcgaaccggattctcagtcaaaagtccccaagaattctgttgtattgagtatgataatatcatactttttaggtctgctagctttgatttcaacggccgcatttaatgcttttataggcgctgcagtgctctgtctttgttctgcgactttcattccgttagtcttggtgctgtttacgagaagaagagctatccgaagcgcgccagtaaaaatcaggtataagtttggttggttcatcaacattgtttctattgtgtggctcttgttatctatggtttctgtttgcctaccaacgcaagtgcctgtaactttcaaaacaatgaattatgctttaatggtgtacgtattctgcattttagttatcactggtctttatttcaaatgggggaagtataattttagattacccttggcagatgacatcaaggctccaattcccagtgatgcggaagaaactgtttttgaactagaggatagcaatgttgaacatactctaaactcgggaaccacagtgaaagagtctgtagaaaataattctgaagaaggtttcatcaaggtgcatcctaaaagtagtacagaaaatccctttgaggaaaatgaggaaaacgtgataaccgattatggtgatgagcaccatacagcagaacaagaatttgatcttgccgatgatcgtagatatgatatatga

SEQ ID NO: 4234 - DNA, 1857 bp, Saccharomyces cerevisiae
atgccgttaatgtccaattcggaaagagataaattggaaagtacattgaggagaaggtttttctacacaccctcgtttgagatatatggtggtgtgtcaggtttatttgatttagggcctccgggttgtcagttgcaaaataacttgattcgactgtggcgagaacattttattatggaagaaaacatgcttcaggttgatgggccaatgctaactccttacgatgtgttgaagacttctgggcatgtagacaaatttactgattggatgtgccgaaatcctaagactggggaatactacagagcagaccatttgattgaacagacgttgaaaaaacggctgttggacaaggatgtcaatccacaggatatgaaaaatatggagaaaatattgaccacgattgacgggttttcgggtcctgagttgaatctcgtcatgcaggaatataacattaatgatccagtcactaacgatgttttagacgcactaacttcctttaatttgatgttcgaaactaaaattggagcctcaggacaattgaaggcctttctaaggccagagactgcacaaggacaatttctcaatttcaacaaattattggaaatcaaccaagggaaaattccgtttgcttcagcttccattggtaagtcattcagaaacgaaatttcccccagaagtgggcttttaagggtaagagagtttttaatggcagaaattgagcactttgttgatccgttgaataagtcacatgcaaaattcaatgaagtgttaaatgaggagattccactactatcacgcagattacaggaaagtggtgaagtccaactgcctgtgaaaatgactataggagaggcagtgaattctggaatggtagaaaatgaaacattgggatattttatggcaagagttcatcaatttttgttgaatattgggatcaacaaggacaaattcagatttcgccagcatttgaagaatgaaatggcacactatgccacagattgttgggacggtgaaattttaacatcgtatggttggattgaatgtgtcggttgtgctgacagggcggcttttgatttaactgtacactccaagaaaacgggaagaagtctgacggtaaagcaaaagctagatacaccaaaagaaagaaccgagtgggttgtggaagtgaataagaaatttttcggatcgaagttcaaacagaaagcaaaattaatcgaatctgttttgtcaaaattttcccaggatgaattgattaggaggcatgaagaactggaaaagaacggtgaatttacctgtcaagtaaatggccagatcgtaaaactagatagcagtttggttactatcaaaatgaagacaactttgcaacatatacgagagtacattcctaatgtcattgagccctcgttcggtttaggtcgtatcatatactgcatcttcgaccattgtttccaagttcgagtggatagtgagtcaagaggcttcttctcttttccattacagatagcgccgatcaaagtatttgttacgacaatatcgaataacgatggcttccccgctatacttaagaggatctcgcaggctttacgtaaaagagagatatactttaaaattgacgattccaatacttcaattggtaaaaaatacgcccgtaacgatgaattgggaacaccatttggtatcaccatagatttcgaaactataaaagaccaaacggtgacgttaagagaaagaaattctatgaggcaagtaagaggcactattactgatgtgatttcgaccattgacaaaatgcttcacaaccctgatgaatcggactgggataaatcaacatttggactgtcgcctgttaagatataa

SEQ ID NO: 4235 - DNA, 1857 bp, Saccharomyces cerevisiae
atgggtagtagacgtcataagaacaagcaagccgccccaccaaccctggaggagtttcaggcaagaaaggaaaagaaggctaatagaaagctagaaaaaggaaagagaccttctaccacgcaaggggatgaagtttctgatagaaagaaaaagaagtcgaagccattcaagaaatctagaaaagaggaggaagaagttgttgaagaggataaggatttgccagaagttgatcttgaagaattatcaaaagccaggaaatctttatttgatgatgaagaagatgacgatgaagcaggattggtggatgaagaactaaaagatgaatttgacttggaacaagaatatgattacgatgaagatgaagataatgacgcccacccaattttttcagatgacgacgatgaggctgatcttgaagaactaaatgcacaaaacatggaagctctttctaagaaacttgatgaagaagaagctgaagaagctgaagaagccgaaatggagttagtggaagcggagaacatgcaaccaagagcagacatattgcccactgaggagcaggaagaaatgatggcacaagaaactcctaatttaacttccacaagaacaagaatgattgaaattgtaaaggttttggaaaattttaagactcttggtgcagaaggcagatcgagaggagaatacgttgacagacttttgaaagatatttgtgagtactttggttatacaccatttttggcggaaaagttattcaatctattctcaccagcagaggcgatggagtttttcgaagccaatgaaattgcaagaccaataaccatcagaaccaacaccttgaagaccagaaggagagacttagctcaaactcttgtgaatagaggtgttaatctacaacctattggttcttggactaaagttggtcttcaaatattcgattcccaagtcccaattggtgctacgccagaatatttggcaggtcactatattttacaagcggcatcatcttttctaccagttattgctctagatcctcatgaaaatgagcgtatcttggatatggcagctgctccaggtggtaagaccacttatatatcagctatgatgaaaaacacaggttgtgttttcgctaacgacgccaataaatctagaacaaaatctttaattgctaatatccaccgtctaggctgtaccaacactattgtatgcaattacgatgcccgtgagttccctaaggtaattggaggttttgacagaattttactggatgccccatgttccggtactggtgttatcggtaaggatcaatctgtcaaggtgtctcgtaccgagaaggacttcattcaaattccacatctacaaaaacaattgcttctatccgccattgattctgttgattgcaactcgaaacatggtggtgtaatagtatattcgacatgttctgttgcagtggaagaggacgaagctgtcatagactatgcattgagaaaaagaccgaatgtcaagttagtcgatactggtttagcgatcggtaaagaagcgtttactagttacagaggcaaaaagtttcatcctagtgtgaaattagcgaggaggtactatccacatacgtacaacgtcgatgggttctttgtcgctaaattccaaaagatcggtccatcttcgtttgatgataaccaagcaagtgcaaaagaaaaggaaactgctgctagaaaggaagctttggaagaaggtatcattcactctgacttcgcaaccttcgaggacgaagaagacgataagtacattgaaaagtctgtgaaaaacaatcttttgaaaaagggtgtcaatccaaaagctaaaagaccttctaacgaaaaataa

SEQ ID NO: 4236 - DNA, 1860 bp, Saccharomyces cerevisiae
atgatcataagattgcatttttactacctcctcactttagtttaccatttaggacttgtaggtgcgtatgaaaaagcagcaagaaagagaattcaacctcccgatttgatacctggtcctccgggacataaacttggtgatgaaagaccaccgcattacgaccaccggccaccttataaaaaacacatcgacaacattccagcttacaatctgactgatttgatagatgataaactactaaataaatatgaaaactcatgcacggtaaatgtattgacaggtggcttcatctctctagcaagtaattcgtggcacttacgtgcttataattacactttaaattacccatcctttttgatccgatgcgataatggcagtgcaaatcctaatttctctcatgtcttacaagactttgtttatgacatcaacaacaaattcaacgttcaagatgacagtagtaaatacatcggaaaagacccatttcccttaggaatgataatgatcacctttgcttctgggtgtatctgtgtggcaacatggatgctatttttggttgtcttattactgccatccgataatcataatagaagaaataaagttgtacatgtttacgtccttttctctgcgattataagaactgtatttctaaacgagactatagccgtcatatttgacagccaatatcacgatgactaccaggatgcgagccaatttgaatcgttcatcgtagaaactgcaccatataaaatatgtgaattagttgcaaatattttgagtgatataaactggatttatattgttcactacttacagtccaattatggaaaaccaacttggaattggatcccatttaaaatgaaaaaggggacacatatcataattaccgtgggttgcttcctctcactagccgataacattttattcgcaaaccttctttggagaaagaaccttgtagttttgaaggtattttacaagctaatcgaattactgatttacacaattttcatctccattatttgttacttcacatggcataattttgcttacatacttttaccgaaaactgctgaaattaatacggacggtaagtgtaaaacgaaattgagaattctttgggaaaattatcacgaaactataccattattggcgtataatattcttatatttattttattctatttcaccacaatttttttcgctgctttcaccaaacatgttagaggttggacatttaactttgttcatcttttgaaagttttaataacagtgaacgtttggggcttaattggagtattggaaaagagggagctgcacataagcaaaaaaacagtccttggacgaaaaattaacaatagggacaaatttttcgccaatccaacagtcaattattacggagaagatttaggcaagcatttaagcgccataacgttaaacagggatttaaacactactaaaagtaacactacttcccacgattcatcaagtttagtaggatccccttcacccacctggaaatctccaatcgaaagaataagggacagaagaagaagacataagataatgaaaagtgagaataaatttgggcaaaatcccagttttggaagtaaatcgaatggcaaacctaatactaaaacgacattatccaaatatcgacagctattaaggaagcctaggcgaaaaaccaattcatatgaaccaaaaaatggcattggacagaataaagaaggctcaactgttagaccaggagccgacaaacatattagagattccaattatctagctacagacatcagtgacaacgaaagtatggaaaccgaacttcgaaccaaccacatttataattacgaaaatagtgattaa

SEQ ID NO: 4237 - DNA, 1860 bp, Saccharomyces cerevisiae
atgcatagcgatactaacggtcgaacaaagagcaataatagcccatcagacaataatccaaatgagacagttatattaatagatagtgataaggaagaagacgcttctattcgcgaggctaaccttcctgtgaggttgtacccagacagacgggtagggagacgacgtgatgctttaaataggtttgtgaggtcagattcaaggagcaggaattctcaacggactcacataacagcaagctctgagcgccctgattttcaagctaataacgacgatatcactataatacgagaagttggacggttttttggagacgatggacctattgatccttctgcacattacgtcgatcttgatcaggagccaggttctgaaacgttagaaactccaagaacaatacaagtagataacacaaacgggtacttgaatgataatggtaataacaatgaaagtgatgatggcctgacaatagttgaagagagaacaacacgacccagagtgacactgaacctgccaggcggggagaggcttgaggtaactgcgacgacaacagacataccgataagaaggtcatttgaattccaagaagatctaggcgcatcacgcaggcagttactgagaaggagtgctacaagagcccgtaatttatttgtggaccggtctgatgaaaacgatgaagattggacagatgatacccataatttaccagaagctattcaaagggctcgtagggagagccgtatgcgaatgagcagacggattgcagaaagacaacgtagggtacaacagcaaagggtgtccagtgacgaaaatataagtacatctattaggttacaatcaatcagggaacgaatacaatcatatacgcctgatattcgtagtgcttttcatcgtgcagagtcactgcatgaattcaggtctattttacaaaatgttgctccaattactttgcaagaatgtgaagaagaactaatggcactcttcactgagttcagaaatcaactgctgcagaattgggccattgatagggtcagaaatactcaggaagaggccttgagacttcaccgagaagcattggaaagacaagaaagaacggcaggaagagttttccatcgtggcacattacgtgaatcaatcacaaactatcttaatttcaatggagaggatgggttcttaagtcgtttgtggagtggcccagcattgagcgatgctgacgaggaacgacacactcaaaatatcattgatatgatccaagagagagaagaacgagagcgggatgtggtcatgaagaatctaatgaacaaaaccagagcccaacaggaagaattcgaagctagggcagccagcctacccgaaggttatagcgcgtcatttgatactacgccaaaaatgaaattagacattacgaaaaatggtaaagaagaaaccatcattgtgacagatgacgatttagcaaaaacactcgaggatattcctgtttgttgcttgtgtggcgcagaattgggggtcggaataccggatgattttactggaatcagtcaaaaggatcgtggtgtttcatttgaagggttagtgtcaaaatacaaattccactgcccctaccaaaccctagccagaccatcaatgcttgatagagatttatcaaaacgaacgtttattgcatcgtgtggtcatgcattttgtggtaggtgtttcgccaggattgacaatgcaaaaaaaaaatctaagatgcccaaaaagaaactagctcaactaaagggttcggctcatccggataattatggccccaaattatgtcccgcagattcttgtaagaagcttattcgttcaagaggcaggttgaaggaggtttacttctag

SEQ ID NO: 4238 - DNA, 1860 bp, Saccharomyces cerevisiae
atggacgatagtgtcagtttcattgccaaagaggccagtccagcacaatattcgcacagtttgcatgaaagaacacacagtgaaaaacaaaagagagactttacaataacagaaaaacaagatgaggtatctggacaaacagcggagcctcgaaggacggacagcaaatccatattacagaggaaatgcaaagaattcttcgactcttttaaaaggcagctgccaccagaccgtaattccgaactagagtcccaagaaaaaaacaacctgacaaagtcgatcaaatctcgtcacttagtcatgatcagtctcggtaccggtataggtactggtttactggtcggtaatggtcaggtgctgggaacagctggtcctgccgggttagtccttggttacggaatagcatcgatcatgctttactgtatcatccaagcggcaggcgagttaggtctctgttatgcaggactaaccggcaattacaccagatatccttctattttagtcgacccttcgttgggttttgcagtttctgtggtttacaccattcaatggctaactgttctgcccttacaattggtcactgcggcaatgacagttaagtactggacgagtgtaaatgcagacatctttgttgccgtggttttcgtttttgtaattatcattaatctatttgggtccagaggctatgctgaagccgagttcattttcaattcctgtaagatattgatggtaatcggattcgtcattctggcgattatcatcaattgtggtggtgcaggtgacagaagatacatcggtgctgagtactggcacaatcctggtccatttgcccacggtttcaaaggtgtatgtacggttttctgttatgctgcattcagctacggtggaattgaagttctacttctatctgccgctgagcaggaaaacccaacaaaatctattcccaatgcctgcaaaaaagtggtataccgtattctgctgatttacatgctcaccaccattttggtttgctttcttgttccatacaacagtgacgaattattagggtctagtgactcctctggatcccatgcctccccatttgtcattgctgttgcatcacatggtgtcaaagttgtgcctcactttataaatgctgttattttgatttctgtcatttctgttgcaaactcttcgttatattctgggccaagattgttattatcattggcagaacaaggcgtcttacctaaatgcttagcatatgttgatagaaacggcaggcctttactttgtttttttgtttcccttgtctttggatgcattgggtttgtagccactagtgacgctgaagaacaggttttcacctggttattggcaatttctagtctttcgcaattatttatctggatgtcaatgtccttgtcacatataagatttagagatgccatggcaaagcaaggtcgttcgatgaacgaagttggatacaaagcacaaactggctattggggttcatggcttgcagttttaattgcaatcttcttccttgtgtgccagttctgggtagccatcgcacctgttaatgaacatggaaaacttaacgtcaaagtgtttttccaaaattatttggcaatgcccatcgttttgtttgcctattttggtcacaagatatacttcaaatcatggagcttttggattccagccgaaaaaattgatttggactcacatagaaacatatttgtgtctccatcgcttacagagatcgacaaagttgacgataacgatgatcttaaagagtatgaaaattcagaatcgtcggaaaatccaaacagctcgcgttcaagaaagttttttaagaggatgaccaatttctggtgctaa

SEQ ID NO: 4239 - DNA, 1860 bp, Saccharomyces cerevisiae
atggttaaagagagtattattgctcttgctgagcatgcggcctccagagcctcaagagttattcctccagtgaagctagcctataaaaatatgcttaaggacccttcctccaagtacaagccatttaacgctccaaagctatctaatagaaagtggccggataaccggatcacgagggctcctcgttggttatcaacagatttgagagatggtaaccaatctctgccggatcccatgtcagtggaacaaaagaaagaatactttcacaagctggtcaatattgggttcaaagaaatcgaggtttccttcccctctgcatctcaaacagatttcgacttcactagatatgctgtagaaaacgccccagacgatgttagtattcaatgtcttgtccaatctagagaacacttgattaagagaacggtggaagcattaacaggtgctaaaaaggctactatacatacttacttggcaacaagtgatatgttccgtgaaattgtttttaatatgtctagagaggaagctatttccaaggcagtagaggccaccaaactagttaggaaactaactaaggatgacccttcccaacaagccactcgttggtcctatgagttttcccccgaatgtttcagtgatactccaggtgaatttgctgtagaaatttgcgaagctgttaagaaggcttgggaacctaccgaggaaaatccaatcattttcaacttacctgctaccgtagaagttgcctctccaaatgtttatgctgatcagattgaatacttcgctacccatattactgagcgtgagaaggtttgcatctctacacattgtcacaatgaccgtggttgcggtgtcgccgccacagagttaggtatgcttgcaggtgccgaccgtgtagaaggatgtctctttggtaatggtgaacgtacaggtaatgtggacttggttactgttgctatgaatatgtatacccaaggtgtttctcctaatttggatttctctgacttgacctctgtcctagatgtggttgagcgttgtaataagatcccagtatcgcaaagagcaccatacggcggtgacttggtcgtttgtgccttttccggttctcaccaagacgccattaagaagggtttcaacttacaaaacaagaagcgtgctcaaggtgaaactcaatggagaatcccatacttgccattggatccaaaggacattggccgtgattacgaagctgtcatcagagtcaactctcagtctggtaaaggtggtgccgcttgggttattttgagatctttgggtttggatctaccaagaaacatgcaaatcgaattttctagcgccgttcaagaccatgctgactccttgggtagagaactaaaatcagatgagatttccaagttattcaaagaggcttacaactacaatgacgaacagtaccaagctattagtttagtcaattataatgttgaaaaattcggcactgaacgtagagtgttcactggtcaagtcaaagtaggcgaccagatcgtcgatattgaaggtacaggtaatggtccaatctcttctttggtcgacgccctatcaaacttgttgaacgtgagatttgccgtagcaaactacacagagcattctctaggttctggttcttctacgcaagctgcttcttacatccatctatcgtataggcgtaatgccgacaacgaaaaggcctacaaatggggtgtaggtgtctccgaagatgtcggtgattcttcagtgagagccatctttgccaccattaacaatattatccattctggtgatgtgtccattccatctttggccgaggtcgaaggtaagaatgctgcggcatctggctctgcataa

SEQ ID NO: 4240 - DNA, 1860 bp, Saccharomyces cerevisiae
atgtacaatcctgtggacgctgttttaacaaagataattaccaactatgggattgatagttttacactgcgatatgctatctgcttattgggatcgttcccactgaatgctattttgaagagaattcccgagaagcgtataggtttaaaatgttgttttatcatttctatgtcgatgttttacttattcggtgtgctgaatctagtaagtggattcaggaccctgtttattagtaccatgtttacttacttgatctcaagattttaccgttccaagtttatgccacacttgaatttcatgtttgttatgggtcatttggcaataaatcatatacacgcccaattccttaacgaacagactcaaactaccgttgacattacaagttcacaaatggttttagccatgaaactaacttcttttgcatggtcgtactatgatggttcatgcactagcgaaagcgatttcaaagatttgactgagcatcaaaaatctcgtgctgtcagaggtcatccacccttattaaagttcctggcatatgcatttttctattcaacgttgctaactggcccaagtttcgattatgccgattttgacagctggttgaattgtgagatgttccgtgacttgcctgaaagcaaaaagcctatgagaagacaccaccctggtgaaagaagacagattccaaagaatggtaaacttgcattatggaaagttgttcaaggtcttgcttggatgattttaagtacactaggaatgaagcacttccccgtaaaatacgttttggacaaagatggcttcccaacgagatcttttatattcagaatccattacttattcttgcttggtttcatccatagattcaagtactacgctgcctggactatttcggaaggatcttgtattttgtgcggtttgggttataatggttatgattcaaagacacaaaagatcagatgggatcgtgtcagaaatattgacatttggaccgtagaaacggcgcagaatacgcgtgaaatgttggaagcatggaatatgaatactaacaagtggctaaaatactctgtttatttacgtgtcacaaagaagggcaaaaaacctggtttccgctcaactttgtttactttcctaacttccgcattttggcatggtaccagacctgggtactatctgacttttgcgacaggggctttgtaccaaacatgtggtaaaatctacagacgcaattttagaccaattttcttgcgagaagatggtgtcactcctttgccttctaaaaaaatctacgatttagttggcatatatgcaattaaactagcatttggttacatggtgcaaccatttattatccttgatttgaagccatctttaatggtatggggctctgtttatttctatgttcatattattgttgctttctcatttttcctattcagaggaccatatgctaaacaagttactgaattttttaaatccaaacaacctaaagaaatattcattagaaaacaaaagaagttggaaaaagatatttctgcaagctctccaaacttgggtggtatattgaaggcaaagattgaacatgaaaagggaaagacagcagaagaagaagaaatgaacttaggtattccaccaattgagttagaaaagtgggacaatgctaaggaagattgggaagatttctgcaaagattacaaagaatggagaaataaaaatggtcttgaaatagaagaggaaaacctttctaaagcttttgaaagattcaagcaggaattttctaacgctgcaagtggatcaggtgaacgtgtgagaaaaatgagttttagtggttactcaccaaagcctatttcaaaaaaggaagagtag

SEQ ID NO: 4241 - DNA, 1863 bp, Saccharomyces cerevisiae
atgagagactctaatcatcgatcattaacgtcgaacaagcctatagtaacaataacatctactgtctatgaccgaagggcattggatatcaactctagtattccgttaataaactccctaaactacttaacatatctaacctctaattcatcaaaagttagggaaacggtagctaacgacggtgctctcgaaagattagtctcaatattgaggagttgtcatttaagtttgtttgagttgctggatttggatttagaaaattttaatgagcacgaaaacataaaggatctatggaaggagaaaagactagcactatgcgcttggaaatggactttaacatttcagtgcttagtattgacaggtactagagggacagaacaaattcgtaaaaaagtggtaatgtctggggtcttatctgtgctggtcacagtattggataactatttactatatcataaaaattacgacttcatcaaagatcaaacaatgacctttgacttcaaagggataaccacggagacaatgtataaattcatgagaaaagatgagaatgaaacatatcagcagtatatagagttcattacaggtcaggataaattgaagttgtcaactgacaaaaattttctaaacgaacgattagtggcaccgtctatgacaattccaactgattttagtgatatatggggccggtttgcagacctagctagcaattttgaacctgaccaggaaagacacgacgacgacattgatattgatagtgaagtagaaagtgaaaattttgatgcacataagaatttcttttcgcaaccagacattaatagacctacaatttccactccacgtgaattttttctcggaagaattgtccccaaacaagacgacgttatatggtcgcttcagttattagcttttgtttcgaagtatacatatatgaaatcaacccttcaaaatgttgagctggttgaatccctatcgttcagaagtatggcttacaaaattaaacagagaatctcagaagagaatgacttagaagaacaagaaagagacgtaactgtaaaattgtcttcattatatccttatttatcgaaaaatcctgaaaacaattccaaagttaaggcactagatactagcaaaatggatccatttttcaaagaattagaagaactctcaaacagatgtcaacaagaagaacaaaatgaaatatgtaataaccactgtcccgttcttaatttgtttgagcgctaccgtgtaccgaaacctagcgacgacaatgcctatggcaaagacaaggaaagaattaatttaaggaagaaaatatctgataactttgaaaggcgctggagctacgataaaatgaaaaaggaattaacaaatattgtttacaaaaacaaggtactaacaaatgttgtaaacatcttccccttagtcgaaaaatatacagtgagcgcagaaaatacacatgatgttatatattggagttctgtcatcatgagaaattcatgtcgaaaaaatgagatcttaggtgtgcgtcagtgtgccaatttttcgtgcggaaaatgggaagattttccaagacaatttgcaaaatgtcgtcgatgcaaaagaacgaaatattgctcacgaaagtgtcaattaaaagcatggggatatcataggtattggtgtcacgaagttggatcaagtcatatgagatccacgaatactaccacaggtgtcaataccccaaatgagcctagttctttaaatgccaccgctactacagcagctgatgtttcgaattctaccagtacgttcactcctaatatatccaccaccgtacctgatgaaataagcaatagggatgaaaatagcatacctgagtaa

SEQ ID NO: 4242 - DNA, 1863 bp, Saccharomyces cerevisiae
atgagggatattgtatttgtatcaccgcagctgtatttgtcatcacaggagggttggaaaagtgattctgccaaaagtgggttcatccctatcctcaaaaatgatctacaacgttttcaggactcattaaaacatatagttgacgccagaaacagcttatcagagacactgctaaatagcaacgatgatgggagtatacacaattctgaccagaatactggtttgaataaagacaaagaggcttcaatagcagataacaatagtgctaacaagtgcgccacaagctcttcccgttaccaagagctcaaacaatttcttcccatttccttagaccaacagattcatacagtatctttacaaggtgtctcttcatcattttctcgcggacagatagaatcattgctagaccactgtttgaatttagcgttgactgaaactcaaagcaattccgcattgaaagtagaagcttggtcttctttttcttcgtttttagatacccaggacatttttataagattcagtaaggttgatgaagatgaggcatttgttaatacgctgaactactgcaaagccttattcgcgtttattagaaagctacatgaggatttcaagattgagttacacttggatttgaacacaaaagaatatgtcgaagaccgaacaggaactataccgagtgttaagccagaaaaggctagcgaattttattctgttttcaaaaacattgaagatcaaacagacgaaagaaattcaaagaaagaacagttggatgactcttccacacaatacaaagtggatacaaacactttaagtgatttgccatcggatgctttggaccaattgtgcaaggatataatagaatttaggacaaaagttgtcagtatagagaaagaaaaaaaaatgaaaagtacgtacgaggaaagtaggcgtcaaagacaccaaatgcaaaaagtttttgatcaaataaggaaaaaccactcaggagccaaagggagcgccaatacagaggaggaggatactaatatggaagatgaagatgaggaggatgacactgaagacgaccttgccttagagaagagaaaagaagaaagagacctggaagaatcaaatcgtagatatgaggatatgttacaccaattacattccaatacagagcctaagataaaatccattagggctgatatcatgagtgctgaaaactatgaggaacatttggagaaaaatcgctcattatatttgaaggagctattacaccttgccaacgacgttcattacgaccaccatagatctttcaaggagcaagaggaaagaagggacgaagaggatagagctaaaaatggaaatgcaaaggaactggcgcctatacaactatcggatggtaaggccatatctgcagggaaggctgccgccatcacccttcctgaaggcactgtgaagagcgagaactataacgcggacaagaatgtgtctgagagctcagaacacgtcaagatcaaattcgactttaagaaggctattgatcactcagttgaaagctctagcgaagacgagggatacagagagagcgagctacctccaacaaaaccctccgagagaagcgcggcagaggaccgtttgccatttacagcagatgaactgaacataagactaactaatctgaaggaatcgcgctacgtggacgaactggtgcgtgaattcctcggcgtctacgaggacgagctggtggaatacattcttgagaacatccgcgtgaaccagagcaaacaggcccttttaaatgagctaagggagactttcgacgaggacggggaaacgatagctgatagactgtggagtcgtaaagaatttcgcttggggacctga

SEQ ID NO: 4243 - DNA, 1863 bp, Saccharomyces cerevisiae
atgatcgaagtcccagaagacaatcgttctagccaaacaaagcgtaagaatactgaaaaaaattgtaatgaactgatggttgatgaaaagatggatgacgattcgtcgcccagagatgaaatgaaagataaattaaagggaacaaaatcattgattattcgtaagtctgagctaatggctaaaaagtatgatacttggcaattaaaagctatattcctgttttctgcattcatttgcactttcgcttatggattagatagcagcataaggggtacatatatgacctacgcaatgaactcgtactccgcacattctctcatttctacagtaagcgtcatagttctaatgatatctgctgtttcacaggtgatctttggagggttatcagatatctttggaaggctaacgttgtttcttgtatccattgtactttacattgtgggtacaataattcaatctcaagcatatgatgtccagaggtatgctgctggagctgtcttttattatgtgggacttgtcggtgttatgctacaggttgttttgatgttgtctgataattcttcattaaaatggaggctattttacacattgataccttcatggccctcgattatcactacgtgggtctcaggtagtgtagtggaggcagcaaacccgttagagaactggtcgtggaatattgctatgtgggcgttcattttccctctatgctgtatcccattgattttgtgtatgctccatatgagatggaaagtaagaaatgacgtggaatggaaagaattacaggatgaaaaatcgtactatcaaacgcacggattagtacaaatgctggtacagttgttctggaagctagatgttgtcggtgtgttgttgtttactgctggtgttggttgtattcttgtaccactcactcttgctggtggcgtctctacaaattggagaaattcaaagattatcgggccctttgtgcttggctttgtcctggttccaggcttcatatattgggaaagtcgacttgctttggttcctttcgctccattcaagctgctaaaagatcgtggcgtgtgggccccattgggaattatgttttttatctgctttgtatatcaaatggctgctgggtatctctacaccattctagtagttgcggtagatgagagcgcttcctcagctacaagaataataaacttatactcttttgtgactgctgttgttgctccatttctggggctcatcgttacgagatcatctagattgaagtcgtatattatttttggtggctcactttatttcattactatgggactattttaccgctacaggtcaggtcaagacgccgatggaggtataattgctggtatggttatttggggtctcagtagttgtttattcgattatcctacaattgtttctattcagtcggtaacatcccatgagaatatggctactgtcacagcattaaactatacagttttcagaataggtggagcagttgcagctgccatttccggtgccatatggacgcagtcattgtaccctaaattattgcactacatgggagacgctgacctggctacagcagcatatggctcaccactaacttttattctttccaatccctggggtactccagttaggtctgcgatggttgaagcttacagacacgttcaaaaatacgaagttattgttgcgcttgtattttcagcgcctatgttccttctaacattctgcgtaagagatcctcggttgactgaagattttgcccaaaagttacctgacagagaatatgtccaaaccaaggaagatgatcctatcaatgactggatcgcgaaacgttttgcaaaggccttaggcaggtcataa

SEQ ID NO: 4244 - DNA, 1863 bp, Saccharomyces cerevisiae
atgattgaagaaagagatttggttttaagcaatggtatccattgtattgctgacatccactccgaactatacgccaggttaaaaaaagaatcgcaggcagcgacaccatgggtgtaccaaaaacaatacggaaaattcgtcacttactttgtcgctgtgataatttttttgtctttgataaaaaagctggcatttatgtattatgattccagtgaggaatttcttccagaaaagaagaactcgccgactaccccttctgtattccttgctcgaataatgacgaaacttgtcgcattcaacagatacatttgctacaggaaatttcccacgttgatattttcttatttaggtattccgacatctgtgggtacttttttagtagtaatggctaccactttatacacacttctatactgctttgttcctcatccattctacagaccttgtgcaggatttggttcgccgcctttgtctgttcgtgcaggcataatggcaatatctttggttccgtttgtattctcactttccgggaagatcaacgttataggttggttggttgggctttcgtatgaaaaaatcaacatataccaccaatgggcatccattctttgtttattctttagctgggttcatgtcattcccttcctacgtcaagcacgacatgagggaggatatgaaagaatgcatcaacggtggaaggcatccgacatgtggaggagtggtgtcccacccatcttatttttgaatctgctatggttatcttcgctgcctattgctagaagacatttttatgagatttttttgcaacttcattggattttagctgttggattttacattagtttgttctatcatgtatatcccgaattgaattcccatatgtatctggttgctacaattgtggtttggtttgcacaactgttttacagactagctgtgaagggttatttaagacctggtagaagtttcatggcctcgaccattgcaaatgtcagcatagtcggcgaaggatgcgtagaattgatcgtcaaagatgtggaaatggcctattccccaggtcaacacatattcgtgagaactattgataagggcatcatttccaaccatccattttctatctttccgagtgcaaagtatcccggaggaataaaaatgctgattagagcccagaaagggttttctaaaaggctatacgaaagtaatgacgacatgaagaaaattcttattgatgggccttatggtggaatcgagagagatattagaagttttaccaatgtctacttgatttgctctggttcaggtatatctacatgcttacctttcctgcaaaaatatggccccatactccataagacaaacttagaagttattacattggactgggtggtaagacatagggaggatatatcatggattagagatgaaatgtgtaccctctcaaataatttgcgccagttatttttagatgggaaaattgtggttagaatttacgtctgctcggacagtaccgtccctggtattattaaaactttccctcaaacaatagacaccgccagtgaccaatctgatttagctaaaagagaaaaagataccgaattcggccaggatgatactgagtcaaattcaactttcgacaaatccaataacgaatataaaggtctcatcaccattattccttccaaacctgatttgaatcaggtcattaatgattaccaaattgggttcaggaactgcttcatttgttcaggttctgacagcctaaggtataccgtcggaaattccgtggcaggtttacaggccaaggttttttctaacaaaaatgtcgaagagtgctatttacacagcgagagttttggctactag

SEQ ID NO: 4245 - DNA, 1863 bp, Saccharomyces cerevisiae
atgctaaatggggaagactttgtagagcataatgatatcctatcgtctccggcaaaaagcaggaatgtaaccccaaaaagggttgacccacatggagaaagacaactgagaagaattcattcatcaaagaagaatttgttggaaagaatctcgcttgtaggcaacgaaaggaaaaatacatctccagatccggcactcaaacctaaaacgccaagtaaagctccccgtaaacgtggaagaccaagaaagatacaggaagaattaactgataggatcaagaaggatgagaaagatacaatttcctctaagaaaaagaggaaattggacaaagatacatcaggtaatgtcaatgaggaaagcaagacttctaacaacaagcaggtgatggaaaagacggggataaaagagaaaagagaacgcgaaaaaatacaggtagcgaccacaacatatgaagataatgtgactccacaaactgatgataattttgtatcaaattcacccgagccaccagaacctgcaacaccatctaagaagtctttaaccactaatcatgattttacttcgcccctaaagcaaattataatgaataatttaaaagaatataaagactcaacctccccaggtaaattaaccttgagtagaaattttactccaacccctgtaccgaaaaataaaaagctctaccaaacttcggaaaccaagtcagcaagctcgtttttggatacttttgaaggatatttcgaccaaagaaaaattgtcagaactaatgcgaagtcaaggcacaccatgtcaatggcacctgacgttaccagagaagagttttccctagtatcaaactttttcaacgaaaattttcaaaaacgtcccaggcaaaagttatttgaaattcagaaaaaaatgtttccccagtattggtttgaattgactcaaggattctccttattattttatggtgtaggttcgaaacgtaattttttggaagagtttgccattgactacttgtctccgaaaatcgcgtactcgcaactggcttatgagaatgaattacaacaaaacaaacctgtaaattccatcccatgccttattttaaatggttacaaccctagctgtaactatcgtgacgtcttcaaagagattaccgatcttttggtccccgctgagttgacaagaagcgaaactaagtactggggcaatcatgtgattttgcagatccaaaagatgattgatttctacaaaaatcaacctttagatatcaaattaatacttgtagtgcataatctggatggtcctagcataaggaaaaacacttttcagacgatgctaagcttcctctccgtcatcagacaaatcgccatagtcgcctctacagaccacatttacgctccgctcctctgggacaacatgaaggcccaaaactacaactttgtctttcatgatatttcgaattttgaaccgtcgacagtcgagtctacgttccaagatgtgatgaagatgggtaaaagcgataccagcagtggtgctgaaggtgcgaaatacgtcttacaatcacttactgtgaactccaagaagatgtataagttgcttattgaaacacaaatgcagaatatggggaatctatccgctaacacaggtcctaagcgtggtactcaaagaactggagtagaacttaaacttttcaaccatctctgtgccgctgattttattgcttctaatgagatagctctaaggtcgatgcttagagaattcatagaacataaaatggccaacataactaagaacaattctggaatggaaattatttgggtaccctacacgtatgcggaacttgaaaaacttctgaaaaccgttttaaatactctataa

SEQ ID NO: 4246 - DNA, 1863 bp, Saccharomyces cerevisiae
atggagggctcatatctatctgcacaagaaaaccaacccataccggagcgattgatacctaggtcgaactcaacttcgaatttgtttgctttgtctagtacattctctaaactcaatgttaggaatgatgctgattacaattattcgaacccgaataagaagagacacatttatagtggcgagatagactgtaggtctgtgacagcagctagaaaatttccagtaaggtcctgttcaatgacagccgcccagcaaagaaagagaactgcgctattcacagttagggaaagaaactcttaccatgaggggttcaataatgatcaagattatgtgagccaataccagaagccacagtacactttcggagtatataaagaattaacaccttatcaactgcagcgctctaaaatgaaaagaagctttcaatttcccaatggcgaaatatacaagccaaaacttgatggaaaatgcacccacagcttgaaaaagcctgaattaaattcaagagactcttctttattcaaattcagcgagaagaaaggtcgcaatttatcaaaagattttgtggggcctcataatgggacatcagtcatacatattcctcccaatgatacaggctacggtgtaaatagcttggagctgaacacttcagttccttcaacaataaaaagttcggtttcatcaacctctccgatatctgctgttaataccctgaccagcttgccagaaagtcaaactgatgatgatgacggttatgaaaataaaactgtaactatatcttattgcttcgaaaatacggtaaatgaaaaacatggtagccatatagaaaaattggatttatcaactaaggaaaaaactaagccaacaactaattcaggcctatttgatagaaagaaaaagactattctgggcactgagaaatatagatgtataaagtcacaatcgaagttgaaactgggttctgttttgaagaaattatggcgtacttcaggaaactcgaatacaaagcatggaaaaaaggatacaaaaagaaggagaattcctatcgatgatatggttacgcattctgatggaaattctgaagctgagaatgatattgaattaatggatgcaaatctggacggcattgaatttgacgacgacgaaactctaatggatacagattcaatttttgatgatctgttgtccaaggaaaatgataaatacgatttgaggcgaaggcaattagaaatacgacaaaagctccacgagacctcgcacaacgacgatggcaaggtttcttttcgagataccgaaaagcataatgtcaatgaaggtttgatcgacaagaccataatcgaagaattttcaaagctcggtgaatatataatcgacacgagaaatcaaccaccaccaagatcgtccaagaggccttcattagatgacaatgaatctgcacgatacttctacaacatatcgacagatttgcgacagtctctgtcaggtccaataagcttaccaatgcatgttgggaacgacatggtaaataggttgagaaatgactgggagtatatcagattcgaagatagaaggaattcgctgccagattcctcatttgataaagtcgaaacacctccaaaaccaataaaaaaagatgtccggtttgcaaaagaagtatgtttagcaagcacttggtcatcgaatgcatatgagagagctaatccggaattcattatgaatcgccacagattgttgtggatgatgaaagtacatccaagcatgaatagtgccatgaatgagatcaaacttgaacttaactcttacaaaaaaaatgagatggttgtccatgagaacagcaagtgctttacacattatttaatttga

SEQ ID NO: 4247 - DNA, 1863 bp, Saccharomyces cerevisiae
atgggcagatcaaagaaaagatcaagagcatcttcgtctcgattaaatccactacgcaaagctgggtcaaatgacaataataaagataccaacgtcgttaataaaaaactccagccgctattgcagaatttgtcaagtgtggtgcctaatgatagaagtattgctttgagttccatcagtgttctttgtgaggatgcacatatgagacaacttttactgaaagagaaattagttcctatcattttgaataaattgctgaacgattctaattcggacatagttgtggagtcgttcggcttattaaggaacttgtctttggaagaaggttatgatgtgtcaatctacctttggagatctgatatatggacaagtataacaagtaattttggcaggattgttgaatcgttatccgctttgcaagcagcagaacagcaaccgcagctaaaacctgcaggaaaatccaaaatagaatctaaaaggttgttattcgattttgccgataacttactgtcgttagtggtggctctgtctaatggatccgacgatattcttaatgagatattaacggaaagtaaaataaatgaaatttttcaggtcatttcacagctattaaaatatggtgtcgagaaactgccaattaatctgttcaataccactcttgatctcatttatgatttgagttccgaatcatttgaatttattgatcatgtttccaacaatgaacttctatcacagttcttaaatgggctatctccggctttacatccacaagctaatgaattaacaaaagttctaattgaaggtatccattgccaattccttgacatgaaaataacttatgatcaatgtaacaaaatgatccactctgtatgtcattccattaataacattgatccagtacagttagttaatgacattaataaccctgtagaaattggacctgctactagtaaagatgaaagcagtaaggttataactaagatcaaggattacaatgcgaaacgtaacgaatccatgataaaattgcaaagcattgaaatagcaattgatcttatcaccgcaatcattgagatagttgcatccaaatatgaatcaccagaatcacaggaagtagcaattccagaggagctaatcaataccttaacaaatttcttacctcacgttttcatgattttgaaagataccttcacctcgcgaatattgatcggatggaacaatctgatctggctctttgtgtctctatctctaacagagctctctggagagttgttaaccaccttatggagttatgttacacagttggacagccaagatgatttgagtattaaaataggaagaatgggctgtatttgggcgcttctgaaactcatctttcctgatggagcgtttgaaagtgagaatcgagcattgatcaatgtccaaatgctgaacaattcaggattcgctaggggaattattgaagagttccaaaataataatgaccttgagttacaacaaaaatgtattaatgtactaagcacatatgctatgattcagggacaaattgatgcaaataaggagattgggcagttcttcatacaaactttaacacagttgaatgttcgccctgaaattttgatagaaatgacaaattcgcttttccaaatttacggggatgcctcttacgactataatgaaccaatatttgtaaggggtggatttttatctattctaaaagaccaagttgtaccaaatttgaggcagcaattcaaaatggttgataaaaacaaaaatcccgaactaaaagaaagatgccatgattgctttactacgttggatagtttcattcactacaaaatgaatgaaaattctactaaccaatag

SEQ ID NO: 4248 - DNA, 1863 bp, Saccharomyces cerevisiae
atggttaaggaaactccattacactcatcttcatcaacttcgctgtcttcattatttaggccaactaagttgaagaatttatcggctaaaatattcaatggaggtggtaaccaatcatactcaaagacagatgatgtttcaaggtcttcttctagatcttcaaaaaagaatacagattctgaccaagaggatcaaataaagtataacaaacccaacgaccgaagatctaccataggaaagagcccccagggaaatggcgcgttgtcaaaggagtcacacgtagtagcaagttctactttgacaggtatttctcctacttcagctaaaaaagctcctattgactactctccttcacggcccttacctaacaatcataatcccgttcgtacgggacacactgtgccccacttaccccatagtattcacaatccaataaactacattcatcaaggctcaaaagatgctttccaccatcctcaccccgttcgctctacagctcatagcaacatttctacagtgtcttctgcaaaatctgatacaccctcttcgaatttatcataccaggcacatatgcatcccgtagagatactacagaaacagattgaagacaaacacttcatggactctcaagcctccacccctgggtccgtggaactacagcataattcttcaagcggtagtgatgatacctcatcaagaaagaaaaaatccttgagattaacaagatttttcaaaaaaattcataatgattatcacgataaccatcatcatcaccaccatcacaaccgtggatccacccctacaaaaccgaagctcaatttgaacaccaatgaaaatatagtagaaagtaacggaaaagcgttatacgaaacagataacccagtggagctattagaaaaatatggtattcctggtagaaaattaggcgaaggagcttccggttcagtgtccgtagtagaaagaacagacggcaagttatttgcttgcaaaatgttcagaaaaccacacttaaacaatgaaggaactaatcagtctcaattagctaattattctaagaaggttaccactgaattttgtattggttccacgctgcaccacgaaaatatcgttgaaaccctagatatgttgactgaaggtgacacctatttattagtaatggagtatgcgccatatgatttttttaatctcgtcatgagtaacctaatgacacaagatgaagtcaactgttacttcaagcagctgtgccacggcgttaattacctgcactctatgggcttagctcatagggatttaaaattggacaattgtgtcgtcactaaagatggcatcttgaaactgattgactttgggagcgctgtagtgttccaatacccttacgaagataccattgtaaaatcacatggaatcgtgggttctgacccttatttggctcctgagttattgaaacaaacatcctacgatccaagagtagcagatgtgtggtctatcgctattatattttactgtatggtccttaaaagatttccttggaaggctccaaaaaagagcttcaactcatttaggttatttactgaggaacctgaggacgaagatgatatagttcgggggccaaataaaatattaaggctactgccaagacattcacggacaataataggcagaatgttggctttagaaccaaagcaaagagttttaatgaatgacgtggtaaaggatgattggcttgtatccgtcccctcctgtgaagttgaccctacatctggcgatttggttgaaaaaccaaagaatcataagcatcacttggtcactgaggaggagttgaatgagctgaccaagcaacacgggaataaagattcaaattaa

SEQ ID NO: 4249 - DNA, 1866 bp, Saccharomyces cerevisiae
atgagcagtgttcaactttcgaggggcgattttcatagcatcttcaccaataagcaaaggtacgataatcccaccggtggcgtttatcaagtttataacaccaggaaatctgatggggctaacagcaacagaaagaatttgatcatgatttccgatggtatttaccatatgaaggctctgttgagaaaccaagctgcatccaagttccagtcaatggaactacaaaggggtgatatcattcgcgtgataattgcagaacctgctattgtcagggaaagaaagaaatacgttcttttagtagatgactttgagttggtccagtcgcgtgctgatatggtcaaccaaactagtacttttttggataactatttctcagagcatccaaatgaaaccttaaaagacgaagatataactgacagtggtaatgttgccaatcaaacaaacgccagcaatgctggtgtccctgatatgctgcattcaaactcaaacttgaatgcaaatgagagaaaattcgccaatgaaaaccctaattcgcaaaaaaccagaccaatttttgccatcgaacaactgtctccataccaaaacgtttggactatcaaagcaagagtttcctacaagggagaaattaaaacgtggcacaatcaaagaggtgatggtaaactattcaatgtcaacttcttggatacctctggagaaatccgagccacggcgtttaatgattttgctacaaaatttaacgaaattttacaagaaggcaaagtatactatgtatcaaaggcaaaactccaaccagctaagccccaatttactaatctaacacacccttatgaactgaatttggatagagacactgttatagaagaatgtttcgatgaaagtaatgttccgaaaacccatttcaatttcatcaaactagatgctattcagaaccaggaagtaaattccaacgtagacgtcctcggtattatccaaactataaacccacattttgagctaacttcaagggctgggaagaaattcgatcgtcgtgacatcacaattgttgacgactctgggttttctatctctgttggcctatggaatcagcaagcccttgatttcaaccttcctgaaggttctgttgctgccattaaaggtgttcgtgtgacggattttggtggcaaatctttgtctatgggattttctagtaccctgattccgaatccagaaattcctgaggcatatgccttaaagggttggtatgattccaagggccgcaacgcaaacttcatcactttaaagcaagaacccggtatgggtggtcaatcggctgctagcttaacaaaattcattgctcagcgtattactattgctagagctcaagctgaaaatctaggaagaagcgagaaaggtgacttttttagtgttaaagctgctataagtttcttaaaagttgataattttgcatatcctgcctgttctaatgagaattgtaataagaaagttctggaacagcctgatggtacttggagatgtgagaagtgcgacaccaataatgcaaggccaaattggagatacatcttgacaatatcaattattgacgaaaccaatcaactatggctcactttatttgacgaccaagctaaacaattattgggtgttgatgctaatacattaatgtctttgaaggaagaagaccccaacgaattcacaaaaattactcaaagtatccaaatgaacgaatatgactttaggattagagcgcgtgaggatacatacaatgatcaaagcagaattagatataccgttgctaacctacacagcttgaattacagggctgaagccgactatcttgccgatgagttatccaaggctttgttagcttaa

SEQ ID NO: 4250 - DNA, 1866 bp, Saccharomyces cerevisiae
atgtcagttgaagtagataagcaccggaacacactacagtatcataaaaagaacccttactcccctttattctccccaatttctacatataggtgttatcctcgggtattgaacaatccctccgagtctagaagatcagccagttttagtggtatttataaaaaaagaaccaatacgtcaagattcaattatttaaacgaccgccgtgttttatcaatggaagaatcaatgaaagatgggtcagatagagctagtaaagctggttttataggaggcataagagaaactctttggaactcaggtaagtacttatggcacacatttgtgaaaaacgaacctcgcaattttgatggttctgaagtagaagcaagtggtaacagcgacgttgagagcagaagttctggaagtaggagcagtgacgtaccatatggtctacgtgaaaattattcctcggatacaagaaaacacaaattcgatacgtcgacgtgggccttaccaaataaaaggagaagaatcgaaagtgaaggtgtggggacaccttcaacctcaccaatcagctctttggcttctcaaaaaagcaattgtgatagtgacaatagcataactttttcgagagatccttttggttggaataagtggaaaacaagtgctattggttctaactcagaaaataacacttctgatcagaaaaatagctacgacaggcgacagtatgggacagcctttattagaaagaaaaaagttgcaaaacagaacattaacaatactaaactggtgtcgagagcacaatctgaggaagtaacatatttacgacaaatattcaacggagaatataaagttccaaaaatattaaaagaagaaagagaaagacagttaaaattaatggatatggataaggaaaaagacactggcttaaaaaagtctataatcgacttaactgaaaagatcaaaacaattttaattgagaacaacaagaacagactacagacaagaaatgaaaatgatgatgatttagtatttgttaaagaaaaaaagatatcttctttggaaaggaaacataaggattacttaaatcaaaagttgaagtttgatagatctatattagagtttgagaaagacttcaaaagatataacgaaattttaaatgaaagaaagaagattcaagaagatcttaaaaaaaagaaagaacaattggccaagaagaaacttgttcctgaattaaatgaaaaagacgatgaccaagtacaaaaagctttggcatctagagaaaatactcagttaatgaatagagataatatagagataacagtacgtgattttaagaccttggcaccacgaagatggctaaatgacactatcattgagttttttatgaaatacattgaaaaatctacccctaatacagtggcgtttaattcatttttctataccaatttatcagaaaggggttatcaaggcgtccggaggtggatgaagagaaagaagacacaaattgataaacttgataaaatctttacaccaataaatttgaaccaatcccactgggcgttgggcataattgatttaaaaaagaaaactataggttacgtagattcattatcgaatggtccaaatgctatgagtttcgctatactgactgacttgcaaaaatatgttatggaggaaagtaagcatacaataggagaagactttgatttgattcatttagattgtccgcagcaaccaaatggctacgactgtggaatatatgtttgtatgaatactctctatggaagtgcagatgcgccattggattttgattataaagatgcgattaggatgagaagatttattgcccatttgattttaaccgacgctttaaaatag

SEQ ID NO: 4251 - DNA, 1866 bp, Saccharomyces cerevisiae
atgttcgaccaattagcagtctttacccctcaaggtcaagtactttaccaatataactgtttaggaaaaaagttttctgaaatacaaattaacagctttatatcccagctgattacttccccagtaactagaaaagaaagtgttgcaaacgcaaatacagacggatttgatttcaatcttttaacaatcaacagcgaacacaaaaattctccttcatttaatgcactattttatttgaataagcaaccagaattgtatttcgtagtgacttttgccgagcagactttagagcttaatcaagaaactcaacaaacacttgcactggtgttaaaactctggaactcattgcatttaagtgaatccattctaaaaaatcgtcagggccaaaacgaaaagaacaagcataactacgtcgatattcttcagggaattgaagacgacctgaagaaatttgagcaatattttaggataaaatatgaagagtcaataaaacaagaccatatcaatccagataattttaccaaaaatggatcagtaccccaatcgcataataaaaataccaagaaaaaattgagggatacaaaaggtaagaagcaatctacaggaaatgttggtagtgggagaaagtggggccgtgatggtggcatgcttgatgaaatgaatcatgaagatgcagccaaattagatttctcatcatccaacagccacaatagtagccaagtagctctagactccactattaataaagattcttttggggatagaacagaaggaggcgatttcttaatcaaagaaattgatgatcttttgtcttctcataaagacgagataactagtgggaacgaagctaaaaattctggatacgtcagtacagcttttggattccttcaaaaacacgttctaggtaacaaaacgatcaatgaaagtgatttgaaatctgtattagagaagttaacacaacaattgataaccaaaaatgtagcaccagaggcagcagactatttaacacagcaagtctcacatgatcttgtaggctcaaaaactgcaaattggaccagtgttgagaatactgctcgtgaatctttaacaaaagcattaactcaaatattaacgcctggtgtatccgttgatctcctccgtgaaattcagagcaaaagaagcaaaaaggatgaagaaggtaaatgtgatccctatgtgttctctatagttggtgttaatggtgttggtaagtcaacaaatctttcaaagctagcgttttggttactgcaaaataatttcaaggtcttaattgttgcttgtgatacgtttaggtctggtgcagttgagcaactaagggtccatgttgaaaatttggcacagctaatggatgattcacacgttcgtggctccaagaacaaaaggggtaaaactggtaatgactacgttgaactatttgaagctggttatggtggatctgacttggtaaccaaaattgcaaagcaagccatcaaatattctcgtgatcaaaacttcgatatagtgttaatggatactgccgggagaaggcataatgatcctactttaatgtcgccattgaagtctttcgctgaccaagccaagccagataaaatcattatggttggagaggctttagtaggtactgattctgtccagcaagccaaaaattttaatgatgccttcggaaagggaagaaatcttgacttctttattatctccaagtgtgacacagttggtgaaatgctgggtactatggtaaatatggtttatgctacggggattcctatcttattcgttggcgtgggacaaacctataccgatttgaggacattaagcgtaaaatgggctgttaatacattaatgtcttaa

SEQ ID NO: 4252 - DNA, 1869 bp, Saccharomyces cerevisiae
atgaacagacaggaatccataaattcgtttaattcagacgaaacatcttcgttgtctgatgtagaaagtcagcagccgcaacaatatatcccttcagagagtggatctaaatccaacatggctcctaatcaactgaagttgacccggacggaaaccgtgaagtcattgcaggacatgggtgtgagctccaaagcccccgttcctgatgttaatgctcctcaatctagcaagaataagatttttcctgaagaatatactttagaaacccctacaggtttagttcctgtcgccactctacattccataggtagaacttctactgcgatttcccgtacgagaactagacagatcgatggcgcttcttcgccttcttctaatgaagatgctttagaaagtgataataacgaaaagggtaaagaaggcgactctagtggtgcgaatgacgaagctccagatctagatccggaaattgaattcgttacctttgtgactggcgatccagaaaacccccataactggcctgcatggatccgttggagttacactgtcctactgtcaatcttagttatttgtgtcgcctacgggtctgcttgtatcagtggtgggttgggaaccgttgaaaagaaataccatgtaggtatggaagccgctattttatcggtttctttaatggttattgggttctcgctgggtcctttgatttggtctcctgttagtgatctttacggtagaagagttgcttactttgtttctatgggtctttatgtcatcttcaatatcccttgcgccttagctccaaatctaggtagtcttttagcttgtagatttttatgtggtgtttggtcatcatctggtttgtgtttagttggtgggtctattgccgatatgttcccaagtgaaacaagaggtaaggctattgctttcttcgcttttgctccttacgttggtcccgttgttggtccactagttaacggttttatttccgtttctaccggacgtatggacctgattttctgggtcaatatggcctttgcaggtgttatgtggatcatatcttctgccatcccagaaacgtacgctccagttatcttgaagagaaaggctgctagattaagaaaggaaactggtaatcccaagattatgactgagcaggaagcgcaaggtgtcagtatgggtgaaatgatgagggcttgtctgttgagacctttgtacttctctgtcactgaacctgttctagttgctacttgtttctacgtgtgtttgatttactctctactatatgcgttcttctttgccttccctgtcattttcggtgaactatatggctacaaagacaaccttgtgggtttgatgtttattcctattgttatcggtgctctttgggcgttagccacaactttctactgtgaaaacaagtatttacaaattgtcaaacagcgtaaacctactcctgaagatcgtttgctaggtgctaagatcggtgctccatttgctgcaattgctttatggatcctgggtgctaccgcttataaacatattatttgggttggtccagcttcagctggtttagcttttggtttcggtatggtgttgatttattattcattgaataattacattattgattgctacgtccaatacgcatccagtgctctggctacaaaggttttcttaagatccgccggtggtgctgccttccccttgtttaccattcaaatgtaccacaaattgaatctgcactggggttcttggttgttggctttcatctccactgctatgattgctttaccttttgcattttcttactggggcaaaggtttgagacataagttatccaagaaggattattccatagatagtattgaataa

SEQ ID NO: 4253 - DNA, 1869 bp, Saccharomyces cerevisiae
atgagattacattatagaagaagatttaattttttaaggagaatactttttatattatgcattacttcattgtatttatcgagagattcactaaagctacatgcaaaaaatgtattaatggatcataatgtagcagaatatcatggcggaatgatagacgatattcaaatcctgcggtgctaccattggtacaggcaatgtagttctttgtatgccccgaaattacacccctccaatactgctaaaaagatcaaagacaaaaacagcattctgtggaccagagtttctaagaatattactgtagagacattgtattcacttcagtctggaccattctacaacagttacttatatgttcatctgaaagatttccaaagtaatccaaaaaacacaataaaagaactagccatagcaagggactcagcactaatacccctacaagtgctgagagacattaataagttggtgaaatcgagcgacagttctgtctttcacaatcatgtgtatctacgagaaaagcctacttcgtcatggtggaagctgcttttcggcatatccgttgatacagataacatagctgtgttcggtgaggagtgggtatacaaggggagcggcatatggtgtaagtatatccttaatgatgatgataatgacgctcctataactaatttggaaatatatctaggatcatcgtttattgaatcgaggccttcttggaaagaagttatccatgaatttcatagaaataacataccttctctgcccatatcaattacaagaaagcttgaaaccaaaaaccatcatcacaaattttctaatggattgctaggttctttgagaacacccagcaaagacattaatatccaagtcgatgcagattacaaaataacatctccccatatacaattttcgaggggacaaagatcattcaaaattctccaaataactgattttcatttcaaatgtacggataatagcatgaccgtaatcaatgaaataaaaacagtaaattttattgatagggtactcgcatcagaaaaccctgatttagttgtgatcacaggtgatttgttagactcacataatactatcgactatcaaacgtgcattatgaaagttgtccaaccaatgatttctaataaaataccctacgcaatttcattgggtgtttctgacgaatccaatttggccacatcggcacaaattagagactttatcaggaatttaccttacacatttaacaacgttgcatcagaagagggtcatatggccatagaagtctcatttaaaaagaagctcacgaagaatactcttttggaaagagacattgataccgaagacgaaacaaacccatcagaggctttatttttcgtctttgattcatttgcgcccgtcaataatttcctacaagattataacgacctgattgggaaaatagactttggcttggcatttcaatattttccattatcggaatataggcctcatggtttatttcctattattgggcagtataatgagaggtctaccttaacagtagatacgccaaggtctagaggacaagtttcaatgacgatcaatggcaaacattacaaaagcttccttgatatcctgagtctttggaatataaagggtgtcagttgcggacatgaacataataatgactgttgcttacagtcaaaaaatgagatgtggttatgttacggtgggtccgctggtataggcttgccgagaatccaaggtatatatccaaccgttagattatttaacttggatgatattttggacgaaataacttcgtggaagaggaatagcaatcttgttgacgaggtttacgattatcagtacatctataaggggaagcaataa

SEQ ID NO: 4254 - DNA, 1869 bp, Saccharomyces cerevisiae
atgagcttttccaccataaatagcaacgtcaataaaaccaccggcgatagcaataataacaccaccgagaacagttcgactgcagaccttttaggaatggacttgttgcagagcgggcctcgactgatgaacacgatgcagccaaacaactcttctgacatgctgcacattaacaacaagactaataacgttcaacaaccagctggaaacacaaatatcagcagtgctaatgcgggagcaaaggctccagcaaatgagttcgtaagaaaactgttcaggatactggaaaacaatgaatatcctgacattgtaacttggactgagaacggcaaaagtttcgtcgttttggacacaggaaagttcactacgcatatattgcctaatcacttcaaacattcaaattttgcatcttttgtaaggcaactaaacaagtatgactttcacaaggttaagagaagtcccgaggaaagacagagatgtaaatatggcgaacaaagttgggagtttcagcatccagaatttagagtccattacggaaaaggtctcgataacatcaaaaggaaaattccggcgcaaaggaaagtgcttttggatgaatctcaaaaggctcttttgcatttcaatagtgaaggcactaaccccaacaatccttctgggtctcttttgaatgaatccaccacagagctgttgttaagcaataccgtaagtaaagatgcatttggaaatctaagaaggcgagtagacaaactacaaaaggagttggatatgtccaaaatggagagttatgctactaaagtagaactacaaaagttgaactcgaaatacaatacggttatcgaaagtttgataacattcaagaccataaatgaaaatttactcaacaacttcaacactctgtgttccactttggcaaataatggtattgaagtgccaatatttggcgacaatggaaaccgtaacccaactggtaataccaacccagcaacaacaacagctatccaaagcaacaacaacaccaacaatgcttctccggcaacatctacagtttccttacaactacctaatttacccgatcagaatagcctaacaccaaatgctcaaaataacacagtcacgctacgaaaaggtttccatgtactgttggtggaagatgacgcagtgtctatacagttgtgttcaaaatttttacggaaatatggctgtactgtccaagttgtcagcgacggtctttcagctatctcaacactagagaagtataggtatgatttggttttaatggacattgttatgccaaacctagatggtgccacagcgacatccattgtcagaagttttgataatgagactcccatcattgccatgacaggtaacattatgaatcaagacttgatcacatacttacaacatggaatgaatgatatcttggccaaaccattcacgagggatgatttacactcaattttaatacgttatctaaaggaccgtattcctttatgcgaacagcaattaccacctcgcaactcttcgccacaaactcattccaacaccaatactgctaattcgaatcctaatacgattaatgaacagtcgttagccatgttaccacaagataatccgtcaactactacccctgttaccccaggtgcctctatatcttctgcacagcatgttcaacaaggtcaacaagaacagcagcatcaaattttccatgctcagcagcagcagcagcatcacaacgccattgctaatgctaggtcagacgtagccataccgaatttggaacatgaaatcaacactgtaccacattcctcaatgggttccactccgcaattaccacaatctacacttcaagaaaaccagctatcataa

SEQ ID NO: 4255 - DNA, 1869 bp, Saccharomyces cerevisiae
atgctaatcacacgtttacgggtccctacaataaagcggccactgcttccaattacaagtcatctcgtaagacactgtattcgaacttacgtcgcaactaatcatggaaatgtcagaccttttataacaccttacaagagttcgttacctgttagatgtttgatcgcccaaaggcacatccgaacatttccaagcaatgacaagttcactaccaaggcttccaatattgagactattttgctgagaaaaaataatgagcgagagttcaagcaatcgcttctagcagatgcaaagaattttcaagaaaggttcaaaatcaatctaaagtggattcttattaaaaacaacaggccgttctctctgaatgaaataagtattatagcgtcttggctgatattgtcacaaattctatggctcattctgagcaccaccactttcatttcgttctatctattcgtcattaactctgttttcagtcaggaatacatccatgagaagaaaatctatgaaaggcttctaaaatggttgttgaaagatcataagtgctccaatcaagatttggaaatcacattttctccggaagataaagcatcaatgcttgtgctctctccagactgggagtcaaattcaatacttataaaaaggctaaatgtcagggatgagattttggacttagacttaaaatttcaccacattaacctgaatgtttccctaaaaaattggttacttggcaggggactaattacaaatgtttcaatatacggtattagaggatgtttgaacttatccaatttcatcaatttagtaaactcttttcaaggagatcaaaagacggagaattttttgaaaactttaaataacgttgaaattactgactcagaaattcttttgaaacaatctctgagtgcccaggaaactccgagtctaaaattttccatttacaatctatctttaccacgactaagactgaaccattttatttctgatattctgagtgccaaaacattttctggttcaattaataattctcttttcaacttatttaagaggcaacaaaagttaacagcagttattgaaaataataacaaaaataggatggcaagctcgaagtttgatttcacggacaacaatcaggaaaattaccgcacagtgactcatcaggatgatccgaattatgtaacgacgttaagattgaactttatcaacattaatgatttaaaatttaatggcgatggtaagttcaactggttgaaagacggccaagttgaaatacttgctgacataatgctaacaaattctacttctcatctatcatcggagtcgaaatatgcagtggtggatttgaaggtaacttgtagggacttgaagacaactttccctcaggaacctccagtattatcgacaggtgacagtattgtttcattggatgaattgaaacctataataacatttattaactcatatgaagggatggctaatcctatattgaaagatttctcggaaaacgagagattgaccaattccataatctggaactcgccaaatgtatcgattaataggcaaaggaaatcttatcctttaactacaaaagtcacttccaattccacgaaggaaatcatcaagtttcataatcaaccaaatactaatgcaaacgaaattgttttacgctgtaagatggtcaaaaacttgtcagatttacagcttattaacattaatcaaatactagaccaaattaccatggagctatatgttgatttaaccaaaatagtagaagattgggagtttaaaaacaaaaatgattggatgaaacaatggggtactacctttgcatcccaattattgttgtttgggtttggtgccatggtttga

SEQ ID NO: 4256 - DNA, 1869 bp, Saccharomyces cerevisiae
atggtacgtcgatggattcctagtggcaggcatcttcgcaataatgacaacactggtgatgatgacgacagcgagttcacaaactcgatggattctgggatgtccataccatcactcagggactccatgaccacgaggtcatctcataacgatcccatcaagcctgctctgatgaacgattccaacaaagtcaaaaatttggagaaggagttgactaatgccaaaatcaagattcaagtactctatgaatacattcgcagaatccctaataaagacggcaatgcaccatcgctgggcaatgacactgattttagaaattcgattatcgagggtctaaatcttgaaataaacaaattgaaacaggatttaaaggcgaaggaagtcgagtaccaagatacgctacaattcgttcaagagaatttagaaaattcggaaagtatcgtgaatacgatcaatcacctattgtcctttatattgacgcattttaatgagcaagatgaaaatgcccatcttcttgataaagaagagagggagaccctggaggaaactttagagctgagctcggattatgttcttgaaaaaatggatactttgtccaagttcatcatccaattcttgcaggactttttgcattccaaaagtcgagcggaatcaaagcaggataaggaagaatttctttcactggcccagtcctcaccagcaggatcacagttagaaagtagggactcaccatcaagtaaagaggagaatactgatggtggataccagaatgacgaaattcatgacagtaacaaccacattgatacagaaaatgtaatggcaaacagtacttccttaccaatttcagccgtcgagtctcgttttgagaaaaccttagacactcaattagagattgtcatagaaaatttgcacaaagaatatgatcaatttataaattccattagattgaaattcgagaaatcgcaaaaattagaaaaaataatagcgtccaaactaaatgagcagtctcatctactagattccttagaattggaagaaaattctagttccgttatagaaaaacaagatcatttgatttcccaactgaaggaaaagatcgaatcgcaatctgtcttgataaacaatttggaaaaattgaaggaagacatcattaaaatgaaacaaaatgaaaaagttttaaccaaagaactggaaactcagaccaaaatcaataaactaaaggaaaataattgggacagctacatcaatgacttggaaaaacaaatcaatgaccttcaaatcgataaatcagaggaattccacgtaatacaaaatcagttagacaaattagacttggagaattaccaattaaaaaatcagttaaatactttggacaaccaaaagttaatactatcccaatatgaaagcaattttatcaaatttaatcagaaccttttactacaccttgacagtattttcaatattctgcagaaaatcttacaagaaagttctattgcccaatttgacaggaaaatgaaatccataaaatctgtaccaaatgcgttgaaaaacttgaatttgattcagcccaaactagaatcgctctacacttttatagagactgcattagagtccataataaactcatatatctcttcactgatttccatggaaaccccagagcagccacatcaacagggcaatgaattaacggcaactccaaataaagaactgaccttacgaatagaggagttacaaagaagatggatatccgaaagagaaagacggaagctcgatgctaacgcttcagaagctcgaatcaaggctttagaacaggaaaatgagtcattgagatcgaaacttttcaacctatcaatcaacaatccctaa

SEQ ID NO: 4257 - DNA, 1869 bp, Saccharomyces cerevisiae
atgtccgttagcacgccaagtgagttagacgcattaatagaacaagccactagtgagagcattcccaacggtgaccttgatctccccatagcgttggaaatttcagatgtgttaagatctagaagggtaaatcccaaagattctatgcgttgtataaagaaaaggattctcaatacggccgataatccaaatacccaattgtcttcctggaagcttaccaatatatgtgtaaaaaatggtggaacgccttttattaaggaaatttgttccagagagttcatggataccatggaacatgtcattttaagagaagatagcaacgaagaactttctgagctggtaaagaccatattatatgaactatacgtagccttcaaaaatgattcgcaacttaactatgtggcaaaagtttatgataaattaatctctcgtggcattaaattccctgaaaagctaacactttccaattctccgactgcaatgtttgactcgaagacgcccgcagattggattgattctgatgcttgtatgatttgctccaaaaagttttctctactaaataggaaacatcactgtcgttcctgtggtggagttttctgccaagaacactcatcaaatagtatacccttacctgatttgggtatatatgagccagtcagagtatgtgatagctgctttgaagattacgatttgaagagacatgacgacagtaaaaaatctaaaaaacatcgccataaaagaaagaaggacagggactactcaactcctgaggatgaagaagagctgataaggaaagcaatagaactctccttgaaagaatctagaaatagcgctagtagcgagcctattgtccccgttgtagaatcaaagaatgaggtgaagagacaagaaatagaagaagaagaagatcctgatttaaaagctgctattcaggaaagcttgagagaagctgaagaagcgaagctacgcagtgagcgtcaaaaagcctctagacagatgcaaccccaacagccatcacctcaacctcaacctatccattccgttgatttatctgatgaggagaaagacagcatatacatgtttgcttcacttgtcgaaaaaatgaaatcgaggcccttgaacgaaattttggaagactctaaattacaaaacttggctcaaagagtatttgcttccaaagcaaggttgaattatgctttaaatgataaagctcagaaatacaatactttgatagaaatgaacggcaagatttcggaaattatgaacatatacgatagattattggagcaacagctacaaagcatcaatttgtctcagcaatacacacttccacaagtcccttctgatccgtacaattacctaacagaaaatgtgcaaaatccagcagaaagctatcaaacacctcccctccagcaactatcatctcatcaatacaaaccacaacaggatgtctcacgccaacaatcggtaaaagcaaattcatcacctaccactaatattgatcacttgaaaaccatcgatgtgacaccacacgcacagcaaaagcctcaatcgcacgttgaacttgcaccttcggacccaccttatccaaaagaagaggccgaagatgaaggaacacaggcagtgcaagatgaggaatcctccacacaagaatcccgcgaaaggccgtatccagtagaaacagagaatggtgaaacttcaataaataaacggcctcaaggcattacacgttacgattttccaactgttcctgcacgcaaattcgtccaaccggagtcaactgtaccacttcctgcaagttcctctgaaattccgatcaaagaggaaaggccgcctagtcctcaagaggaactgctaatagagctttaa

SEQ ID NO: 4258 - DNA, 1869 bp, Saccharomyces cerevisiae
atgttgcaaggaattttagaaaccgtaccatctgacttgaaagatccgatatcattatggtttaagcaagaccgcaacccaaaaactatagaagaggtcaccgctctctgcaaaaaatccgactggaatgagttacacaaaagatttgattctagaattcagtttggcactgctggtttaagatcgcaaatgcaagctggctttagcaggatgaatactttagtagtcatacaagcgtctcagggattggcaacttatgtaagacaacagtttccagacaatttggtagctgttgtgggacacgatcatagattccattctaaggagttcgctagagctactgctgctgcatttcttttaaaaggatttaaggtacattatttgaatcctgaccacgaatttgttcatacccctttagttccctttgcagtggataagctaaaggcctccgttggcgtaatgataacagcaagtcacaacccaaaaatggataatggatataaagtatactattccaatggatgccaaatcattccacctcacgatcatgccatctctgattccattgacgcaaatttagaaccatgggccaatgtgtgggatttcgacgatgttctaaataaggctctcaaacaagggaaattgatgtattccagagaagaaatgctgaagttatatttagaggaggtttctaaaaatctggtagaaatcaacccattaaagcttgaagtaaaagccaaaccttggttcgtttacactccaatgcatggggttggatttgacattttcagcaccatcgtaaaaaaaacactgtgcctggtagaaggtaaggattacctatgtgttcctgaacaacaaaatccagatccttctttcccaactgttggatttcctaaccctgaagaaaaaggtgctttagacattggtataaacttggctgaaaaacatgacattgacttacttgttgccaacgaccctgacgctgatagattctctgttgctgttaaagatatgcagtcaggcgaatggcgacaactaacaggtaacgaaatcggttttctttttgcattttatgaatatcagaaatataaaagtatggacaaagaatttcagcacgttcatccgttggctatgttaaattcaacagtgtcttcacaaatgataaaaaaaatggcagaaatagaagggttccattatgaggatacattaacaggatttaagtggatcggaaatcgtgccatactcttggaaaagaaaggctattacgttccttttggattcgaggaagcaataggctacatgtttccagcaatggagcatgataaggatggtatcagtgcatccattgtcttcttgcaagcctactgtaagtggaaaatagaccacaatttggacccgctaaatgtcttagaaaatggcttcaaaaaatatggcgtgttcaaagagtacaatggctattatgtcgttccaaatccaactgttacaaaagatatatttgactacatcaggaatgtctacactcctgagggcgcgtcatatccttcatctattggtgaagaaatcgaagtactttactatcgagatttaaccactggttaccaatcggataccataaatcataaacctactctacccgtcgatcctacatcacaaatgataacagtatctgctagaccaagtaacggtagtgagaatgagcatatccgcttcactattcgcgggtccggaacagaaccaaaacttaaagtatatattgaagcttgcgcaaatgaagaacaaagagcctctttcttggcgaaattgacttggaatgtgctgagacgtgaatggtttagaccagatgaaatgaatatagttacaaaattttga

SEQ ID NO: 4259 - DNA, 1869 bp, Saccharomyces cerevisiae
atgttgttctactcgttcgtgtggtctgtactggccgctagtgttgctttggcaaagacacataagttaaactataccgcttcttgggtaactgccaatcctgatggattgcatgaaaaaaggatgattggttttaatggcgaatggccacttccagatatccatgttgaaaaaggagatcgtgttgagctttatttgactaacggctttcaagacaatactgctacttctctacatttccatggtcttttccagaatacgagtttggggaaccagcttcaaatggatggtccttctatggtgacacaatgtcccatcgttccgggacaaacatacctgtacaacttcactgtcccagagcaggtaggaacgttctggtaccatgcacacatgggtgcccagtacggtgacggtatgaggggtgcatttatcatccacgatccggaggagcccttcgaatatgatcatgaacgagtcatcactctatcggaccattatcacgaaaattataaaacggttaccaaagagtttctgtcaagatataatccaaccggtgctgaacctattcctcaaaatattctttttaataatacgatgaatgtaactttagattttacacccggtgaaacgtatctcttcaggttcttgaacgttgggctgtttgtatcccagtatatcattcttgaggatcatgaaatgagtatagtagaggtggacggtgtttacgtaaagccaaactttactgattcgatatatctttctgcggggcaaagaatgagtgtgttgattaaagctaaagataaaatgcctacaagaaactacgctatgatgcaaataatggatgagacgatgcttgatgttgtcccacctgagttacaactcaaccaaactatccaaatgaggtatggccactcgttgccggaggcacgcgcattgaacattgaagattgtgacttggaccgcgccacgaatgacttttacctagaacctctgattgagagagacctacttgctcactatgaccaccaaattgtcatggatgtaagaatggtcaacttgggtgatggtgtgaagtatgcatttttcaataatatcacttacgtcacaccaaaggtgcctactttgacaacgttgcttacctcaggaaagcttgcgtcagatcctagaatttatggtgataatatcaatgcgcagttattgaaacataatgatatcatagaggttgttctaaacaattatgattctggcagacatccattccatttgcacggtcataatttccaaatagtccaaaagtcgccagggttccatgttgatgaagcttatgacgaatctgagcaagatgaaatgaccgtcccttataacgaatctgcgccattacaaccgttccctgagaggccgatggtgagagatacagtggttcttgaacctagtggacatgttgtcctgagatttagagctgacaaccctggtgtctggtatttccattgtcatgtagattggcacttacaacaaggtttggcttcggtctttattgaggcacccgttttacttcaggaaagggaaaagcttaatgagaactatctggatatatgcaaagccgctgatattccggtagttggtaatgctgcaggtcattcgaatgattggtttgacttaaaaggattaccaagacaacctgagccactaccaaagggatttactactgaaggatatttggcattgattatttcaaccattatcggtgtctggggcctatattccattgctcagtatggtattggcgaggttatccctaacgatgagaaggtgtaccacacgttaagggaaatcttggctgaaaatgaaatagaggtttctcgcggctaa

SEQ ID NO: 4260 - DNA, 1869 bp, Saccharomyces cerevisiae
atgtttagtcactaccgctataaagaaaattcttgccaaaaaagagaggctataccagacaaatctcgcgtatcactgacatttcttcagaaaagaaccgattcatctaacgtcactgttgcagtggccgttgctgttcccattggtgctattattatagtactatccgtcgttttaatagtagtatataggagatgcaaaaaagaaccttctatgcaggattttgacccaaattttgagggcgatttatactatttaccgaagatggattcttctatgaattctgcaaactcagacagcaatgccacagaaaagaggtttatttatggtggttatgacgattttttgcaaccgtcaatcgaaaactcacaatctttcaaagattatgtgaggcgtatcaatgagcatgcaccctccgcttataatattgcttcactggcttcgcagaataacagcaagttatcggtcccctccaagcacattgacctttcgaataagatttctttcgaatcgttagagaattctgagctgattgtttcaccacaacactcaaatactgggcaagactgtgatcaaagatgtgatagtacgtcaaatcctgatgtaaatgaaaagtccagccataacaacgataatcgacttaaatcgaattatacgagtcgtagcgggctcgagcctcagtgttcgagagaggaggaagaaaatattgacagaataagaagcatttataacatttattttgagaaaagtaatagcacgatacgatcctctgtaacttcttcgatacggcgtgactctaaattaaacatcgctacaagaaaaagtgtaaatatgagctctcaagacaatccaaatgatactacattaattgaacagagtcacttcggaagtacaactgtccaagaaattgattccagttccagcgccaatgaggaatatgaagatgcaactgattatctgcaagtgccggcaccacaagagaataaaaacattgcatcgtcagtatattcagaagtagcaaccagagaaaaagtgattcccgaatcgtctctatctcttacattcccaccaccgaatggtctttcaacgagaattacctcatcaatatattctgacacggtcgctaaggaccatattcactctgcaaaggctcccgtacgggccctttcggagggttcgggtcagtcaaatcttacttctgctcagcaatattctacatattttatagatcactgcaaccagagcaatgatgacaattactactataattatcccctcccgttagaacatcctcaaaattatgagaacatcggagatttgcccacgcctacccaattcatttattccacctcttcgcattccttgacgtcattcaaaggaaggcctaaacctccaaaaacactaaaacatgtacctacagctaggcttaatgggacagcgttgaatccaatggatcatcctgaaatgttttacagttcgcctacgaaaataccgtcaacatctttgacaaagcaattttgtacgccccttccatatcagcttagacaaagtgttgttatgaccaacccatcagaactttctatgaaacctcgctataagcctgcaggatctttaagaaatttaataaaggcccaatatctccctggtaactcatccactacaacatcatcttctttatcacaaccgccgtcaacgttgtcaaatgcaataaatttccgtgttagtgggttattggatgacactgacatcttgcagcctcctagtgtgggggaaatcttaccttttaaagcttctacggaagacttaaggaagcaactgggcacatcccataattacgaaataacaccgtacgagaatgtacatgtataa

SEQ ID NO: 4261 - DNA, 1872 bp, Saccharomyces cerevisiae
atgacaggtccaatagtgtacgttcaaaatgcggacggtatcttcttcaagcttgctgagggcaaaggaactaacgatgctgttattcacttggccaatcaagatcaaggtgttcgggtccttggagcagaggaatttcctgtgcaaggtgaagtagtaaagattgcgtccttgatggggttcattaagctaaagttgaacaggtatgccattatcgcaaatactgtggaagagaccggtagattcaatggccacgttttctatagagtgttgcaacattctatcgtatctaccaagtttaactcgagaatcgattctgaagaagccgaatatatcaagctactggagttgcatttgaaaaattccaccttttatttttcatacacatatgatttaacaaattccttacaaagaaatgaaaaggttggtcctgcagcctcctggaaaaccgctgatgaacgattcttttggaaccattacttaactgaagatttgagaaactttgctcatcaagatcctagaattgactcctttatacaacctgttatctatgggtatgccaagacagtggacgccgttttgaatgccacccctatcgttcttggtttgattaccagacgtagtatatttagggcgggcacaagatacttccgtcgtggtgttgacaaagacggtaacgttggcaatttcaatgaaactgagcaaattttactcgctgagaatccagagagtgaaaaaatacacgttttctccttcttacagacaagaggatctgtgccaatatactgggctgaaatcaacaacttgaagtacaagccaaatcttgttcttggagaaaactcattagatgcgacaaaaaagcattttgaccagcaaaaggagttatatggcgacaactacttggttaacctagtcaaccaaaagggccacgaactacccgtgaaagagggctatgaatcagtcgtgcacgcgctaaacgatccgaagattcactacgtgtattttgacttccaccatgaatgtcgtaagatgcaatggcatagagtgaaattgttaattgatcacctggagaaattaggtttatctaacgaagatttcttccacaaggtcatagactctaatggtaacaccgttgaaattgttaatgagcaacattccgttgtaagaacaaactgtatggattgtttggacagaacaaatgtcgttcaatctgttttagcccagtgggttttgcaaaaggagtttgaaagtgccgatgtcgttgctactggaagcacttgggaagacaacgctccattgttaacttcttaccaaaacttatgggctgataatgcagatgcagttagtgtggcatattcgggcactggagctttgaagaccgatttcacaagaaccggtaagcgtacacgtctaggtgcattcaacgattttttgaattcagcatcacgttattaccagaacaattggactgatggtccaagacaggattcatacgatttattccttggtggatttagaccacataccgcttctatcaagtcgccattccccgacagaagaccagtgtatattcagctgatcccaatgatcatttgcgcagccttgaccgttttaggtgctacgatattttttcctaaagatagatttaccagcagtaagaatttgctgtattttgcaggtgcgtcgattgtcttggcgctttcaaccaaattcatgtttaagaacggtattcagtttgtcaactggcctaagttagtagacgttgggttcttggtcgttcatcaaacgcatgataaagaacaacaattcaaaggtttgaaatatgcacagagtcctaaattttccaagccggatcctttaaaaagagattaa

SEQ ID NO: 4262 - DNA, 1872 bp, Saccharomyces cerevisiae
atgcccgctgaaattgacattgatgaagctgacgtattagttttatcacaggagttacaaaagacaagtaaactcactttcgaaatcaataaatctttgaaaaaaattgcagctacatccaatcaatccagtcaactcttcactcctattcttgctagaaataatgttttaaccacattacaaagaaatattgaaagtacattgaattccgttgcctcagttaaggatctagcaaacgaagcttccaagtatgagatcattttacaaaagggtattaatcaagtcggtttaaagcaatacacccaagtagtacataagctagatgatatgttggaagacattcagtctggacaagccaatcgagaagaaaactcagaattccatgggattttaactcacttggaacaattgatcaaacgtagcgaggctcaactaagagtatattttatttcaattttgaacagtattaaaccgtttgatccacaaatcaatatcaccaaaaagatgccatttccatactacgaggaccagcagttaggcgctttatcgtggattttagattattttcatggaaattcagaaggttctattatacaggacatactcgtcggtgaaaggagtaaattaatcctcaagtgcatggcattccttgaaccttttgccaaagaaatcagcactgcaaaaaacgccccgtatgagaagggcagtagcgggatgaacagctacacggaggccttattaggcttcatcgccaatgaaaaatcactagtagacgacctctactctcaatatacagaaagtaaaccccacgtcttgtcacagatcttgtcgcctttaattagcgcatatgctaagcttttcggtgcaaatttgaaaattgtacgaagcaacctcgagaactttggattctttagttttgagctagtggaaagcataaatgatgtgaaaaaatctcttcgaggcaaggaactacaaaactataatttattgcaagattgtacgcaagaagtacgtcaagtaacacagtcattattcagagatgccattgataggattatcaaaaaggcaaattctatttctactattccttccaataatggtgtcactgaagcaactgtagataccatgtcaagactaagaaagttcagtgagtacaaaaacggatgtttaggcgccatggacaatatcacacgtgaaaattggttaccatccaattataaggagaaagaatacactttgcaaaacgaggctttaaattgggaagatcataatgtattactatcatgttttataagtgattgcatagacactttggcagttaatcttgagagaaaggcacaaatagcactgatgcctaaccaagagccagatgtggctaatcctaatagctctaaaaataagcacaagcaacgtattggattcttcattttaatgaacctgacgcttgttgagcagatcgtggaaaagtcagaattaaacttaatgttagctggagaaggtcactccagattggaacggctgaagaaacgttatattagttatatggtatcagattggagagatttaactgcaaatttgatggattctgtgtttattgatagtagcgggaagaagtcaaaagacaaagaacaaataaaggagaaatttagaaaattcaatgaaggattcgaagatttagtatcaaaaacaaaacagtataagctttcagatccatcattgaaagtaactttgaagtcagaaataatatcgttggttatgcccatgtatgaaagattctacagtagatataaagactctttcaagaatcctagaaagcatatcaaatatacccctgacgaactaactactgttcttaaccaattagtgagatag

SEQ ID NO: 4263 - DNA, 1872 bp, Saccharomyces cerevisiae
atgcttggcgaagatgaagggaataccgttcttgaaaagggaaataatccttctgtaaaacaaggagaggttggagctgtatttatagtacccaaaatacttatcagagaacatgaaagagtgatacttaagcaaattctgcaaatcctggatcaagatgaattggttcaacctcccttagacaaatttccctacaaaaaattagaattaccgaaatatatagatgaacttaagacgagagacgctactaatacatcctacaagatgatacaattggatgcttatggtgagaaaaaagtgggttcgaacggtgaattatttggcggtagacattatttgttcaacaccttcacattcacggctcatatgggtgttcttctggtacttttacaagatgtcattaaagtgttataccaaagcaacgcaacgcatgacgaggacgagtttattgtccagcatgatcaaattctggtaatggaaacttctgaggaacaaacaaaatttttggccaaaaatggtgtcattcctgaagaatccaaaggatcttttaagtatataactgccaggtcagcctttgttgaattcggtgcttctgttattgccggtggtcaacgcatcgttgatgattattgggaatctttagctaaaaagcaaaatttgtcgtctcaccaaagggttttcaaattatcaacaaatttaatttctaaaatctcacttttacgcccctccttccaaaataacaggattagcaatgccaatgaaattagtgcgaacactaataatacctgtacgatttctacttcaaaattcgaatcacagtatccaatagtcacggaacaaccgtcagcggagattagagaagcctatattgaaaactttgccaaaggtgagcacatttcggcaattgttcctggtcaaagcattagtggaacattggaactcagtgcacaatttagagtaccgcgttatcacagcaaaaactcatttcaacaagctctgcaaatgaaggcaatggacataccaatcggaagacatgaagaattacttgcgcaatatgaaagtcaagctcctgatggttccgcttcaatttcacttcctaaccatattccatctgtcaatcctagcaataaaccaatcaaacgaatgctaagtagcattcttgatattaacgtttcctcatcaaaaaacaagaagtctgaggagaacgaaatgataaaacccatgaacaagggccaacacaaaaataatacatcgttaaacataaacggctggaaatttgaatctttgccattaaaatccgccgagaattcaggtaaacagcaatattatagaggattgccgttatatgaaaaaaacacgctgctagaaaggttgaaacagctgacaccgaacgaaattaaagaactagagcatttacacgatgccgtttttgttaataccggtttgcagaacgttagaaaagttaggacaaaaaaatggaaaaagtactggcagtacaaggcaggtattcctatcggtttgaaacggtctcaattggatgaattcaaaaataaatatttgaaagatgtgttggcgcaaacgagtgttactacaaattttaacgaaataacgaatacggatgaaacaataacaacaaagagggtaccgaacccaaacttcctaggaaattgtaacattaaggattttaaacctccatacatttattctcatgtgaacaaagtaccacaaaatgtcgctggggataaaacggctgttaagctggacactgaagtaaagaacacaaatgctaatccagtggtggcgacggatccggtcgccgctaaaccggacaacctggctaacttcagcaacgaagtagctatgaataattga

SEQ ID NO: 4264 - DNA, 1872 bp, Saccharomyces cerevisiae
atggttaatcagggccaaccgcaacctaacctctatgacaaacacattaacatgtttccaccagcaagggcgcgggagtcctcgcataaattgggaaatgccaattcggataggcatggtttgccagctcaaaatatagtgcctgcaccctatccagtggatgactctatcgttgaactcacaccagctattccttttacatccccttcatcttcctcatcattatcgctgcctttgagtgcgctgaatttcacagacgggaatgctgatggtggtcaattaggcactccagtaaccataaatagtaataacggcatggacatttttaattccaagccaacaggtgaaataggatatgccaataatggcaccaacagtactggtagtaggtatgaacttcctttcaattttagttctacaaaagagagtttgggttcaccagctgtacaagatgcatcaataagcagtggaaatcgaatatcagagtctgtaagggacaactcagcgccaccaccctatgaggaatctgaatctaggatactgcaggaaaaagtttacagaaccgaggaaaaagctccaatacgacctttgaataataatcctgttccaccacaaaaaatcaaccaaccacccactgggagcgcgaagacagacgataatgggtcctcaggtggtgaggacaaactgtcttcctattcaccagaggcattggctttctatcaagtgtacaagaagacaattactgactcttcaaaattcacccccgagatacaaatgcaatggtgtgaaacattacttacatatgcctttaatgaggatttcatatcgcaatataacataaacgcggagaagctcaaaagaagcttaaagcctgaggaaatgctcaaaaaccagaaagtcattttggaacattcattcaaggtgctcacaaaattgataactttaaaatggccacctgccatgtatttaatggggacgctgtattcacaccaaccctatttacctataaagaacaaaaacatcgttattaaaaatgatgaaaaggcgctggaatattattgtaaagctgcgaaattgaacaattcagatgcatgctaccgtgcaggtgtatgctttgaataccaaaggggcacctcttctttggatccatcaccaaccaaagaacaatgcataaaaaaggccttccaatactaccagcatggcgcagaagtttgttcaaattctgcgtgtatgtataaattagggatgagccatttatacggtctgaacatgcaaaagactgatgtattgctagctattaaatggtttgataaagctgcccaaaagggtgactctccacaaacattatatgagttaggtaaaatatatgaattcagtgttttgccgccagaaatccagaacctattatttgcgaacggcatacgaaaagactctcaactggcaataaaatactaccaacaatgtgccaaagattttgagtaccctttagcgcaatggaaattaggaaattgttatgagtttggagacctagggttgccagtggtggccaaaaaatccatatattggtattccaaagctgctgctgctcagccgaaggggaatccgatggcaatgttatccttaagtggatggtacttaacgggagcaccaaatattttgaaaccaaacaataaagaggcattcaactgggccttgaagagcagcaagtgttcagacggtaaattagcccgcactgaatttgccttaggattttattacgaaaaaggtgtcggttgtgaagttgatttggatctggccaaacaatattatcagagggctgcaagaatgggattcaggaaggcagttgatgctcttcgaagtttgacaaattaa

SEQ ID NO: 4265 - DNA, 1872 bp, Saccharomyces cerevisiae
atgtcatcgagcaagaaaatcgtcatcctctatggatcggagacaggtaacgcgcatgattttgctacaatcttatcccatcgactacatcgctggcatttctcccatacattttgctccattggtgattatgacccacaggatatcttgaaatgcaggtacctttttattatatgctccacaacaggccaaggtgaattaccaaggaatgtcaatgcattaaaaggtgaaagacccgtcacgttctggtcgtttttaaagagaaagaatcttccgtcgaatttgctcaaccatattcaaactgccatgcttggacttggtgattcatcttatcctaagtttaactacggcattagaaagctacatcagcgcattgtcacacaattgggtgctaatgaattattcgatagattggaggctgacgaccaggctatggctggtagcaataagggtacaggtctcggaattgaatcagtatattttgaatatgaaaagaaagtcctaagctttcttttaagtaagtaccccaacagaaaggtcaatggccaaataattaagagggaagaattggaccctgaggtttacctagagccagcatcctacctacagctttcagacgaacatgccaatgaaaagttcactagcaccaaggttatattcgaaggtgatgaatcgttaaaggttggcagagttaatataaacaaaaggattacatctgaaggtcatttccaagacgtgaggcagttcaagtttagtaatgtggacaagattcaagaaaactatgaacccggtgatacagtaaccatatatccttgcaatacagatgaggatgtttcaagattcctagcaaatcaaagccattggttagaaattgcggacaaaccattgaatttcaccagtggagttcctaatgatcttaaggatggtggattagttcgcccgatgactttaaggaacttgttgaaatatcactgtgatttcatgagcattcctagaacaagttttttcttgaagatttggacctttgcaactgatgtaactaagatggaacgtggccaagaacaactgaatgatcaaagagaaaaattgcgccaatttgctactgatcaagatatgcaggacttatatgactactgtaatagacccagaaggtcaattcttgaagtactggaagattttatctccgtaaagttgccctggaaatatgtgctagattacttgcccatcattaaaccaaggtactactctatatctagcggccctggggatcctaatattgaattaacagttgcgatagtaaaatataaaactatcttaaggaaaattcgaagaggaatttgcactaactacattgcacgattgcaagagggggaacagataaggtataagttacaaaataatcacataatcaaaaaggaatttttgaataaacctatgattcttgtcggaccgggtgtcggtctagcaccattattatcagtggttaaagcggagatatctaaagatatcaaactcctcttcggttgtagatataaagataaagattatatttataaagatatgctggaagattggttccgtaagggcaaaattgccttacattcatccttttccagagatgaggaaaattcaccaggtgttaaatatgtccaagactacttatggagattaggtgaggaaataactaatttggtagttaataaagacgccgtttttttcttatgtggctcatcaggtaaaatgcctatccaagtcagattaacattcattgaaatgttaaaaaaatggggcaattttagtgatgaagaaactgccaaaaaatacctgaaagaaatggaaaaatctgatagatatatccaggaaacttggtag

SEQ ID NO: 4266 - DNA, 1875 bp, Saccharomyces cerevisiae
atggacttgaatcaaagaaaggaaaaaaagggccagcatgttggatgctgtggctccaggacagacctgtctgctgacacagtggaactgatagaaagaatggacagattggctgaaaatcaggcgacagcttccatgtcgatcgttgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcatcaacgtcaggactagtgcgactaccactgccagcatcaacgtcaggactagtgcgactaccactgaaagtaccaactccaacactaatgctactaccactgaaagtaccaactccagcactaatgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacatatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtagggtatttgaaattttttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggaggtgtggttgttaccacattgggttgatttggcaaacgttgaagttctcgctgcagataacacgagggtaccgctgtacatgctgatggtagcggttcacaaagagctggatagcgatgatgttccagacggtagatttgatataatattactatgtagagattcgagcagagaagttggagagtga

SEQ ID NO: 4267 - DNA, 1875 bp, Saccharomyces cerevisiae
atgaactcttccacttcttcagaaaatgtgttcataaattcatttagctatttgaatcaaacatcacaagccgtaatctcaggtaactccactttcgcaaatgttatcaactttccttatagacttggattatcctttattggggctgtgaacttgcagtacgagcaaaccgttaaatctgaagaaattcccccaactctaaggtctgtttttgatacaatagggttttttttcagcccgtacgccatattttgctttgtaatcgccattgtcctgaaccggttcgttgtattttacgccgtccttaacaacggttccagacgtactttaccgttatggttgagtaatgttttccatgtatcagcagtagttgtattagcaatggtatccttaggtccgctgaccttgggtaaggatttcaaaatattaggcgaccctgcttttgcccaagaaaaatttttactgaatatattctacgctttcgcttactcttattgtgtcgaaaccatatttaccatcatgcggaattccagccctttggagggcactgactattcattgtttgaactttcgattcagttttatacaatgactaataataatactaaatttttagattctcctgattacattatagactgttctatggctattttgagcaggatattgatccatttggtggagattttcaggcttagaaattatcgtctactttttagtactattatgaacctctgtcatatttgttacttagggataagagttaagcagggcggctggaaaagccttccattttcggtgaaatttaggcactttccaaaactgttttcagtgtctattatttgcttatcattactgatttttaaattatcatgcttaattagatgggatccatttggaaaatcacgtaattcttgcgaacttttacagttttaccctctcagtagaaattggaaaaaatacttaaattacacgggagaagaagatttttctgctatggccactaaattcgcactattattatgctcaggaactgaactaatggaaaagggtatacgaagagaatttcctgctattaacatcccggataatgttaatgagaaattttttattagcggttatttaaatgaactttctaaaccgtataaagagaacacttccatcagcttcccaaagaaaaattcatcaatattaaagcaaagattttttttaatgtttccaaaatctataatatggatcatgaagaagcttgtaggccaagtattctttggcttcagagataacaaggacgaggacatccccgacaacgacccatcaaaaatgttaaagataactaaaacgaactctctcaataatagtgccggccacaaagaagatattgaacttgaactattgaacacatcagatgatgagtattctgaagattacgagccttctgaagttgagtcactgggggattctgatgaagaaaacttggaagaagattcactgattttcaacgaaactcgggatgccctactggatttattttcttccgaagataatgaagttcatactgattataattggatcatgtcaactagccgtatccttcaacaaaaattactgtcagataaaactttgacaagggcgtctatcttagatacaaagttaagtgaagtagatgagacttttggtacagaaagtgattttgatctatcttgcgcggtatgcaaagtcaatgaaagaaatacagtattatggccctgccgatgttttgccatttgcgaggattgcagaatttctttgggtttacgtgggttcagcacttgcgtatgttgtaggagtaaagttcatgggtactgtaaggttcatcctgtttcagatagtaaataa

SEQ ID NO: 4268 - DNA, 1875 bp, Saccharomyces cerevisiae
atgagattccaccgtcaaggtaccgcagccaccgtaggcgtactgctcattgtgctgcttggtttctgttggaaattatctgaatcttatggcatagtgtcaactgccctaccacacaagcaacctgcaaccaaaatcacagacacaccttctatacgatgggataattaccatgagtttgtcagagacattgattttgataacagcacggctatctttaattccattcgagctgctttaagacagtctccatcggatatacatcctgtcggagtatcttattttcccgctgtaattcccaaaggaactttaatgtaccatgccggatcaaaagtgccaactaccttcgaatggctggctatggaccacgaattcagctactctttcggcttgaggtcaccatcctatgggagaaaatctttggaaagaaggcatgggaggttcggcaatggcacccatggtgatcatccaaaagggccaccaccaccaccaccaccagacgaaaaagatcgaggttcacaaaaaatgcttacctatagagcagcacgggacctcaacaaatttctctatcttgatggggcttctgctgcaaaaactgactcaggagagatggacacgcagctaatgttgtcaaatgttattaaagagaaattgaaccttacagatgatggtgaaaacgaacgaatggccgaacgactctacgctgctagaatatgcaaatgggggaagccattcgggcttgacggaattatcagggtagaggttggctttgaggtcgttttgtgtgatttttcggctgataacgtcgaacttgtttcaatgttagaaatggtccagcctaaccagtacctaggcttaccagcacctaccgttatatcgaaagaggaaggttggcctctggatgaaaatggaaacctagttgaagatcagctaacagatgaccaaaaggcgattctggaaagagaagatggttgggagaagactttttctaatttcaacgcagttaagagcttcaatcagttgagagcgggtacagcgcatgacaacggggagcatcgaatccatatcgactataggtacctagtgagcgggataaacaggacttacattgctcctgatcctaacaacagaagattactcgatgaaggaatgacatgggaaaagcaattggacatggtagatgacttagaaaaggctctggaagtcggatttgatgccacgcaaagtatggattggcagttagcatttgatgagcttgtccttaaatttgctccattactaaaatctgttagtaacatactgaacagcaatggtgatattaatgagtcaattgccatcaatgcaacagcactcacattgaacttttgtttaaggtttgagcctgcaagcaacaacagtgatgaattcggtagcgggaaagactttgctgtctaccaatatgtgagcccataccaggccttaaaaacggatgcagactttttgatttggtcatctgctgtcagcgtggtcggagaaattgttgatgccatttataaagtgaatgatttattgatacccgaagtctactcttttatgacagataacacaacttccagcgacttaataaagaatgtcgaaacggctcgctccactatcgatggtttaattgaatctctagggtggattgaactaaattaccgttgtgagagacaatgcaattgggatgaagtttgttacactccttcctggggcccatctccaatgggtatgactgaaccaggttcccacaatgagggatttggaacccactttgatgaatctcgacaaaggttggttattaacagtaaactacagtgtatcaatataaatgatttgatggttaatcgtaatcattag

SEQ ID NO: 4269 - DNA, 1875 bp, Saccharomyces cerevisiae
atggaaaatcttggcgacaaacttagtatttcacaagtataccacttagcacaggaatacagagaccatgcatattcaattgcgaataaaatcggttctgaggaagggttgaagcagtattatggcctcatgaacatgtctatccagatgtttcagctattgaaaacgaaatgtacgctttcagttctggaggatagtaaggtcacgtttgagatggtggagttattgatacaggagacgtataattttgacctagcagagctttacatttccagtttgaaagaacggttacaaacgcaccagagcgacacagatttggtagaagagatcatgcgttgcgagtttctgctgttacatgacttgccacttatgagagacagtaagttccactataagattgcactaagaaattgcaatgaattagtccagtacatggtaaatttgcaggatgagttgtatcaaaattgggcatccgtattccagtatgtcggcgtgatgctttgcattaagctgaaacagcaccgcagggtgaagacgagttttcatgggctactctcgcaatgtcgggaaaagtcacaatggaaatggtttctaaatctgtgttatgtgaattacttgctaaatgagaggttcccaatccccgaggatgctctgcaggagctgcgaagcacggagctgcacacggtggggcctgagctatatgcatggaagttggcattagagatggtaatccagctttgtaaagacgggaatattacggaccacttgaacgaattcaaaaatttctttgacacaaacaagcaatctctagtcactaatgaaggtaagggatgtgtgatcaaaatcatgccaaggatagcgctgaaagtagagttgcctatgattttccactacaaagaattaaagaacatactgttattattgcaaagtgtcagctacatcgtgaactgttatgacgaaaagggcaatttttccaggaagttcctccccaaagtctattctacaacgcagaaactgattaagaacattgccgctggcggtgtttcgatgaatgagctggactcacgaatccagacatacaagagcattcttgaattctgtgagttttacaaagtgtgggaacaaacactcttgaagggggccgtagtgacgaccgagtcacctaagttagggccctctccaggctacgtgaggctgctgcaagccatgaaggttcagtttgaaggcggcggggccgtagaagagtacacgcggcttgcacaatctggcggtacatccagcgaggtgaagatgatatcgcttctgaattgctacacagtgcaggcggcaagagtgagccgatgttcgggggacaaacagggcgaactcgtagagcaatgcaacaaggtgtggcttcaggtggagaaattgctacaagaaacggatctgcagttcaaccccatatgggagtgcacagtaacgatcctatggcttttcagccatttcgagccgttcagttggaacccgctgccatgtagtgacaagcagcgcgccgagtacgtgtcgaagctccgcgagttctactctagcaacaagttcgttgccggagaagccgttgcggacaaccgcttcaaattgaagaaggctctgttgctgcaaatactggtaaactacttaggcggtcgaatgctcgaacacgatctgggcgagatctatgcgatttcagcaaagtgtttcgatatgtgccgccagcagggcggcatgcgcaaggtccaatacgtgatcggaatatggcatttaatgaattgtacggtggcgatgcggggaaaagacgtcgctctcacgaacgcgaagctggaggcgctggttaagcaaatcaccagtgtcaaacaataa

SEQ ID NO: 4270 - DNA, 1875 bp, Saccharomyces cerevisiae
atggctactccccatttatatcacagatataactccaaaagctctaacaaaaatatcaattcgagcggaaattctacagaggttgaccgtttcattccaaaatcagtttcgagaaatgcttataagtctattccaatgttaaatgggtttgacataagttactcagaactttgcgagaaatctccttcacctgagcggctatcatcccctgaattctttaacgaactgcgaaacaccgggcattacgaatcaatcagtacaacaaatgagttttccatgtcaagtatctctagctcttctgagagtcaagttaccagaagtggaagtgcaagagcttcaagaaacgattattcaaaattaactaaagagcaaaaggaccatagaaagaatattgcacattctcttggttttcaattgcccgaccgtgtctttacgtttgagaccacaagtgctgaaattctggaaaagaataaagccatcaaaaattgctttggaccaggaagttgcgccgaaataagatcaacctttgactttagtacactctcgcccgatgttgcccgttattatatcgctaattctaacgcaagatcagcttccccacaaagacaaatccaaagacctgctaaacgagtaaagtcacatattccataccgtgtattggatgcaccttgcctgagaaatgatttttattcgaacttaatttcttggtcaagaaccacaaacaacgttttggtgggactgggttgctccgtatacatctggtctgagaaagaaggagcggtatctatattggaccatcaatacttaagtgaaaagagggatttagtgacatgcgtctcattctgtccttacaatacttattttattgttggtacaaaatttggccgtattcttctttatgatcaaaaagaattttttcattccagcaacacaaacgaaaaggaaccagtatttgttttccaaactgaatccttcaaaggaatatgttgcctagaatggttcaaaccaggtgaaatttgcaaattttatgttggagaggaaaatggcaatgtgagcctctttgaaataaagagtttgcatttccccataaaaaactggagtaaaagacaaaaactcgaagatgaaaatttaataggattgaaacttcattccacttatcaagctcaggcacagcaagtctgtggtacgttattaagagcttatgctttcacatacccttttctggtatagcgcttattttttcattatgaaaaatactaacaaatattttctacaggtatttctctgaatgaacatgcaaacctgcttgcagtcggcggcaatgataattcttgtagcttatgggatatttccgacttggataaacctattaaaaagtttgttcttccacataaagcggctgtgaaggccattgccttttgtccttggtcgaagtctttgttggctacgggtggtggaagcaaagacagatgtattaagttttggcatacatcgacaggcacattgttggatgagatttgcacctcgggacaggtgacgtctttgatatggtcgttgagacataaacagattgttgctacttttggattcggtgataccaagaatcctgtattaataacactatactcatatccaaaattatcaaaactactcgaagttaggtcgcccaaccctttgcgtgtactgagcgcagtaatctctccaagttccatggcaatttgcgttgccactaacgatgaaacgataagattttatgaactgtggaacgataaggaggaaataattaatgaaattcaagagagtgggatttatggatctaatattatagaatatatggagggtatcgaaacaacacataacaaaagaataaggtaa

SEQ ID NO: 4271 - DNA, 1875 bp, Saccharomyces cerevisiae
atggtggtgcagaaaaaacttagggctatcttgaccgatgaaggtgtattgatcaaatcgcaatcacaccatatgttcaataagcatggtcaactcagaagcggagattctttatccttgttgagctgcttgtcctgtctggatgatggaactttgagctctgatggaggttcttttgatgaggatgattccctggaactgttgcctcttaatactaccattccgttcaacagaattttgaacgcaaaatatgtgaatgtcggtcagaaaggcttcaataatggcaaaatttcttcgaatccttttcaaacggaaaatctgagttcttcgtctgaaaatgacgacgttgagaatcatagtttgagcaatgataaggctcctgtaagcgaatcacagtcatttcccaaaaaagacaagtgggatacaaaaacgaacactgtgaaggtgtctcccgatgattcacaggataactcaccatctttagggataaaagataatcaacagttaattgagttaacttttgctgtacccaagggccatgatgttataccacaaaaattaaccttgttaatagatcacgtttctaggaaatcgagagcaaataccggagaggagaacatttcttctggtactgtggaagaaatcctggaaaaaagttatgaaaattccaagagaaacagatcgatattagtcattattaatccccacggtggtaaaggtactgctaaaaatttattcctgacaaaagcaaggccaatactagtggaaagtggctgcaaaatagaaattgcatacacaaaatatgcccgtcacgccatcgatattgccaaagatttagatatcagcaaatacgataccattgcatgtgcctcgggtgatggtattccatacgaagtaattaatgggctttatagaagacccgacagagtggatgcgttcaataaactagccgtaactcagctaccttgcggttcaggaaatgctatgagcatttcatgtcattggacaaataacccatcgtacgccgctctgtgccttgtcaaatccattgaaacaagaatagacttaatgtgttgttcccaaccttcttatatgaacgaatggccaagattatcctttttgagtcagacgtacggcgttattgcagaatctgatattaacactgaattcatcagatggatgggtcccgttaggtttaatttgggtgtagcattcaacattatccaaggtaagaaatatccctgcgaagttttcgtcaaatatgctgccaaatctaaaaaggaattaaaagttcatttcttagaaaataaagataaaaacaaaggatgtttaaccttcgaaccaaatcctagcccaaactcttcgccggatttactatctaaaaacaatatcaacaacagtacaaaagatgaactttcaccgaattttctcaacgaggacaactttaaattaaagtatccgatgacggaaccagtacctagagactgggagaaaatggattcagagctaactgataacttaacaatcttttacacagggaaaatgccgtatattgctaaggacaccaaattttttcccgctgctttaccagcggatggtaccattgatttagtcataacggatgcaagaatcccagtgacaagaatgacaccaattttattatccttggataaaggttctcatgtattagagccagaagttattcactcaaaaatattggcttataagattataccaaaagtggagtcaggtttattttcagtggatggtgaaaagtttcctttggaacccttgcaagtggaaataatgcccatgttatgcaagacgttgctaaggaatggtagatatatcgatacagagtttgaatccatgtag

SEQ ID NO: 4272 - DNA, 1875 bp, Saccharomyces cerevisiae
atgttatcaaggtacaaccgcgttattgaaataaatgggggtaatgcagatatttctctgcccattgtcaaatttccaccgtttaaactcagagctcaattaattgaaaaggaccccgtagtatggctgcatctaatagaaacctatgtaacgtattttgagtatttgatgcaaggtgctaacgttgaattattagatgaatctacacttgatcatcttcgtttatttttgagaacttacttgcatgaaattgctgatgaggaaggaaagttattaagtctcggtatcaaccatgatgtgtctgaacagttatatttactaaaaggctggatattttcattgatcaagaaatgcgggttattacatcttcagatttttggtgactccctgtggaatttgatcaaagtatatgttagacgtaatccagattctattcgtggtttgatcgatggctcattgaaaccacggatcaacacgcaacgtgtacaattggacaaatcgtaccaagttcaacagcatttgaagcagttaatagaatctggaaaatttaaaagaatagatttaaggtgcgttgaagatctgctgtctgccaaatccatgcagccaaataagtttgcggagaacttctttacggcaaattggattgaaattttagaggcattatgggcaaagggacagggccggggtcataaagaggctagagaattgatcattatcagtttattttctgtttctgctgatcgtttactaaaaataactaaagaattaggcataagcaattttgaaactttggcgttatatcctcttttaggaacaatgctcataaatgaaggagtccacaaaaggcttcctgatttgaagagcaagttactatttctgaatttaggggggttgtcaatggacgaaggagaccatatgagctatccaacatcatcaggtactgaagttaatgaagaacaactgtccgcgttgatggaattgttcccccagttttctaaatatcaattatctcaaacgttgcttgcctatgataataacattgaattagtaacgaataaaatatttgaggatcctaccattatcgaagcattctccagagaacctgcggaggaagaagtagagccggtgtcagatggtgataatgcatcctttactgaagaactgagtatattggatagaggagatagctcaaaaaataaagagctagacaaaaagattatctcggagggtgttccggatgaattaagaaataaaactttgacaagagcattgaaacttttatacgaggctgatgaagatgaaagggatgacacttatgatgaagccgatgtgaaccggtccgatccttcgaaaagaattggacttcaagaagacgaagaaagctatgatacaaaagatgattctaatgaagtgcgacaagatcataactatcatattgttgaagcttacttgtggaatctattgaaagaggatccgaaattatttgagagatcaaaaagaggtacaaaagtcaggaaaactatgaaagaaatgacttcatggtcggatgaaaaaatcgaaggttggtgtcggatgttagaaagatctcctacccgagcaagacttttagaaaagaagtttatgttcaaaggaaatagcaaaacagggaaaacgtcttatgttcataatcgtgatagccaaaatgatggaaatgtcgtcaaagaacaagccaaacaaaaaaaatctgaaaatattaagaaacatgaacctcaatctactgaacagaagaaaagacagcatgctaagaatgaaaaaaggaaaggggctagagctaaccataaccgtaagaaggggcacgataaaaaattggctcgtgcgggaaataacgctatttga

SEQ ID NO: 4273 - DNA, 1878 bp, Saccharomyces cerevisiae
atgcctgctgtcttgagaaccaggtccaaagaatcctctatagagcagaagcctgcttccagaactagaacgagatcaagaaggggcaagcgtggtcgtgacgatgatgatgatgacgacgatgaggaaagcgatgatgcatacgatgaagtaggtaatgactatgacgagtatgcttcaagagcgaagctggccaccaataggcccttcgaaatagtcgcgggactgcctgctagtgtggagctgcccaactataactcttcgcttactcatccgcaatcaattaaaaattctggggtgctttacgactctctggtcagttccagaagaacctgggttcagggtgagatgtttgaactgtattggcgaagacctaagaaaattgttagtgaatctaccccagcagcgacggagagtccaacatctggaacgattcctttgattcgagataagatgcagaaaatgtgcgattgtgtaatgagtggaggtcctcacacgttcaaagttagacttttcatactgaagaatgacaaaatcgaacagaaatggcaagatgagcaagagttgaagaaaaaggaaaaggaactgaaacgaaagaacgatgcagaggccaaaagattgaggatggaggaaaggaaaaggcagcagatgcaaaagaaaatagccaaggaacaaaaacttcaattgcagaaggaaaataaagccaagcagaagttggaacaggaggcgctgaagctaaaaagaaaggaagaaatgaaaaaactaaaggaacaaaataaaaataaacagggttcaccttcttcctccatgcatgacccaagaatgataatgaatttgaatttgatggcacaagaagatccaaaactaaacactttaatggaaaccgtcgcaaagggtcttgccaataatagtcaactggaggaatttaaaaagttcattgaaattgccaaaaaaaggtcactagaggagaacccagttaataagcgtccatctgtcacaacaacgcgacctgcacctccctctaaagctaaagacgtagccgaagatcaccggttaaactcgataaccttggtgaaaagttccaaaaccgctgccacggaacctgaaccaaaaaaagctgatgacgagaatgcagagaagcaacagtccaaagaggcaaagacaactgccgaatcgactcaagtagatgtcaagaaagaagaagaagatgtgaaggaaaagggtgtgaaatcagaggatacacaaaagaaagaagataatcaagtggtaccgaaaaggaaaagaagaaagaacgcaataaaggaagataaagatatgcaattgaccgcgttccaacagaaatacgttcaaggtgcggagatcatcctggagtatttagaattcacccattcgaggtattacctgcctaagaaatcagtagtagaatttttggaggatacggatgagattataatatcttggattgttatacacaattctaaagaaattgagaagttcaaaaccaagaaaataaaagctaaactgaaagccgaccaaaaactaaacaaggaggatgccaagccaggctctgatgtggagaaggaagtcagctttaatcctctttttgaagccgattgccctacccctctctacaccccaatgacaatgaagttatcggggattcacaaaagatttaaccaaatcatccgaaatagcgtttctccaatggaagaagttgttaaagaaatggaaaaaattctgcaaattggtactagattgtctggctataatctgtggtaccaattggatggatacgatgatgaagctttgagcgaaagtttgcggttcgaactaaatgagtgggagcacgccatgagaagcagaagacacaaaagataa

SEQ ID NO: 4274 - DNA, 1878 bp, Saccharomyces cerevisiae
atggactacaacatatttgaggcggtacatgaacaacaaagcagcacatctgacatggatctctcagaagaagataataatccattcgtcggcactcatcacctatatgcttctggaattgggactactatcggcgaagctcgcccagagaacgaaaattcgcccccttcttcatcgtctttgccatctagcccggcacattcctcttctgctggctcttccagagcatctacgtcatcttcaacctcttctcatgccgtagtggaagcagatgcggaaactgaaccttttgtttccttgtcgatgtctactactgctactattagcaaatttactccccacgatatgaatgggacacagcagatccaaatcattgatgccggcgatttcaaagatccatgggggaaacacgctatcggttacgtaattctatatgaaaacaacaagattatcagaaggtactctgaatttcattctttgaggcaatctctaactagactccttcctacgataattattccacccattccatccaagcattctcttctcaaatacatatggagtcccataaacgcagcaaatgattccaaaattatctccaccaggaagaaaatgctcaattcattcttgtctaactgtctgaacattcaagaaataagcaacgatattgtttttcaaaaatttctaaaccctgaatttaattggaaagatgttttaagttcgtcgccgataatcatactacctttgaataaccttttagctccacctttaagcccaacaaaaccaagcccccttcattctattttacctattccatccaactcgtctctgagaaactataattcgatttggcaacaacacatcacagtaaaaagtcataatgaaatttccaacctcccaacagaaattttacaaaacgaatctcaatttacacatattgaaaatttattccaaaattataagcgaataatcacccatttattaaaaaacataagatcaaataaatctcatttccactccttgtccacgtattttgctgaattaggcgcatattataatgcttttagtttggaaaatgacataaccatgcccaacagccttcgcgaatctgaaaacaattcaaacaacccaatgatggaaattattagtcatattgaaaagacaggccattcattcgatgttatatacatttcttccgagatcttaatagaaaagtacacctctattcttgaggaccccattaatgagttattgcagttcttaaatgagtcattcaaagttctaaatttcaagaaattaaagtttttgcaatttaaaatattagagaggctaattatcgaaaaagaaacgaaactttcgagtctcactgagattgaaaaccaactgcagaagattaatgaaagtttaacgcggtcgactatattgacagatgaaaattacaaagatacaaaggctgctgacctgacatttgttaaaaaggacgtaagatcgctatcgaagtcaagttcaaattcaagctccagtggacaccaaaacgaaattcatataggcgcaagtaaactaaactataaaacgtctacgccaacaatgaatctcaataaattagaaatcaaacaattgactgaacaagaaagatctaaacagatcaaacagttgaaccaagatttatccaaattgaaagattgtctatcaatctgtatatcagacatgctagaaattaacaattcgtcatacaacagcttaatgcatacatataaccatattaatttgaccattggaaagatcttgaaacttttcgcagctagcttcaaagcatggatcaaagaatgtctgaagaattggaaactggcaaagttacaaatcgacgaggccctataa

SEQ ID NO: 4275 - DNA, 1878 bp, Saccharomyces cerevisiae
atggtagttaagaagcgtaagttggcaactgaggccggtggcagtgatgaaaggcctaaatacttgccgggaaaacatcctaaaaaccaagagaaaactccgcatgtggattataacgccccattaaaccctaaatctgaactttttctagatgactggcatatacctaaatttaatcgatttattagtttcactttggatgttcttatcgacaaatacaaagatattttcaaagatttcatcaaactaccaagtaggaagtttcatccacagtattattacaagatccagcagccaatgtctattaatgaaatcaagtcaagagattatgaatacgaagatggtccaagtaattttcttttggatgttgagctactgacaaagaattgtcaagcttacaatgaatatgacagtttgattgtaaaaaactccatgcaagtagtaatgttgattgaatttgaagtattgaaggcaaaaaatttgaaaagaaattacttaattaacagcgaggtcaaagccaaattactgcactatcttaataagctagttgacgccacggaaaagaaaatcaaccaggctctgctgggtgcgtcatctcctaaaaacttagacgacaaagtcaagctaagtgaaccgtttatggaattagtcgataaagatgaacttcctgaatattatgaaatagtgcatagccccatggctttatcgatcgtaaagcagaacctcgaaattggtcagtattccaagatatatgatttcatcattgatatgcttttagtttttcagaatgctcatatattcaatgatccaagcgctttgatttacaaagacgcaacaactttaacaaattattttaactacttaatacaaaaggaattcttcccagagttacaggatttaaatgaacgtggcgaaattaatttagaatttgacaaattcgaattcgaaaactacttagctattggtggtggtggtccagccgcagcaggtgcgttagctatatctgctcttgataatgatattgagccagaatctaaccgtgaagatcttattgatcaagcagattatgatttcaatcatttcgaaggtctcggcaatggttataatcgttctctcctaactgaagattatttactgaacccaaacaacttcaaaaagttaatagccaaaccggaaacagtgcaatccgaagtcaaaaatgaaagatcaacgacatctgatattgagaagacaaactccttagagagcgaacatttaaaaatccccaaatacaatgttataaaatccatgcaaaaagaaatgcaatcactctcagagcaacacaccatggagtataagccctataaattaatacaacaaatttacattttttcttctaaaaatttgtattcgcaggcaactaagcctttactgggttcaaggccatcatgcaatcaaaattgggtagagtatattttcaatggtaatgaattgagtcaaaatgaaaacgctttctccttcatgttacaacccatgcaaacttttttaacattacagtctcatttgacctcatcattaaaggatacagagactttattaaccattaataaagagccagtgaagtctagaacttcaaatgtaaacagtaacctttcccaacctcagcaacaagaaaatgatgttattggaaacgatacgaagcaagatatagaaaatttgacaatcggcggcggcaacaataacgatattgttggtaacgataatgataaacgtaataatataaccgaaatctttgatattcgcttatcagaaggtttaaatcatttgatgtttaggtgtgaggacaaaatatctcatgaaacggaattcatgaatttctggataaatgtcttaccatga

SEQ ID NO: 4276 - DNA, 1878 bp, Saccharomyces cerevisiae
atggtgccattggaagatctgcttaataaagaaaatggcactgccgcacctcaacacagccgggagagtatagtagaaaatgggacagacgtttctaacgtcacaaagaaggacgggctgcccagtcctaacctatctaaaaggtcttctgattgttcgaagaggcctagaattaggtgtaccacggaagctattggcttgaacggtcaagaagatgaacggatgtcaccaggcagcacttcttcatcatgcttaccatatcatagtacttcacacttgaacactcctccatacgatctattgggcgcttcggcagtttcacccaccacatcatcttcctctgactcgtcctcctcctcgccattggcacaagcgcataacccggcaggtgatgacgacgatgcggataatgacggtgattctgaggatataacactatattgtaaatgggacaactgtggtatgattttcaaccaaccagagctgctatataatcatctgtgtcatgaccatgttggcaggaagtcacataagaacctacaattgaattgtcattggggagactgtaccacgaagacggagaaaagggaccatatcacctcgcatttgagagttcacgtaccattgaaaccgttcggttgctctacgtgctccaaaaagtttaaacgtccgcaagatttaaaaaagcatttgaaaattcatctggaaagtggcggtattttgaaaagaaagaggggacccaaatggggctcaaaaagaacttctaagaaaaacaaaagttgtgcaagcgacgcagtgtcgtcttgttctgcatctgtgccttccgctatagctggtagctttaagtcacattctacttctccacagatattacccccattgcccgtgggtatatctcaacatctgccttcacaacagcagcagcgggctatttccttaaaccaactatgctcagacgagctatctcagtataagccggtatattctccacaattgagtgccagattgcaaacgatcttgccgccattatactacaataacggcagcacggtaagccaaggtgccaacagtcggagcatgaatgtctacgaggacggttgttctaataagaccatagcaaacgccacccaattcttcaccaaactatcgagaaatatgacaaataactacattttgcaacaaagcggtggtagtactgagtcctcgtcatcatctgggcgcatccccgtagcacaaacaagctatgtgcagccacctaatgctccttcataccaatccgtacaaggtggtagctctatttcggccactgcaaatacagcaacttatgtgccagtacggttggccaagtatccaactggtccttcgcttactgaacatttgccacctttacattcgaacactgccggtggtgttttcaaccgccaatcacagtatgctatgccacactatccatctgttcgtgctgcgcctagctattcctccagtggctgttctatattaccgcctctacaatcaaagataccaatgttaccatcgcgccgtacaatggcaggtggaacttcattgaagcctaactgggaatttagcctgaaccaaaaaagctgtactaatgatattatcatgagtaagctggcgattgaagaagtagatgacgaaagcgagatagaggatgatttcgtagagatgttgggtatagtgaacattatcaaggactacttgttgtgctgtgtcatggaagatttagatgatgaagaaagtgaggacaaagatgaagaaaacgcattcttgcaagaatctttagaaaaattgagtttacaaaaccaaatgggaactaactcagttcgcatcttgaccaagtatcccaaaattttggtatga

SEQ ID NO: 4277 - DNA, 1881 bp, Saccharomyces cerevisiae
atgaatgacgacagccaggataaaataatacatgatatacgtattcagctacgaaaggctgccacagaattatcacgatggaagctatacggctcctcaaagtgggcagcagaggcgctagcaggtcttgcagaagctattgatgttgatcaaacacactctttagccgatgaatcgccactaagaaataaacaaggtgtaccgaaacagatgtttgaaataccacaaaacgggtttggcctatcagagactgagtatgacctgtacctccttggttctacgttgtttgatgctaaagagtttgatcgatgcgttttttttctaaaagatgtcactaatccataccttaagttcttaaaattatacagtaaatttctatcgtgggataagaaaagccaggaaagtatggaaaatatcttaactacagggaagtttacggacgaaatgtacagagctaacaaagatggggatggtagtgggaatgaggatataaatcaaagtgggcaccaacgcgccaatttaaaaatggtcagcaatgagcatgagtcacaatcgaacatatcatctattttgaaggaaattaacacatttctggagtcttatgaaataaagatagacgatgatgaggccgatttagggttagcactgttgtattatttacgaggggtcatcttaaagcaagagaagaatatttctaaggcaatgtcgtcattcttgaaatctctgagttgctactcctttaactggtcctgctggctggagttaatggactgtttacaaaaggttgacgatgcattgcttttaaataattatctatatcaaaatttccaattcaaattttctgaaaatcttggtagtcaacgaacgatagaatttaatataatgatcaaatttttcaagctaaaagtgtttgaggagcttaatggccagttagaggactactttgaagatttagagtttttgttacaagttttccccaatttcacttttttaaaggcttacaatgctactattagttacaacaatttggattatgttaccgcagaaagccgatttgatgacatcgttaaacaagatccgtaccgtctcaacgatttggaaacctactccaatattctatacgtcatgcagaagaattcaaaattagcctatttggcgcaattcgtctcccaaatagatagatttagaccggaaacatgttgtatcatagcgaactattacagtgcccgacaggaacatgaaaaatctatcatgtatttccgtcgagcactaactttggataaaaaaacaacaaacgcatggactttgatgggtcacgaatttgttgaactaagcaattcacatgccgcaatagaatgctatcgtcgggccgtagatatatgccctcgagacttcaaagcatggtttggtttgggccaggcttatgctctcctggacatgcatttatattctctttactacttccagaaagcttgcactttgaaaccttgggatcgtcggatttggcaagtattgggagaatgttatagtaagacgggaaataaggtagaagctataaaatgctacaaaagatccataaaagcttcacaaacggtcgatcaaaatacttcaatatattaccggttagcgcaactatatgaagaacttgaagacttgcaagaatgtaagaagttcatgatgaaatgtgtagatgtggaagaacttctggaaggtatagtaacagatgaaaccgtgaaggctaggctttggctggcaatatttgagattaaggcaggaaactaccaattggcttatgattatgccatgggggtatctagtggaacgtctcaagagattgaagaggctcgtatgctggctcgggagtgcagaaggcatatgtag

SEQ ID NO: 4278 - DNA, 1881 bp, Saccharomyces cerevisiae
atggatcacgacacagaagttatagtcaaggatttcaacagtattcttgaagaattaacttttaactcgagacccattattaccactctcacgaagttagcagaagaaaacatttcgtgtgctcaatattttgttgacgccattgagagtagaattgaaaaatgtatgcctaagcagaagctatacgctttttatgccttggactccatttgtaagaatgttggcagcccatacacaatctacttcagtagaaatttgtttaacttgtacaaaagaacatacttattggtggacaacaccacaagaacaaaactcatcaatatgtttaagctttggttgaatcctaatgacaccggcctgcctctgtttgaaggctcagcactggagaaaattgaacagtttttaataaaggccagtgctctccaccagaaaaacctgcaagcaatgttaccaactccgactgttcccctcctattaagagacattgataaattaacttgtttaactagtgaaaggctaaagaatcaaccaaatgatgaaaaattaaaaatgaaactgttggttttatctcagttgaaacaagaactgaaaagagaaaaactaactctcaatgctctgaaacaagttcaaatgcaactaaggcaggtcttctcacaggaccaacaagttttgcaggaaagaatgaggtatcacgaacttcagcagcaacagcaacaacagcagcaacagcaacaacaacaacagcagcagcagcagcagtatcacgaaactaaggatatggtcggttcttacacacaaaactctaattcagcgattccattgtttggaaataattcagatacaacgaaccaacagaattctttatcttcctctctttttggtaatatttctggcgttgaatcttttcaagaaattgagaaaaaaaagtccctaaacaaaatcaataacctctatgcatctcttaaggctgaagggctcatatatactccaccaaaagaatccatcgtaacgctttataaaaagctaaatggacactcaaactactctcttgattcacacgaaaaacaattgatgaagaacctgccaaagatacccttattaaatgatattctttctgactgcaaagcttattttgccacggttaacatcgacgttttgaataacccatccctgcagctgtccgaacaaactcttcttcaagaaaatcccatcgtccaaaataatcttattcacttattataccgatccaagccaaataaatgtagcgtgtgtggtaagagatttggcaactcagaaagtgaaaaactactacaaaatgagcatttggactggcatttcagaataaatacaagaattaagggatcacaaaacacagcaaatacaggcataagcaactctaacttaaatacaactaccacaaggaaaaatattcaatcaagaaactggtatttgagtgactctcaatgggcagccttcaaagatgatgaaattacctccacaaagcataaaaatgattatactgatccgcatgccaataaaaatatcgataaaagtgccctaaatattcacgctgatgaaaatgacgaaggctctgtagacaacactttaggaagtgatagaagtaacgagttggaaatacggggaaaatatgttgttgtaccagaaacttcacaagatatggccttcaaatgtccaatttgtaaggaaaccgttactggcgtttatgatgaagaatctggtgaatgggtttggaaaaatactattgaagtgaatggcaaatatttccactcgacatgttatcatgaaacgtcgcaaaattcaagcaaatctaatagtggcaaggtcggtttggatgacttaaagaaattggtcacaaaataa

SEQ ID NO: 4279 - DNA, 1884 bp, Saccharomyces cerevisiae
atgaatgaaatggaaaacacagatccagtattacaggatgatctcgtatccaaatatgagagggaattaagcacagaacaggaagaggatacgcctgttatccttacgcagttgaatgaagatggcaccacttcgaattatttcgacaaaaggaaactaaaaattgcccctagatcaacactacagttcaaagtgggacctccatttgaattagtgagagattattgtccagtcgttgagtctcataccggaagaacactagatttacgaattattccaagaattgacagagggttcgaccatattgatgaagagtgggtaggttataaaagaaattattttaccttagtatcaacgtttgaaacggcaaattgtgatttggatacttttttaaagagcagttttgatcttctcgttgaagactcttcagtagaaagcagattaagagtgcaatatttcgctatcaaaataaaagctaagaatgacgacgacgacacggaaatcaatctcgtccagcatacagcgaaacgcgacaaaggtcctcaattttgtccttcagtatgtccgttggtgccttcccctttgccaaaacatcaaatcataagagaagcttcaaatgttcgaaatatcactaaaatgaaaaaatacgattccactttttatttgcacagagaccacgttaattatgaagaatatggagtggactctttattgttttcctatccagaagattctattcagaaagttgcccgttatgaaagagttcaatttgcttcatcaattagcgtgaagaaaccatcccaacaaaataaacactttagcttgcatgtaattttaggtgcagtggtagatccagatacctttcatggggagaatcccggaattccttatgatgaactggctttaaaaaatggatcaaaagggatgtttgtgtatttgcaagaaatgaaaacgcctcctcttattattagaggaagatcaccttctaactatgcgtcatctcagcgaataactgtgagaacaccgtcgagtgtcaattcctcacaaaacagcacaaaaagaaaaatgccatcaatggcgcagccgttaaatgaaagttgcttaaatgcaagaccttcgaaaaggcgatccaaagtggcgctaggtgcaccgaactctggggcctccatctcgcctatcaaatctcgtcaatccacaccaatggaagcttcgaaggaaaatgaggatccgttcttcaggccaaataaaagggtggagactcttgaacatatccagaacaaactgggtgctttgaaaaatcaatgtccagattcctctctgaaatatccgagttcatcttcaagaggtatggaagggtgtttagaaaaggaggatttagtttactcaagtagtttttctgttaatatgaagcaaatcgaactgaaaccggcacgctcttttgaacatgagaatattttcaaagtaggctcattagcattcaaaaaaatcaatgaattacctcatgaaaattatgatataacaatagagaagaaatcaatggaacagaattatctaagaccagagataggctcacgttctgaatgcaaaacaagctatggtaacgaactctccctttcaaatatttctttctctatactacctaactcagcagaaaattttcacttggaaactgcacttttcccagctacggaagaggatgtgccaaggacattttcaagaatattagaaacaggttcgtttcaaaattattatcaaaaaatggatgcagaaaatgcagatagggtatattcgaaaggggtcaagttgattgcaagcggtactctaccatctggtatatttaatagggaagaattgtttgaggaagatagtttctataagtattaa

SEQ ID NO: 4280 - DNA, 1884 bp, Saccharomyces cerevisiae
atgactctagaaccacactatagtgccaagtcggctgcttcagccagtgcctttgttgcccgttctgcgaccgaaagctcaacagcaagcacaaaagctgctcctaggaaaaagacgtactcgcagtcaaatggtattcccataaggattgataatctccctccgggcaagacttgggcccaggtaaaatatttgataggcggaatcatataccataccaatattttacaggtgaaaatgctgcctccaatgacttccatggttcctccttttattacttttcagagttgcattgtcattctgaagaactcgatagataacgagtccctggaaaacttactacttactttgaacacctaccaatgggattatcatgatctgttcgtttacctgttgccgtacactaatgattctccttcactgcgatatccagaaatcagtgatagcaacaatgacgtccggagtgctcccgatgaaactaaaagatctatttctcctcgatatgcaagccatgtttcatctgtgacaccgcagccaccatccgcttctaccccaccttctcaatttttcagtttttctcctgaagtgagccttcgaaagaatgagaacataacgccattgcccacgcctgttcccgtacctgttggtgtgccacctcttgctcccccgcctcatggtccattttcgacttcgatgctacctatgttgggtgctcctccgggaacggtacctaatatgcagatgccctatcaaactactctaccttcaccaacagctgctgctactgctggtggtccacttgcttcccctacacactatccccgtcgtcggcatttctatcaccagaaccaaagccagtttcaaaaatacatgcataatagccccaggaatccagatactggcacaggccctcgtctttctcagcagcatcacctctccttaaggaacaataagataaatccctcttataacgaaatatctgccctttacaacttgaacatggcctcaaattccaataataatggtaatattcccactacaagtacgaatggtgatgaccgtgccctccaagcaaagaatggtggaacaattacaccttcacaaactcaaataaatcacaaaagattaaagcatatctttaacgagaaaagctttagaaaacaaatgacgaatagaggtatgtggcagctgaagatcataaatttcccaccctatatacctatagaattcttggagaaattatcagagtctgatttcaatgagttaatgaaccaagagaagttcacagttattgaaattaaagagaaaggacaattggaaaaatttggaaggctaagatggacagttctaaaagattttataaaactgaaatgccccaagctattaagactacaggaaagacagtttctacagcaacaaaacgaagcatctttactcaatgaatctatggacgctctaaagatatcagaaaatgagaacaccaacgggagtgcaaataatagcacatacacaaatggcggacctcgaacatctatcaataatacaagggaattctatgtaggggtttatgaagatcatgaagaagcaactctactgaggtttgaattaccggaagatgaattagaggagtttaatagaaatttgccaactacttttgcacaaagtggaaacgtctctgactccgaaggtgatagcaaggcgaaatactttaaagttagcacaattgtgtataatgccattgttgggttccacgataaagagctgtctgatttgacgttcgaatccttacaagaccaggaatattcactggggtacaaaattcatgtaatggaactgccaccatttgacgaggatgaatttgaaaatcaacggcagcagttctaa

SEQ ID NO: 4281 - DNA, 1884 bp, Saccharomyces cerevisiae
atgatggcttttgagaatacaagtaaacgaccaccccaggactttgtagctcctatagatcaaaaaaaaaggaaggtccagttttccgatagtactggcctggtaacccttcaaccagaggagataaaagatgaagtgttttcagcggccatgtatagcaggttcgtgaaatctgccctagatgatctggataagaatgattcaacccagatcggcataattgccaatcaagtagcgcttccgagcaagaatcctgaaagaattaatgataagaatctcaatattcttttggatatcttatctagtaatatcaacaggatagaatcctccaggggaactttcctcatacaatctatcataaactttgagaagtggtgggaattgcctccacacactctaagtaaatatatatatttcatcaaaatcctttgctcgagtatacccaaatggtggcaagacgtttcgatgatactggtatcttgttttattttaccaatcaaacagacagtgtgtcatcatgatatgcttaaatatttcttaaggatgattccctcctcgatgggattcatagatacatatttggccaaatttttcccaaataaaaatgatactcggagaaagttggttaattacacttcaaatttgctgaaattgagaggctactgctctgagctaggattccaaatttggtccttactgatagaaaagattatttcgattgatgtcgagttacaaaatgaattagatgaattagatgatgatgtagatgacgatgatctagaggaagttgatctagaggatgacgacgatttagatgatgattcaggagacgatgatgatgaaaattgtgggaacagtaatgaagagttaaggtctggagcagccgacggtagtcaaagtgatagtgaagatatggacatcattgaaggtatggacggtactgaagaatataatgtggagttgacgcagggaatcaaagaactttccaccaaattggactctatcttaactttggtaagcacgcatgtggaagagcaagtgacgccggagagtttagaaagcggtgaaggcgtaggagtcttcaacactctaacaacattatttaaaacgcatgttctacccacgtactataccaggtcgattcaatatatcatgttccatgtttcacaacaacaattagaactaatggattcatttttagtgacactgatagatatttcgtttgccgtcaacgaagcagcagagaagaaaattaagtcattacaatatttggggtcgtacattgcgagggccaagaaactatccagaactcaaattattttcgttgcaagctatttaacgtcctggttgaatagatacgttatcgaaagagaagaagaagttgatcaacgtggaggtatggaaaggtttaaacatttctatgcagcatttcaagcactttgttacattttctgtttcagacataacatcttcagagatacagatggtaactgggagtgtgaactggacaaattctttcaaagaatggtcatttcaaaatttaacccattaaagttttgtaatgaaaatgtcatgttgatgtttgctcgtattgcccaacaagaaagcgtcgcgtactgtttcagcataattgaaaataacaacaatgaaagattgaggggaatcatcggcaaagctgatagcgacaagaaggaaaattccgcacaagcaaataccacatcgtcttcttggtctttagccactcgacaacaatttattgacttacagagttacttcccatatgatcctttgtttctgaaaaactataaaattttaatgaaggaatactacatagagtggagtgaagcaagcggggaatatgaaagtgatgggtcggatgactaa

SEQ ID NO: 4282 - DNA, 1884 bp, Saccharomyces cerevisiae
atgattaggtacactgttgctggccattccagaaggtgtgtagtaggagcttcgaaaagagtgggtgcaattaaatgtatcaccgtcgccgccaccaagagatttatctccaataagccaaacgaagtttttaccaagctaacgaatgacaatgatccaaagagagatgcctttttcaaatatacgtggggctcatggcttaaaaatgataagcaagaaaaggaaaaaagattcacgaagttttcgattgaaggtttaaatcgcattctcaatgacatctacattcaatctaatgaaatggctaaggcccccgacggtaagatcttaccaccagtgtttaacaagaacttgaccgtttcattggtcaataacgttgtaccaaagaatataggtaaaatcaacccaaatgaaaaagttcaagtaaccacattatctagtattcacgaaggtaaacatcacagaatatacaaggtcgacacgaatttgaacaaggcatttatcttgaggattccttatccgctggaaaatgaaaacactctatcctacagaataagaagtgaagtagcaaccatggattttgctgacttgaagttgggcatcaaagttcccaagattttttgttatggtgtcaattctttgaaccctgtaaggcagccttttgtcttacaagaatttatcgaaggagaactcttgatgaaagattgggatccattgattgaagacggttcctccaatcaaaaaaaatatgacaatgttattaaacaagtttctgattttcagtcgaagttagtgtcattgaaattaaatgcatttggatccatatattttaacaatgacttaaaagacggaaatgagaaggagtttgttaaggaagacatatacgatggggaaactaatccggatctacaaaacagatggaaaattgggccatccgtggaaagatgtctctggagacataaatctcacttggattttcataaacaaatgaaaccttttttgggaccatggccaaagaagtctccaatggatataattaaaaatactggcctattggaagctgaaaatgctaaaactagaatagccatgaaagaggcaggaagttcagctgaattgatgtatcctcgaactttgaaggagcaaataactacctatgaaaatttagctaagattgccccggatttattcaacgtcaaaacaaaggccattccaaatatgcaggaactattgtcaccacgtttgtttcatcctgatctagaccccatgaatattattgttaacaaagaagcacaagaagcctatctattagattttgaaggagcatgcacaaaacctttcattttacagaattcgccacaattcatcgcctatgatgggcccaagatttatgacttaaaggaggacataaccgattttgacaaattatctgaggcggaaaaggtgcaatatcagttcatgtacaagcgcacccgtaatcaacatcaatgggagaaaaaattaaatgacaataatcctaaattaattactgcagttgccccacctgttaagctactgagaagcccatatattgcagctgtcgaaagaaaaacggaagaagagtatttacttattgatgaatcactattgcaattgaaggaagtttgggacatctttgcccagaatgagttagtgaatcagaaaaagtttcctctaaactatagtaaagaagatattgaaagacatgttgaggatttgcaaaaattacacgaaaagctaatctctacaccatttgctgccactcaagggtggattcctcaagatatgtttgatcaactattaaattccggcagtattgttaagcaagagaacggagactacaccgtgaagcaacctgaagctaccaaataa

SEQ ID NO: 4283 - DNA, 1884 bp, Saccharomyces cerevisiae
atggagtctgttcactctcgcgatcctgttaaggaggaaaagaaacatgtcttcatgggaatggaacacgagttgaatcctgagactcataacgattccaactccgactcatatggtctccctcagttatctgaaaaatacaatgccttgagacagaacaggagcctaattatccagcagactgaaatcattggctctgcttacaataaatggtacttacaagcgattttacttttgagtgctttcatatgtggctacggttatggactggacggtaacatccgttatatttacactggttacgccacatcatcctatagtgagcattctctgctgtctacaatcaacgtcattaatgctgtggtcagtgccgcttcgcaaatcatatacgctaggttgtctgatgtgtttggtagactataccttttcattagtgctgtcatcctatatgttgtgggtacaattattcaatcacaagcttatgatgttcaaagatacgctgcaggtgccattttctacaatgctggctatgtgggtgtaatccttattcttttgattatcctatccgatttttcatctttaaagtggagactgctgtatcaatttgtcccgacttggccttttatcatcaacacatggattgctggtaatatcacttccagagccaatcctgttgtcaactggtcttgggatgtaggtatgtgggctttcatctttcccctatcatgtgttccaatcgttttgtgtatgttgcacatgcaatggagggccagaaagactcctgaatggcacgctttgaagggccagaagtcctattatcaagaacatggttttattaagatcttaaagcaattattttggatgttagatgtcgttggtgtccttttgatgggttgttccctaggttgtatcttggtcccactgaccttggctggtggggtcaaaactacctggaatgattcaagattgatcggcccctttgttcttggctttgttttgatccctatcttatggatttgggaatatcgattcgctagagatccaattcttccatataggctggtcaaagatagggctgtatggtcttctatgggtatttctttcctgattgattttatttactatatggccgctgattatttgtacacggttatgattgttgccgtcaatgaatccgttaaatctgcaaccagaattgccacattatcttcatttgtctctactgtggcctctccatttttcgctttacttgtaacaagatgtacgagattgaaaccattcataatgtttggatgcgcgctatggatggtggctatgggtttattgtaccactttagaggtggaagtcagtcccattcaggtattattggtgcattatgtgtctggggtgtgggcactactttgttcacttacccagttaccgtctctgtacaatctgccgtctctcatgaaaacatggcgacagttacagctttaaactataccctctatagaattggttctgctgtcggttccgcagtttccggtgccatttggactcagactttgtacaaacaaattttgaagagaatgggtgatgttgctctagccacaactgcctacgaatctccatatactttcattgaaacctatacttggggtaccccacaaaggaatgccttaatgaacgcttacaaatacgttcaaagattggaaactatcgtggctttagtattttgtgttccattaattgcattctccttatgtctaagggatcctaaattgactgatactgttgctgtggaatacatcgaggatggcgaatatgtcgacacgaaagacaatgatccaattttggattggtttgaaaaacttccatcaaaattcacttttaaacgggaataa

SEQ ID NO: 4284 - DNA, 1884 bp, Saccharomyces cerevisiae
atggtaaatatactgcccttccacaagaacaatagacacagcgcgggagtcgtcacctgcgcggacgatgttagcggcgacggtagcggcggcgacaccaagaaggaggaggatgttgtccaggtaacggaatcaccatcgtccgggtcgcgcaataatcatcgcagcgacaatgaaaaagatgacgccatccgtatggagaaaatatctaagaaccagtccgcgtcgtccaacggcaccatccgcgaggatttgattatggacgtggacttggagaaatcgccctccgtcgatggcgatagcgagccgcacaaactaaaacaaggtttgcagtcgcgccatgtgcaactgatcgcgctgggcggcgccatcggtaccggtttgctggtggggacttcatccacgcttcatacgtgcggtcccgcggggctgttcatatcgtacattattatttccgcggtgatctacccgatcatgtgcgcgctgggcgaaatggtgtgctttttgcccggtgatggttctgacagtgccgggtcgacggccaatctggtcactaggtacgttgacccttcgttgggcttcgccactgggtggaattacttctactgctacgtcattttagtggccgccgagtgtacggcggcatccggtgtggtcgaatactggaccaccgcggttcccaagggcgtttggatcacgatctttctatgcgtggttgttatactaaacttttccgcggtcaaagtgtacggcgaatccgagttttggttcgcgtctatcaagatattatgcattgtgggactgatcattctgtcctttattttgttttggggtggtggccccaaccatgaccgtcttggcttcagatactggcaacatccgggcgcttttgcgcatcacctcacgggcggatcgctgggtaacttcacagatatctacactgggattatcaagggcgccttcgccttcattcttggtccggaactggtgtgcatgacttccgcggaatgcgcggaccagcgtagaaatatcgctaaggcttcgcgccgctttgtatggagactgatcttcttctacgttctggggacgctggccatctccgttattgttccatacaatgacccaacattggtaaatgcgctggcgcagggcaaaccgggagccggctcgtcaccctttgtgatcggaattcaaaacgccgggattaaggttcttccccacattatcaatgggtgtatcttgaccagcgcgtggtctgccgccaatgcgtttatgtttgcgagcacgagatcactgttgaccatggcgcaaacgggacaggcacccaaatgtttgggcagaatcaacaaatggggtgttccatacgtggctgtgggtgtttccttcttgtgttcttgtttggcatatctgaacgtgtcttcatccacggcagacgtgtttaattggttttccaatatcagcaccatttccgggtttctgggctggatgtgcggctgcatcgcgtacctgagattccgcaaggctattttctacaatggcctctacgacagattgcctttcaagacgtggggacagccttacaccgtgtggttctctctcattgttataggcatcatcaccattaccaacgggtatgccattttcatccctaagtactggagagtagcagatttcattgctgcctacatcaccctacccatcttcctggttttgtggttcggccataagctgtatactcggacgtggagacaatggtggctccctgtgtccgagatcgatgttactacagggttagtcgagatcgaggagaaatcaagagaaattgaggagatgagattaccccccaccggtttcaaagacaagttcttggacgccttgttgtaa

SEQ ID NO: 4285 - DNA, 1884 bp, Saccharomyces cerevisiae
atggttgacgactcaaactatcttacaccacatgaaactgcattagcggtggtggccactgcaatgaagaaagcaagactgcaactagatacattgctaataaattccatacttggtggcgttctgtttagtagtggttcgttcctattggtagcggtatattccgaagatcctgacatagtcgcacgaaacccgggtattgtgaatcttattactggtgttaatttcgccatgggactattctatgtagtaatgatgggtgctgacctcttcaactctaatatcctatttttctccgttggagttctgagaaaagcagtaactatctatgatttgatgatttcgtgggttgtcagttggttaggtaatattgctggctcactttttgtttcatatctttttggtcatctttctggtattagttctcagaagctttggataataggctcacggcaaatcatagaacaaaaagtttcatattcattcgtccaaacctttttaaaaggaatagcgtgcaatttttttgtttgtttagccatatatttacagttaatggcaaaacctattcatgtgaagtttattctaatgtcattccctatcattgactttattggtatcggatttacacatgtagtcggagatatgtctgcatctttcattgcaatgcttaacggtgcaaatgtttcagtgggtaaatatatatggaaactactaattcccgcttctttaggtaacatcgttggaggactcttttttagtgcagtcgttcccttctacttacatttggtggttgtggaacgtgatagaaagagattatctttaccagaatacgaagcaagagatgagcaaccagaactgaatatggattcaagagttgtaagaatacaaaaaaatgagtgtgacgatgatgcaactgaaaccggtgaagatcttgaaaaccttactgaaaagggctttgcaagcatttataatacaaatcacgataactcgagctatttcaccggcagaagtctaaattcgcttcgatccataccttcatcagttataacttccgacaatgttacaatggaatcggacttgggagaacccgtacaattcatacctaaaagtaactctacgacaagatctccacacctggggttgcctcacaatctgcctcacaatcactcgatcaaatctattaacaggcaccgtattaacaagcgccacagtttgagatcgccgcctggtgtctttcctgtaaggggaatgggggaaccgctagaaagagaaaaaacgattgaagatgcaacttacgaccctaaggaaaatgagcttttcttaagaagagccgaaacacataactccgcgtacgtgaagaataaaaaaaaggaggatgataacctgttaaggctagtgaaaactgaagaagatcgtgagcaaaaggagtacgaaaaaaatggtggttataatattttggaaaataaaccaggtaccaggctagaaaaaataattacccatcttgctgaaaatgtatcttctagggaagtgacgcctccgatattacctagaacgacacaggatacttttcctcataacgctcccgcctcgtctccagcatacacagacgatgctcattcattacgtaaagcaaacagtaccacgttgggcggactgtttagggcggtgtcgaaagaatttcactcaagcaaggatgcagaaagcccagatgacttactcaaaaaaatggctgctgttggcataaaccgcaatgctagaattacagcaaataatgtagccggaattgttaacctaaataaagaggacctggacagcactacaaggcggcaaaaaattactgagcccaaaaacttttataatcgtcacacatccccccagttatga

SEQ ID NO: 4286 - DNA, 1887 bp, Saccharomyces cerevisiae
atgatgaaaagatgcttcagtatcctaccacaaaatgtccggttcagctcaaagttcacaagtttaaacttaccaaagttagatttggcggattttatagactcaaataaaagaggaatcaatgttcttccgtcgtacagagatgaaaccgctagcaccactcaagcaactaattctaaagagctcagattactttccaaaacacttcagggccagtcgtaccgggaccaattagagttgaatcctgatgtaagcaaagcaatcaacaataatattatggctgtacatattcccaataatcttagaagggttgctacaaattattacaaagagattcaggaaccaaattcattacatcgtccctgtagaaccaaaatggaagtggatgcacatatagcgtccatttttttacaaaattatggttctattttccaaagtctgaaagaattacaaaaaagggtaggtcctgataattttaaacctcaaagaatccttgatgttggatatggcccagcgactggtatagttgccttgaatgatattttaggcccaaattatagacctgatctaaaagatgccgttattttagggaatgcggagatgcaagaaagagccaaaatcattttgagcagacaacttaacgaggtggtcgatactgtagaagaaaatgtgtctacagagaaagagcaggaaacagatagacggaacaaaaactttcaagaggatgaacatattggagaagtgatgacaaaaaagataaacattatgactaacttgcggtcttctattcccgcatctaaggaatatgacctcataatattaacgcatcaacttcttcatgacgggaatcaatttccaattcaggtggatgaaaatattgagcactacttaaatattctagcgcctggaggccacattgttattattgaacgaggcaacccaatgggattcgagattatagccagggcaaggcaaattacgcttagacctgaaaactttccagatgaattcggaaaaataccaagaccttggtctaggggagtaacagtcagaggcaaaaaagatgctgaattaggaaacatttccagtaattattttctgaaggtgattgcaccttgtccacatcaaaggaaatgtcccttacaggttggaaatcctaacttttatactcataaagagggtaaagacttaaagttctgcaattttcaaaaaagcatcaagcgtcccaaattcagtatagagttaaagaagggtaaacttctcgctacttcatgggatggttctcaaggaaatgcgtcgaggctaaaaggaacgggaagaagaaatggtcgtgactatgaaattttaaactactcctatttaatattcgagagatcacataaggacgaaaatacgttgaaagaaattaagaaattacggaatgaaaatgtgaacggcaaatatgacattggatcactgggtgatgacacgcaaaattcctggcctagaattatcaatgatcctgtcaaacgtaaaggtcatgttatgatggatttatgtgcgccatcaggagaacttgaaaaatggacggtttcgcggtcgttttctaaacaaatataccacgatgccagaaagagtaagaaaggtgatttatgggcctcagcggccaaaacacagattaaagggctgggagacttgaatgttaagaagttccacaagctagaaaaggagagaatcaagcagttgaaaaaggaagaacgtcaaaaagctagaaaggctatggaatcttataatgaattggaggactctcttcaatttgatgatcatcagttctcaaactttgaggtaatgaagaaattgtccacttttcacggcaacgattttttacaacatgtaaatagaaaatag

SEQ ID NO: 4287 - DNA, 1887 bp, Saccharomyces cerevisiae
atggaccctggtattgctaatcataccctccccgaggaatttgaagaggttgtcgttcccgagatgctggaaaaggaagtaggagccaaggtcgatgtcaagccaacgctaaccacatcttctccagcaccttcttacattgaattgatagatccaggtgtgcataacatcgagatttacgcagaaatgtacaaccgcccgatctaccgtgtcgcattattcttctcacttttcctcattgcctatgcttacggattagatggtaatatccgttacactttccaggcgtacgcgacttcgtcgtactcccagcactcgctgctatcgaccgtcaactgtattaagacggttattgcggctgtaggccagatcttctttgccagattatcagatatcttcggcagattttccattatgattgtcagtatcattttttatagcatggggaccatcattgagtcgcaagcggtgaatattacaagatttgcagttggtggttgtttttaccaattgggtcttaccggtattattctaattttggaagttattgcttctgacttttccaacttgaactggaggttgttagccttattcattccagctttaccatttatcatcaacacctggattagcgggaacgtaacaagtgccatagatgctaattggaaatggggtattggtatgtgggcttttatactgccgctagcttgtattccgcttggaatttgtatgttgcacatgaggtatttagcaagaaagcatgctaaagatagattgaagcccgagttcgaagcgctaaacaaattgaagtggaagtccttttgtatagacatcgcattttggaaattggatatcattggaatgttattaattactgtatttttcgggtgtgtattggttccattcaccttagcgggtggtttgaaagaggaatggaaaactgcgcatattattgtccctgaagtcattggttgggttgtagtgttaccactgtacatgctatgggaaataaagtactcgagacatccattgacaccttgggacttgattcaagatagaggtatctttttcgctctactcatcgcattctttatcaattttaactggtatatgcaaggtgattacatgtatactgtactagtcgttgcagttcatgaatccataaagtccgctacaagaattacctccttgtattcatttgtttctgttatcgttggtacaatcctcgggttcatactgattaaagttagaaggactaagccttttattatatttggcatttcttgttggatcgtctcatttggtttgctggtccattaccgtggtgactccggtgctcattccggtatcattggctctttgtgtctattaggtttcggtgcaggttcatttacctatgtgactcaagcttccatccaagcatccgctaaaactcatgcaagaatggcggtagtaacctcattataccttgccacttataatattggttctgcatttggtagttctgttagcggagctgtctggactaatatcctacccaaagaaatttcaaaaagaatttccgatccaaccttagctgcacaagcgtacggttctccatttacattcattacaacttatacctggggaacaccagaaagaatagctttagtcatgtcttaccgctatgttcaaaagattttatgtatcataggtttggtattctgctttcctttgttaggttgcgcattcatgttgagaaatcataaactaacagattctattgctcttgaaggcaatgatcatttggaaagtaaaaacacctttgaaattgaggaaaaggaagaaagttttttgaaaaataaattctttacgcactttacaagcagtaaagataggaaagattaa

SEQ ID NO: 4288 - DNA, 1887 bp, Saccharomyces cerevisiae
atggagctgccttcaataaatagcaccacaagtatatccgacaaccaggagttaaggaattactatgacaagttgctgttcaagaacaatagtggcaagtcgctagcggatttgccaggaaaaatggcagattttaacgacaacagcgctgctgcgcatccccgctccagagttgactttatcaacggttacatcggtttcagagaggataagcagtctcttctggggcagaagaacactaaaagggcctcgttcagcgcatttgcggacgaaggaaggaaacagagcgagatgagcattaacgggaagagccctaatttgtctcttttctcatttgagtttaacggcaccccgactcaggacagaaagccatacaaacaggattacttgaatgtgatgaacacttcgcctaacaatattctttctcccttaaacaacagctcccaaaaatactatccacagaaacagcagcagcagcagcagcagcagcagcagcaacagcaacaaagcatctttgacccgggaagaagatcttcctatatttctgatgcgctgattcatggcaatgcggctacccagcaaccacaatactcgcaacctgtatatattaacaacaacccatctttgcaagtaccatacactgctccttccgagtatactcagcagcaacagtactcgtcacccttcaatgctaggcgcaacacccagccagtgctgaacttgcatccggcagccgctcccacaaacgatgccggattggcggttgtcgacggcaagaatttgacgtcatccaaggagctgcatgacttatatcttgactgcgggtcaaactattttgctagtgataaagtttataaatttattgacagcataaagggaactttacgcggggataatgtctccgcctccagttccaggattatagagtttttggattttttgaaaaattgtaatctgaattacaacccacagtctgacgcattcatctccactgctgtttcaaacgcttcgtcgaccggggcggccaaatccaagaacagcacttcaatgcatttgcactataagccattagtgttagtatcgttgaaaaatggtaagctcgaactgttgtctaaaccacaaacggccacacttatactgaaaaggggcgatttggtcattattgatggtgatcgtggtaaagatttagttttggtggtggaaccggttgtagatataaatttggcactatttataaattttttgaagaaaaaaattcactttgattctctaatcaccaatagtcaacagcatttccccaatgaccagtttatcaagactctggttgatacaaccaatggtaagccggtcgctcatgagttgaatccgaagttatatgatatcattgaactaacgcaattgatcatcccatcaaagcaggttctgagatttgccaccccgtgggaatcctccacgaatttacacaacaaattccaggatgagctaaaggctcttcacattgcacagctaaaactgaggtcgctaaataacaataactccggtggcgggttgaacatcaaaatattgaatgcagagttccaattcgacagaaagaaattgactttctactacatttgccaggagcgtaatgatttcagagacctgatcaaagaactctttaagttttacaaaacaagaatttggctttgtgctataccgaacaatttatcgatagattccaaattttatgattcaaacaagtttgagtgggagatgtatcaggatatgatgtcccactattccatggacaacactggaattgtcgtggcccctgaactgaatcgcttgaaactggacgacttccagatcggtgtttatatggaattggtgaaggttttgttcggctaa

SEQ ID NO: 4289 - DNA, 1887 bp, Saccharomyces cerevisiae
atggctggagagaacccaaagaaggaaggtgtagatgctaggtttgccgggatctacagcgatcctaaatttaagaacacgaaaaccaaagatcataagatcaagttagattctaggttcagtaagaaggatctggaggtccagcataaatctaaggttgacaagtatggtagaaagatcaaaaatgcgcagaataacagggaattggaagatttcgacaaatatttcgaaaaggaagcagaaaatgatgaagattcagaagttaatgcgaaaacagtagtggaccgtgcccgtggtgaagttcctgatgattatgttagctcttctgatgaattcacttcttctgattctgaatcgtccggagaaagtgaagttgaaagcgaagaagaaaatgaagtagaaattgaaaatgccaaaccagaatctggtgacatctctaagaatttggccgtcgtaaatttagattgggaccatgttaaatctgaggatttgatgattaccttttccagtttcgttcctaaaggtggtaaaattgaaagagttgctatttatccaagtgaatttggtaaagaaagaatgcaacgcgaggaagttgaaggacctccaaaggaacttttccaaaagaaaaataagaacaaaacctccaaaaagaagaaaactgatgactctgattctgatatggacatcggtattaaggatctttatgaagagggagatgctgacaaggacgtggattccagagctttacgtcaataccagttggacagattaagatattattacgcaatagtttattgtagtgatacaaccacctccaaagctatctatgataactgtgatggtaccgaatatgagtcaaccgctaatatgttcgatttaaggtatgttcctgatggtatgacttttgatgatgatgtaagagatgaatgcagtatattgcctaagaactataggccacaccagtttagcacagatgctctacaacattcaagcgtcaaattgacctgggatgaaacgccagctgatagggtcgaagttgctaagagggcctttacccaaaaggaaattgatgatatggactttaaggcttacttggcgtcagatagtgatgaatcggatgggcaggtcgatgaagaggcgaaaaataaactaaagtcgttggttggtgactttgggtttaattccaagaaagaaacccctaacgatgaagatgaagaagttgatatggaaattacatttactccagccttggaaggaggaaacgagaaatcgtcggaagacaaagaagaaacgactatagagaaaataagaagaaaagagaaggaacgtcgtaaagcaagaaagcagaaagtaaaggaattgaaacagcagtcggagaaggataagaaaagcaagttgaaatctgttaataaaaagcatactaacgatgaagaggagatcgaaaagaatgccaaatcaaaggctgaattggagcttttaatggatgatgatgatgataccgaaactcagggcacaataaataacaaagcacatttcaacatgaacgaaatcttaagatcagaaaaagaaaaacacaagaaaggccggtatcaaaagaaagagagaattgttgaagacacctttacacctgatttagaagatcctagatttaaagaagtcttcgaagatcacgattttgctatcgacccgacccagcctgaattcaaaggtacacaagctatgagtaaaatcctaaaagaacgtagtaaacgtgttaagaataagaaaagaaaacttggcggtagtgaaaacaatatgaccaataacgcagatgataatgaagatattggtaacttggtaaacaagttgaaaaagaaaagcaaatcatccaagaaggtaaaggtttaa

SEQ ID NO: 4290 - DNA, 1888 bp, Saccharomyces cerevisiae
atgggtgtcgcagatttgatcaagaaattcgaaagcatctcaaaggaagaaggcgatgctaccgttgatacaaacagttcatcaaagcctctcaaatcaaacgatgaaaccaaagaattgcatcaacaagagtctactgctgttccgcaagaggttgacgtaaatgaagagtttgagaatgaaccagaaacaattaacagtagtagaactgctgagaaaccattggaaacaaacctcccaaaacctgaaactaacgaagaagacgaagaagagggctccatgagcgagaataaaatatattctaaaggtgaaaatgctgacatcaacgttaatgattttcaagaatataaagaaatggaaaatactggcgctgaagttcttgcaagtagtgttgaagaatccgatgctattcaagaaggtgtggctgaggaaactgaagggattgctactcctaaacaaaaagaaaacgaaaaaaatgatgaatcagaagaagaatctgcaaataatgcatctgaaccagccgaagaatattctcaatctgaagaagatgctgacatcgagcaatctaatggcaaagaaactgaaaatgccgaaaacgcttctcaacaagctaatgatggctctacaagtaccacgacttctaagaataagaagaaaaaaaacaaaaaaaaaaacaagaagaagagaaatggaaatgttaacaccaacgctaatgtcgacgacagcaccaaaaccggtgaaaatgatgatacaaccggcgacaccacgtcatcaacaacctccgccattcaagaagtgaatgatttggaagttgttgatgactcttgtcttaggcattgatcaacagcataatagggagcatttgaaagcgttaactcaggacgttaaagaagagacgttagagaatattgcgcacgagggcagaggtgataacacaggcgatcagaatgcagtagaaaaatctgatttcgaaaaatcagatacagaaggttcaagaataggccgcgacttaccctttgaatttggaaaacgtaacttgaccgaggaatctgacgtttgggatcataacgcttgggataatgttgagtggggtgaagaacaagtccagcaggcggaggaaaaaatcaaagagcagtttaagcatcctgtacctgagtttgacaaaaaactatacaatgaaaatccggcacgttattgggacattttttataaaaacaacaaggaaaactttttcaaggacagaaagtggttacaaattgaatttccaatcttatacgcatctaccagaaaagacgcagaacccgttacaatatttgaaattggctgtggggcaggtaacacttttttcccgatcttgaaagataatgagaacgaaaacttgaggataatagccgcagattttgctccaagagccgtcgaattagttaaaaattctgaacagttcaaccccaagtacggccacgcaacagtatgggatttggccaatcctgacggtaatttacctgatggcgtcgaacctcattctgtggatattgcagtaatgatcttcgtttttagtgctttagcaccaaaccaatgggatcaagccatggataaccttcacaaaattttgaaaccaggcggtaagatcatatttcgtgattacggtgcatatgatttaactcaagttagattcaaaaagaacagaatcctagaagagaacttctacgttagaggtgatggtacaagagtttattttttctctgaagaaaaactaagagaaattttcacgaaaaagtacttcttggaaaataaaattggaactgatagaaggttgttggttaacagaaaaaggcaactaaaaatgtaccgctgctgggtacaagctgtgtttgacgttcctcaatag

SEQ ID NO: 4291 - DNA, 1890 bp, Saccharomyces cerevisiae
atgccagatgaaacaaattttacaatagaagatattgagcctaggcctgatgcccttcgaggtttggacacccagttccttcaagacaacacagcattagtacaagcatatcgtggtttagactggtcagatatttcttcgttgacccaaatggtagatgttatagagcaaacagtggttaaatatggcaatccaaatgattcaatcaaattggccttggaaactattttatggcaaatattgcgtaagtaccctttattgtttggattttggaagaggtttgctactattgagtaccagttatttggtctcaagaaatcgattgctgttctggccacctcggtcaaatggttcccaacttctctggagttatggtgtgattatttgaatgtgttgtgtgttaataacccgaacgaaacggattttattaggaataattttgaaattgcaaaggatcttattggcaagcagtttctatcacaccctttttgggacaagtttatagaatttgaagttgggcagaagaattggcataacgttcaaagaatatacgagtacattattgaagttcctctacatcagtatgcgcggtttttcacatcttacaagaagtttttaaatgaaaaaaatttgaagacaacaaggaatattgatatagttttacgaaaaacacaaacaacagtaaatgaaatttggcagttcgaatcgaaaatcaaacagcccttcttcaacctgggccaagtgttaaatgatgatttggaaaattggtcgcgatatttaaaatttgtgacggatccttcaaaatccttggataaagaattcgtaatgtccgtttttgacagatgtttgattccttgtctttaccatgaaaatacgtggatgatgtatattaagtggctaacaaagaaaaatatatccgatgaagtggtagtggatatataccaaaaagccaatacgttcttaccactggatttcaaaactttgaggtatgattttcttaggtttttgaaaagaaaatatcggtcaaataataccttattcaataacatattcaatgagacagtatcgcgttatttaaagatttggcccaacgacatattacttatgacggagtacctttgtatgttgaaaagacattcttttaagaattccttagatcaatcgccaaaggaaattctagagaaacaaacatcgtttactaaaatcctagagacatcaatcaccaactacatcaataatcaaattgatgccaaggtgcatttacagaccttaataaatgataaaaacttaagcatagtcgtggtagaattgataaaaactacatggcttgtacttaaaaataatatgcaaacaaggaaatatttcaacctttatcaaaaaaacatcctcattaaaaattctgtaccgttctggttaacttactacaaatttgaaaagagtaatgtaaattttaccaagctgaataaattcattagggagcttggggtagaaatatacttgccgactacagtaatgaatgatattttgacggattataagactttctatttaactcattcaaatatcgtcacgtatgaatcctccattatagattcaaatacatttgaccctatcttgtaccctgagctgaaaatgtcgaatccaaaatacgatccagtattaaatactacagcaaatgtagattggcataaaaagacggaatggaaggaggctggtcacatcggcataacgacagaaagaccgcagatatccaacagtataattgagtgcaattcaggaactttgattcaaaagcccatcagtttgcctaattttagaaacttggagaaaattaatcaggtcaagattaatgatctatacactgaagaatttcttaaggaaggtaaatga

SEQ ID NO: 4292 - DNA, 1890 bp, Saccharomyces cerevisiae
atggataaaagcatgatcaaaaaaagaggcaggcctcccatcaccaaagattatcccaatcccctacaaagccccatggcgcattcttcaatgcaggttcagaagcaggggcctcacagttttgccaaacctttgatgaaagtggggcaatctagtccatccccgaataaaagaagactcagcatcgatcatcatcataatttggcggcaactacgagaaagggcagatacaggggcgttcttctttctactcccaccaagaaatcgagcactaatggctctacgccgatctctaccccgtcttcgaatgacagctataataacacggtgttttctgaaacaaggaaaacctttcttcagagttcgccgcctatcatgacgtcttctccagctttccaaaagaaaaatgactacatgtttccttcacaggaacaattcaaactttctttaaccattaccgaaagtgggaaggccgttattgcaggatctttgcctttctctccatcgtcaaaatcgtctcatttaatgaacaataataataaaaagatcatgcaaaatgaaaaaattcacaaaggaagcaagaaaaatgcacccaagtttgagaagagacgtattctttctctcttaaaacagatgaagaatgagaaatattgtgatactgatacgctccccgaagcacctccagcgaaaccaagcagatctgacatcatcgacacagaattgccgactatcatagaaacttcagcttctccaataggcagtgctagaaacaataatatactgctttcgcaaccaccacaatcacccccttcaagcgcgcaacttaagcccccatccactccaaagagttctctacaattcaggatgggatttactcccaatgttgcactaaattccgtatcattaagtgatactatatccaaatctacaaatgctgtgggtgccagcaataataacaatcagaacggtaattccattagcaatatcgcggatgctaatactttacttaccttgactaatagcccgggagttttcttatcacctcgaaacaaaatgttgcccaagtcgactactgcatctaacgaacaacagcaggaattcgtgtttaagttttcaagtggtgacccgttattgcttactgacgacgcagatgggaattggccagaaatgctgttcaatgtatctaatacgcccagacgtcaaaaatgttttaacacacctccttcatggataaactttggttcacctggattattcagcccaccaagaagctctaatgtcatggtaaatggcaccactgtagccaccgcatcggatagcggcaacgtccatagacaattacaagctcaattggaggcgcaagtgcaagtgcaatcgcaatccaattctcctactcaaaggcaacaacaacagcgtcaatttcaaatacccccacctcacataaacatgaactcttccccgccacaaatcaatatcgcttccccacctcatcaatctatgtctcgggtgtcatctatttacttcaacaaagaaaaaaccacaacaggggtagcaaatatgctaggtaacaccaaaagcgaaaacttacagccgccggcgaatttatttaccgctgcccatggaccttcaactcctagaaatcaagaatttcaattacccactttgattgaatgcactccattaatccagcaaaccatgaatggctcattaggaaccaaatacataccaggtacttcaatttcgaacagtgcaactcctaatttacacgggttccctgttggaaccgggaaagctccctctagctttgacgattcactaaaacaaaacccgtacagcaacaaacaggatgatgctagaactgccttgaaaagattaatcgatgatcagtga

SEQ ID NO: 4293 - DNA, 1890 bp, Saccharomyces cerevisiae
atgtcaagtgagtcaacaactttcatcgtggatgtttcaccatcaatgatgaaaaataataatgtttccaaatctatggcatatctagagtacactctattaaacaaatctaaaaaaagtagaaaaacagattggataagctgttatctcgctaattgtcccgtatctgagaattcccaggaaataccaaatgtgttccaaatacaatcctttttggctcctgttaccacgacggccaccattgggtttataaaacgcctgaaacaatattgtgatcagcacagtcatgatagttcgaatgaaggcttacaatcaatgattcaatgtctgttggtcgtctcattagatattaaacaacaatttcaagcaagaaaaattctaaaacaaattgttgtatttacagacaatttagatgatctggatattactgatgaagaaatagacctgctaacggaagaattaagcacaagaatcattttgattgattgcggtaaagacactcaagaggagaggaaaaaatcgaactggttaaagttggtcgaagcgataccgaattcaagaatctacaatatgaatgaacttcttgttgaaatcacttccccagcaacatctgtcgttaagccagtaagagtattctcaggcgagcttaggttaggggcagatatattatcaacacaaacatcgaatcctagcggcagcatgcaagatgaaaattgcttatgtatcaaggtagaggcttttcctgctacgaaagcagtttcaggcttaaataggaaaaccgctgttgaggtggaagactcccagaagaaagaaaggtatgtgggggtcaaatccataatcgaatatgaaattcacaacgaaggaaataagaaaaatgtcagtgaagatgaccagtctggatcgtcatacattcccgtgaccatctccaaagactctgtaacgaaggcataccgttatggtgcagactacgtagtgctaccgtccgttctagtcgatcaaactgtatatgaatcttttccaggcttggatttaagaggatttttgaatagagaagctcttccaaggtactttttgacgtcggaatcctccttcattaccgccgacacaagacttggctgtcaatctgacttaatggctttcagtgctctagtggatgttatgctagaaaatagaaaaattgctgttgcaagatatgtgagcaagaaagacagtgaagtgaatatgtgtgcattgtgtcccgttctaattgagcacagtaacattaattccgagaagaagtttgttaagagccttaccttgtgtagattaccattcgcggaagacgagagggtaactgattttccaaaacttctggatcgaacaactacatccggggtaccgctgaaaaaggaaacagacgggcatcaaatcgatgagcttatggaacaatttgtagattcaatggatacagatgagctaccagagattccgttaggcaactactatcaacccataggcgaagtaacaacagacaccactctcccacttccctctttaaataaagaccaagaggaaaacaaaaaggatcctcttagaatacccacggtttttgtctacaggcaacaacaggtgctactggaatggattcaccaactgatgatcaatgattccagggaatttgaaatcccagagcttcctgactcattgaaaaacaaaataagtccttacacgcacaagaaatttgatagcacaaaattggttgaagtgctcggcatcaagaaagtagacaaattaaaactcgactccgaactaaaaactgagcttgagagggaaaagatcccggacctagaaacgctattgaagcgcggtgaacaacacagtaggggaagtccaaacaatagcaataattaa

SEQ ID NO: 4294 - DNA, 1890 bp, Saccharomyces cerevisiae
atgtttgcatcgagatttgaccctagccaattgactgctcctgcagctagcgcaccagaaggaatcgtcggaactactcccccggccattgtgcctttaaagaggcaggctactgaatctgataatgaagaatatggctctcaccaagattctgatgagagttccaactctagttcagaggaagacgaagaccgtatgcaagtagattatggggctagtgaagaggattcgagtgaagtggaagaggaagagagtaagccaagtactcacagcacagtgctatcgagattcaagcaaacagtatcattgcaagaaaggctaggtgcatctgatattgctgagagtaaggaagacgaaggtattgaagacgaggcggcctcaactcaccaactaaaacagattcctcaacctgaattcgtcaaaaacccaatgaatttgaatacaaattcattacagttcaaatctacgggttggttaaatactgagaagatatattatgataattccttgatcaaaccgttctcggattacgcaaatgaattagaagcaaaactactgcagaatatttgcaagaatttctctacaaacacttttcccatccaatcgatcatcctagactccatattaccggtattgaacttcacgttgaacgtatctaagagaaacttcaccagaagaatcggtgatattcttgtaaatgctgctaccggttcaggtaaaactttggcttactccattcctattgttcaaaccctcttcaagagacaaattaacagactgcgttgtataatcatcgtccccacaaaactattgataaaccaagtttatactacgttgacaaagctaactcaagggacgtcgcttattgtgagcattgccaaattagaaaattctttgaaggacgaacacaaaaaattatcaaatttggaaccagatatcttaatcactacacctggtagattagtagatcatctaaatatgaaatcgataaatttgaaaaacctaaagtttttgattatcgatgaggctgatcgtcttttgaaccagtccttccagggctggtgtccaaaactaatgtcccatttgaaaacggataaattagatacacttccagggaacgtgatcaaaatgatcttcagtgcgacattgactaccaacacagaaaagttaaacggcttgaacctttacaaaccaaagttgttcctgaagcaaaccgataaattgtaccagctacctaacaaattgaatgaatttaacatcaacattcccacggcgaaaagtgtttacaagccattgatattgttgtattcaatatgccaatttatggcacattcccccattgctgcaaagattttgattttcgttaaatcaaatgaatcgtctatcagattaagcaagttactacaacttatctgtgaatctcgctcacaatccagcgtattgaaaaaccttcaaaatttggcggtgagtattaattctgtcaattcaaacaactccaaagcagaaaataaaaaaattgttgcgaacttctcgcatcactcggaaagcgcaggcattaccatcttaattactaccgatatcatgtcccgtggtattgatattaacgatatcactcaagtaataaactatgacccaccaatgtcttctcaacaatatgtccatcgtgttggtagaacagcaagagctaacgaacttggttccgcttataacttactagtaggtagaggtgaaagaacgtttttcgatgacttaaacaaagatctagatagagacggtaaatctgtccagccattagaactcgattttaccctattggaatctgattctgaactatatacttcgtctctagaaagtttgaaaaactatcacaataacaccgcacaagcttaa

SEQ ID NO: 4295 - DNA, 1893 bp, Saccharomyces cerevisiae
atgctagtcttcggacctaatagtagtttcgttcgtcacgcaaacaagaaacaagaagattcgtctataatgaacgagccaaacggattgatggacccggtattgagcacaaccaacgtttctgctacttcttctaatgacaattctgcgaacaatagcatatcttcgccggaatatacctttggtcaattctcaatggattctccgcatagaacggacgccactaatactccaattttaacagcgacaactaatacgactgctaataatagtttaatgaatttaaaggataccgccagtttagctaccaactggaagtggaaaaattccaataacgcacagttcgtgaatgacggtgagaaacaaagcagtaatgctaatggtaagaaaaatggtggtgataagatatatagttcagtagccacccctcaagctttaaatgacgaattgaaaaacttggagcaactagaaaaggtattttctccaatgaatcctatcaatgacagtcattttaatgaaaatatagaattatcgccacaccaacatgcaacttctcccaagacaaaccttcttgaggcagaaccttcaatatattccaatttgtttctagatgctaggttaccaaacaacgccaacagtacaacaggattgaacgacaatgattataatctagacgataccaataatgataatactaatagcatgcaatcaatcttagaggattttgtatcttcagaagaagcattgaagttcatgccggacgctggtcgcgacgcaagaagatacagcgaggtggttacctcttcctttccttctatgacggattctagaaattcgatctctcattcgatagagttttggaatctcaatcacaaaaatagtagcaacagtaaacccactcaacaaattatccctgaaggtactgccactactgagaggcgtggatcaaccatttcacctactaccactataaacaactctaatccaaacttcaaattattagatcatgacgtttctcaagctctgagcggttatagtatggatttttctaaggactctggtataacaaagccaaaaagcatttcctcttctttaaatcgcatctcccatagcagtagcaccacaaggcaacagcgtgcctctttgcccttaattcatgatattgaatcttttgcaaatgattcggtgatggcaaatcctctgtctgattccgcatcatttctttcagaagaaaatgaagacgatgcttttggtgcgctaaattacaatagcttagatgcaaccacaatgtcggcattcgacaataacgtagaccccttcaacattctcaagtcatctccggctcaggatcaacagtttatcaaaccctctatgatgttgtcggataatgcctctgctgccgctaaattggcgacttctggtgttgataatatcacacctacaccagctttccaaagaagaagctatgatatctcgatgaactcttcgttcaaaatacttcctactagtcaagctcaccatgcagctcaacatcatcaacaacaacctactaaacaggcaacggtaagcccaaacacaagaagaagaaagtcgtcaagtgttactttaagtccaactatttctcataacaacaacaatggtaaggttcctgtccaacctcggaaaaggaaatctattactaccattgaccccaacaactacgataaaaataaacctttcaagtgtaaagactgtgagaaggcattcagacgcagtgagcacttgaaaaggcatataagatccgttcattcaacggaacgcccttttgcttgtatgttctgtgagaaaaaattcagtagaagtgacaatttatcacaacatctaaaaactcacaaaaagcacggtgatttttga

SEQ ID NO: 4296 - DNA, 1893 bp, Saccharomyces cerevisiae
atgctcatagaaaacactaatgatcggtttggtatcgtcatagatgcagggtcttcgggttcgagaatccatgtgtttaagtggcaggacacggaatcgcttcttcatgcaacaaaccaggactcacagtccatattacaatcagtacctcatattcatcaagaaaaagactggacttttaagctgaatccaggcttgtcgagttttgaaaaaaaacctcaagatgcgtacaaatctcacatcaagccgttactagattttgctaagaatattatccctgaatcacattggtcgagttgtcccgtttttattcaagcaaccgcgggcatgcgccttttacctcaagacatacaatcttccattttggatggtttgtgtcaggggctcaaacaccctgcagaatttttggttgaggattgctcagcacaaattcaagtcattgatggtgaaaccgaaggtttatatggctggcttggcttaaactatctatatggacactttaatgactataatccagaggtctctgaccattttacatttgggtttatggacatgggcggtgcctctactcagattgcgtttgcaccgcatgattcaggagaaatagctagacatagagatgacatcgccaccatcttcttgaggagtgttaacggagatttgcagaaatgggacgtttttgttagtacgtggttagggtttggtgccaatcaggctagaagaaggtacttggctcagttgatcaatacccttccagaaaacacaaatgattacgaaaatgatgacttctctacaaggaacttgaatgatccatgtatgccgcgaggaagcagcacggattttgaatttaaagataccatatttcacatcgcgggttctgggaattacgaacaatgtacaaaatctatttatccgttacttttaaagaacatgccttgtgatgacgagccgtgcttgtttaatggtgttcatgctcctcgaatagactttgccaatgacaaatttataggtacttctgagtactggtacactgccaacgacgtattcaaacttgggggcgaatacaactttgacaaatttagcaaaagcctaagggagttttgcaattccaattggacgcaaatattagcgaacagtgataaaggcgtgtataattctattccggagaattttttgaaagatgcatgctttaagggcaattgggtccttaatatacttcatgaagggtttgatatgcctcgaatagatgtcgacgcagaaaatgtcaatgacaggcccttatttcaaagtgtggaaaaagtcgaagaacgagagttatcgtggacactaggcagaattttactttatgcctcaggtagcatattggcaggtaatgatgacttcatggtgggtattgcgcccagtgaaagaagaactaagctcactggtaagaaattcatacctggcaagttactggagtctgatcaactacgcaagcaaagttccagcctttctaataaaggatttttgatgtggttcgcaattatttgttgcatattttacttgatctttcataggtcacacataatcagaagacgtttttccggtctgtacaacattaccaaggactttaagacaggcataaggagaaggttgaaatttctaaggagatcagatccattttccagattggaggaaggtgaacttggaacagacgtagatggcttcaaagatgtgtacaggatgaagagtagcagtatgtttgatcttggtaagagttcagccacaatgcaaagggagcacgaaccacaaaggacagcaagtcagtccgctaatctcgctccgtcaaacttacgacctgcgttttctatggctgatttttccaaatttaaggacagtaggctatatgattga

SEQ ID NO: 4297 - DNA, 1893 bp, Saccharomyces cerevisiae
atgcttaaatcattaaaatccagaagactaatcttaaaacgattagtaacactgctgctctctttattcttttcttatctcattttctctgccagtcggaatgttacatcatccaataaattaaacaaccatgcaagcgagaggacagctgttgaatcatctgcattcaattggattgaaaaacgacaacaccaagtgagatccgaaaacttaatgaacagattatctgcctactttttgccctttttgagtagaagttctcacaaagaacgtgtattgttgaggcaattaggaaataatgaaatagcgaagagtgacaagtgccgttacatttttgaagtactatacaagattgatcccgactgggacaatgcgcaaactgcaaaattttataatgttgatggtgtagataacacgttggcctcattgttaggggaaagattaagatcttatgattattgctttttatctggtcaattagatcctactgcaatatttgcaaattcaaccgtaaatcctcatgatttgcaaaacagaatgtttccatttctgaagaaaattaacgaggaatccaaaactgtaatgtggcctattatcacagacatgacaactggagaggcagttccggcacccgaggttgatatggaatcatcaaactttaatggtaacttttggtccaactggaataggttgagcaaaggaagaggttttgttttaactattgctgaaaaggatgttcctttatttttgaaacagttgaaagtgatggaattttcaaaaaacgaattaccattccaaatagtatccacgggaaatgaactatcagcagagtctattgctaaaatttctgagaccgctaaagaaacggaacaaagggtctacttagtagactgctcgacagtgcttgacactaattttgctaatacatacatttctttttttcagaataaatgggtcgccactttgttcaacacatttgaagaatacattttgttggatgcagacgtagtaccgtttgtagggtctgattactttttcgactctccttcttacagggagagcgggatacttttgttcaaggatagggttatggaaaacgagcaaactttccaatactgcatcgaaatgttaaatgaagtggaaccctctgcacaagaacgcagatttattggaagtaggttagtttttgattcgtcattaccgttttcttccgaaacctcagaagaagcatctgtgtattacaattttttcaaaaaattacgactccatcatgttgatagtggtttggttgtagtcaataaacttgagaaattaaatggattgttgatgtcttttatgttaaatttggatggaaaattgcagaggtgtgtgtatggtgacaaggaaatattctggttggggcaattatatgctggccaggattattctatcaatcccgttgatggcagtattattggacctgttaatgaagagcctgaaaatgatgacggacataaaagcgggatgtactacatttgttctacgcagattgcacacagtgactccaaaaatcgattactatgggtaaacggtggactgaagacttgtaaaatttcgaacagtgctgaagatgactttggaagagagccagagtattttaagagtagatatggggacatttcaaaattaaaaaggatatatgatgcttcgttgaacgtagagggactaatcgttcctgacgtttctgttcatccatggatgcaaatcaaggaatgttctaattatatgtattgtgcatatgctacgggtgacggacacacaaactctgaacttgacgaaggtcgtctaatcacgtttactgaaaaggaattacgatatatcaatgatatttctcgaacctggaatgctaattga

SEQ ID NO: 4298 - DNA, 1893 bp, Saccharomyces cerevisiae
atggtgaattggcaaacattgttcatggtctcattgaggagacagggcagttcctctcgttacaggtataagttcaacatggagaatatcacacatcaggtgttccctcgctgtaagcaagcgtttaagaagacaaacttatcttatgaatattgtgatcttgaaggagtactgtataatatttcactcacggacttgcaaaaactgctattacgtgatataaacgcccctcgcgaacacgcattcaagattgttagaacagatctaactcaaaaatcctcgaagaagaggatccaacactgggaacggattgcgcctatgtttgaccaccccttaagtctctacgagaagttgttcagcgaaatggatgaggacttcaagccatctttcgagtggcaacaattaataagggtacgatgcaaagatgataagttgaaactgcagcgtgtaatttggcctaagtcgatattttcaaacttttgtcggggaatcggggttaagaagagcacttacgatagactcttggaacaaaataatggtgaggtacccatgtttgtaaacccagctaatgcaaagcccttgcctcttttccaggtttccgatgaggcgatgattggggaattcgatggaattggtattttcccttactttgtagataaacatagagaatttttcgttactgaggtagacaaattgaagaccaagatagcttcgccactttgcaccttgaatgaacgaaagcgcattgagaaggctaacgctggtcggatactggcgaacgaagagggtaaaccattctatctggatgcaaacagtgccacaactcgaatcgctggtggtaatgtcgtcactttgaagcaacttttagaaagatcggttagccataagacattgtggagcaaacaatcaaacaaagacagaacgtgccctggagacattttaagagctacaatattatcaaacgacttctccatccggcaattgagggctgaattttgcaaaaatttcattctctacaatatattcaccattttacaacgtaacaagaaaagcatccgttccttctctggtaacgataatgcgccttcctttcaatttagttggaatgtttgggactcatatatatggaagcaatatcaagagaccgagtccatgaaaatacccacggaccaagcttctctgatcaactacaagacaaaatacgactcttttcttcatgacctacaaacatattccgcactggtaatttcagaaatgaaatggaaccaattctctattttccaaaatgatgaaacgactttatcaagatttgaacacatcacattaattttgcaaaccgtgctgacaaaatcgaaaatgattagaattttccagccaaacttgtacaagtttatgcaagatgatttaagaccaactttaatggagttggtgggtttcactgagtcaataaatgcaacaatagaacctggttttgcgaatgaacaatcgctacaatctgcaaacggattaaagaaattggccaaccaacttttatacttcgaacaggaaatatatggcgaaaagttccgcgtaaataggcccatccagcttcgtccaataacattatcagcaaactacaaaattgttattctggataagaagaacgccatacccgaaatatttcaaaccctactgaaattcatgacacaaataacgacatattttgttaaagatttgtcggaggtagaacttcatgggcacatgcattgtattgataaaaaaatgctggacaagtcgaaattcatgtatttatacgaagagaaaagcaacgaggaagtgaaagcagcttctcctcaaaaggagaagatagtagataatatcattggcctattatcaaatgatgaagaacattaa

SEQ ID NO: 4299 - DNA, 1893 bp, Saccharomyces cerevisiae
atgtcgtcagaaagggtcttaagttatgcaccagcttttaaatcatttctggatacatcttttttccaagaattatcgagattgaaactcgatgttctgaaattagattcaacatgccaaccacttactgtgaatctagatttacacaacattcctaaatctgctgatcaagttccattattcttaacaaatagaagctttgaaaaacacaataataagcgtactaatgaagtgcctttacagggcagtattttcaattttaatgtattagacgagtttaagaatcttgataagcaactatttttacatcaaagagcattggaatgctgggaagatggaataaaggatatcaataagtgtgtttcttttgtgattattagttttgctgacctaaaaaagtacaggttttattactggttaggtgttccctgttttcaaagaccctcttcaacagttttacatgtgcggccagagccgagtttaaaagggctgttctcaaagtgtcaaaaatggtttgatgtcaattactcaaaatgggtgtgtatactggatgcagacgatgaaatagtaaattatgacaagtgtattattcgaaaaactaaagttttggcgataagggacactagtacgatggaaaacgtcccttctgctctaaccaaaaattttctcagcgtgttgcaatacgatgttcctgacttgatagatttcaaactattaattattagacagaacgaaggtagctttgcattaaatgctacatttgcttctattgacccacaatcatcctcaagtaacccagatatgaaagtttctggatgggaaaggaatgtgcaaggtaagctagcaccacgtgttgttgatttaagttcattgttagatcctttaaaaattgctgaccaatccgtggatttaaatttgaagctaatgaaatggagaattcttcctgacttaaatctagatatcatcaaaaacacaaaagtactactactaggtgctggtacactaggttgttatgtttcacgcgcattgatagcatggggggttagaaaaataacatttgtggataacggtacagtttcatattcaaatccagtgaggcaagcgttatataattttgaggactgtggaaagccaaaggcagaacttgcggctgcgtctttgaaaagaatatttcctttaatggacgctactggtgtgaaattaagtattcctatgatcggtcataaattagtaaacgaggaggctcagcataaggattttgatagattaagagcattaataaaagagcatgatatcatttttttattggtggattctcgagaaagcagatggcttccgtcgttattgagcaacatcgaaaacaaaaccgttattaatgctgctctggggtttgatagctacttagttatgaggcatggtaatagagatgaacagtcttcaaaacaactgggctgttatttttgccatgatgtggtagcaccaactgacagtttaactgacaggactttggatcaaatgtgcacagtaactagacccggcgttgctatgatggcctcttctttagcagttgaattgatgacttccttactacagaccaaatactctggttcagaaacaacagtattaggggatatacctcatcaaatacgtgggtttttgcataatttttccatcttaaaattagaaactccagcctatgagcattgtccagcatgtagccctaaagttatcgaagcatttacagacttaggttgggaatttgttaaaaaggccttggagcatccactttaccttgaagaaattagcggtttgtcagtcataaagcaggaggtcgaacgactaggcaacgatgtttttgaatgggaagatgatgaatctgatgagattgcttaa

SEQ ID NO: 4300 - DNA, 1893 bp, Saccharomyces cerevisiae
atgtgttctccaactaatttcttatatgagcccttttccagcgatgctgtgacgcagaactatgaccaaaatctaaaatgcaccaaatgtggcgcctattattcgatggcttgttccctacgagaacagaatgtttggacttgtctattctgcaaccaatcaaactcaaatgctgaattgccactggtaccttccaacacctatacattgacttctgcaaagaaagaaatactttcaagacggaccattatgattatagacgctatttgcgatcctcatgagctaaattatttagtttccattctatgtaataattacatcacaagacaacaagagccactatcaataattactattcagcaatcaggtcatgtgattttacacaatgctgtgaatcacagacgtgatgctgtattttcaataaatgaatttatgaccaaatataatcttgataaattaaatgccagttacttcgagaaaaaaatttcagaaatcaatcaagaatcatactggtttgataaatctactcagggttctttaagaaaattgctacgggaaatatgcaagattgcaaacaaagtgaatatcagttctaaaagggacaagcgttgcaccggattagcgctgttcgtttcatccgtactggcgtctcagtgcagtttgtcagcctactgtcatatagtttcattcctgaatggtccatgtactaagggtggcggcaaagttatgtcaagagaacgtggtgaaagcatgagacaaaaccaccattttgaatccaaaagttcacaattgcaactatcaaaaagtccgacaaaattttacaagaaaatgcttgaaaaatttgcaaaccaatcgttaatctatgaattctttatagcttcattggatcaaatcggtatactcgaaatgagtccattaataacttcgtcaatggcagtttctcagtttgattcattcaatgatgagagattcgcaatgtcttttcaaaagtacctgaacttgcgtgaccataatgccatttacaattgtcattcaaagataatgaccgcaaagaacgctattgtcgttaaggacttcccaaaatatagcttaaaccctaaaaacctttctctaccattagaaatctcactaggtcacaattcagctgaagctcctatacagtttcaaaccacttttgaaaatcaaacggaaaaatacataagaattgaaaccctcttattgccaaaagccaatagatcatttggggcacaaaatgaaattgtgttttcaatgaaaaagatagcctcacgaattatcgatagctttgcttactcatccaagcacactaaagaattgatgaagcaattgtttctattaccaaatcaaatccggggaaaagacgtagatatggtcaatctgatacagtggtgttatcatatatataggtctccaattctatcggttcggaatacttcacctgatgaaaggtacctttttcttcaccgaataataaacgcttctaaagacacatgcctttcattatgcaaacccttcatctggagttacagtgatttgaaacacgactggatcgtgttggatgtcccattaacaagagcccagatacttcaagatgataaaaccaccatttgtgtagatggtggctcgtacttagttttaagaaggggaaaacttttggaaaaagaaggtcgcgagctctgttgcaagcttttaaatgacttgcaaaggtttccgcagccattatatgttgaaactaaaaccggtggcagtcaggaccgtttcttgaaaagcaaaattattcccttggacatcactgacaaggaaactcttggtacagaggatatgacattcaatgaatatttcaacttgttcaccgatctaagtggaagcaaataa

SEQ ID NO: 4301 - DNA, 1896 bp, Saccharomyces cerevisiae
atgattaagttcactaacgagaacttaattagagggatccgaatgacgatttccgcaaaatctcgtcatttggctctagggacagatatgacgagaaagtttagcttgtcgtgtaggtttttgaacaaagcaaatcttactgaagaagagaaagagttgttaaatgaaccaagggcgcgcgactatgtggatgtttgtatagttggaggagggcctgcgggattagcaacagcaatcaaattaaaacagttagacaattcgtcaggaacaggccaattgcgtgtcgttgttcttgaaaaatccagtgtattgggtggacaaactgtttccggcgctatattggaaccgggagtgtggaaagaactattccctgatgaaaagtctgacattggcattccgttaccaaaggagttagctacgttggtaactaaagaacatttgaaatttttaaaggggaaatgggcgatcagcgttccagaaccatctcaaatgatcaataaaggacgtaattatattgtctctttgaaccaagtcgtcggatatttaggagaaaaggcagaagaagtaggagttgaagtttaccccggaatagctgtctcggatctcatatatgatgaaaacaacgccgttaagggtgtaattactaaagatgctggtatttcgaagtccggtaagcctaaggaaaccttcgaacgtgggatggaattttgggctagacaaactgtattagcagagggctgtcatggttccttaacaaaacaagccttggcaaaatatgatttaagaaaaggcagacagcaccaaacttatggattaggtattaaagaagtttgggaagtcaagccggagaattttaacaagggatttgcagctcataccatggggtacccgttgacaaatgatgtttatggcggtggtttccagtaccattttggtgatgggctggtcactgtgggccttgtcgtggggttagattataagaatccctatgtttcaccttacaaagagtttcaaaagatgaaacatcatccatactattcaaaagttttagaaggaggtaagtgtatcgcttatgctgcaagagcattgaatgaaggtggactgcaatctgtacccaagttgaatttccctggtggtgttttggtaggggctagcgcgggtttcatgaacgttccaaagatcaagggtactcatactgcgatgaagagtggattacttgccgctgaaagtatctttgagtccataaaagggttacctgtcttagaagaggttgaagacgaagacgccaaaatggctatgtttgataaggaggcaactattaacttggaatcatatgaaagtgcattcaaagaatcatcgatatataaggaactatacgaagtgcgtaatattagaccgtccttcagcgggaaacttggtggatatggtggtatgatctactctggaatcgattctttgatattgaagggaaaagttccgtggacactgaaatttgatgaaaaaaatgacggtgaaattttggaacctgcttccaagtacaaaccgatagaataccccaagcctgatggtgtgatatcctttgatatattgacctccgtgtctagaaccggaacctaccatgatgatgatgaaccatgtcacttgagggttcctggacaagatatggtaaagtacgccgagagaagctttcccgtttggaaaggtgttgaatcgaggttctgcccagcaggtgtctacgaattcgtcaaagatgaaaaatcgcctgtgggtacgagactgcaaatcaattcacaaaattgtatccattgcaagacctgtgatattaaggcgcccagacaagatattacttggaaagtacccgaaggtggagatggaccaaagtacacgctaacttaa

SEQ ID NO: 4302 - DNA, 1896 bp, Saccharomyces cerevisiae
atggtgcgttttgtttcaattttaagtttattcggctgcgcggcgacgcttgtcacggcccatgatgacatggacatggacatggatatggacatggatatggacatgaatatcgatacgacaacgtctcaatccatagatgtctcatccacggcttcaatcgtccccgtgccacatgaaccaaaacatttgcatggccttcctatactgcaatcgccctcgcttacccctgcggagagattgtactgggaaaactacaacaccacaacctactttactacacaggctgggaataggtctgcccttcgctaccacattattacgctgctcttggttgcatttgtgctctaccctgtgtccctggcgctaagcgccgcccgttctaggtggtacttacccctgctgtttgttaatctatgcatttgtatttcgtccgtaatggcattgtccgtgttcaaaaatactttcccggaagaagactggtatgcgcataatatctatggcaccacttctgtgctacttctcgtttttatgcttgttcacttcttcgctgcggtgctttctgtccccgtctcattagcatcgaaaaaggagtaccgtccggttgacaccatccctctgaatgatcttgaatctacgcccgtcatggtgaatagtgcacgtggctctccaagtccttcttccaacagagacacgttgttctcgctctcttcagacaccacgaccgccacggccaccaataataataaacggagacgcgctgaaggcgaagacgagggtgataacacctccaaccacgacactttgcgcgacgaagactacgataatgatgacgacgaaattgcttccattgaagcgccacctctgcttcctcaagacatacccgttttccgaatcttgtttaccaacacgaagtaccagatgcttgccgcgcacctctcgtgcgtcgccaacgtggtctttcacatgcttacctacccgctattcatgtacatctttgtagacctaatcatcggcttcgctgtaggtaacttgctcggcaagggcatccgcatctttaatctcttggcccactggattaagggcggcgtattttttactctgggcgttgtctctttagcaagatactgcggtttcgcagctaagtacggctgggcatggaacaacatcagcttcacctctcaactcacacaaacgcgttcctccaatcttcttttccggtttgctcctgcggggactttcaccatggaattcgttgaatccttcctcattttcttttacgggtccaccaacatcttcttggagcacctggcaggaaacggcggcgcatggactgccaaggatttacagcatgtgtcgatcgcgtttatgttcataggaaccggattgtgtgggctactcacggagtacaagctcaaccattggcgattcgagcatgcccgcaaacggccacagaccgatgtagttgctgccacaccggggtactctccaaacccgttccccgctttcaccatattttggactgggattctgatgtcccagcacgcacagtcctcgcaattttctactaccattcacacgcaatggggatacttgttgtcctatgggtccttcttccgtctgctaacatttttgattctgtttttggtgcccaacaccaacagtgccgcatccaagcctttcacggagttgatcacctcgttctgtctcctctgtggtggtctggtatttatggagtccacggatcagtccattgaagccatggaatatagggggtttacccccatgttcactttcaacctcagtgttggattcgtttctttgttgatggcttgggaaatgattttatttatttggaaagactggctcatcaaaaccaggaaaaccagtctttaa

SEQ ID NO: 4303 - DNA, 1899 bp, Saccharomyces cerevisiae
atgaattcacaaaaggcgagtaaaatgactggctcactaaaaaagaatgatctttatatttttgatttgtctgagcaacttctgaattcattgaaattgatgagctttgactccacactgcgagaagttgaagtagagaagacatctgataatgatagaaacaaggagtctggagatctccaaatagcaagaaagaaggtcacatcaaatgttatgcgttgtagtgtttgtcaaatgagctttgattccagaaatgaacaaaaggcccactaccagactgattatcatttgatgaatgttaagcgtaaccttagggggctggatatcctatccgttgaggaattcgatgcgctgatttctaaggagcatggtatcaagtctgaagacgaaaattctggcggcgagcaaacttcaagcgatcacgaagaaagtgaggaagccagcgatcgggacccggacctacaaactaataattatatggaaactataatcgaaaatgatttgcagaaattagggttccaaaaagacgagtcggatgctattagccatattaatacccaatcgccctacatttatttcaaatcgaagtatcttcaaaagaatgaggtcttggcgatttataagtctctatttaataaaaggagtctttccaaccccaatgaagctttgactttttggaattcgcaagagaacccaatggccatttcagctctgtttatggtgggaggtggacattttgcgggagcaattgtttctcatcaaagactcaatgtcaaggggaacgcgcacaagaaggacgaaaccttaattgagcaagcggtcaatttcttagagcacaagacgtttcacaggtatactaccagaaggaagcaaggtggttctcagtcagcaatggacaatgcaaagggaaaagctaactctgccggttcagcacttcgtaggtacaatgaaagcgctttaaaaacagatatacagggtgtgttgaaggactgggaaccttatctgtcaaagtgtgataatatttttattcgagctcgcaatgtcagtgataaaaaaatttttactgataataccgttctgaacaagggtgatgaaaggataaagagcttcccttttaccacgaacaggcccactgtattagaattgaagaaggcatggtgcgaactttcctacctgaaaatattacctaagcctgaaccattggcagtgaaagaaacagtacaaaagttagaagtgtcgaacaaaaaggacgaatttaaagaaaaacaagaaccgttactggaagaaatccaaacagaagaaataatttctctgctgaagaaaggaagggcaccgttattgatatccttcttaaaaaagaataagcttgatggaaactttcggttaaagcctgagagtaaatattccttaacccctaccatgttacattatgcatcgcagcaagggatgaaacagatggcactgattttgctctcaaatattaaatgcgatccaacgatcaagaacagactaggaaggactgcgtgggatttgaatagaaacgacgacgtgagacacgcgtttcaaattgcaagatacaatcttggagagtctttcactaattgggacgaaactcatatcggtcagccattgagcagagaacaagttgatgaaatcaatgaaaagaaaaaagcaatagagaatgaaaaggcagaaaaactgattaaattggaattagaagccgccaaggaaaaacaaagatttgctaaagatgcagagaggggtccaggcaaaaagttaaccaatattccttcaattcagcaacaaaatttgaattctttgaccgatgaacagagacgcagattgatgagagaacaaagggctagagccgcagaagaaaggatgaaaaagaaatactga

SEQ ID NO: 4304 - DNA, 1899 bp, Saccharomyces cerevisiae
atggaactcaacgacccttcaattatatcaagcagccagttttcaggtgaattgtctgacagcgatactgcagccgctactcacaaatcgcaacaagccatctcaaatttattccaaaaattagccaaaaagggcagagaagagaagccaatcggtagcgtagaatcttcaactgatagctctaacatttctgttgctacgagcggtaacaataaagaaagcaataaaaaaaaaaataagaaaacggccatgctaaatttcagcagtttgacggaccctataacgaactacaaaccaatggatctgcaatacaagacatatgcatactccatgaatgaactttatcatttgaaaccatctttggcaagtgcttcgtacgaagaagacccacttatttcggaacttgtgaggagtttacccaaaagaaagttttggcgattgcgcatgggacctccagatcaaaagcatgctaataaccatcattttaatgggaacaatggtggaggcagttggaaggctggttacaagaatgggaaaaacgatgagagaagaatgagtagaaccaaaaacatgcagggaggcaaacgaagatctcaacaagatgatgaagaaaaaaagattgaccaagaaatgctggagatggacaagaatcttcaattaggaggtgacgtcggccattcaattgcagattttgaagattggaaggcaaagatgaaagaattagaattgaaaaaactttcaaaatctaaaggaatcagtaactctaccgcaattgctcccagggaaagcgcctctcatgaaacacccaccgatttaagaccggtcattccaaggggccctagttcaataacagattttttgaatttaaagaggcaagataagaaggaagaatcttcacaacaaacacctggtattcctgttggacagccaagcctatccaaaaccagtatagaacaagttaacgaattagaaactaattcagatttgggtaaaagttcatcatctcggttttcatcatttttcaataaatctgccacttcgttgccttcattagataataataatcaagtgccatcgtcaaacgtgtctgtagtaaacaacgatggcaacagtacacctcatcaaagtggttcaagactgatgtcgtttttcaaagaatctagatcgagcactccaaatgcagaatcgcagttgttatcagcctcagacaaagataatggaaagatgcagactcttccgcaattccagcagcaaccgcaacaaatgcaaccaatggcatttacccagcatcctcctaataacaacgcatttttcaatgggctattgaataaaggtaaaagtgaaactagtactcctcctcctccacccccaggactaattgctcatcagggtccacaatttcctgtgatgggtgtaccaccaaattttccacaacgcatgatgccaccgccaccaggtctcgttcaattccagaaagattctaaagatgtaaataagaaggaagacaggcaattaaggcaaaataaaaatccaaacggaacaagaaatagcaagggaaaacaagaggaaacagcaacgccagatctgcctcaacagcaatacatgccaccacccccacctccagggttttttccaatgcatcctaactttcctaacggcccaatgccaccattaccacaggggttcccaatcccaccaaatggtatgttaccggtaacaggacaacagccacagccaccttatccaaatatgatgctacaaggaaatttcccccctaatttccagcaaggttttggtagtaactcccctatgccaattccatctattattaatgccaatggcaaaaatgttacaaaccagttaccaccaggattaaactctaaaaagaatataaaatga

SEQ ID NO: 4305 - DNA, 1899 bp, Saccharomyces cerevisiae
atggaactctcatcaaacttaaaagacctatatattgaatggttacaagaattagttgacggattaacccctaaacaagaacaactcaaaatagcctatgaaaaagcaaaaaggaatttacaaaatgctgaaggttcattttattatcctacagatctaaagaaagttaagggaattggcaatacaataataaagagattagatacgaaattacggaactattgcaaaattcaccacatatctcccgttgaggctccttccttaactcagacaagtagcaccagaccaccaaagaggactactacagctttgcgtagcatagtaaactcatgcgaaaatgataagaatgaagctcccgaagagaagggaactaaaaagagaaaaactaggaagtatatacccaaaaaaagatctggaggctacgctatccttctttccttactcgagcttaatgccattcctcgaggcgttagtaaagagcaaatcatcgaggttgcaggaaaatacagtgaccattgtatgactccaaatttctccacaaaagaattctacggtgcttggtcgtctattgctgcacttaaaaaacattcgttggttcttgaggaaggtagaccaaaacggtattcgctaacagaggaaggtgtagaactaacaaagagcttaaagacggcagacggaatctcttttccaaaagaaaatgaagaacctaacgagtattccgtaaccaggaatgaaagtagtgaattcacagcaaatctgactgacctccgtggtgaatatggtaaggaagaagagccctgcgatataaataacacttcattcatgctggatataacttttcaagatttgagcacgccgcaaaggctgcagaacaatgtatttaaaaatgatagactgaatagccaaactaatatatcttctcataaattggaagaggtctctgatgatcaaacagtacctgattccgcattaaaggctaaaagcacaataaagaggagaaggtacaacggagtaagttacgaattgtggtgtagtggtgatttcgaagttttcccaattattgatcacagagaaataaagtcacaatctgatcgtgagtttttttcaagggcatttgaaagaaaaggtatgaagtcagagataaggcaactcgctttgggtgatattatatgggttgccaagaataaaaataccgggttgcagtgtgtgctcaacaccatagttgaaagaaaaaggctagacgatttagctttaagtataagggataacaggtttatggagcaaaaaaataggttagagaaatctggctgtgaacacaaatactatctcattgaggagactatgagtggcaacattggaaatatgaatgaggccctaaagaccgcgctttgggtcattttagtgtattacaaattctccatgataagaacttgcaattcggatgaaactgtggaaaagatacatgcgttgcatactgtaatttctcatcactattctcaaaaagatctcatagttatatttccaagtgaccttaaaagcaaggacgattataaaaaggtgcttctacagtttcgtcgagaattcgaacgaaaaggcggtattgaatgctgtcataatcttgaatgctttcaagaactaatgggaaaaggcgatctaaagacggttggtgagctaactatacatgttttaatgcttgttaaaggtatatctttagaaaaagcagtagccatccaagaaatatttcctaccctgaataaaatactaatggcatataaaacgtgctcctcggaagaagaggctaaattgttgatgtttaatgtactgggagatgcacctggtgcgaagaaaattactaaatctctttcagaaaagatatatgatgcttttggtaaactttag

SEQ ID NO: 4306 - DNA, 1899 bp, Saccharomyces cerevisiae
atggtgatagattccaaacaggatctacctcaatataccaaagattcaggttcagaatcggactcagactcaagtaataatttcattgtggaatctccgtcaattccatcttcaaaaagtgcaaccgtagttctcaatagtgaagagtatgaggacgacgaaggtgatgacttgaacgggctggatgctgaattgatcgataatataacgtatgaaggagatgaagatgaaactatgtttgtggggttgaaagaaaaacagaagttacatttatctggtgttttccggctgcaagtggtgaaaggaggtattgtctacaacaatgtacactataacgcttcgagagaaattttaaccttctggcacccgttatcacagtccatacctactatagatttttcgcactttgcaggctggcaagacactttttttatgccgagaaacaacaggtttaaaattagagatgaagaattcaaatcatttccatgtgttcttcgcgtttttaattctaatcatacgggcttgttagaagcaggtcatttatatcgggatgttaattatctatggaaacctaaagaaccttactttccattaaacgagagaacaacgtatcatttattacatgagtcagaccgaattcaatctttatccgtgccgggatattggtcaactccgttagagaagttatatttgagtcacaagaacgctgcgtatgatacaagaatcatggtgattggtggtaaaaactctgggaagtctacattcttgaggcttttattggaaaaatttacgcaagatatacgagattctactacgagccaggaagaattggtatacctggatttagatcctggtcaacctgaatactcactacctgattcaatatccctgaataagattctttccagccctatttctctcggacaacatctctgccaaggttcaaatttccaaactttgttacagttctacgctggctcctcttccccgcaggacgagcccacatcatacctgaactgcgctgataaacttatagaccatttggaagagcaagccttcttcggaacgtcattgcttaatctacctgggtggataaaaggattcgggatgcagattttaaatcatataataaggaaatataagcccactcacttattgtttttggaaacagctaattcgaaaagacacctggatgaactaacaattccacagagtttttccacatcactacgagatgcatatgcacctgaagttgttcgcgttccagcccatagtctgaaccacaccttatcttctaggttccatgcatcacaactgagaacattcaaaatactggcactgtttcataaaataactcaatttgattatgattttgcgcctcttttaaaatctgcacctttgcaaatttcatatggcaaaggtaaaagcggtattaaaggcattcaatttcctatggaattccaggatctgaatcctcaagatatcaagtccgcattggaaggtactgtcattgggatatatacatattctggagaagactcactagaggtgaaatccttgaatacctttcccatcctacaatcgtgtacttcttcttctaaaaatttcataactctggggctgatacactctattgacacctcccagcaaataatgaacatttacgtgccaccttgccatacccagattttagataaacaacctgaggatgctcaatggataatagtaagaaataagacggaaactcctttttgtgactttcttccatccccccgcacaattacatgggatgataatatacaaataccgttcgcaacttttgaaagaaggaaaaaattggaacatgtgtggaaagttcgtaagaacgtcatgagacgtggccaattcatgaaaagatag

SEQ ID NO: 4307 - DNA, 1899 bp, Saccharomyces cerevisiae
atgtcaaaatttacttggaaggagttgattcagcttggttcccccagtaaagcatacgagtcctccttagcatgtatcgcccacatagatatgaatgccttttttgcacaggttgagcagatgcgatgtggcttaagcaaagaagatccggtagtctgcgttcagtggaattccattattgcagtctcttatgcagcaagaaagtatggtatatcaaggatggatacgattcaggaagcactaaaaaaatgtagtaacctcataccgatccatacagccgtttttaaaaagggagaagatttttggcaatatcatgatggatgtggatcttgggtgcaggatcctgcaaagcagataagtgtggaagatcataaagtatcactggaaccatataggagggaaagtcgcaaggcgctgaagattttcaaaagcgcatgtgatctagtcgaaagggcgagtattgatgaagtatttcttgatttgggccggatttgtttcaatatgctaatgtttgataatgagtacgagcttacaggcgacttgaaactgaaagatgcattaagcaatattcgtgaggcttttatagggggcaactatgatataaattcccatctacctcttatacccgaaaagataaagtctctgaagtttgaaggcgatgttttcaatccagagggcagagatctgatcacagattgggacgatgtaatacttgcactaggatctcaggtatgcaagggtatcagagatagcataaaagatattctcggttatactacttcgtgtggtttgtctagcaccaaaaatgtttgcaagttggcttctaattacaaaaaacctgatgcccaaacaattgtgaaaaatgattgtttattagattttttagattgcggaaagtttgaaattacatcattctggaccttaggcggcgttcttggcaaagaactaattgacgtattggatcttccccacgaaaacagtattaaacacatcagagagacgtggcctgataatgctggccagcttaaggaatttttagatgctaaagttaagcaatctgattatgatcgctcaaccagcaatatcgaccctttgaaaacagcagatttagcagaaaagttgtttaaattaagtagaggccggtacggtctgcccttaagttctcgccctgttgtaaaaagtatgatgtcaaacaaaaatcttagaggaaaatcgtgcaattccatcgtggactgtatttcttggcttgaggtcttctgcgctgagcttacgtccaggattcaggatctggaacaggagtataacaagatcgtaataccaagaacagtatctatatctttaaaaacaaaatcctacgaagtatatcgaaaatcaggtccagttgcgtacaagggcatcaatttccagagtcacgaactcctaaaagtaggcataaaatttgtcacggaccttgatattaaaggaaagaacaaaagttattaccctttaacaaaactaagtatgacaattactaatttcgatattatagatttacaaaaaactgttgtagatatgtttggcaatcaggtccatactttcaaaagctcagcaggcaaggaagatgaggaaaaaactaccagctcgaaagctgacgagaaaactccgaagttggaatgttgtaaataccaggtgacttttacagaccagaaggctcttcaagagcacgcagactatcatttagcattgaaactgtcggaaggcttaaatggtgctgaagaatcatccaaaaacctttctttcggggaaaaaagattgttgttttcacggaaaagaccaaactcacaacatactgccacacctcagaagaaacaagttacatcttccaaaaacatcttatcattttttacaagaaaaaaatga

SEQ ID NO: 4308 - DNA, 1902 bp, Saccharomyces cerevisiae
atgagcagtaacaacaacacaaacacagcacctgccaatgcaaattctagccaccaccaccaccatcaccaccatcaccaccaccatcacggtcatggcggaagcaactcgacgctaaacaatcccaagtcgtccttagcggatggtgcacatatcgggaactaccaaatcgtcaaaacgctgggagaggggtcctttggtaaagttaaattggcatatcataccactacgggccaaaaagttgctctaaaaatcattaataagaaggttttggcaaagagtgatatgcagggcagaattgaaagagaaatatcttatctgagactcttaagacacccccacatcatcaaactgtatgatgttatcaaatccaaagatgaaatcattatggttatagagtacgccgggaacgaattgtttgactatattgttcagagagacaaaatgagcgagcaagaggcaagaagatttttccagcagatcatcagtgccgtcgagtactgccataggcacaaaattgtccatagagatctgaagcctgaaaacttactactagatgagcatctgaatgtaaagattgccgattttggtttgtcaaacatcatgactgatggtaatttcttaaagacttcttgtggttctcccaattatgcggctcctgaagttatcagcggtaagctgtacgcaggcccagaagtggacgtgtggtcatgtggggttatcctttatgttatgctttgtcgtcgtctaccgtttgacgatgaaagcatcccagtgcttttcaagaatatcagcaacggtgtttacaccttgcctaaatttttatctcctggagctgctgggctaatcaaaagaatgttaatcgttaatccattgaacagaataagcattcatgaaattatgcaagacgattggttcaaagttgacctgccagaatatctacttccaccagatttgaaaccacacccagaagaagagaatgaaaataatgactcaaaaaaggatggcagcagcccagataacgatgaaattgatgacaaccttgtcaatattttatcatcgaccatgggttacgaaaaagacgagatttatgagtccttagaatcatcagaagacactcctgcattcaacgaaattagggacgcgtacatgttgattaaggagaataaatctttgatcaaggatatgaaggcaaacaaaagcgtcagtgatgaactggatacctttctgtcccagtcacctccaacttttcaacaacaaagcaaatcccatcaaaagagtcaagtagatcatgaaactgccaagcaacacgcaagaaggatggcaagtgctatcactcaacaaaggacatatcaccaatcacccttcatggatcagtataaagaagaagactctacagtttccattttgcctacatctttacctcagatccacagagctaatatgttagcacaaggttcgccagctgcctctaaaatatctcctcttgtaacgaaaaaatctaaaacgagatggcattttggtatacgatctcgctcatatccattagacgttatgggtgaaatttatattgccttgaagaatttgggtgccgaatgggccaagccatctgaagaggatttatggactatcaaattaaggtggaaatatgatattggaaacaagacaaacactaatgaaaaaatacctgatttaatgaaaatggtaattcaattatttcaaattgaaaccaataattatttggtggatttcaaatttgacggctgggaaagtagttatggagatgatactactgtttctaatatttctgaagatgaaatgagtactttttcagcctacccatttttacatttaacaacaaaactaattatggaattagccgttaacagtcaaagcaattga

SEQ ID NO: 4309 - DNA, 1902 bp, Saccharomyces cerevisiae
atgagtgcagatttatcgattggtaatgaaattaaagattcatttaaggaaacccataaatgggtccaaaataacttaaaatggttgaaggacattgagcaattttatcgggaaagggctaagttagaaaaagactacagcgagagattatctcgcttatcagcagagtactttaataagaagtcttcgacctcagttcctatctcggtaggtgacacacctactaccacgccagggtccattgaagctgcaggtgtggttgcatggaatgaaattctatctcagactgatatgatttccaaggatcatgatcagttatcaaccgactttgaaaatcatgtagcaaatcaattgagtggattattcactaaacttgatatgactttgagcaagataaatggatttaacaatgacatggttaataaaaaggataacatttaccacgaactggaaaaagcgaagaaggactatgatgaagcctgttccactatggaaatggcaagaaataggtataccaaggcatctaatgatagaaataaaaagaagttggatgaaaaagaaatggagatgaacaagtgtaaaaatgaatatttaatcaagatcaaccaggcaaatagaactaaggataaatactattttcaagatgttcctgaagtgctagatcttctacaagacgtaaatgaggcaaagacccttttcttaaatgatctgtggttgaaggcggcttctgtcgagaacgatctgggtgcaaatgtcagcaaaagactccaggcggcaaattctgttgtcaagcagaataaaccctctttaaacacggccatctttatcaagcacaatctaaagaattggaaagaaccacaagactttgtctataagccatctccagtatggcatgatgatgaaaaatttgctgttccctcgtcgttggaagttgaagacttgagaataaaactggcaaaagcagaaaatgattacaattcattgcaagataaaactcaaaatgagttatccaaactgtctactttgaacaagataaagcacgaaatgaaaactaatgaagataatatcaatgccactaagttttatgatacactaaaggaatacttaaatgtcgtttcaccctttacctcacacgaaacattaaaattgcaagccgaagttcaaatcgaaagtattcagaataatgttcctgaagaatacgatttatccacagacaatattgatctttccaaaacaaagaagaaatccgggatattcagtaagttcaaacacaacatcctgaacgtcgactcgaagccttcgagtggagggagcactggtaatggcaacggaggacccttgcatataacaagtctcttcaacacatcaagaagaactaggctaggctctgcccctaacaacgctggtgaagattcagataataattctatacgcaccactagtaccaacaatacaaaaaagaccacacaaaattccagtgatgacggcaagaataaagtgttgtatgcatacgtacaaaaggatgatgacgaaatcaccattacgccaggagacaaaatctctttggttgcacgcgatacgggttctggatggactaagataaataacgacaccactggggaaaccggccttgtacccaccacatatattcgcatatctagcgcggctacagttaaagcaaatgatagaggccctgcaccagaagtaccaccaccaagaaggagtacactacctgttaggacgatggaggccatatatgcctacgaagcacagggagatgatgagatttcaattgatccgggggacataattactgttatcagaggcgatgacggtagcgggtggacatatggtgaatgtgacggattgaaaggtctatttcctacaagttactgtaaatga

SEQ ID NO: 4310 - DNA, 1902 bp, Saccharomyces cerevisiae
atgcagaacgatcaacagaggttctccctgcaaaataggacggtactggcgcatccatacaaaaggctaggaggggcatttacggtgaaatcaccgtctgttcctaactttcatgataaaatgcattcagatcatagttctagcgactcagctctggtgaacggaagctttagagcgaatgatcatcgctctgtggaaccaagttgtttgggccaagcatccccctctgaacatgatgggaatttaagcgttattgacctgtatggagacgaagtggaatcccaacgtgccgaaggagaggatgatgatgataataatggcgataatggtaacgaagatctggaggaagtgcacagtgatgacctcgatttggttcctgatgatgacaaccgtcagcgtgtagaattggagggtgccgctagtgccacaagtgcgaattccaatggaatcaacaatacccattttgatcgatacggtttcaaaaaacagaataattacatatctgaagcagaatacgataagtggtgggtagaatattcgcagtactgcgttcgccgtaagcacaaatggcaattgctgttggagaaaagtgggttgccagtgaccgatgattctccttcacgatttccatcaaagagtgaacggttaaaaaggtatgtcagaaagggcattccagcggaatggagaggaaatgcatggtggcatttcgctagagggcaagagaagttaaacaagaataaaggcgtctattcacaacttttacgaaagatgaagcagatcaagaaacaaaaccctaatgaaaaacaagttcaagacttggatattattgaacgtgacttgaatagaacatttccggacaatatacatttccaaagtagcttgcataacaaagagggacctccgattataaaatctttacgccgggtgcttgttgcgttctctctctacaatccgaagattggctattgtcaatctatgaactttcttgcaggcttgctattgttatttttagacgaggaaagggccttttggatgctagtgattattacttcaagatacctaccgggggtgcataatatcaatctagaaggtgttaacatcgaccaaggggtactgatgctatgtgtcaaagaatatattccagaagtttggtcgtacattaagccttccattgaccaccaccaaaaaaataacaaaactttttctccgtcaaataaaaaagttttattcaatatgcaaaagaatgagttcttgtacagacttccgcccattactttgtgcacggcgagctggttcatgagttgctttgtcggtgtagtgccgatagagaccacgcttagaatatgggattgtctgttttacgaggaatcacattttctattcaaagtttcgttggctgtcttaaaattgagcgagcatgacctttcgaaaataaaacctcgtaacaattcgttgaattattcttggggctctaacttaaaccagagaggcggatcaatgggccaagaagatagcgatatggaaatttttcaggtcatacagacattccctaagacattattgaacccaaatgagatctttgagaaaatcattttcaaaaggagatttaatttaaataggttagatcaggatgaaatagacaggtgtcgaaaatttgttgccgctcagcgtctcaaatttaagacatatggtgaacttcttggaaattcaacatcagaggcagatttgccaattaatgataatacagataataaaggtatccacataacaagtgatgcagtcaatgaagcattatcttcagaggtatatgggtttaaaaagagcctagctggagttcattggaataatagcatcaaggagaaagtgaagcagatgaggaagaaaaaagacaagggtgactaa

SEQ ID NO: 4311 - DNA, 1902 bp, Saccharomyces cerevisiae
atgccagacaatctatcattacatttaagcggctcttcaaaaagattgaactctcgccaacttatggaatcttccaatgagacctttgcgccaaataatgtggatttggaaaaagagtataagtcatctcagagtaatataactaccgaagtttatgaggcatcgagctttgaagaaaaagtaagctcagaaaaacctcaatacagctcattctggaagaaaatctattatgaatatgtggtcgttgacaaatcaatcttgggtgtttctattctggattcatttatgtacaaccaggacttgaagcccgtcgaaaaagaaaggcgggtttggtcctggtacaattattgttacttctggcttgctgaatgtttcaatatcaacacttggcaaattgcagctacaggtctacaactgggtctaaattggtggcagtgttggataacaatttggattgggtacggtttcgttggtgcttttgttgttttggcctctagagttggatctgcttatcatttgtcattccctatatcatctagagcatcattcggtattttcttctctttatggcccgttattaacagagtcgtcatggccatcgtttggtatagtgtccaagcttatattgcggcaactcccgtatcattaatgctgaaatctatctttggaaaagatttacaagacaaaatcccagatcactttggatcaccgaatgctactacttacgagttcatgtgtttttttatcttttgggctgccagtcttccatttttactggttccacctcacaaaattagacacctgtttactgttaaagccgtcttggttccgtttgcttcttttggtttcttaatttgggctatcagaagagctcacgggcgtattgccttaggatctttaaccgatgtacaacctcatggctctgccttttcgtgggcttttctaagatcactaatgggttgtatggctaatttctccacaatggtaatcaacgctccagatttctctagattttcaaaaaaccctaactccgctttatggtcccaattagtgtgcattccatttttgttttccatcacttgtttaattggaattctagtcaccgcagctggttatgaaatatacggtattaattactggtcgccactcgatgtgctagaaaaatttttacagactacttataataagggcacaagagctggtgttttcttaatctcttttgttttcgccgtagctcagttaggtactaatatttctgcaaactcattatcgtgtggaactgatatgtccgctattttccccaagtttatcaatatcaagcgtggttcattattttgtgcagccatggcgctgtgtatttgtccatggaatttaatggcaacatcaagtaaatttacaatggctttgtccgcatatgctatctttttgtccagtattgccggtgttgtctgctcagattactttgttgttagaagaggatatatcaagctaacacacatatattcccatcaaaagggctctttttatatgtacggaaacaggtttggtatcaattggagagctttggctgcatatctatgtggggtggctccttgcttgcccggtttcatcgcggaggtgggcgctcccgctataaaggtttctgatggagctatgaaactatattacctaagttactgggtaggatatggcttgagtttttcttcttatactgctctgtgttacttcttccctgtacctgggtgccctgttaacaacattataaaggacaagggctggttccaaagatgggccaatgtcgatgattttgaagaagagtggaaagacacaattgagagggatgacctggtagatgacaatattagtgtctacgaacacgaacacgaaaagactttcatttaa

SEQ ID NO: 4312 - DNA, 1902 bp, Saccharomyces cerevisiae
atgctatccaaggtattgctgaatatagctttcaaggtgctgttaaccaccgccaagagagcagttgatcctgacgatgatgatgaacttctaccttccccggatctcccgggtagcgatgaccctattgcaggtgatcctgatgtagacttaaaccctgttacagaagaaatgttctcttcatgggcattgttcattatgttgctcctattgatctctgcattgtggtctagttactatttaactcagaaacgaattagggcagtgcatgaaactgtgctttctattttttatggtatggttattggcttgataataaggatgtcccccgggcattatattcaagatacggttacttttaattcatcctacttttttaatgttctattgccgccaattattttaaatagtgggtacgagttgaatcaagtgaactttttcaataatatgttatctatcttaattttcgccataccgggcaccttcatatctgctgtggttattggaatcatattgtatatctggacctttttaggactagagagtattgacatttcattcgcagatgcaatgtctgttggtgctacattatctgctaccgaccctgttacaattctttcaattttcaatgcgtataaagtggatcctaagctatataccatcatttttggagaatcactgttaaatgatgccatctctattgttatgtttgaaacctgtcaaaaatttcatggtcaacctgcaacattttcgtcggtttttgaaggggcaggcctctttttgatgactttctccgtttcgttgttgataggcgttcttataggaattcttgttgctcttctgttgaaacacactcacataaggcgctatcctcaaattgagagttgtttgatcttgttgattgcttatgaatcctattttttctccaacggttgccatatgtccggtatcgtctccttgttattttgcggaattactttaaaacattacgcctattataacatgtcaagaagatcacagatcaccattaagtatattttccaactattggcaagattatcagagaatttcatctttatctatctaggtttagaactttttactgaagtagaactagtctataagccactgctaattattgtggcagctatttctatatgtgttgctcgttggtgtgctgtgttcccattgtcgcaatttgttaactggatatatagagtaaagacaatcagatctatgagcggcataaccggagaaaatatttctgttcccgatgaaataccctacaattaccaaatgatgacattttgggcaggtttacgtggtgctgttggtgtcgccttggcgttgggaattcaaggtgagtataagttcactttattggcaacggtccttgttgttgttgttttaacagttatcatttttgggggcactactgcaggaatgttagaagttttaaatattaagactggttgcataagtgaagaagatacatctgatgacgagtttgatatagaggctccaagggcgataaatttattgaacggtagttctattcagacagatttgggcccatattctgacaacaattctccagatatttcaattgaccaattcgcggtcagcagtaacaagaatctccccaataacatatccacaactggtggtaatacttttggaggccttaatgaaactgagaatactagccctaacccggcaaggtcttctatggataagcgtaatttgagagataaactgggaacaatctttaattccgactcacaatggtttcaaaattttgatgaacaggtattgaagccagtattcttggacaacgtttctccatccttacaagattcggctacgcaatcacctgcagatttctcttcccaaaaccactag

SEQ ID NO: 4313 - DNA, 1902 bp, Saccharomyces cerevisiae
atggattacgaagaaattttatttggtctgcaaccgatcctcaatgcgtcttcaataaaggatgttccgatgaacgatgtctacttaggaagctacctagcggtaatggaccaattggctgtttcgttgagagaaccaagtaatagagatattgttggtaaaactgggctgctactgaacctagtaagagtattagaacaagcgcttgatatctgctttcatgatacgagcatttcaattaatgataaaatagcgttttatgagatcagttctgaagtgattagatgtatcgctaacgcaataattgataatgatgataatcgggaaattctcttggattctggaggtaaaaagcttcttaattattatataggcggggttcttcagctggacgaaatttcttctgacaagagtgaggatagcttagtggataaattacagatgcggtcagttgtgctactaaggaatttttgcattggaaatctcaagtatacagaaaatttggctcccttcattagaggtccattatttgttttgttgaaaaccacacaatatagctatttgtcatctcccgaaaaagttgttttaggttcagatttattgaacgatattttaaaagtcaattactcaaatgttcaaataagcgatctctttttcttaagccagtacatcaaaaaaatctcttcaaatgtgcaaaataaagaattgcaggcaatggaagatggagcagtcgaagcatattcaaatactgaaactcagaagttcgctggccaaggaaatcaagagtacatcgaaaaagaggaagaagatgatgaggaggacgttaattgtgaattgctattaaatctgtcaacatgtcttgaaactattgtagccaaggatgaaactataaactttaccaatgaggagcagcttgtgctaagcatgcaaaaaaatttaatattgtccttagtttgcttagaatcaaaaaccttcaataataagctaattgtaatgagaagactcatatcgtgcgcaggcaacatctccgccaacctaacaaactctaacaaacgagagcaatcattatgtatcgaaactattaagagttccgcaagtagttatgccctagccgcagctttgatgatattatgtaactcagttgcatccaaaagtgacgctgtcgcgctactgaagctcatatctcttagtgaattgattcaagttggtagcttgctacaagacccactacaatatcaaggattcctagatttactgaggaagctgttaaatctggaaaataccatgtggctagatatcaaggacctcttcaccctatttcagattatgagaagatgtcacgagcaaactaaatattataacaacctgagatcgttattaacaaatttattaaacaaaactttaacggtgcttccaagttcaaaaatacacaattcaataagcagtgatccaacaattatctcttttatagcagagcatggaacgttaacgtcctgtattgcgatggataagctgcttgtgtccaagaaagcccttcctaaagaagctattacatccctatgggattcgatcttcaaattccaaaatttaggtcaagcagaacaactaagcatctcagatttatttcatatcacaaaaacggttggaatttatttaaaagattcaagtgtaacagctgacgtgaatccgattgaaaatatactattcaaggattacattcaaaagttaaccctgatattagagaccatactttcatttaaagaaaataaagataagggtagcgagagttgtttcaacaatgggaaatttatagcgggcataatactaaacattgtgaaaaatacgaaatgcttaacgccagaggaacaaaatttagaagcgcttgcaaaatcgttcttttag

SEQ ID NO: 4314 - DNA, 1902 bp, Saccharomyces cerevisiae
atgggactcctaaactcttcagataaggaaattatcaaaagggctctaccaaaagcgtcgaataagattattgatgttacggtggctcgactatacattgcataccctgataaaaatgaatggcagtacactggactttcaggagctcttgctctagtagacgatcttgtggggaatactttttttttgaaattagttgacatcaatggccatagaggagttatctgggaccaagaattgtatgtgaattttgaatactatcaagaccgtactttttttcatacatttgagatggaagaatgctttgcaggtttattgtttgtagatattaatgaagcatcgcactttttaaagagagttcaaaagcgtgaaagatatgctaacaggaaaactttgttgaacaaaaatgctgtagcattaaccaagaaagtaagagaagaacaaaaatctcaagtggtgcacggcccaagaggggagtcattgattgacaatcaaaggaaaagatataattatgaagatgtggacacaattccaactacaaagcataaggctcctccccctcctccgccaacggccgaaacatttgattcagaccaaacaagttcattttccgatatcaattcgacaacagcatccgcaccgactaccccagcccctgctcttcctcctgcatctcctgaagtaagaaaagaagaaacgcatccaaagcatagtttaccgcctttaccaaatcagtttgcgccattaccagaccctccacaacataactctccacctcaaaataacgcgccttcgcaaccccaaagcaatccatttccattcccaattcctgaaattccctcgacacagtctgcaacaaacccatttccatttccggtacctcagcagcagtttaatcaagctccttcaatgggcataccacagcagaataggccccttccacagttgcctaacagaaataatcggcctgtgccacctcctccgccaatgcgtaccactactgaaggttcaggtgttcgcctacctgctcctccacctccgccaaggcgtgggccagcaccaccgcctccaccacataggcacgtaaccagtaataccctgaattctgccggtggaaatagcctccttccacaggccactggaagaagagggccagcaccaccacctcctccaagagcatctcgccccacaccaaacgttacgatgcaacaaaatccacaacagtacaataattctaaccgcccctttggatatcagacaaatagcaacatgtcatctccaccccctcctccagtgacaactttcaataccctgacaccacaaatgactgcagcaactggacaacctgcagttccccttcctcagaatactcaagcaccttcgcaagccacaaatgtgccagtggcaccaccacctcctccggcatctttaggccagtcgcagatacctcagtcagcaccctcagcacctattccgccaacgttaccatcgacgacgagtgctgcaccacctccgccaccagcattcctaactcaacaacctcaatctggaggagctccagctccacccccacctcctcaaatgccagctacatcaacatccggaggcggttcattcgctgaaactactggagatgcaggtcgtgatgcacttttagcttcaattagaggggcaggtggcataggcgctttgagaaaagttgacaaatcgcagctagataagccctcagttttactgcaggaagcacgtggagaatctgcttcaccaccagcagcggctggaaatggaggcacacctggtggacctccggcttctttagcagatgcgttggcagcagctttaaacaaaagaaaaactaaagtgggagctcatgacgatatggacaatggtgatgattggtaa

SEQ ID NO: 4315 - DNA, 1902 bp, Saccharomyces cerevisiae
atggtgcaaatgagatccaaaaacatggcatacgagtcgggaactaataactatagtgatacaatagctaatggaaataccctgccgccgcgaagcaagaagggacacagtggacgtagaaagaggagcgaaactttgcccatagcgtgtaataatttttgtgttacaagacagattgatgacgatgaacaagcgttcaaaatgctagataaagtgagtcatctgaaaaaattcagtgctgaagacggtgatgataacaatatattcgtccaatgggccgatgatattacagatatcttatttggactatgctgtacaggaacgtttttgaaacttcttataagctctgcattatccggccgggctaagacatggtttgattctacaacggagggaatcgatgaccatgtgataaaggcttacagttttgaaaaatttcttgctctactatcagaagaatttgatggagcaagatctttaagaagggaaatttttacggaactattgacgttgtccattgattctgagaagtcattagaagcatttgcccataaatcgggacgtctaactccatattatctgtcttctggtgctgcgttggatctattcctcacaaaattggagccacagttgcaaaagcaactggaaaattgtgcattcccaatgactttgaatttagcactattgataactgcctgtgaatttgcgaagagagcatctaatcataaaaaataccggtataaaaatacgagggattccgacatttgtactccaaagagtaagaatactgctatcgttagcaaattatcgaatactaaaactataagtaagaataaggttattgaaaagagtgataagaaaaattactttgataagaacagtcaacacatacccgatcctaaacgtcggaaacaaaatgaacctggaatgcggctctttcttgtcatggatgaggaaaagaatattcttacatctaggaatgtttctgccaatgcatacacatcaaaaaatggacacaccaatttaagcgatctccatacgaatcttaaaaacagtaaatctcaacaatgtgcagtggagccaatatcgattttgaatagcggcagtttggttacaggcacaattaatattgacctaattaatgatgaagttttaggcacgaaggaggaaactacaacttatgatgaacgtatggatggaaactcacgttctttgaatgagaggtgctgcgccgtcaagaaaaactcactacaacctataacatcaaatatatttcaaaaaaacgctgaaattcagggcacaaagatcgggagcgttctagatagtggtatatcgaatagcttctcctcaacagagtatatgtttccgcccacaagctctgcgacagttagtaatccagtaaaaaaaaatgaaatcagcaagagtagccaggttaaagatattgcccagtttaatccgttcatgacaaacgaaaaggagaaaaagttaaatccatcagaaagcttcaaaagccctggagtgtctatggaaataaataggctaagccgtatcgcgggcctcagaaatattccaggaaacatttacgaagacagcaaaatgcttaatttgaaaactcgaaagtgctacccactgcataactttgctgtgcgcacgaggagtgcacattttaatgaccgtccttctaattatatatcaccgcatgaaaccataaatgcgactctccgatcacctgcaagctttgatagtattcaatgtattactaggtccaagagggtagacgcagagaccaataaagcaactggttcagcaaaaagcgaaaatatagaaactaagagcagaaagttccctgaagtaataaacccttttcttgtgaacacaacgaacaagaaagaaagcgattaa

SEQ ID NO: 4316 - DNA, 1902 bp, Saccharomyces cerevisiae
atgtcgtcgtcgaagtctctatacgaactgaaagacttgaaaaatagctccacagaaatacatgccacggggcaggataatgaaattgaatatttcgaaacaggctccaatgaccgtccatcctcacaacctcatttaggttacgaacagcataacacttctgccgtgcgtaggtttttcgactcctttaaaagagcggatcagggtccacaggatgaagtagaagcaacacaaatgaacgatcttacgtcggctatctcaccttcttctagacaggctcaagaactagaaaaaaatgaaagttcggacaacataggcgctaatacaggtcataagtcggactcgctgaagaaaaccattcagcctagacatgttctgatgattgcgttgggtacgggtatcggtactgggttattggtcggtaacggtaccgcgttggttcatgcgggtccagctggactacttattggttacgctattatgggttctatcttgtactgtattattcaagcatgtggtgaaatggcgctagtgtatagtaacttgactggtggctacaatgcataccccagtttccttgtggatgatggttttgggtttgcagtcgcttgggtttattgtttgcaatggctgtgtgtgtgtcctctggaattggtgaccgcatccatgactatcaaatattggacgacatctgtgaacccggatgtgttcgtcattattttctatgttttggtgattactattaatattttcggtgctcgtggttatgcagaagctgagttcttcttcaactgttgcaaaattttgatgatgactgggttcttcattcttggtattatcatcgatgttggtggcgctggtaatgatggttttattggtggtaaatactggcacgatccgggcgctttcaatggtaaacatgccattgacagatttaaaggtgttgctgcaacattagtgactgctgcttttgcctttggtggttcagagtttattgccatcaccactgcagaacaatctaatccaagaaaggccattccaggtgcggccaaacaaatgatctacagaatcttattcctattcttggctaccattattctactgggtttcttggtgccatacaattccgatcaattattgggttctaccggtggtggtactaaagcctcgccatatgtcattgctgttgcatcccacggtgtccgtgtcgtcccacacttcattaacgccgttattctactttccgtgctgtccatggctaactcctccttctactccagtgctcgtttatttttaactctatccgagcaaggttacgctcctaaggttttctcctacatcgacagagccggtagaccattgattgccatgggtgtttctgcattgtttgccgttattgccttctgtgctgcatctcccaaggaagaacaagttttcacttggttattggccatttctggtttgtctcagcttttcacatggactgccatttgtttatcccatcttagatttagaagagccatgaaagtccaagggagatctcttggagaattgggtttcaaatctcaaactggtgtttggggatctgcctacgcttgcattatgatgattttaattcttattgcccaattttgggtcgctatcgcccccattggtgaaggtaagctggatgcacaagcctttttcgaaaactacttggctatgccaatcttgattgcactttatgtcggctacaaggtctggcacaaggattggaaactgttcatcagggcagacaagatcgacctagattctcatagacaaatctttgatgaagaattaatcaagcaagaagacgaagaatatagggaacgtttgaggaacggaccttattggaaaagggtcgttgccttctggtgttaa

SEQ ID NO: 4317 - DNA, 1905 bp, Saccharomyces cerevisiae
atgttatctttgaaaaaaggaataacaaaatcatacatcttgcaaagaactttcacttcttcctctgttgttcgtcaaattggggaagtgaaatctgaatcgaaaccgccggccaaatatcatattatcgaccatgaatatgattgtgtggtggtaggcgctggcggtgcaggtttaagagcagctttcggtttggctgaagctggatacaagactgcttgtttatccaagttgtttccaacaaggtcacatactgtggctgctcagggtggaattaatgctgcgctgggaaatatgcatccagatgattggaaatcgcacatgtacgacactgtcaagggttctgactggctcggagaccaagatgcaatccattacatgacaagagaagcacctaagtctgtcattgaactagaacattacggtatgcccttttcgaggactgaagatggaaggatttaccagagagcatttgggggacaatccaaagattttggtaaaggtggacaggcctataggacttgtgcggtggcagatagaacaggtcacgcaatgcttcatacattgtatggacaagcgctgaaaaataatacacacttctttattgaatactttgcaatggatttgttgacccataatggcgaggttgtgggtgtcattgcctataatcaggaggacggtacaattcacagattcagagcacataagaccgtcatcgcgacaggcggatacggtagagcttacttctcttgcacttctgctcacacttgtacaggtgacggtaatgctatggtttctcgcgctggatttccactagaggatttagaatttgttcaatttcatccgtcaggaatttatgggtctggctgcctaatcactgaaggtgcccgtggtgagggtggatttttattgaattctgaaggagaaaggtttatggaacgctatgctcctactgccaaggacttggcaagcagggatgttgtttccagagcaatcaccatggaaatcagggctggcagaggtgtcgggaaaaacaaggatcatatccttttacaattaagccatctaccacctgaggtactaaaggaaaggctaccgggaatatctgaaacagctgctgtctttgcgggtgtcgatgtcacccaggagccaattcctgtcttgccaactgtccattataatatgggaggcattcccacaaaatggactggtgaagcattgaccattgacgaggaaactggagaggataaggtcatcccaggattgatggcgtgtggtgaagctgcttgcgtatcggttcatggagcgaacagattaggcgctaactcactactggatttagtcgttttcggtcgcgccgttgcaaataccattgctgacacattacagcctggcttgcctcataagccattggcttcaaacatcgggcacgagtcaattgctaatttggataaagtaagaaatgctcgcggctcactgaaaacctctcaaatcaggttgaacatgcaaaggacaatgcaaaaagatgtttctgttttcaggacgcaagacactctagatgaaggtgttagaaatattactgaagtggacaagacatttgaggatgtgcacgtttctgataagtcaatgatctggaattctgatctcgtagaaactctggaattgcaaaatttacttacttgtgccacacaaacggctgtttctgcttccaaaagaaaggagtctcgtggtgctcatgcgagagaggactatgcaaaaagagatgatgtgaattggagaaagcacacattatcatggcaaaaggggacatcaacacctgtaaaaatcaagtacaggaatgtaatcgcacatactttagatgagaatgaatgcgccccagtccctccagctgtcagatcctattaa

SEQ ID NO: 4318 - DNA, 1908 bp, Saccharomyces cerevisiae
atgaagttagaaaatactctatttacactcggtgccctagggagcatctctgctgctttggtcatcccaaatcttgaaaatgccgccgaccaccacgaactgattaacaaggaagatcaccacgagagacccagaaaagtggaattcactaaggacgatgatgaggagccatctgactctgaagataaagaacatggaaagttccataagaagggccgcaagggccaagacaaggagtctccggaattcaacggtaaacgtgcaagtggctctcatgggagcgcccacgagggaggaaagggcatgaagcctaagcatgaaagttccaatgatgatgataatgatgataagaagaagaagcctcaccataagggtggctgccacgaaaataaggtggaggagaagaagatgaaaggtaagaaagtcaagggcaagaagcaccacgaaaagacgttggagaaagggaggcaccacaacaggctggctcctctcgtgtccactgcacaattcaacccagacgcgatctccaagatcatccccaaccgctacattatagtcttcaagagaggtgcccctcaagaagagatcgatttccacaaggaaaacgtccagcaggcacaacttcaatccgtagagaacttatctgccgaagacgctttcttcatttctactaaagacacctccttgtccacctctgaggctggcggtatccaggactcattcaacatcgataatcttttctccggttacatcggttacttcacccaagagattgtcgacttgatacgtcaaaacccattagtagactttgttgagagagactctattgtcgaggctacagaatttgacactcaaaatagcgccccatgggggttggcccgtatttcccacagagagcgcctcaacctggggtccttcaacaagtatctctacgatgatgatgccggtcgcggtgtcacgtcctatgttattgacacgggtgtcaacatcaaccacaaggacttcgaaaagagagccatttgggggaaaaccatcccacttaacgacgaagatctcgacggtaacggccacggtacccactgtgccggtactatcgcttccaaacactacggtgtcgctaaaaatgccaacgttgttgcggtgaaagtcttgagatcaaacgggtctggtaccatgtctgatgtcgtcaaaggtgtcgaatatgccgcaaaggcgcaccaaaaagaagcccaagaaaagaaaaaggggttcaaaggttccacagccaatatgtcgcttggtggtggcaagtccccagctttggacttggctgttaatgcagccgttgaagtcggtattcactttgccgtggctgctggtaacgaaaaccaagacgcttgtaatacctccccagcttctgctgacaaggccatcaccgtcggagcttccacgttgagcgatgacagagcctacttttccaactggggtaagtgtgtcgacgttttcgccccaggtttaaacattttgtccacctacattggaagtgatgacgccaccgccactttatcgggtacctcaatggcttcccctcacgttgctggtttgttgacctactttttgtctttgcaaccaggttctgatagtgaatttttcgaattgggccaggattctttgactcctcagcaattgaaaaagaagctaattcattacagtacaaaggacattttgttcgatatccctgaagacactccaaatgttttaatctacaacggtggtggtcaagatttgtccgctttctggaatgataccaaaaagtcccattcatctggtttcaagcaagaattgaacatggatgaattcattggatcaaagaccgatttaatctttgatcaagtgagagatattcttgataaattgaatattatttaa

SEQ ID NO: 4319 - DNA, 1908 bp, Saccharomyces cerevisiae
atgactgcgttgcatagtgtgtccaaaacgcccgcgatcaaggaagaggaggaggacggtgatgagcgagacggcagaggagttcccctgggaccaaggaaccatgactaccgtggcaggaaaggtgatgaggaaagcggtgctgacaccgtgacatctcccatcacgtttgaaaagaagaagatagcgcccagggcgtcaacgcattccgaacagagtattttgagcagcatctcattgaaatcgatggtaaatcaacatcgtcagcagcagttgcagcaagagagctcaacaggggcaggcactgggtttgttgacagaaagcagcagatccaatctccggcgatggtgtccatattgaggaagaactctgctgaggagaatgttcgcagcagccacagtagcaagctcggtgaagggcagatagatggtaggaaggcttctgctagtaaggagatcggcaagacgttgccattcacggatgaccaaagatcgaaccctgaactagatcccaccaatagcgtggtggatgttagcaggggcaagaatacaaagagcaaaactgtgttcaatgagttagaagatgatgccgatgacgatgacgaggttcgacaaaagaatctaaccacgcaggcgttacgcaagttgtcgtcgttcaaaatgaatgctagttctaatttgaggttgagtaaagaaaacaaggcgaaagagtcttcatcttcgtccacgtcttcagtgtcgtcatcgtcgacgtcgaaggtggaaaatattgtcgacaagctgactacaacgaattctagctcgatgtcccaactgcggtttggcaacacgaacgtcattattgattcggtgaatcatgcggcgaaaccgccgcatcagcagatgctaaggaaaccctcgctggaatttttaccgcagcctgcttcgagcactaatctgaattttaattccaataaacataaatcaaatgtaagacagatcagtaaccctaaaaaaccgctatacatccccgccgtgctgaggaaagtttcagagacaaacataactaatgacgatctgttgaatgcaacattgtcgtcttactacaagaaggcatctaacctggaacatggctttaatccaagcaagtcgcaatccgctagcgttcagaatgcgaacaacctacggatcatatcttctcaatccagcgtacaatccaacacatcgtcaatcttggaaagctacaaaaacaaaatatcctcgtacttgttcccgaattctattccgaacagcgacagaatcaacttaataccaactatttcaaacagaaactctgccagagtaaacccgcccactaaggaccactggattccggacagtaagaggaattcttgtcgttactgccataagccttttaccctgtgggaaaggaaacatcattgcaggcattgcggggacatcttttgtcaagaccatttgcgccattggctgtacctggactcgcaggcaaattttataatgatcaacgaactaaacaacggtggcataaatggcggtggcactctctgtaaaatatgcgatgactgtctggtcgagtacgagaacctttcaaccacgaaccataacgcaaacacgaacgaggataacataaacgttgaggagggcgaagatgacgataatgacaataggaagaaattacgcaattactacaagaataggcagatgaacgctcttttcagaccaaagaagggcggttcgtcccaagagcatgccacggttgatcgagacacaacaacgcccatccaggtgaagtcgaacgacgaagaagcagataatgagaatacggggggagaacaagaagaaggtaatgatgttttgggcagtgttatcggctctgtgcctgcaaactggaattggagtagtttctga

SEQ ID NO: 4320 - DNA, 1908 bp, Saccharomyces cerevisiae
atggcacctgttacaattgaaaagttcgtaaatcaagaagaacgacaccttgtttccaaccgatcagcaacaattccgtttggtgaatacatatttaaaagattgttgtccatcgatacgaaatcagttttcggtgttcctggtgacttcaacttatctctattagaatatctctattcacctagtgttgaatcagctggcctaagatgggtcggcacgtgtaatgaactgaacgccgcttatgcggccgacggatattcccgttactctaataagattggctgtttaataaccacgtatggcgttggtgaattaagcgccttgaacggtatagccggttcgttcgctgaaaatgtcaaagttttgcacattgttggtgtggccaagtccatagattcgcgttcaagtaactttagtgatcggaacctacatcatttggtcccacagctacatgattcaaattttaaagggccaaatcataaagtatatcatgatatggtaaaagatagagtcgcttgctcggtagcctacttggaggatattgaaactgcatgtgaccaagtcgataatgttatccgcgatatttacaagtattctaaacctggttatatttttgttcctgcagattttgcggatatgtctgttacatgtgataatttggttaatgttccacgtatatctcaacaagattgtatagtatacccttctgaaaaccaattgtctgacataatcaacaagattactagttggatatattccagtaaaacacctgcgatccttggagacgtactgactgataggtatggtgtgagtaactttttgaacaagcttatctgcaaaactgggatttggaatttttccactgttatgggaaaatctgtaattgatgagtcaaacccaacttatatgggtcaatataatggtaaagaaggtttaaaacaagtctatgaacattttgaactgtgcgacttggtcttgcattttggagtcgacatcaatgaaattaataatgggcattatacttttacttataaaccaaatgctaaaatcattcaatttcatccgaattatattcgccttgtggacactaggcagggcaatgagcaaatgttcaaaggaatcaattttgcccctattttaaaagaactatacaagcgcattgacgtttctaaactttctttgcaatatgattcaaatgtaactcaatatacgaacgaaacaatgcggttagaagatcctaccaatggacaatcaagcattattacacaagttcacttacaaaagacgatgcctaaatttttgaaccctggtgatgttgtcgtttgtgaaacaggctcttttcaattctctgttcgtgatttcgcgtttccttcgcaattaaaatatatatcgcaaggatttttcctttccattggcatggcccttcctgccgccctaggtgttggaattgccatgcaagaccactcaaacgctcacatcaatggtggcaacgtaaaagaggactataagccaagattaattttgtttgaaggtgacggtgcagcacagatgacaatccaagaactgagcaccattctgaagtgcaatattccactagaagttatcatttggaacaataacggctacactattgaaagagccatcatgggccctaccaggtcgtataacgacgttatgtcttggaaatggaccaaactatttgaagcattcggagacttcgacggaaagtatactaatagcactctcattcaatgtccctctaaattagcactgaaattggaggagcttaagaattcaaacaaaagaagcgggatagaacttttagaagtcaaattaggcgaattggatttccccgaacagctaaagtgcatggttgaagcagcggcacttaaaagaaataaaaaatag

SEQ ID NO: 4321 - DNA, 1908 bp, Saccharomyces cerevisiae
atggctaacgacgctctaagtgctattttcagtaatccttcgaggaaaggtgtccaaccctccacatctattgtgtcatatacaaacaatgaagatgatattatagatgtggaaaatgggaagttcaacaagaacaagaatatcaacactaatgtgtatgtggacaactcctcaatagaggagagcgaagtcgtgcccttgcccgaaacaaagtccatctggagtaaaatatactacgatttcattgtgttagacaagacaactttgaatgtttcgttgaaagagtcgttcttgtataacagagacttgaaaccggttgaagaagaaagaaggtgttggtcctggttcaattacttatatttctggctggcagactgtttcaatattaacacatggcaaatagctggtacaggtctacaactaggtctgaattggtggcaatgttggcttacagtttggatcggctacacttttgcaggtatcttcgtagtattgaactcgagatttggttccgcatatcacttatctttccctattactgttagggcctcatttggtatattcttttctatgtggccgattataaatcgtgtcgtgatggctatagtatggtatgccgtgcaagcctggttaggtgcaacgcccgtggcactgatgctaaaatctatttttggcaagaatctggaagatagaatcccaaaccattttggttctccaaatagcactacttttgaattcatgtgtttctttatattttgggtggtcagtataccatttgtcctagtggctcctcataaaatcaggcatttattcacagtaaaagcagctttgatccccttcgcagcctttggatttttaatctgggctttgaagaaatcgcacggtaaaattgagttggggacgctgaatgattattcacctcatggttccgaattttcatggatattcgttagatccctaatggcctgtgttgctaactttgccgctttgattatcaacgcccctgacttcggtagatttgccaaaaatcctcaagcgtctttgtggccacaattggttgccatcccattgttcttcgccataacatgtttgatcggtatcattgttactgcggccggttatcacttatatggggttaactattggtcaccactggatgtacttggtcaatttttggagaccacttacaccagaggtactagggctggtgtgttcttgatttcttttgtatttgccttagctcaactgggtacaaacatttctgccaactctctggcatgtggtgctgatatgacggctttgtttccaagatatattaatattagaagaggttctttattctgtgtggcaatggctctatgtatctgtccatggaacttaatggccagttcaagtaagttcaccagcgctttgggtgcttatgcaattttcctttccagtattgctggtgtcatttgcgcggattatttcgtagtaagaagaggatatgtgaaattaacacatttattcctggcacagaagggttccttttacatgtttggaaacaaatttggtgccaattggagggcctttgttgcgtatatttgcggtatcgctccaaatttaccaggttttataggtgatgttggagctccaaaaattacggtttcagagggtgcaatgaggttatactatttaggttatccggtaggtttctttattagtgcggtgatatacctcatattatgttacttttttcctgtccctggtactcccgtaaccaattttctgacagagaaaggatggttccaaagatgggcttatgttgaggacttcgagcaagattggaagaatgagttacgtagggatgacctctgcgatgacacagtcagtatctatgatggcaccgaggaaaagatagtttactaa

SEQ ID NO: 4322 - DNA, 1908 bp, Saccharomyces cerevisiae
atgtctggagcaagatcaacaacggcaggtgccgtgccctcggcagcaacaacatcaacaacatcaacaacgtcaaactctaaggactcagactctaacgagtcattatatcccttggctctgcttatggatgagttaaaacatgatgatattgctaatagggtagaagccatgaaaaaactagataccatcgcgttggcactcggtcccgaaagaacaagaaacgagttgattccctttttaacggaagttgcacaagatgatgaagatgaggtgtttgccgttttagccgaacagttaggaaaatttgtcccctacattggcggtcctcaatacgccacaatcctattaccagttttggaaattttggcatctgcagaagaaactttggttagagaaaaggccgtagattctctgaataacgtggcccaagaactttctcaagaacaattatttagtgacttcgtccctttaattgaacatttagctactgcagattggttttcttcaaaagtttctgcttgtggtcttttcaagtctgttattgttagaatcaaagatgattcattgagaaagaatatcctggctttatacttacaactcgctcaagatgatactccaatggtgaaaagggccgtcggtaaaaacctgcccatcttgatcgatctgttgactcaaaatttgggattatctacagacgaagattgggattacatttctaacattttccagaaaatcattaacgataatcaagattctgtcaagtttctggcagttgattgtttaatttccatcttgaaattttttaacgctaaaggtgatgagtctcacactcaagatttattgaactctgctgtcaaattaattggtgacgaagcgtggagggtacgttacatggctgccgatagattttcagatttagcctcgcaattcagttccaaccaagcatatatcgatgaattagtacaaccatttttgaacctttgtgaggacaacgagggagatgttagggaagctgtggctaaacaagtttctgggtttgccaagttcctaaatgatccttcaattatattgaataagatcttacctgctgtgcagaatttgagtatggacgaaagtgaaacagtgagatctgctttggcttctaagattacaaatattgtattactgttgaataaagatcaagtcattaacaattttcttccgattttactgaatatgctaagagatgagttccctgacgttcgtttaaatatcattgccagcttgaaggttgtcaatgacgtaataggaattgagctgctatcagactctttgttacctgccataacagaattagccaaggacgtgaattggagagttagaatggctataattgagtacatacctatcttggcagaacaattaggtatgcaattttttgaccaacagttaagcgatttatgtctttcatggttgtgggatactgtttattctatcagagaagccgcagtgaataatttaaaaaggttaacggaaatatttggctctgattggtgtcgtgatgaaattatttcaagactgctcaaatttgatctacaattactggaaaattttgtctcgaggttcacaatactctctgctctaaccactttggtgcccgtggtatcgttagatgtcgttactgagcaactattaccattcatttctcacttggctgatgacggtgttccaaatattaggtttaatgtggccaaatcctacgctgtgatagtgaaggttttaattaaggacgaggccaaatatgatgcattaattaagaacacaattttaccctcattgcaaacgctgtgtcaagacgaagatgttgatgtaaaatacttcgctaagaaaagtttggcagaatgtcaagaacttttaaaaaattga

SEQ ID NO: 4323 - DNA, 1911 bp, Saccharomyces cerevisiae
atgaactccaatagtaccatcggaaggaccacccttggagaatctgatacgatatccctgtcattcagtgaaccaagtagcagtctgaattcacgatcaacggatgttgtcttcgcatctacttcaactttagtaccccaacaaggaagtctgacctcattaccgcccgtgtctagtacagctactcctacatattattctacaagcttaacatatgatgagactttgcatacatccattgatgtatcttcgacaagtactttagtatcatctaccgacagcagttcatcgagcgagcaagatacgtatagttcccaatatgacccagctacctcctcatactcaataattacaccatccatgtccattttctcatcgacgtcaccaatgtcatcatcgtcgtcaataacgtcggaatggtcatcgttaacatcaacaacaccaacgttatcgtcatcagctacatcgctgtcatcatcatggtcgtcgttatcatcaccatcttcgttactggtatcgtcctcgttgtcattatcactatcttcatcatattcagacactaaattgttttcgttcgacagcagatcttctattttctcaccatcaacacccaccgtaatatcccctagttacacatacttgtcttccatatctgcaacttcatttcaaattagtaccacttcagaactctcttctagttggttctcaacaatttcttctccttctacgatatcaaataaagataccacattcccaagttccagtcggaatacttccacatcgttttacagttcatcgctttcatcgacgaacgatttttcaaccataagcaaatcatcgaaactcagtccatcagcttcatcttcgacagtttccataagcacgatttccgtgccaacgtcaagttctgttagctcatccagcagtaaagtaccttcaaaccgtccttcatcatcatcatcatcagatgatacaacaagtgcttactcaagcacgtatacttttcagtccttacaatctactactagcagcagtataccacccaccactcaaacacccagcactagtacgatttctacgtctcccataccaacatccagtcaggtcttcaatacggtagccatttcaagctccgaagattcaaaaactatttattatttctatacccaaacatatgatattactgactcctctacaacgttcgtgacgggattacctacgaccatagcagttgcaaaaagtgaggtaacctcattttccgctccatcttcgacgatcacagctgacatgtctttctatcagcactggcttgatggcagtttggataataacaaaaaccaaggcacttcaaagacaaatactggtaccattgttggaagtgtggtaggaagcgtcggtggtattcttatatgtgtactagtagtttggttcatgctggttagaaaaaggaaggcaaagaggcatttcaaggaaaacgattccttctgtcacgagattgggcgcagaacgggattcccaacaactgcccaagcaaaagaggcgtcacttcaagctcaagactcgggatcacagcaacgaaacaccgagactgcttctgctaataatccgttcagcaacgaattcaattttaaggcaagaggaaatcctcctccagtgccaccaccaaggaatgttaccgcaatgaatggctcctttcaaaatatgcggagtaatttcatggaccaggaaaacagattttcctatggctcttcatttacatattcgtcattgggttcatctactcaaggtggcttttctactttatcttcaaattcgatacgactcggacgtggtttagataatgacatctctcatgatgagagaaatacagttcagaacaattcacaagggttcttgagggaaattatatga

SEQ ID NO: 4324 - DNA, 1911 bp, Saccharomyces cerevisiae
atgactaacgctttgctctctatagccgttttgcttttctcgatgctctcgctagcacaagcggagacgcacacgtttaattggaccactggctgggactacaggaacgttgatgggctaaagagccgtcccgtgatcacctgtaatggccagttcccatggccagatataacggtcaacaaaggtgaccgtgtgcagatttacttgaccaacggaatgaacaacaccaatacttctatgcatttccacggtctcttccaaaacggaaccgcctctatggacggtgtgcccttcttgacgcaatgtccaattgcgccaggcagtactatgctttacaatttcacggtggactacaatgtaggcacctactggtaccattcacacacggacggtcaatatgaagacgggatgaaaggtcttttcatcatcaaggatgatagcttcccctacgattacgatgaggaactttctttatcgcttagtgagtggtaccacgacttggtcacggacttgacgaagtcgttcatgagtgtttataatccgacaggtgctgagcccatcccacagaacttgattgttaacaacacgatgaatctgacatgggaagtccagcccgatacgacgtatcttttgagaattgtcaacgtgggtgggttcgtttcgcagtacttttggatcgaggaccacgaaatgaccgtggtcgaaatcgacggtatcactaccgagaagaacgtaacggatatgctttacatcactgtcgctcagagatatacagtcctggttcacactaaaaacgacacggacaaaaatttcgccatcatgcagaaatttgatgacaccatgttggatgtcattccaagtgatttacagctgaatgcaacctcttatatggtctacaacaaaaccgctgcgctgcccacacaaaattacgtggattcaattgataacttcttggacgatttctacttgcaaccgtacgagaaagaagccatctatggcgagccagatcatgtgattaccgttgacgttgttatggataacttgaaaaacggtgtgaattacgccttcttcaataatatcacctatactgcaccaaaagttcctactttgatgaccgttttgtcttcaggtgatcaagcaaacaactccgaaatctacggttcaaacacgcacactttcatcctagagaaggatgaaatcgtggagattgtgctaaataaccaggacacaggtacccatcctttccatttacatggtcacgctttccaaaccatccagagagatcgtacatatgatgatgccctaggtgaagttcctcacagtttcgatccggacaaccaccctgccttcccagaatacccaatgagaagagatactttatacgttagaccacaatccaatttcgtcatcaggtttaaagccgataacccaggtgtttggttcttccattgtcatatcgaatggcatttgttgcaaggtttgggtcttgttctcgtggaggatccttttggtatccaagatgctcattctcaacaactcagtgaaaaccacttagaagtttgccagagttgctctgtggccactgaaggtaacgccgctgccaatacactggatttaactgatttaactggtgaaaatgttcagcatgccttcattcctaccggttttaccaaaaaaggtattattgccatgacattctcctgctttgccggtattcttggtattatcacaattgcaatttatggtatgatggatatggaagatgcgaccgaaaaggttattcgagacttgcacgtggaccctgaagtcttgctaaatgaggttgatgaaaatgaagagcgtcaggtaaacgaagatcgtcattccactgaaaagcatcaatttttaactaaagccaaacggttcttctaa

SEQ ID NO: 4325 - DNA, 1911 bp, Saccharomyces cerevisiae
atgccaagggaaacaagtttggtaacaatcatcggtgaagatagttacaagaaattacggtcctcaagatgtcttctggtcggtgctgggggcatagggtctgaattgttaaaggatataatcttgatggaatttggtgaaatacatattgtcgatttggacaccattgacctttcgaacttaaacaggcaatttctttttagacaaaaagatattaaacaaccgaagtctaccacagccgtaaaagcagtacagcatttcaataactctaagttagtgccttaccaaggaaatgttatggacatttctaccttcccactgcattggtttgagcaatttgacattatcttcaatgctcttgataacttggccgcaagacggtatgtcaataaaatatcacagtttctatcactgcccttaatagaatctggaacagctggatttgatggatacatgcagcctattatccccgggaaaactgagtgttttgaatgtacaaagaaggaaacaccaaagacttttcctgtgtgtactatcaggtccactccttctcagccaattcattgcattgtttgggcgaaaaactttctatttaaccagctatttgcgtcagagacctctggaaatgaagatgataacaaccaggattggggtacagatgatgctgaagaaattaagcgcattaaacaagaaactaatgaattgtatgaattgcaaaaaattatcatatcaagagatgcatcccgtattccagagattcttaataaattattcattcaggatataaataaactgctagccattgaaaatttatggaaaacgagaacaaagccagtaccattatcagactctcaaataaatactcctactaaaacagctcagtctgcctctaattctgttggcacaatacaggagcaaattagtaatttcattaatattacacaaaaattaatggatcgctatcccaaagagcaaaatcatattgaatttgataaagatgatgctgatactttggaattcgtcgcaactgctgcgaacataaggtcacacatattcaatattccaatgaagtccgtatttgacatcaagcaaattgctggtaacattatcccggctattgcaacaacgaatgctatcgttgccggtgcatcgtcattgatttcactgcgcgttttaaatcttttgaaatatgccccaactactaagtatactgatttgaatatggctttcacagcaaaggcaagcaatctatcccaaaatcgttatttatcaaatccgaaactagcccctccaaataaaaattgcccagtttgctctaaagtttgtagaggtgttattaagttatccagcgattgtttgaacaaaatgaaactaagtgattttgtagttttaatacgcgagaagtactcatatccacaggatatttcgctcctggacgcaagtaatcaaaggttactatttgattacgatttcgaggatttgaacgatcgtactttatcggagattaatcttggaaatggttctataatattattctccgacgaagaaggtgatacaatgatccgcaaagccatagaattatttcttgatgttgatgatgaactcccatgtaatacttgcagcttaccggacgttgaagtcccattaataaaggccaacaatagtccttcaaaaaatgaagaagaagaaaaaaatgaaaagggtgcagatgtagtcgcaactacgaacagtcatgggaaagatggtatcgtgatattagacgacgatgaaggtgagatcaccatcgatgctgaaccgatcaatggttcaaagaagaggccagttgatactgagatttctgaggcgcccagtaacaaaaggacaaagttagttaatgaaccgactaattctgatattgttgaattagactaa

SEQ ID NO: 4326 - DNA, 1911 bp, Saccharomyces cerevisiae
atggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgttacgaaatagcgagtgccaggccgaacgacagctctacgatgcgtactttcactgactttgtttctggcacacctattgtaaggagtcttcagaaaagcaccataaggaaatatggatacaatttggcaccctacatgttcttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatgttttgcatgtgtgctgcccaagttgagaagagatactaacaaaatgaccgcggctctcaaaaataattgacgagcttacggtgatacgcttaccgttatccagagctacagcgcaacgtatacgtcgacgatacaacaagaacggttcatcggagcctcgactaaagacgcttgacggactcacttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccggaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcatctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgttgctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagcttgggtgctgcagaaaaggtgtctcgcacaaaggagtttgtcactga

SEQ ID NO: 4327 - DNA, 1914 bp, Saccharomyces cerevisiae
atgacaacatatttcaagttggtaaaaggtgctaccaagatcaagtcagccccgcccaaacagaagtatctggatccgatactgttggggaccagcaatgaagaggatttctatgagatcgtgaagggtttggattcccgaattaatgacacggcgtggactattgtgtataaatcgctgttggtggttcatttgatgataagggagggttccaaagatgttgcattgcggtactactctaggaacctggagttttttgacattgaaaacatacgtggctccaatggcagtgcgtctggagacatgagggcacttgatagatacgataattatctgaaggtgagatgcagggagtttggtaaaatcaaaaaggactatgtgagagacggctatcgaacactgaagctgaacagtggcaattacggaagctccagaaacaagcaacactctatcaatatagcactagatcatgtggagtccctagaggtacaaatacaagccctgattaaaaacaagtatacacaatatgatttgagtaacgaattgatcatatttggtttcaagctgcttattcaagacctgctagcgctatataatgctctcaacgaaggtatcataactctgctggagtcttttttcgaactatctcatcataatgcagagagaactctagacctgtacaagacgtttgttgatttgaccgagcacgttgtcaggtacttgaagagcgggaagactgcgggcttgaaaatacccgtcatcaagcatatcactaccaaactggtcagatcgctagaagaacatctgatagaggatgataagacgcacaacacttttgtgcccgttgacagttctcaaggaagtgctggggccgtagtagccaaatctactgcacaggaaaggttggagcaaatccgggaacaaaaaaggatactagaggcacaattgaaaaacgaacaagtagcgatttcccctgctctaactactgtcacggcggctcaatcttacaacccgtttggaacagactcttctatgcatactaacattccaatggctgtggctaatcaaacgcaacagatcgcaaataacccatttgtatctcaaactcagccacaggtgatgaatacaccaaccgctcatacagagcccgcaaatttaaacgttcctgaatatgcagcggtccaacacacagtgaacttcaaccctgtacaagatgctggcgtaagtgcccaacaaacggggtactattcgattaacaaccatttaacacccacatttacaggtgcagggtttggaggatactccgtttcacaggatacaactgccgcttctaatcaacaagtctctcattcacaaactggttctaacaacccgttcgcattgcacaacgccgcgacgatcgcaacagggaatcctgcacacgaaaatgtcttaaataacccattttcacgaccaaactttgatgaacaaaataccaatatgccgctacaacaacagataataagtaacccttttcaaaaccaaacgtacaatcaacaacaatttcaacaacaaaaaatgcctttgagctcgatcaatagcgttatgacaacccctactagcatgcagggatcgatgaatattcctcagcgttttgataaaatggaatttcaggctcactacactcagaatcatctccaacaacagcaacaacagcaacagcaacaacagcaacagcaacaacagcaaccacaacagggttattatgtgcctgcaactgcaggagccaaccctgttacaaatataactgggacagttcaacctcaaaatttccctttctatccacaacagcaaccacaaccggaacagtctcaaacacagcaaccagttttaggaaaccaatatgctaacaacctcaatttaattgatatgtaa

SEQ ID NO: 4328 - DNA, 1914 bp, Saccharomyces cerevisiae
atgagtgaagttgagagcagagaaaaggagcctgacgcaggattgtccccagatatcgttcaagctacgctaccatttttaagcagtgatgatattaagaacctctcgcagacaaataagtattataatacattactagattttgaccactctaaaattttgtggcatgaactatttcataaggcatttgggacattaaagacaaatgacgagcctttccagggtcgaaattcggcggaatttaagacctgcacagagacgattttaagagaagcattccccaccttgtcatggcaggaagtataccaattacgggcatatgatgcaaagttttatagttggggttatttaaagcatggaaggttgggctataccgcgagttccaataatgaacttgtcgccacttcactaaacgggccaagtccgcggttcaaatatggtgtcaatacccccactgaagttccttggtttaacagtaggacaacatctagaactagtaacttcactccttcagaggacccgttaagcgccatcaagaaggatggagacgaaatcatagctcaagtatctagtggtggtttttctttccaaatattgactgagtcaggtaacctttacagcagcggatccactttttctggagggttaaaaggaccaggtcccagtggttcacagcatgattataatcccttcagagaaatgattcacaatatggaaagatcgtatccgcggatcactagccgcagtaatgggagtactgtcaataccacgggtacattttctggaaggagaatgagcggtagccatccatctactgcttatgaaccaggaaatgcaactacagctcagcatattaccatagatagcggaggtgcgcctgcagcctctcccggagggagccatagtggtgtccctagaactacaatgccttcaatggggccgcatgagaatatttacagccagatagaaatgctggaacgaagtgctaacaaggctgtaccaggaaataatcatatcaggagaatgttcgcaagaaattctttcccattatatagtggtagggatgaaaatttaggatcatttaatgatattcaatttgtcgcggtaagctctgggagaagtcatttcctagcaatggatacagataacaatatttattcttgggactcaacggaatctgaccaaggtgtcaaaattgagtttgctaacctacctagtcgtgctacgaatcctattttgaaaattgctagtggttggaatttcaattgttgctatatatataaggtcgggttggttgcatggaaagaaagagatgctattcaaaagggcgagagctttgcttttgcaaaatacgagattgtcccgaatacgaatgatgttaatggagactccaggattgtcgactttgcatgtttacaagataactgcgttttcttcattaataacaacggcgataaactatggaagtaccacaatggactgaaccagatagtagatttaaatattgtcggaaaactgtgcaaaattaacgcctgttttgcttcattagtcctcttcaccgatactcactgttatactttgaaagtaacaaatggagatgtcgataaagatagtttaacggagctagacatcaatgaaaatgttatctccgttgcaagtggtgactatcacacggtggcactaaccgaacgcggtcatttgtattcatggggtattgaaagtcaggattgtgggtgcttaggattgggcccttctgaaaaaatagttaacgagctacatattggcaattgggaagggcaaagaaacattagggtcgttaagcccacgaaaatagaactacctgaagattatatttgtgtcagtgtaactgctggtggctggcaaaccggtgcattaatcatcaagaagcattga

SEQ ID NO: 4329 - DNA, 1914 bp, Saccharomyces cerevisiae
atgggtgtgagatccgctgcaaaggaaatgcacgaacgggaccataattcggacagttccagtttagtaacttccctgatgaaatcttggaggatatcgtcggcttcttcctccaagaagccatcgttatacaaaatgaatactactgaatctactagtttaccctcgggttatgcttcctcggcagatagagatcggagaaccagtgacggtaattttgaagctatggcaaagcaacaagcaagcactagacgtacctcgaattcctattcacctctacgatatgtaaaccccactctaagcactgcaagtaacgaaagtccccggcctgctttactcttacgtcagcatcaccagcgtcatcaccaccatcaacaaccccgccatagcagtagtggtagtgtaggcaacaattgcagtaacagtacagagcctaacaaaaagggtgatcgatatttcaaagacttagatgaggattggagtgctgttattgacgattataatatgcctattcctatacttactaacggtggatttggtacacctgtagctccaacgagaactttgtcgcgaaaatccacttcttcttccatcaattcgatttcgaatatggggacctccgcagtacggaattcttcctcctcttttacataccctcaattaccacagctgcaaaaagagaaaacaaatgattccaagaaaactcagttggaaatcgaaaacgaacgggatgttcaagaattaaactccatcatccagcgcatttctaaatttgacaatattttgaaagataagacaatcataaatcaacaggatctgcgccagatcagttggaatggtatcccaaaaatacacaggcctgttgtttggaaattattaataggttatttgcctgtgaacaccaagagacaggagggtttcttacaaaggaagaggaaagaatatagggatagtctgaaacataccttttctgaccagcactcaagagatatcccaacttggcatcagatagagatagatataccgagaacaaatccccacattcccctctaccagttcaaatccgtacagaacagtttacaacgaatactatatctttgggcaatcaggcatcctgctagcggatatgtgcaaggtattaatgatttagttacaccatttttcgagacttttcttaccgaatatctgccgccttcacaaatagatgatgtagagataaaggacccctctacttatatggtagatgaacagattacagatttagaagcggacacgttttggtgtcttaccaaattgctcgaacaaattaccgataactatattcacggacaaccaggcatattaagacaagtgaagaatttgagtcagctagtgaaacgaattgatgctgatctatataaccattttcaaaatgaacatgtggagtttatacagtttgcattcagatggatgaattgccttttgatgagagaatttcaaatgggtacagtaataaggatgtgggacacatatttatctgaaacttcacaagaggtcacttcttcttattctatgtcgtccaatgacattaaacctcctgttactccaacagaacctcgagtggcaagttttgttacaccaacaaaagatttccaatctcccaccacagctctttctaatatgacaccaaacaatgctgttgaagacagtggaaaaatgagacagtcttcgttgaatgagtttcatgtgtttgtttgtgctgcattcctcatcaagtggagtgaccagctaatggaaatggatttccaagaaactataactttcttacagaaccctcctacaaaggactggactgaaacggatattgaaatgcttctgagcgaagcctttatttggcaatctctttacaaagatgctacgtcgcactggctgtaa

SEQ ID NO: 4330 - DNA, 1917 bp, Saccharomyces cerevisiae
atgaatcaacctcaaattggcacttacaatgtaggtacacagttaacagttgggtcacatcaggttgagatcattaaatatctaacaagcggtgggttcgctcaagtatattccgcgttaatcaacccacctgacccacattctaattcaagcgttgcatgcttaaaaagagtcattgttccagacaaacctagtctaaacactttaagagctgaagtagatgctatgaggttgctgaaaaacaataggtatgttgtatcttacattgattctcatgcagctaaggcaatgttacataatggttcgtatgaagtattcgtcttaatggaatattgtgaaagaggtggtctcattgattttatgaacacaaggctacaaaacaggcttcatgaatttgaaattttgcaaataatgagccaagttactcaaggagttgccgctatgcatgctttgcaacctccgttaattcaccgtgatataaagatagaaaatgttcttatctcagccaataatgagtacaagctttgtgactttggttctgtatgcggtattataaggcctcctaggaattcacaagagctatcatatgttcagcaagacattttgaaaaacacaactgcacagtaccggtcgccagagatgattgatacatttcgcggtctgccgatagatgaaaagtcggatatatgggcgctgggtatttttctatataagctttgctattacacaacaccgtttgaaaagggcggtgatcttgccatattaagcggaaagtttgaatttccattgtatccgaactacagtgaacagttgaaaggcttaatacgtgatatattggttcaagatccgcgccataggcctaacgtttatcaactactgaagaggatatcaattatgcaaaatgttccgtgtccaataaatgacatacaagtggttcaggcgcccagtagccatttgaatttgaccgaacttcatcagctttcggcaacacaaaatattctaagcttgaactctcccacaaccatggaaaatacgatgccgaacgctacatttcaaatcagcatggctgataatactacaacagcacaaatgcatcctaatagaaaaccatcacaaatagcatatgacgctagcttcagtaattccgccaaaggttctcaaccactttttgacaaatcacagaatatgtaccacgcattggatcctccacttgttgaaccgctagcgagtagtgtttcaaataatgacaacgaactcaaggcaaattccgcaaccaagttaaagcaggcaattgtctctgaagcacatacttttaggcagaataattcaatagactttccactacaaaacataataccccagtacgaagattcttcttcctcttcagatgaatcttattctggagacgtagatgaattaaagaaaactcgatctctaggttcttattccacacgcggtaacataaaaaaaaaccaatccgtaaaggaatctcttacttcatcaagcctaccaggcactagcttcaccccaacgtctacaaaggtaaatttgaaacacgaaaattcaccttttaagtcgacattcgttaatacgattgataattccaaagacgatcttaacaaaccatcttatgaagatttggacgtatctaagcagaatttgaagaactccattcaacagcgtatgatcgataaactcaactcttctgaggagtcattcaacgctaggaaaatgtccaaggtcaagctgcatgagaaaggggagatagataagccaacaatgctgaaatcaagtggcccgatttcaaaagacaaaaaaacaaaacctaccccaccacctaagccttcacatttaaagcctaaacctcctccaaaaccactgctcctcgcgggacgaaagttatccttggataagtga

SEQ ID NO: 4331 - DNA, 1917 bp, Saccharomyces cerevisiae
atgtctcgtactaacatggatacaagacacgcacattctgctttactggcagcaccacagagtgctactgcaaatagcaggagcagcaacagcagcagcgagagtagtagtaacaaaaacaatatcaatgtcggcgtcggtgacgatagcggtaatgtcagcgcggtaagtatcgacgatggaccccacttcagggatatcttccactatggacacgaggaaaattacaaacttgcgagcagcggtatcactaacctgaattcttcatcccacgcccaccaaactttgtctcccatttccattagtaatgcatccactccggaaagttttcccgagcaccctttgggcctagaacgggaaacagagccggcgttggaagctgaaatggaagcggaggaactaccaccacaccaaagtaaataccttttaagctccattaaggcgaccaaacgattaaaagatgctagaccgtttctgaagccggttgatcctattgctttgaacatcccgcattatttcaactacgttcaaaccccaatggatttgtctttaattgaaacaaaattgcagggcaacgtgtatcattcagtagagcaagtcacatcggacttcaaaacaatggtggataattgtttaaactttaatggtccagaatcttcaatctcttcgatggctaaaaggattcaaaagtattttgaaaaaaagttatctgcaatgccaccaagagttttacccgcttctgccttgaagaaaacaagcagaaaccggaaaaaaaatgaggatatggattccccacttgtcattagacgttcagttagtaccaccaatgacaatattggggaaagcggaaatagagaaggcgtcagtggtggtagacccaaaagaacaattcatccacccaaatcaaaagatttgtttgatatatatgaaaactccaaaccaaaatcaaagactttacaaaaaaaattcaggacttgtctgaaaatactaaaggttttgatgagtaaaaaaaattcggatataaattttccctttttacaacctgttgatccgattgctttgaatctaccaaattactttgatgtcgtgaagaatcctatggatttgggtacaatatcaaataatttaatgaactggaagtacaaaacaattgatcaatttgtcgacgacctcaaccttgtcttttataattgtttccaattcaatccagaaggcaatgaagtccattcaatgggcaaaaaactaaaagagcttttcaattttcattggttagagaaccaggatattttgaatgaaattgaaacggattcagatcttgaagaggataactattcttcttcatattcatctgatgatgaatatgatgatgaagacataaatgaaaacgatataactaatccggctattcaatatttggaacaaaaactgaagaaaatggaggttgaattgcaacaattgaaaagacaagagttaagtaaattatcgaaggaaaggaagaggaagcatctaggtaaaacgcttttgcgtaggaaggcaatgaagcattcagttgacgatttaaagaaatctattactgataaaatcaatgaattaagtgatttagaaatgaatgggatgattcgtatcattaaaaattcattacccgcagatgaaatactaacttccaatgaagatgaaattgaaattgatttggatattttagatgaagcgactattgcaagaatttatgagagatattttgagaaaaaaaataacaacaatagcaaaagaaaactaagtggcaactactcgactgcgccaactaacaagaaaaagaaaaccttgaaatttttggaaaaggatgaaatcataaataataataattattccgattctgaagaagacagtagtgatagtagcgacagtgacagtgattaa

SEQ ID NO: 4332 - DNA, 1920 bp, Saccharomyces cerevisiae
atgagcgaatcagtgaaagaaaacgttactccgacacgtaacttccgtcgtactcaagggccccaaaataatacaaaacctcacaacgacaggaagaatttcagaagaaagcaaaagaaaaataacctttctgctgaacccaacctcaccacttcaagcgcagatgatactgatgaagaaaatgaattatgtgtaatttgtgcgcgcaagttaacatacgtatctctaacaccatgccatcataagacatgccatatctgtggtttcagacaacgagctttgtacaacaagaaaagctgtttgatttgcagaacggagaatgaagaagtcatgtttaccgatcgcatagatggtgatatttcagataaatataacttttgcgaaaaaaatgaaaaatatggaataaatttcactagcgaagaggttgctaccgaaacactaaatcttttaaaatttttttgtcccctatcgaaggatgaacaagtttgtgactttggtagtttcaagaaatataatgaacacttgaaatctgaacataacagaatgatctgtttaatatgtgcaacccataagcatgcattcccttgtgagcttgaaatattcacccaaaatcaattacgcaaccatcaaactaagggtaattcagaaggattcaaaggccaccctatgtgtgccttctgttccggaaaacgattttattcagacgacgaattgtacattcacatgagaaatcagcatgaaaagtgccatatttgtgataagatgaaccccgcttctcctcaatactttaaggattataatcagctttttgaccactttaaacattcgcattacgtttgcaccgtccaaacttgcttagataacaagtttgtcgtatttaaagacgagttggagttacaagcccacattttgcaggagcatggtaatatcctgaagggaaagccaaagtttttccagtcagaactttctacttttatctcggctccatctagagtgatcagggaaagagatgattacgaccttccatctatatcttccctaccgggttcatcatccggctctagaactgatgtgagatctgctagttctcccgaggaaagtagactaagattggcagaaagagcaaaatactatctggaaaattccaaagaagacttcaataagttttcttcttataacgaagattattctaaaggtcgcttaagtgctgaaaaattattggaatcatataaattgttattcacaaaaccaaatgcggatgtatatttattgattcataacttagctgaaacctttcccaaaaactcctccaaatacaataatctgaacgccatatatgaacaaagagagcaaacccttgcacgacaaacttcactaccttctttatctagtgattcttccctttcaatgtcaataggcaggggccattggggtggaacaaacgatgggggcagcgctggtgcagcattaggcgttaggaatatcaaaaatcttccaaccctgaaaagtccttcagcgtcgtatgatccctttgcaaccaccgtaaaaaaaaacactctgagacccgtgcaaaacattaaaagaactacacctcaatcagttagttatcgaacttccactaatacagtcgccttctctccaacctatttggaaagtaaaaagggttcctcttctacttctctaaataatagcaaagataaattgaaaagtctcaacctacctcaactacctccaccaaagccaaaggtgcaaattccaggtctgaacagaccccaaattgctgatcctaagcagtggggtaaaaagtcaagcacacaagatactaacgtgcacgataatttgagggaattgaacacaactagtggaggaaataaaaagaaaggcaaacaaaagcagctgttattccacattggtgtatag

SEQ ID NO: 4333 - DNA, 1920 bp, Saccharomyces cerevisiae
atgatatctagaaccattggtgaatctattccgcccaacacaaaacatgctgtttccgtgtgtttgcccacatgggaagctacagtaggctatgaagagggtgaaagcagtataattaactcgcttactaccggatatccaagatttttcatacacaagtcaataaagaaattatgtgaaattttatccgctaagtactccatggaagatgaagcttgtctttgcttcccctcttacaaggttgccaataggtgcagagagtttatcaaagtgaaaacgggtctttctaccaaagtacgcatcttacaactatgtacacctaaacctatgaaccaagaggaaaagctctggagaagggaatgtaaaatcacggtggtgtttgtagaccaggaaatattccccgtgatgaagcagtattggcaacattctggtgagattgtatctagcagaatggcggagtatattttacatgaattacaagtcaaggataatcttaagaagatggaaacagtggataacggtaaaaaatttatgaccgaagatgaaaacagagtgaacgaagaatatatagaaacgagatttgggagaaatttaaattttcttgctgctgataaagccaaatatctaatacgaaagaggattgccacaaaagttgttgaaaaaattgactctgaaggtctatcggacctattctcttttgaacactataacgagagcaacggtccattcaatgttggcagtggagaggctctggatgatgatcagttgaattcggacatacctgccgaaacaattacttctatgggagaaagtggctcaaacagtacttttgaaaacacagctaccgatgacttgaagtttcatgtcaaccctaatacggatgtttacttatttccaagtggaatggcgtccattttcactgcccacaggctgcttttaaacttcgatgccaagcgcttatcaaggtcttctagtagacaagataagttgattggatatggacctccgttcaagaagaccgtcatgtttggattcccatatacagatactctgagcattcttcggaagttcaatcacacacatttcttgggacagggagattcaacgtcaatgaacgctctgaaaaatattttacattctggtgagcaaatactggcggtatttatagaagctccatcgaacccactgttgaaaatgggagatttacaagaactgaaaaggctatcagacttgtattcattttacatagtggtcgatgaaactgtgggtggctttgtcaatatagatgtattaccgtatgccgatattgtttgtagttcgctaacgaaaatcttcagcggcgactcgaacgttattgcaggatccttagtactaaatcctagaggaaagatttatgagtttgctagaaaatttatgaagactgaagacggatatgaagattgcctatggtgcgaagatgcgttatgcctggaaagaaattcgagagacttcgtggaacgtacaatcaaggtgaatacaaacactgatatattgttaaaaagggtgttattgcctcaggtgggaaaattgttcaagaaaatatattaccccagtttaacatcagaggataccaagcggaattatgacagcgttatgtctacaaaagatggtgggtatggaggtttattttcactaacttttttcaatattgaagaggcaaagaagtttttcaataatctggaattgtgcaaaggaccttctctcggtacgaatttcactttggcgtgtccatatgctattattgcccactaccaggaattagacgaggtagctcaatatggtgtcgaaacaaatcttgtaagagtgagcgtcggtttggaaaatagcgacgttttatgcaatgtttttcagcgtgccattgagaaagctttaggggaataa

SEQ ID NO: 4334 - DNA, 1920 bp, Saccharomyces cerevisiae
atgccggtatctgattctggattcgataattcttcaaaaacaatgaaggacgacactataccgacggaggattacgaagaaatcacgaaagagtccgagatgggtgatgcgactaaaattacttctaagattgatgctaatgtcattgaaaaaaaagataccgattcagaaaacaatataaccattgctcaggatgacgaaaaggtgtcttggctgcaaagagttgtcgagttttttgaggttaagaatgactctaccgatttggccgatcataagcccgaaaatccaattaggacatttaaagatttacaggagtccctccgttcgacgtacttgtacaacacagatctgcggcccgtggaggcaaaaagaagaacgtggacatggaagcagtacattttcttttggatttctgggtcctttaacgtcaatacatggcaaatctcagccactgggctacagttagggcttaactggtggcagacttggatctgtatttgggttggatacacgtttgtcgcatttttcttgatactgggttccaaagtggggaacaattaccatatctctttccccatttcctcaagagtatcatttggtatctacttctccatctggattgtcatcaaccgtgtcgtcatggcatgtgtctggaattctactttggcttatatcggtagtcaatgtgttcagttgatgctaaaggctatcttcggtactaatttgaatactagaatcaaagacaccataaagaaccccaatttgacgaacttcgagttcatgtgcttcatggtcttctgggtcgcatgtttaccgttcctatggtttccacctgacaaattgcgtcatatatttgcactcaaatccgccatcactccatttgcggccttcggttttttgatttggactctttgtaaggccaaaggtcatttggcattgggttccctaaatgacaatggtggcgcaatcagcaagacggttttagcatggtctgtcattagagctattatgagtgctctggataacttctctactttaatcctaaacgctcctgacttcactagattcggtaagacctacaagtcatctgtttactcgcaattgattgcgctacccgtctgctatgccattatttccttaatcggaatattgtctgtctccgcagcttatacattgtacggagtaaattattggagtcccctagacattctgaacaggtacttggataactatacttcggggaacagagccggtgtattcttaatatctttcatttttgcgtttgaccagctgggtgccaacttgtctggtaactcgatccctgcaggtaccgatctgactgcattattgcctaaattcatcaatatcagacgcggttcttatatttgtgctctaatatcgttggcgatttgcccctgggatttattatcatcatcgtcaaagtttactacggcactagcggcatatgcagttttcttaagtgctattgcgggtgtaatatcagccgattacttcattgtcagaaagggttacgttaatattttccattgctacaccgacaagccaggatcgtactacatgtacaataaatatggtacgaactggagggcggtggtagcttatatatttggtattgctcctaattttgcaggctttttaggttcagtgggagtttctgtgcctattggcgctatgaaagtttactacctaaactatttcgttggttatctccttgcagcattgagttactgcattttagtgtatttttacccaattaagggtattccaggcgatgccaagataactgaccgtaaatggctcgaagagtgggtcgaagtagaagaattcggaactgaaagagaagcttttgaagaatatggcggcgtttccactggctatgaaaagatacgatatatctaa

SEQ ID NO: 4335 - DNA, 1920 bp, Saccharomyces cerevisiae
atggaaactattttgcagccaaaggctagaccatttgagtctttgaaaagaaaacgttttagagaatggttgaggccgtcgactgcgcatggatccctgttgcattctgatacattagatttgcgtgactttgcaaaacctaatcccgctgacacattttctaatcttgattctggtcattgtcctttggtcacaactccaataaaatatgagtgcccagatggaaagagttcttttttccgaggagacactaaatttgaaaccctgttcagtaatagaaaattctatgagttcaaagataatttgaaaaggggattgaagaaaatacgtcatgggagaaacggacatcaaagcgaaaagagatgtccagttgttgaagaaacaaaaaagtctgtgtcagataatctggacaaaccagacaataatacgccctgtttcgacagattccacacaaattcgaaagaatttgaaacgcaatttgatcattcaaataggagccaaaattccgagaaggcttatctagacaatgaatcctgttggaacctaagtgagaaatttattccttttaataatttaaaatatgaagatttgaaacattttgaagagaatttgcaaagcttagcgcctgcaacttttactccaattgaatcaaatgaatcgcttgataggtcagattcgacacgtggcacaaaacgaagcattcgcaatgattccagtgatacaacatctgaaaagaggctatgcttaaaacaatactcagatgaacctgaatcggatcattcgatggaaagtacaccatccatttacattaccaaagaagttcaagaaagaattgaagcattaagctccacggattcgtttttaattgaaaaagtagattttccctctaacaaaattggttccagtgcctccgattatgaaagtgataacgaatacagaaatatggatgaggattcaataaacgatgttaccactgagaaagagggaaatgtggtcataccagactctaatactagcacggtggacgcaatggaaaaaccaattgaagtgagctcggccttaaaagatgatacattggataaagacatagatgatgcgagcagtagctattcggatgatgtagagaccacattcgagccagttgaatctgaggaactttccgatttatctgatacaagctcaagtggaagtagtaaaatttatactatccccacatttcgcggccttactaataggaccaatatatcacaaattctttcaaaagttggtaaagctgatttaagccaagataacttaacgcatttgatcaaaagtcatcaaaaaaagaaaagatgcgtgaattttagaaataaaagattctatgatgctttcaatccatatgttgataacgaagaagatgcagagttatctgacagcgaaaacatttcagaaatggatacagatctttgtataaaggatcggagtacctcaagtgttaggtttgatgaaaactcacgtcttttaatctacaaaaaatctaaaaagttaaacaaagatgagactcaaagtggttattcgactactgaaatgaggtcaattctaaagacaaagatgaattcacagcatgatgaggagtctcagagagcttcgaagtgtgacacagtaggtgtagcccaatttttacattattttcaatatacagagtataaaaggcagagaaatgaagcagaaaattatagactgagaggagagcaactaagcaagtactattctgaagaatatcctttggattttgcggctgttgaatgcgaagattccgttaatgataaatctgatatcatacttagtatgagagctacggaaagaaacattggtaggcaactgaaaggtataagtagtcaaggggcacaaattatatcgcttgatgaggatgttttttga

SEQ ID NO: 4336 - DNA, 1920 bp, Saccharomyces cerevisiae
atggccgaaaactccctcctgaggtttatcaccaagaacaaagtggccatcctagcaacggtctctgcggggactgctgctgtgggtgcttatgtttactaccagcaaattaagcagcagcaacagcagcaattgaagggtacaaaagacaaccgacgtcaaagtgaggcctttgctggtcaaaatgaagacgaggcggacttaaaggacgacggcagcgtcgtaagtggaagtaataagaggaagaagaagaagaataaacgcaagaggaacaataaggcaaaatcgggagaagggtttgactatccctccttgcccaatggcgagcctgatattgcccaattgaaaggcctatcaccctcccagagacaagcgtatgccgtgcaactgaagaacagaggtaaccacttcttcactgctaagaattttaatgaggccatcaaatactaccagtatgccattgagctggacccgaatgaaccagtgttctattccaacatatctgcttgttacatttctacgggcgacttagagaaggttatagagttcactacaaaggcacttgagataaaacctgaccattctaaagccttgctgagacgtgcatctgccaacgagtcactgggcaacttcactgatgctatgtttgatctatctgttttgtcattgaatggtgactttgatggagcctccattgaacctatgctggaaagaaatttaaataagcaagcaatgaaagtactaaatgaaaacctatcgaaggatgaaggcagaggctcgcaggttttgccgtctaacacatctctggcgtcattttttgggatttttgactctcacttagaagtttctagtgtgaacaccagttcaaactacgatactgcatacgctctattgtcagatgctttgcaaagactatattctgcaacagatgaaggttacttagtagcaaacgatcttttaacaaagtccactgacatgtaccactctctactttctgcaaatacagtggacgatcctttaagagagaatgctgccttggcattgtgctacacgggtattttccatttcttaaaaaataacctgttagatgcccaagttcttttacaagaatctataaacctgcatccaacaccaaattcgtacatatttttggcattgaccttggccgataaagaaaactctcaagaatttttcaaatttttccaaaaagctgttgatctaaaccctgagtatccgccaacctattaccaccgtgggcagatgtattttattctacaagattataaaaatgccaaggaagatttccaaaaggcccaaagcttgaaccctgaaaatgtttatccctacattcaattagcctgtttgttgtacaagcaaggtaaatttaccgaatctgaagcttttttcaatgaaacaaagttgaagtttcctaccttacctgaggtgcccacctttttcgctgaaatcttgacagataggggcgattttgatactgcaattaaacaatatgatattgctaaaaggttggaagaagtgcaagaaaaaatacatgtgggtataggacccttgattgggaaagcaactatattagctagacaatcctctcaagatccaacccagttggatgaagagaaattcaacgcagccattaagctgctgacaaaagcctgtgaattagatccacgatctgaacaagcgaagatcgggttagcacaactaaaattacaaatggaaaaaattgacgaggccatagaattgtttgaagattctgcaattttagcaagaactatggatgaaaaacttcaagctactaccttcgcggaagctgcaaagatacaaaagcgtttgagggctgatccaatcataagtgcaaagatggagctaacattagctcgttatagggctaaaggcatgctttag

SEQ ID NO: 4337 - DNA, 1920 bp, Saccharomyces cerevisiae
atgtacgaacagtttgaattttctttttttttcttcgaaaattcagacaataaggttaaatataaagctcatctcatctcatcgataaaacgctggagtattatcacatgcatgcgttgcttttggaccgtacagaagtctatatttaaagctaggtttttcgcttgcagaaactttgtcaagaagcataattataaactaatcagcaccatgactggaagtactgaaatggtaccaccaacaatgaaacataccgttgacaacaaaaggctttcgtctcctttgacagattctggtaaccgccggactaagaagccaaagttgagaaagtacaaggccaaaaaggttgaaacaacttctccgatgggtgtcctagaatttgaagtgaacgatttgttaaaatctcaaaatttgtccagggagcaggttctgaacgatgttacttcaattctaaatgataagtcctcaacagatggacctatcgtcttacaatatcaccgagaggtaaaaaatgtcaaggtcttagaaattacttccaatggcaacgggttggctttgatcgataatcctgttgaaacagaaaagaagcaagttgttatcataccgtttggcctgcccggtgatgtagttaatatcaaagtctttaagacccacccttactatgtcgagagtgatttattagacgtagtggaaaaatctccaatgagaagagatgatttaattagggataaatatttcgggaaatcttcaggaagtcaattagagttcttaacttacgatgaccaactagaattgaaaagaaaaacaattatgaatgcctacaagttcttcgcaccaaggttagttgctgaaaaacttttacccccatttgacaccaccgtagcttcccctttacaatttggctacaggaccaaaattacgcctcatttcgatatgccaaaaagaaaacaaaaggaactatcagtaaggcctcctttaggatttggtcaaaagggtagacctcaatggagaaaagatactttggatatcggcggacatggttcgatattagatatcgatgaatgtgtgcttgcaactgaagttctcaacaaaggattgactaatgaaagaagaaagtttgagcaagagtttaaaaactacaaaaaaggcgcgactattttactgagagagaataccactattttagacccttccaaaccaactttagaacagttaaccgaagaagcctctagggatgaaaatggtgatataagttatgtcgaagtcgaagacaaaaagaacaatgtcaggctggctaaaacttgcgttaccaatcctagacaaattgtcactgaatatgttgatggatatacttttaattttagtgcgggtgagttttttcaaaataataactctatcctgccaatagtgaccaagtatgtccgtgataacttgcaagctcccgctaaaggtgatgataataaaacaaagtttctagtagatgcttattgtggatcaggtcttttcagtatatgcagctccaagggcgtagataaagtgattggtgtagaaatttccgctgacagtgtctcttttgcagaaaaaaatgcaaaggcaaatggtgttgaaaactgtagattcatcgttggaaaggctgagaaactctttgagtctattgatactccaagtgaaaacacttccgttatcttggatccaccacgcaagggctgtgacgaattattcctaaagcaattagccgcatataatccagccaagattatttacatatcgtgtaatgtccattcccaggcacgtgatgtcgagtacttcctcaaagaaacagaaaacggttccgcccaccagattgaaagcataagaggatttgatttctttccacaaacgcaccacgttgagagtgtgtgtataatgaagagaatctaa

SEQ ID NO: 4338 - DNA, 1920 bp, Saccharomyces cerevisiae
atgtctaaagctgtcggtattgatttaggtactacctactcctgtgttgctcacttctctaatgatcgtgttgacattattgccaacgaccaaggtaacagaaccactccatctttcgttggtttcactgatactgaaagattgattggtgacgctgctaagaaccaagctgctatgaacccagctaacactgttttcgacgctaagcgtttgatcggtagaaacttcaatgacccagaagtccaaggtgatatgaagcacttcccattcaagttgatcgatgttgacggtaagccacaaattcaagttgaatttaagggtgaaaccaagaactttaccccagaacaaatctcctccatggtcttgggtaagatgaaggaaactgccgaatcttacttgggtgccaaggtcaatgacgctgtcgtcactgtcccagcttacttcaacgattctcaaagacaagctaccaaggatgctggtaccattgctggtttgaatgtcttgcgtattattaacgaacctaccgccgctgccattgcttacggtttggacaagaagggtaaggaagaacacgtcttgattttcgacttgggtggtggtactttcgatgtctctttgttgtccattgaagacggtatctttgaagttaaggccaccgctggtgacacccatttgggtggtgaagattttgacaacagattggtcaaccacttcatccaagaattcaagagaaagaacaagaaggacttgtctaccaaccaaagagctttgagaagattaagaactgcttgtgaaagagccaagagaactttgtcttcctccgctcaaacttccgttgaaattgactctttgttcgaaggtatcgatttctacacttccatcaccagagccagattcgaagaattgtgtgctgacttgttcagatctactttggacccagttgaaaaggtcttgagagatgctaaattggataaatctcaagtcgatgaaattgtcttggtcggtggttctaccagaattccaaaggtccaaaaattggtcactgactacttcaacggtaaggaaccaaacagatctatcaacccagatgaagctgttgcttacggtgctgctgttcaagctgctattttgactggtgacgaatcttccaagactcaagatctattgttgttggatgtcgctccattatccttgggtattgaaactgctggtggtgtcatgaccaagttgattccaagaaactctaccattccaactaagaaatccgaagttttctctacttatgctgacaaccaaccaggtgtcttgattcaagtctttgaaggtgaaagagccaagactaaggacaacaacttgttgggtaagttcgaattgagtggtattccaccagctccaagaggtgtcccacaaattgaagtcactttcgatgtcgactctaacggtattttgaatgtttccgccgtcgaaaagggtactggtaagtctaacaagatcactattaccaacgacaagggtagattgtccaaggaagatatcgaaaagatggttgctgaagccgaaaaattcaaggaagaagatgaaaaggaatctcaaagaattgcttccaagaaccaattggaatccattgcttactctttgaagaacaccatttctgaagctggtgacaagctagagcaagctgacaaggacgctgtcactaagaaggctgaagaaactattgcttggttagacagcaacaccactgctaccaaggaagaattcgatgaccaattgaaggaattgcaagaggttgccaacccaatcatgtctaaattgtaccaagctggtggtgctccagaaggcgcagctccaggtggtttcccaggtggtgctcctccagctccagaagctgaaggtccaactgtcgaagaagttgattaa

SEQ ID NO: 4339 - DNA, 1923 bp, Saccharomyces cerevisiae
atgaacggtcctccaacattcactcaatatagaataaataagttttctgggaatggagcaactcataagattagagaattactcaattttaatgatgaaaagaaatggaaacagttttcgagcagaaggctggagctgatagacaaattccaactaagtcaatataaggcaagcgaacaagatcaaaacataaagcagattgctacaatattaagaacggagtttggataccctgtaagctgctctaaggaattcgaaaagttagtcactgctgctgtgcaatcagtgagaaggaatagaaaacgatcaaaaaaacgctacgctctcagcatagccaatggcagtggcggcaatgtcaacaacagcatctcgtcaaattctacttctgacgacgagatctctccgtcgatctaccagcgctccaattcggacttcctgcctagttctaattatgctgcagatttccagttttcaaacaagttccagcctctcatgagtcaccagagtcataacggaaccatttttccaaccgtgggcacccaaaatgactcatctccatcggttacttcgacccaacaaaagtataacgatatagtcaccatgctagtgcacgatcttgttacgaatgtcgtacccctatcagaacaagctctcaaggacccatatactgggccaaacctgtcacattttgctacgtcttcactcagccagcaacctaacattaccacaaacatcccgatagattctaccgtgccatttttcctgagggaaaagttactcctacaaatccaaagatcaagaacttgtcaggacatttcgcaggctgcaggatccattgatatatacgcaaatctggagattttgggtgaaatgtcaatccgaatgtctattgcattcgttatcgaacgatttttctccaacttggtctcttcttcaatgaagtatatcactgccaagacgtgctctcctgaaaatctggctttgttgtctcaaagactgttcggtgccgctacaagacataacttatctcatttccccgcggctcaggtacaactaaggctactgtatttggtcataggtggtattgtcaaggattttggcttcgaccccacgctttaccctttaagtgaaatcatacatcatattgtgatggttcagtatcctttggctagttcctgtgcgtcagaaccaccatcatcttcacctaacaagagggttaagagaagccctcctgtcgtttcaagtgacgttatgttgaataataataacactctatcgaatagagctacacttttaactacgctaccaatgaagcctcaatcggccaataaagatgttaatcgcagagtgatcattagatttaatgatcgcgagcaagcctttactttccaccagttgagcaatggaccacccacggtgtctgaagttttggaaaactgtaaaaatttatttaatattatcaacaagaacaagaattttggtattttccataacgataacctcttgaacgatgaaagtttggcaaagttatttgattccttttccacgagcgagattcatctcgtaattaaggacatttccaccattccactacaagatgcaaaaataccagtgcccattacgttgcccaaaatgtcatgcataggtgaaaacccctctatgccttctattccattggtaccacaagaaaaagatgatccaaaaaaatcaagcttaactgcctttgataacatccttaataggatctctaaatcgccaatgaatgaagaaaatagcaacactactttaaacactggcacctccacctccaacacaaataataatgaccacaacgagtctgtgccagcgccatacgttacaaagaacaaaaattcttttcaaaatggcaatttaccacagccggttttccagcctttactttga

SEQ ID NO: 4340 - DNA, 1923 bp, Saccharomyces cerevisiae
atgaggagagagaggcaaaggatgatgagtttcgaggacaaggacaaggacgaccttgacaatagtaatagtaataacagcagtgaaatgacagatacggcgatgatgccaccattaaagagattgcttattacgggcagtagcgatgatttggcacaaggatcatcgggtaagaagaagatgacgatggcgacgaggtcgccatcgtcatcacccgatttggcgacaaacgacagcggcactagggtacagccattgccagaatataacttcaccaagttctgctatcggcataacccggacattcagttctcaccaactcatacagcgtgctacaagcaggatttgaaacgaacgcaagagattaatgctaatatcgcgaagctacccctgcaggagcaatccgacatccaccacattatctcgaagtacagcaattccaatgacaagatacggaagctgattctggatgggatcctatcgacgagttgcttcccacagctttcctacatttcgtcactcgttacacacatgatcaagatcgacttcatcagcattctgccgcaggagctgtcgctgaagatcttgagttatctggattgccaatctctttgcaacgccacgagagtgtgccgcaagtggcagaagctcgcggatgacgacagggtatggtaccacatgtgcgagcagcacatagacaggaaatgtcccaactgtggctgggggctgcctcttttgcacatgaaacgtgcgcggatacaacagaatagtacaggatctagcagcaacgcagatatccagacgcaaactacgcgaccttggaaagtcatctacagagaacggttcaaagtggagtcaaactggagaaagggccactgcaggattcaggaattcaagggccacatggatggtgtgttaacgctccagtttaactacaggcttttgttcacaggctcgtacgactccaccataggtatatgggacttattcacggggaagctaatacgaaggctcagcggccattcggacggcgtcaagacattatattttgacgatagaaagctgattacgggctcgctcgacaagacgatccgtgtttggaactacataaccggtgaatgcatttccacgtatcgaggccactcggatagcgttctgagcgtagattcataccagaaggttatcgtttccggcagtgctgacaagacggtcaaggtatggcacgtggagtccaggacatgctacaccttgagaggccacacggaatgggttaattgcgtcaaattgcatccgaaaagcttttcatgttttagttgcagtgacgataccacaatccgaatgtgggatatcaggaccaattcatgcctaaaagtgttcaggggtcatgtagggcaggtgcaaaagatcataccgcttaccattaaggatgtagagaatctagccaccgacaacacttctgatggcagctctccgcaggatgacccaacaatgactgatggtgcagacgaatcagacacaccgtcgaacgagcaagaaactgtcttagatgaaaacataccttatccaacacatctactatcttgcggactggataacacaatcaaactatgggacgtcaaaaccggtaaatgcataagaacacagtttgggcacgtggaaggtgtttgggacatcgccgctgacaacttcagaattataagtggttctcacgacggaagcattaaggtctgggacttgcaaagcgggaagtgtatgcacacgttcaacggtcgaagactacaaagagaaactcagcacacacaaacacaatccttgggtgataaagtcgcccctatcgcttgtgtttgtattggagattcagaatgctttagtggtgatgaatttgggtgcgtaaaaatgtacaaattcgatctcaatgattag

SEQ ID NO: 4341 - DNA, 1923 bp, Saccharomyces cerevisiae
atgccaccaaaagaagctcccaagaaatggaaggcgccaaaagggccaaaacctacccaccgtaaaaataaaaataagcttgaattaggcagagctattaaatatgcacgtcaaaaagaaaatgccatcgagtatttacctgatggtgaaatgaggttcactaccgataagcatgaggccaactgggttaaattaagatctgtaactcaagaatcagctttagatgaattcttgagtacagctgcactggcagacaaagatttcacggccgatagacattcaaatgttaaaattattagaatggatagcggtaatgattctgcgacatctcaagggttttctatgactaatgagcagcgtggaaatcttaatgcgaagcaaagagcgcttgctaaggatttgattgttccaaggaggcctgaatggaacgagggcatgtccaagtttcagcttgataggcaagaaaaggaagcgtttttagaatggagaagaaaattggcacatttacaagaaagcaatgaagacttgttgttaacaccgtttgaaagaaatatcgaagtttggaaacagttatggagagttgttgaaagatcagatttagttgttcaaattgtagatgcgaggaatccgttgctgtttagatctgtcgatttagaaagatatgtaaaagagtcagatgacagaaaagcaaacttactgctagttaataaagcagatttattgaccaaaaagcaacgtatcgcttgggcaaagtactttatctccaagaatatttcgttcacgttttactctgcattgagagctaatcaattattggagaaacaaaaggaaatgggggaagattatagagaacaagatttcgaggaagctgataaagaagggttcgatgctgatgaaaaagttatggaaaaagttaaaattctgtccattgaccaactggaagaattgtttttatcaaaagctccaaacgagcctttattgccacctctgcccggtcaacctccactgattaatattggtttggttggttatccaaatgtaggtaaatcctccactattaattcgctcgtgggtgccaagaaagtttctgtttcatccacgcctggtaaaacaaaacacttccaaactattaagttatctgattctgtcatgctttgtgactgtcccggtcttgtcttcccaaactttgcatataacaagggtgagctcgtgtgtaatggtgttttacctattgatcaattacgtgattatattggtccagcaggtttagtagcagaaagaataccaaagtattacattgaagcgatttatggtatccatattcaaaccaaatcaagggatgaaggtgggaatggggatataccaactgctcaagaattgttagtcgcatacgccagagctcgtggttatatgactcaaggttacggttctgctgatgaaccaagagcaagtcgttatatattgaaagattacgtcaatgggaaattactgtatgtcaaccctccgccccatctagaggatgatacaccttacactagagaagagtgtgaagaatttaacaaagatttatatgtgttcgacagattaccggacaccagaaaggagcaagtgcaaaatgctgctaaggctaaaggcattgatatcgtggatttagctcgtgatttgaatcagctaacgttttcagctcacactggtggtgacacacaaaaagaagccaaatctgttacgcacggtggtaaacaagctgcattgtacaatgccgctgaggacttggatagagacttcttcaagatgaacaacgtcgaaggtagattaagtacaccattccacaaagttcaaaatagttcagctggtaagagacataacaaaaaaaacaaaagtaaaaatgcgaaaagcaaagtttttagcattgaaaataattag

SEQ ID NO: 4342 - DNA, 1923 bp, Saccharomyces cerevisiae
atgctaaatcagcacacaagttcagtaccggatgacgaacatctgcagatggcacaccaaaatagcagttcagaagtgagaaatgaggcagcggtcccagatcaacttttgactcctttacaaccgtataccattttattgaaagatggagaaacaatagctacgatgtatcctatacctgcgtatcctgatttattgccgctagggctcttaaatttccttctagatgaatttaacatggaagtggaaaagggagatagttttccttattacgagactttatcactagaagaattcaaaaatgtctggtttcataatgatggtcacgtttgtattatggtgttaggcgaaataccagaactggattatagtatggatactgaagcggacacaaatgataattttggaacagaaatagaaaccacgaagcacaccacccaatataagaaacgaaaagaacgtcgcaatttaaatctaagtatgcagtgggagaagcaatgtctaggcatatttgacctcaaaccagcataccctggacggtcagcgcatgtggtcacaggaacatttctggtcaatgctggtattcgtggaaaaggtattgggaaaacactaatggaaacattcatagaatggtcaaagaaattaggatttacgtcctcctttttcccgttaatttacggaacgaacgtaggaatcagaagaattttggaaggattgaactttaggcggattggaaagctgcctgaagccgggattctcaagggctttgatgtcccagtagattctttcatgtatggtaaagagttcacacatattacgaaaagtatagatttgttacgagatcctcaaaagagtatcgaaattgggaaatatgaacgattaaagcattttctggaaacaggcaagtatcctttacattgtgatagaaacgaaaaggctagattaagagtactttccaaaactcattcggtattgaatggcaagttgatgacaaaaggaaaagaaatcatttatgacacggatcaacaaatccagattgcattagagatacatttaatggaacatttaggcatcaacaaggtgacctccaaaattggtgaaaaataccattggagaggaatcaagagtactgtttcggaggtaatctctcggtgccaaaaatgcaagatgaggtacaaagacgggacaggggtaataattgaacaaaagagagcagttaagcaggcgcatatgctaccgacgcagcatatagaaactatcaacaatccaagaaaaagcaagaagcatgataatgcgttattgggacaggcaataaatttccctcaaaatattatttccagtacgctgaatgatgtggagggtgaacccactccgccagacactaatatcgtacaacccacattccagaacgccacgaatagtcccgcaacaacagctgaagccaacgaagcgaataaaagatccgagtttctttcctcaatacagagcacgccactattggacgacgaacagtcaatgaattccttcaatagattcgtggaggaagaaaactcaagaaaaagacgaaaatacttggatgttgcctccaacggaattgtaccccatttaacgaataacgaatcgcaggatcacgcgaaccccgtcaaccgtgatgaacgagatatgaaccattcagttcccgatttagatagaaatgaccatactataatgaacgatgctatgttgagcctcgaagataacgtcatggccgctctagaaatggtccaaaaggaacaacaacagaagataaatcatcgaggtgaagatgtgactggccaacaaatcgatttgaacaacagtgaaggtaatgagaattcagtcactaagattgttaacaacgaatctaatacatttacagagcacaattctaatatttattattaa

SEQ ID NO: 4343 - DNA, 1923 bp, Saccharomyces cerevisiae
atgctatcgctaaaaaaatcagcgctctccaagttgactttgctcagaaacacaagaacatttacatcgtcagctttggtgcgccaaacgcagggctctgtaaacggttccgcgtccagatctgcagacgggaagtaccacataatagatcacgagtatgactgtgtggtaatcggtgccggtggtgccggccttagagcggcctttggtcttgccgaggcgggctacaagactgcttgtatatccaagcttttccccaccagatcccacactgttgctgctcagggtggtatcaatgccgctctgggaaatatgcacaaggataactggaaatggcatatgtacgatactgtgaaaggatctgattggctaggtgaccaggactccatccattacatgaccagggaagcgcccaaatcgatcattgaactggaacactatggtgttcctttttcaagaactgaaaacggtaagatctaccaaagagcctttggtggtcagaccaaggagtacggtaagggtgctcaggcctatagaacatgcgctgtcgcagacaggacaggacatgctcttttacacacgctttatggccaagctttaagacatgacacacatttctttattgagtactttgccctcgatctgttgacccataatggcgaggtcgttggtgtcatcgcttataatcaggaagacggtaccatccacagattcagagcacacaagaccattattgccactggtggctatggtagagcatacttctcttgtacctctgctcacacatgtacgggtgacggtaatgccatggtttcgcgtgctggtttccccttgcaagatttagagtttgttcaattccatccttcaggtatatatgggtctggttgcttaatcactgaaggtgctcgtggtgaaggtggttttttggttaattctgaaggtgaaagattcatggaacgttacgctcctacggccaaggatctagcttgtagagatgtcgtttccagagcaatcaccatggagatcagagaaggcagaggtgttggtaagaaaaaggaccacatgtacttacaattgagccatctacctccggaagttctaaaggaaagattgccaggtatctctgaaacagcagccatttttgctggtgtagacgtcaccaaggaacctattcccattattcctaccgtccactataacatgggtggtattcccacgaagtggaatggtgaggcattaaccattgatgaagaaactggcgaagacaaggttattcccggtttaatggcttgtggtgaagccgcttgtgtttctgtccatggtgccaatagattaggtgccaattccttgttggatcttgttgtctttggtcgtgctgttgcccatacggttgctgacactttacagcctgggttgccacacaaaccactaccttctgatttgggtaaagaatccatcgcaaacttggataaactaagaaatgctaatggttcaagatctacggcagaaattagaatgaatatgaaacaaactatgcaaaaggatgtttccgtctttagaacacaatcatctttagatgaaggtgttcggaacattactgcagtagagaagacctttgatgatgtgaagacgaccgatagatcaatgatctggaattctgacttggttgaaactctggagctacagaacttattaacctgtgcctcccaaacagctgtttccgctgctaatagaaaggaatcccgtggtgctcatgcaagagaggattatccaaatagagatgacgaacattggatgaagcatacattatcctggcaaaaggacgtcgctgccccagtgactttgaaatacagaagggttatcgatcacactttggacgaaaaggaatgtccttccgtacctccaactgtaagagcctactaa

SEQ ID NO: 4344 - DNA, 1923 bp, Saccharomyces cerevisiae
atggctaaagataatttaactaatttgctctctcaattgaacattcaattgtctcaagacgagcattcgcaggtcgaacagacttgcgtgaaactattggattctggatgtgagaatccagcggatgtatttagacgttgcttagtagctgttatccaacaggacaagtatcaaaaggctttacattatttaaaaaaattcaaacatatagatgacaagtacggtcgcaaatttgcgctagaaaaattgtacattttctataaattgaatatgccagatgaattcaacacattgtacacagcaattatcacagatgatctcgatacggtactaaaaaaggatatcgagtcacttagaggtatcctacatgtgagagctcaatattgttataaaaatgggctgtaccaagaagcttttaaaatatatcaacatttagcaagtcacaatgagaaggatcaggatagtcaaattgaactctcttgtaacgaaagggttccgctatccgttgcgacagagttaatgaacagatcacccttagttactcctatggatgaatcttcctacgatttattattcaatgaatcattcatcatggcatccgtaggtaaatatgacaaggctatcgaactattagaaaaagcgcttcaaggagccacgaatgaaggctatcaaaacgatattaatactattaaattgcaattatcatttgttttgcaaatggtggggaaaactgcacaaagtaaagaaatcttaaagggcttattgcaggaactgaaagccgattctccattctctttaatttgtcaaaataacctaaatgcgtttgttgatttctctaaatacaatacaaacttcaatttactgttaagggaattaaacgtagaaaaactaaacacttttaatttacaaaccttcacccatgaacaatggtcaaacattcaacgcaatgtacttttcctgcgtttgttcaacaatgtcaaaattcactctcaagagtcccttttatcaagaacgttcgataaatactctaagttagttgacaatgttactttggaaagctacaagacgcaggccaagaaactttaccaccacactacaaaaaccattttaagtggaacagatggaagtacgattggaatattactactgactatccaattgctaataatagagaaggaatgggaaaatgctatcagaataggagaattatttttaaatgaaagctggaaatcgtcctttgaaaaattcaacgattcacaagccatcgtgtgttacattttatttgaattatacaagattaagggaagaaacaactccaaaagtgttctgcttaaaaaattaggctccgtgagagtccaattgagcggaaaaatccaagaaaacataccattttggaaacacgtcgggtttgaattattgtccatgggtaatgctaaagaatcgaaggctttactcagagagatttcaaactttagtaaaggcgatgcagatgtccttgttgacagagttgtttcgtcagattctttggatatagcacaaggtatagatctagtgagagatattgatattgataaattaattcaacttggtgtgaaacccttagaatcgtcagcaaagagaagtaaaaacaccgcagttagcaaagttcaaaagagaaaagttttagagctaaagaagaaaagaaagattaaacgcctcgaaaaatttttacaaggtcgcgacacctccaaattacctgatcctgaaaggtggctgccattaagagacaggtctacttataggccaaagaaaaaacaacaaggtgcaaaacaaactcaaggtggtgctatgaacaaaaaatcagaacaggcccttgacatatcaaagaaagggaagcccactgttaataaaaagcctaagaacaagaagaagggccgtaaatag

SEQ ID NO: 4345 - DNA, 1923 bp, Saccharomyces cerevisiae
atgtcacctcgacagcttataccgacattaattccggaatgggcaccattatcccagcaatcgtgcataagagaggatgagttagatagtcccccgataacgcctacgagccagacatcttcatttggttcttctttttctcaacagaaaccaacctatagtacaattataggagaaaatatacacacgatcctggatgaaattcgaccatatgtgaaaaaaataactgttagtgaccaagataagaaaactataaaccaatatacgctaggagtctctgcaggaagtggacaatttggttatgtacgaaaagcgtacagttctactttaggcaaggttgttgctgtcaagattataccaaaaaaaccttggaatgcccagcaatattcagtaaatcaagtaatgaggcaaatccagctttggaagagtaaaggaaaaataacgacaaatatgagtggtaatgaggctatgagacttatgaatatcgaaaaatgtaggtgggaaatttttgcggcttcaagacttcgaaataatgttcatattgtgcgactaatagaatgcttggactctcctttcagcgaatctatctggatagtcactaattggtgcagccttggtgaactacagtggaaacgtgacgatgatgaagatattttaccgcaatggaaaaaaattgtgatttcaaattgtagtgtttctacatttgccaaaaaaatcctggaggatatgacaaaagggttggaatatttgcattctcagggttgtattcatcgtgatatcaaaccgtccaatattttattggatgaagaagaaaaagtagcgaaactttctgattttggaagttgtattttcactccccaatcattacctttcagcgatgctaattttgaagattgttttcagagggaattgaacaaaattgttggtactccggcatttattgcaccagagctatgtcatttgggcaattccaaaagagattttgtgacggatggctttaagttggatatttggtcattgggagtgacactatactgcttactgtacaacgagctgccatttttcggggaaaatgaattcgaaacctaccacaaaatcatcgaagtatcattgagttccaaaataaatggtaatactttaaacgatttagtcattaaaaggttattggagaaagacgttactttacgcataagtattcaggatttagtaaaggttttgtcgcgtgaccagcccatagattctaggaatcacagtcaaatttcatcgtccagtgtgaaccccgtaagaaacgaaggtcctgtaagaagattttttggtaggctactgactaaaaaaggaaagaaaaagacctcaggaaaagggaaagacaaggtattggtatctgcaactagtaaagtaacaccttcgatacatatcgacgaggaaccggataaagaatgtttttcgactacggtccttagatcttcgccagactcgagcgattattgttcatcgttaggggaggaagccattcaggttacggatttcttagatactttttgtaggtcaaatgaaagcttacctaatttgactgtgaataatgataagcagaattcggacatgaaaactgacagaagcgagtcatcctctcattcgtcattgaaaatcccaacacctatcaaagccatgataagactaaagagttcccctaaagagaacgggaacagaacccatattaattgctcacaggacaaaccgagttccccactaatggataggactgttggaaagcgcacggttaacaattcaggggctagaaagcttgctcattcaagtaatattctcaactttaaagcatacataaattcggaagatagtgacattcgagaaacagtagaagatgtaaaaacgtatctgaactttgcagataatggtcaaatatag

SEQ ID NO: 4346 - DNA, 1923 bp, Saccharomyces cerevisiae
atgtcagacttaaatgatgtccaagaaaatgctaaattgaattcggaaactcggaatacaggaaaggctgaaccacctcatgggacaactgagtatgtggcagaggcagaaatttctaagaatggagttggatcgccaaaaaagagcccaaaaaagggtaaggttggaaagggggacaataacaaagtagaaactgagttagtacacacagccctgttagaaaaagacaacccattcatggaggaggggccaacaggattcacaaaatcagctttattagaaatacccggtatgagaagccataacctaaagaacccgaatgaagattacgaggatgactctgagggattattgcctttaaaccaagaatcgaatgcagaaacatgtagaacaagtcttagtggaagtattaactccatgaacggagagacctctgcgtcagaagaaccttctgtaagtaatagaaagaagtccgctaggatacacatacttgaagcgaaaagagtttccgaaggtcaaggaagagcctacatcgcctatgttattcagtttgaaaattctaccgttcagagacgttacagcgatttcgagagtttgagaagtatcttgataagattgtttcctatgacgttgataccgccgattccagaaaagcagtcaataaagaattatggtaagtcaataactggttcgagttcaaagtatttgctgccctcagaaggttctggttcagtagatctatcattgtctgtgatacatgcgtcggtcaataatagtgatgaaaagttaatacggcataggataagaatgctcactgagttcttgaacaaacttttgacgaacgaagaaatcacaaaaacatctataattaccgattttttggatcctaataaccataattggcatgaatttgttaacagttcgtccactttttcatctttaccgaagagcatcctccagtgtaatccactagatcccactaacaccactagaattcatgccatgttaccaataccgggctcctcgtcacagttattgttgaataaggagtccaacgacaaaaaaatggataaggaaagaagtaagtcgtttactaatattgaacaggattacaagcaatatgagaacttgttagataacgggatttataagtataatagacgaaccacgaagacttatcacgatttgaaatcggattacaatgaaatcggtgaggtatttgcacagtttgcccatgaacaggctcaagttggggaattggccgaacagctttcttacttaagcaatgccttttcggggtcctcgatttctttagaaaaattagttggaagactatactacaatataaatgagcctttaaatgaatctgttcatatggcaacttctgcaagagaattgatcaaatacagaaaattgaaatacctgcaaaatgaaatgattaaaaagtctctgaattccaaaagagcacagttggagaagctggaagcgcaaaacaatgaatataaggatgttgacaaaataattgacaacgaaatgtctaaaagtcatactattaatctggaacgccctaataataatacaggtagcggtgggaaatcatatggtggcaaactattcaatggatttaacaaattggcatcaatggtaaaagattctgtgaagtatcaagaaacagatccgcataccgcaagtatcaatttgaagaaagaaattgaacaactgtctgaatcattggaagttactgagaatgatttggaggtcatttcaaaagtcatcaaaaatgaccagctacctaaattttctaaagaaagggaagtagatttatcagaaattttaaagcattattccagatatatgagaaattatgcccgtcaaaatttagaaatttggaaagaagtcaaaagacatcaagattttgcatag

SEQ ID NO: 4347 - DNA, 1926 bp, Saccharomyces cerevisiae
atggatgttctcaaagaggtgttgtcactagaccaagataaatttgaccagctgaaggaaacgagccgagataaaacaaatgaaacggatgatccttttgaaaactatttgaaggattgtaaatttaaagcgccttcaaacaaagatcagtcaccatttgctaaacttaaatcattacaggaaactcattctaacaatgaagcggctattaatataattattcctcaattgattgattacttaaccgaattcactaataggttatcaaattacacacaagatttagacttcattaaaaaaaagtccaatgaattacagtcattgctcgaatacaactccactaaactggcacatatctctcctatggttaatgatttgatgattcctcctgaactcattgatgacatcattaaagggaagatcaatgaaagctggcaggataatataacattcatagcagataaagaagaaatttataacaagtataggtccaataatctcgatcaagacaacaaggacgcagaaaattcagcaatgctagcaccaaaggattttgataagttatgtcaactcctggacatcctaaaaaatgttattctagaaaggtcgaaaagacttattatttccaaaatcaaaactttgaggagtcataacccagtaccatcgcaaaggatacaaaacaaattattaaaagttcaaaaaattttccccttcataagagataataatctctccttagcccttgagttaagacaggcatattgttacacaatgaaatggtattatagagaatacttttctagatatatcaggtcattgactattttgcaatttcaacaaatcgactcgcaatttgcattgggtaatggcctttctacaacttcagtgagtgggtttaacaattcaccatcattgtttttctcaaattatctaactacatccgcttcaaatgctttctataataaactccctgtaacagatgagaaaattgataaatactttcagataaagaaaagattgaacattttaacacaagaagacaatacggtaatggtatcccaaattgcagaaaataacacaacgaaaaactacattgaaattggatttaaaaatttaaaccttgcaattttagataactgtacggtggagtaccattttttaaaagatttcttcgctatgaatggcgataattttgaggaaattaatggtttattggaacaaatatttcaaccaacttttgatgaagccacaacatacactcaacaactgatccaatataattatgacatttttggtgtattaataagtattcgtgtggccaatcaattacaatttgaatcagaaaggagaggaataccgtctatgtttgatagtttcttgaatggtcaattaattcaattatggcctcgatttcagcaattggtcgattttcaatgcgagagcttacgaaaagcggcaataactacaaatgtggcaaaatatgccggcaactcaagcacatccaatagtagccctttgacctcacctcatgagttaactgtacagttcggtaaatttttatcaagcttcttgacgttggcaataacacataagcagtccatagacgaaagatctgaacccttatacaattccatcattagattaagaaatgatttcgaaacagtcatgacaaagtgcagtaaaaagacgaaatcaccagaaagatttctggctacaaattacatgtatttatacaataacctacagcaattgcatctacatttaaatataaatgactcggatgcacaaaactacaattttgattctgctgaaaatgttggtacgaaagttgcgaatgacgacgataatgattcaagcgtaccactaataatcagagagaccgaaaatcatttcaaaactttagttgaagctttcaccagaaattga

SEQ ID NO: 4348 - DNA, 1926 bp, Saccharomyces cerevisiae
atgtacaacgagcaggtgaactctggaaagtctataaaagaaaaggaacgttatttggatgccctattgaaaatacttaaggataatccagttaccttaaaggaaattggctgggatctgccaaagggtttattgcagtttttctcacgcaaaaacatcaatgtcaatatacatctagtttttagtccccttgtttctagtgtgatggaatgcttcaatgagctagccatcaatggaaatccgaaagaatgcttgttgaccgcttgcgaattggtgtcaacactccatatagtcttaactgaaactggcgactccgatgaagagaatgaagatttaaatgactccaatagaaatgatgcgtcaaacattactgatgagctgtcagttatcactccggagattgggcactatatggccaaaaatacagtagaattcattccaaatttgaaaatttacgttctctttgaatttatgagtttattgttgaaacgtgtggacactttatatccatctaaatttctagccatggtaacttctgcaattattaagtatgtaacaaccaacgttcaggctatggatgatccacactttattttgcgcatagtgtacaatttttgtactaattactctccagctcaaccatctgctagtctgaccgatggtattagtacaaacgatcttgaaaaaattcatgatgatgaatctgccttacagaaaaaactactggctaatctgagcgtattcgtgattagcaactgcctaaaaaatcatccaggtaatattgacaagatatatttcaaaacattgatgcataaaaaaacagatgaaaatgaaatcgatgcttcagttttacagatatgccaccaatactacgagtatgtcacatcattggatgtccacatgaaagaacttttagaaaagtgcctggtagaatcaagaagcatctataactctcttctcatgaacccggccgcttccacgcccgaattcaaagaagaaattaaccaactagtatatgaggtatcttacgcatatcaaatcaagaaactagctgacgaaaagaacttagagctggaccaatatggagttgtgattctatctgcaatacattattctaaaaatggtactcacttattgccgcaaattgatatccaaagcgcaatttacctctatctacggtgtacgacagcttctttattttcagaaatatacgaaaataagtttttggaaagttcagtacgctactggctatgggtatccacaaccgagacttccacagagaaaataaagtgtgccttacaagaacttccagggcacattaccacggcctttttgcagatgttactgatgaaaacttgcaatgaatctaataacgacactaagttgaccgaaattactcttctgaggaggttactctatctcatgcccgaaagcacatcttttacgttcatctttgaaactctactacattgtccatatataactgcaaagattgctgttcttgacattctaagagatatgatgattagatctcctgaggctgctaatcgtgacgaaactgtcggtttaatcgaacaacagaatcctgggaataccgctaatagtgtaccgataatgccaactctacctccaagaccttacatcactattaatgaagatcgcatggcttccattcatagcattgctttaatatgtttttctgccgccaagcaaaagaaaagaacgcaaggtgatttactcttggtactaacatatatgaaattttttgttagtttaaggaacaaatgggatttgggtctgttaacactcatcaataaagaaatctccgaatcatttcaaggagaaggtgagcctgaattagcattcatcaacatttccaataatactctgggagaatatatagaagagatgaacatacgctcgtaa

SEQ ID NO: 4349 - DNA, 1929 bp, Saccharomyces cerevisiae
atgaaggaaacggcgcaggaatacaaggtgtctgctgtaataccgacccttttgaaaaactggatactgcgtgtagtgtatgccacattggaccatatacctccttttgtgtgggaaattctacatgtcatcaccgatatttatttcttctgggttcaaaagctgattaactatgtgcggccacactcaagagtcatttattataacgctattaagaagttagatgagtgtgatacgtatcaaatgtggtgtcagcaagcgtccgtagtggatgaaataacaggcgcaaatttatggcggcggaatttcttttcgaggaggtacgacttcaattctgtcattgaacaatatagcatattggaaaatatgttaagggaggagaagtatgatgtagttaaggagaagttttcgactacaggcccttgtatgttgaggaactttgcgggtattggagataaaaagttgttcacaaaatctttgatgggtacaaagctacttattgaacaatatttgacccgaattctagaaggcttggatatattaaataatcaaactttaactccaacatcctttttccaaagatgtaagttgtcactgggcacaacagcattaatcttgcaaggtggttcattgtttgggctgtttcaccttggggtgattagaggtttattgttacaggacctgatgcctaatattataagtggtagctctatgggggcatgcgttgcaagtttattcggttgcttgtccaatgagcaactaaagcaattattgaccgatgacaacctcttgaatatcatcaagaatgatgtagatttattaaaaagctgtggatacggtaatttagagcagcacctaaacctggggactttgattcagaacctaatacaccacggttattctcaagacgtttatctttttatccggtttgttatgaaatatattgttaaggaaaaaacttttgaagaagtttatcaaattactggaaaagttttcaatattgttattcatccaactgataaatcatgccctaatttactaaattatgtgacaaccccaaacgtattaatcaagtcagccattgaatgctcacttggttctggtgtaatttcagaggatacatcactattatgtaaaaatttagaaaatgaaattgagccttttcttaacatcaataaaaataaacaagtcaaatttcttaccccagaaaatgccaacaatccgagcataacggagagcccctatactaggttaacggaactattcaatgttaataacttcattgtttctttggcgagaccatacttggcaccattggtggtaaatgatttgaagcatgaaataaaaacgtcaaaatattactattataagcattatccaaatatgcctcctataaacgcgaatacagtaagaaaaacacagagatcctcttcgcaatcacccataaaggcaggaactgtcgaggatcttgagccagagcctttaatgagccctgtgcccccaagttcggcagtcaacgattcagcagagtacataatcccagaattgggcataccgcagttgaactttactgaaatggaaccgctggcgtttaaatttaagtatcatctggaaagaaaattaaaaaatattgccactatggaatttcgacataggatggaggtattggataatttaggcctgttgtgctcattaataaaaagactaataattgatgaaaagactcccagatcagctacggagattgctgtggtaccaaggatgaaaagtctatcattaacaaggattattgaaggtcaactaaacaacattccatactggataaaatctggtgaacgaagtacatggcccgcactagctttaattaagacaagatgtgcagtcgaatttaaattagacgacataataagagcaagacggagtaggtag

SEQ ID NO: 4350 - DNA, 1929 bp, Saccharomyces cerevisiae
atgacaaggctcaaagcaaaatattcacctacaaaaggtaaaagaaaagaagataaacatacaaaacgtatgcgtaaatcatccttcacaagaacgcaaaaaatgcttgaagtatttaacgataatcgctcgcattttaacaagtacgagagcctcgctatcgacgttgaagacgatgacactttcggaaacctagtcttaatggaaaatgataaaagtgatgtcgacatacctgtaatagaagaagtcacatcaagtgaagatgaacaaagggcagaatctagcaaaagaaacaattctctcgaagataatcaagattttattgctttttcggacagctctgaagatgaaacagaacaaataaaggaagatgatgatgaaagaagcagttttctgttgaccgatgaacatgaagtttctaagcttacttcacagcaatctctgaacactgaaagcgcttgcaatgtggagtatccttggataagaaatcattgtcattcgaaacaaaggagaatagcagattggctaacttcagaaatcaaagatttcgttcattatatctctccaagcaagaacgaaatcaagtgcagaaatagaacgatcgataaactacgccgggcggtcaaggaactgtggtcggatgcagatttgcatgtgtttggttcttttgccaccgatttatatttgccgggttctgacattgactgtgtcgtaaacagccggaatcgcgataaagaggacagaaattacatttatgaattggcgagacatttgaaaaacaaagggctagctataagaatggaggttattgttaaaacgcgagtgcctattatcaaattcatagagccccaatcacagttacatatcgacgtttcatttgaaagaacgaacgggttagaggctgcaaaactcatcagggaatggctaagagactctccagggttacgtgaactggtactgataataaaacaatttttgcattcaagacgattgaacaatgtgcacacaggaggattgggaggtttcacagtaatctgtttggtttattcttttttaaatatgcatccgcgaataaaatcaaacgatatcgacgttctagataacctgggtgttctactgattgacttcttcgaactttacggaaaaaattttggttatgatgacgttgctataagcatatctgatggttacgcctcttatattcctaaatcgtgttggagaactttggaaccttcaaggagtaaattctcgctagctattcaagatcctggtgatcctaacaataatataagcagaggctcctttaatatgaaggatataaaaaaggcctttgctggtgccttcgaactgttggtcaataaatgctgggaattgaattctgctacattcaaagaccgcgttggaaaaagtatactcggaaacgtgatcaaataccgtgggcaaaagagagatttcaacgacgaaagagatttagtgcagaataaagccatcattgaaaacgagcgctaccacaagaggcgcacgaggatagttcaagaagatttatttataaacgacaccgaagacttgccagtagaggagatctacaaacttgacgaacctgcaaagaagaaacagaaggcaaaaaaggataagagagaaggggaaatcaaaaagagtgccattccatctccacctccggattttggagtgagcagaagcaaattgaaacgcaaagtgaaaaaaactgatcagggctctctcctacaccaaaacaacctcagcatagatgacttgatgggactttctgagaatgatcaagaatccgatcaagatcaaaaaggaagagataccccttcgggacaagatgagaaatcaccactggaaactaagacagtagatgctcaaacgagaagggactactggctctctaaaggccaggctctttaa

SEQ ID NO: 4351 - DNA, 1929 bp, Saccharomyces cerevisiae
atgagcccgaaaaacaaatatgtatatatctgtgtagaatatatatatatatatttcgcaaaaatacataaacaatcaaccctctcctcagacactactaagatgtttgtactgatagataatgtcctcgcctaccttcttgaacaagacgacctatttgtaaccgcacgcttcgctatccagggccaaatcgtctcaagaagagttaacaaaatacatatctccaacatcacagacgtccttctacaacaattcataagtcacacactgccctataatgacaatatcgtcccaaaaaaaatcctcgacagcatgagaacggccgtacggcagttgctggaagcaactgcctgtgtctctagagaatgccccctcgtcaaaagaagtcaggacataaaaagagcaagaaaacgtctactcagtgactggtataggctcggcgctgatgcaaacatggatgccgtattactagttgttaactccgcctggaggtttctggccgtctggcgacccttcgtaaactcaatccaacatgcaactcaggaattgtatcaaaatatcgcccattaccttcttcatggcaacgtaaatatacagagggtcacagcactaatacagctcgtaatgggacaggacgatttactttttagtatggatgatgttctacaagaggtcttcagaatacagctctatttgaataagatgctgccgcacaactctcacaaatggcaaaagccatccccctttgactccgcaaacttactacttaacttcagagactggacaactgacaatgctctcctccaagagttgctactatcctatcccacaattaataaaaacaaacacaaaaatcactccgtccctcgtctaatacaaatctgggtagagtcttattggcaagatagtgagacaacattaaaagatatcctcaatttttggtacagtcacttggctgaatattatgaataccaagaactgtttgcagacatagttcagctgtttataaacaaaaaaagaacgaggcaattgaagattcattacattggtctaactgataaggaaatcgaagaaaataaaccgcccctggactacgaaaacttatttctccaatacgagatagacaaaacgaacgcaaatgatgaattgtgcggtgcaactgacctcagtgatttacttttccaatggaaacagggtgaacttctagaagtcgaagccttcgctctaaacgtatctccatggtcacttgcaaagacattgactctcttagaatcttctctttacttggatattgaaacaatagaattcacaagacatttcaaacacaacgatacaacaattgactccgtgtttacgctttccaaccagttatcgtcctacgttcttgagacaactttgcagcaaacgcacaccatttcctactggttacaagttgcactgtcttgtctatacttacgaaacttaaactcacttgcttcaatcattacatcattgcaaaatcattcaatagaaagactatctctcccgatagatgttaaatcagaccacctttttcagcgcctaaaagtcgtcgtacatccaaacaacaactacaacgtttatagaagaacaattaaacatattttccacagtcagcttccttgtgtaccttttacatcactgcttatcagggacattaccttcataagagacggaaacgatacattcactaaagatggtaataacgtgaatatgcaaaagttcaaccaaatcacaaagatagtcgcttttgcgcaatatttacaacaaaagcaatatgaagatatacactgttcaaatactactgcaagaagcttattaggggctatgataaaggtgcacactttatataacgacaacaaagacagggcgtatcaagtcagtatagctaaggttccaaggcttacctaa

SEQ ID NO: 4352 - DNA, 1929 bp, Saccharomyces cerevisiae
atggacaagaagaaggatctactggagaacgaacaatttctccgcatccaaaagctcaacgctgccgatgcgggcaaaagacaatctataacagtggacgacgagggcgaactatatgggttagacacctccggcaactcaccagccaatgaacacacagctaccacaattacacagaatcacagcgtggtggcctcaaacggagacgtcgcattcatcccaggaactgctaccgaaggcaatacagagattgtaactgaagaagtgattgagaccgatgataacatgttcaagacccatgtgaagactttaagctccaaagagaaggcacggtataggcaagggtcctctaactttatatcgtatttcgatgatatgtcatttgaacacaggcccagtatattagatgggtcagttaacgagcccttcaagaccaaattcgtgggacctactttagaaaaggagatcagaagaagggagaaagagctaatggccatgcgcaaaaatttacaccaccgcaagtcctccccagatgctgtcgactcagtagggaaaaatgatggcgccgccccaactactgttccaactgccgccacctcagaaacggtggtcaccgttgaaaccaccataatttcatccaatttctccgggttgtacgtggcgttttggatggctattgcatttggtgctgtcaaggctttaatagactattattaccagcataatggtagcttcaaggattcggagatcttgaaatttatgactacgaatttgttcactgtggcatccgtagatcttttgatgtatttgagcacttattttgtcgttggaatacaatacttatgcaagtggggggtcttgaaatggggcactaccggctggatcttcacctcaatttacgagtttttgtttgttatcttctacatgtatttaacagaaaacatcctaaaactacactggctgtccaagatcttcctttttttgcattctttagttttattgatgaaaatgcattctttcgccttctacaatggctatctatggggtataaaggaagaactacaattttccaaaagcgctcttgccaaatacaaggattctataaatgatccaaaagttattggtgctcttgagaaaagctgtgagttttgtagttttgaattgagctctcagtctttaagcgaccaaactcaaaaattccccaacaatatcagtgcaaaaagctttttttggttcaccatgtttccaaccctaatttaccaaattgaatatccaagaactaaggaaatcagatggagctacgtattagaaaagatctgcgccatcttcggtaccattttcttaatgatgatagatgctcaaatcttgatgtatcctgtagcaatgagagcattggctgtgcgcaattctgaatggactggtatattggatagattattgaaatgggttggattgctcgttgatatcgtcccagggtttatcgtgatgtacatcttggacttctatttgatttgggatgccattttgaactgtgtggctgaattgacaagatttggcgacagatatttctacggtgactggtggaattgtgttagttgggcagacttcagtagaatttggaacatcccagtgcataagtttttgttaagacatgtttaccatagttcaatgagttcattcaaattgaacaagagtcaagcaactttgatgacctttttcttaagttccgtcgttcatgaattagcaatgtacgttatcttcaagaaattgaggttttacttgttcttcttccaaatgctgcaaatgccattagtagctttaacaaatactaaattcatgaggaacagaaccataatcggaaatgttattttctggctcggtatctgcatgggaccaagtgtcatgtgtacgttgtacttgacattctaa

SEQ ID NO: 4353 - DNA, 1929 bp, Saccharomyces cerevisiae
atggtgcacattactctgggtcaagcgatatgggtgtcagttaagccgataatcaagatttatttgattataggagtcggctttctgatggctaaaatgggaattcttacggttgaagcaacaagaattatttctgatatcgtgctaacagttttactaccctctctgtcattcaacaagattgtcgctaatattgaagataaagacatcaaatctgtgggaattatctgtctgtctgccctcctaatatttggttctgggttcttttttgcatacgttgttaggctattcctgcctgttcctaaacaatggtacggtggtattcttgccggtggtatgtttccaaatataagtgatttaccaattgcatatttacaatctatggaccaagggcttgtattttcggaagaagaaggtaacaaaggtgtggctaacgtcattatatttctgacaatgtttctaatttgcattttcaatttgggggggtttcgactgattgaaagcgatttcgagtacaacgacgatgaaagcgccgttagggtttcagaaacgacaaagacacagcccgcagtaagtgcaaacacaactaatacagatactagcgagcgtttcttctcaaacgaacaacagcttttcaacaataagtacaccgctcgcgatagtctcactgaagctataggtacaaagggtgaaaacgcagacgtaccaccaatttcaaggagatcaacaaatagtatagctcccctgtcactaccagacacttcttcgaattcaaagattacaaaaccagttcaggtgaaggcaagaaatactattgcgtgcactcaaagcgaagagtcacaggcaactcgtggttcaaatccattagatagccaatcatctgcttcaacaatacattcttataatacgtcagagagttatgagagtagcatagatactatgagagcacgtagaaccgcgagccagccgagagcttacaatactaccacactcctagaagagaactgtttagatgaaaaatgcccaaaaaatatgtctatggcggcattggaacctatccgctccattgatatgcgtgcattaccttctcaaaatatacaccatcttatcagagagtactccaacgttgaccagtatggtcatcaaaggaggaattccagtttacgcggcgctgatatgaatgatgtgcattcaattagctcaaattccactttacagactataaaaactgctaacctaaccaggatcttaacatcagatgccactgtaagtaaaaaggatattgaaacatccggcgaatcattaccacagtggatgagaaaattttcattaactccattacttgtgtttttcctaaagaattgtttgagaccgtgctctatggccgtgatcatcgccctaactgttgcatttatcccatgggtcaaggctttgttcgtgactaccgctaatactcctcacataagccaagctcctgacaatgcaccaccattaagctttttcatggattttacaggttatgtcggtgccgcatgtgttccatttgggttgatattattaggagcaactttaggaagattaaagattggcaacctttatcctggattttggaaagccgctgtgacactcgtcattttgagacaatgtgtcatgccaatttttggtgtcctatggtgtgatcggttagtgaaagctggatgggttaattggcaagatgatagaatgctactatttgttatagcaatcagctggaacttgccaacgatgactacccttatatatttcaccgccagttttacgccgccagaaacaactgcgccaatccaaatggagtgtgtttcatttttcttaatgctgcaatacccgctaatggttgttagcttgccatttttagtgtcttactttctgaaagtacagatgaacctttag

SEQ ID NO: 4354 - DNA, 1929 bp, Saccharomyces cerevisiae
atgtcaaaagctgtcggtattgatttaggtacaacatactcgtgtgttgctcactttgctaatgatcgtgtggacattattgccaacgatcaaggtaacagaaccactccatcttttgtcgctttcactgacactgaaagattgattggtgatgctgctaagaatcaagctgctatgaatccttcgaataccgttttcgacgctaagcgtttgatcggtagaaacttcaacgacccagaagtgcaggctgacatgaagcacttcccattcaagttgatcgatgttgacggtaagcctcaaattcaagttgaatttaagggtgaaaccaagaactttaccccagaacaaatctcctccatggtcttgggtaagatgaaggaaactgccgaatcttacttgggagccaaggtcaatgacgctgtcgtcactgtcccagcttacttcaacgattctcaaagacaagctaccaaggatgctggtaccattgctggtttgaatgtcttgcgtattattaacgaacctaccgccgctgccattgcttacggtttggacaagaagggtaaggaagaacacgtcttgattttcgacttgggtggtggtactttcgatgtctctttgttgtccattgaagacggtatctttgaagttaaggccaccgctggtgacacccatttgggtggtgaagattttgacaacagattggtcaaccacttcatccaagaattcaagagaaagaacaagaaggacttgtctaccaaccaaagagctttgagaagattaagaaccgcttgtgaaagagccaagagaactttgtcttcctccgctcaaacttccgttgaaattgactctttgttcgaaggtatcgatttctacacttccatcaccagagccagattcgaagaattgtgtgctgacttgttcagatctactttggacccagttgaaaaggtcttgagagatgctaaattggacaaatctcaagtcgatgaaattgtcttggtcggtggttctaccagaattccaaaggtccaaaaattggtcactgactacttcaacggtaaggaaccaaacagatctatcaacccagatgaagctgttgcttacggtgctgctgttcaagctgctattttgactggtgacgaatcttccaagactcaagatctattgttgttggatgtcgctccattatccttgggtattgaaactgctggtggtgtcatgaccaagttgattccaagaaactctaccattccaacaaagaagtccgagatcttttccacttatgctgataaccaaccaggtgtcttgattcaagtctttgaaggtgaaagagccaagactaaggacaacaacttgttgggtaagttcgaattgagtggtattccaccagctccaagaggtgtcccacaaattgaagtcactttcgatgtcgactctaacggtattttgaatgtttccgccgtcgaaaagggtactggtaagtctaacaagatcactattaccaacgacaagggtagattgtccaaggaagatatcgaaaagatggttgctgaagccgaaaaattcaaggaagaagatgaaaaggaatctcaaagaattgcttccaagaaccaattggaatccattgcttactctttgaagaacaccatttctgaagctggtgacaaattggaacaagctgacaaggacaccgtcaccaagaaggctgaagagactatttcttggttagacagcaacaccactgccagcaaggaagaattcgatgacaagttgaaggagttgcaagacattgccaacccaatcatgtctaagttgtaccaagctggtggtgctccaggtggcgctgcaggtggtgctccaggcggtttcccaggtggtgctcctccagctccagaggctgaaggtccaaccgttgaagaagttgattaa

SEQ ID NO: 4355 - DNA, 1929 bp, Saccharomyces cerevisiae
atgtcaaaagctgttggtattgatttaggtacaacctattcatgtgttgctcattttgcaaacgatagggttgaaattatcgctaacgatcaaggtaatagaacgacgccttcttatgtggcttttactgacacagaaaggctaattggtgacgctgcgaagaatcaagctgcgatgaacccacataatacagtattcgatgctaagcgtctgatcggacgtaaattcgatgatccagaagtgacgaacgatgctaagcattacccattcaaagtgattgacaagggaggtaaaccggtagtgcaagtggaatataaaggcgagacaaagacatttactccagaagaaatttcctcaatgatcttgacaaagatgaaggagactgctgagaactttttaggaacagaagtgaaagatgctgtagtaacggttccagcctatttcaacgattcacaaaggcaagcaacaaaagatgccggtacaatcgcgggcttgaacgttcttcgtatcattaatgaacctacagctgccgctattgcgtatgggctggacaagaaatcgcagaaggagcacaacgtcttgatctttgatttaggtggtggtacttttgatgtctctctgctatccatagatgaaggtgtctttgaggttaaggctactgctggtgacactcacttgggtggtgaagatttcgatagtaggctggttaactttctagccgaggagttcaaaagaaaaaataaaaaggatctaacaactaaccaaaggtccctaaggaggttaaggaccgccgctgaaagggccaagagaactctgtcttcgtctgctcagacatctatagaaatagattcattatttgagggtatcgatttctatacttccattacaagggcaagatttgaagaattatgtgctgatttgtttagatctacattggagccagtggaaaaagttttggctgattcaaaattagataagtcacaaattgatgaaattgtacttgttggtggttcaacaagaattccaaaagtacaaaaactggtttctgattttttcaatggtaaagaaccaaaccgttcgattaaccctgatgaggccgtcgcttatggtgctgccgtacaggctgccatcttaacgggtgaccagtcgtcgacgacccaagatttactgttgctggatgttgcaccattatctctaggtattgaaactgcaggtggtattatgacaaagttgatcccaagaaattcgactatcccaacaaaaaaatcggaagtgttttccacctacgctgacaaccaacctggtgtgttgatacaagtttttgagggtgaaaggacaaggacaaaagacaacaatctactgggtaaatttgagttgagcggtattccacccgctccaagaggcgtaccacaaattgaagttacatttgatatcgatgcaaatggtattctgaacgtatctgccgttgaaaaaggtactggtaaatctaacaagattacaattactaacgataagggaagattatcgaaggaagatatcgataaaatggttgctgaggcagaaaagttcaaggccgaagatgaacaagaagctcaacgtgttcaagctaagaatcagctagaatcgtacgcgtttactttgaaaaattctgtgagcgaaaataacttcaaggagaaggtgggtgaagaggatgccaggaaattggaagccgccgcccaagatgctataaattggttagatgcttcgcaagcggcctccaccgaggaatacaaggaaaggcaaaaggaactagaaggtgttgcaaaccccattatgagtaaattttacggagctgcaggtggtgccccaggagcaggcccagttccgggtgctggagcaggccccactggagcaccagacaacggcccaacggttgaagaggttgattag

SEQ ID NO: 4356 - DNA, 1929 bp, Saccharomyces cerevisiae
atgtcacattccggagctgccatttttgagaaagtttctgggataattgccataaatgaggatgtttcacccgcagaattgacatggaggtctacggacggtgacaaggttcacacagttgtcttatccactattgacaagttacaagctacccctgcttccagtgaaaaaatgatgttgaggctaatcgggaaagtggatgagtcaaaaaagagaaaagacaacgaaggaaatgaggttgtgcccaaaccgcaacgtcatatgttttcgtttaacaatagaacagttatggataatatcaagatgacccttcaacaaatcatctcacggtataaagatgcagatatctacgaagaaaagagaagaagagaggagtctgcgcaacacacagaaacaccaatgagctcttcttctgttactgcagggactcccacaccacatctcgatacaccacaattgaataatggggctccgttgattaatacagccaaactagatgattctctctctaaagaaaaattgttgaccaatttaaagctacagcaatctttactgaaaggaaacaaagttctaatgaaggtttttcaggaaacagtcattaacgccggtttgcctccatctgaattttggtcaactagaattccgttattgagggcttttgccttatctacttctcaaaaagttgggccttacaacgttttgtcaactatcaagccggtggcttcatcggaaaacaaagtcaatgttaatttgtcaagagaaaaaattttgaatatttttgagaactatccaattgtaaagaaagcttacactgataatgtgcccaaaaatttcaaagaaccagagttctgggcaaggttcttctcttcgaagttattcagaaaattaaggggtgaaaagatcatgcaaaatgatagaggtgacgtaatcattgacaggtacttgacattggatcaagagttcgacagaaaagatgatgacatgctattgcatcctgtgaaaaaaattatagatttagatggtaacatacaggacgacccagttgtacgaggcaacaggcccgacttcactatgcagccaggtgtggatattaatggtaatagcgatggtaccgtggacatcttaaagggtatgaatagattgagtgaaaaaatgattatggctttgaagaatgagtattcaaggacaaatctacagaacaaatctaatattacaaacgatgaggaagatgaagataatgatgaaagaaatgaactgaaaatcgatgacttaaacgaaagctacaagacaaactatgcaatcatacatctgaaaaggaacgcacatgaaaagacaaccgacaacgatgcgaaaagctcggcagactcgataaagaatgcagatttgaaggtttctaatcaacaaatgttacaacagttgtcattggtcatggataatttaattaataagctagacttgaaccaagtagttcctaacaacgaagtcagcaacaagatcaataaaagagtcataactgcaatcaagattaacgccaaacaggctaagcataacaatgttaattcagcactcggctcttttgtcgacaacacttctcaagcaaatgaattagaggtgaaaagtaccctaccaatagacctattagaaagttgtagaatgctacacacaacgtgctgtgaatttctaaagcacttttatattcattttcagagcggtgaacaaaagcaagccagtaccgtcaaaaaactttataatcatttgaaggactgtattgaaaagctgaatgagctatttcaagacgtccttaatggtgatggtgaatctatgtcaaacacatgtaccgcctatttgaagccagttttgaactccattactttggctactcataagtacgatgagtacttcaacgaatataacaacaattcgaactag

SEQ ID NO: 4357 - DNA, 1929 bp, Saccharomyces cerevisiae
atgtcatctcagtttttcctgaaaacctctcaggatatagagctcttccaaagctacccaacttttgagcaatccaacacaaactccaaggatttccctgtcatttcctcggttttatcgccatgtggcagatttttggctttatctacgaaggagaacgtcaaagtttttacaggtccatgtttggataacgttctattaacaatgaagttgtccgacgtctatgacctacacttctctccagcaggtaactacttaagcacttgggagagagcgtctatacaagacccaaatcacaagaacgttaaagtttggtatttgaataaaccatttaagaaagattgcgtttcggaggatatagtccctgcttacgaatatcaagccaaatcccaaagcggttggtttttacaattctccaaattagacaattatgggctaagactttttaaacacgacttgaagattgttaaattaagctccgctaatgccgacaatttcgacttccaatctccgtttgctgtcttgtctgatgatgaaacgtcccaacatttcaccacctacctaatctctccagctgaacatccaacaatttgtactttcacaccagaaaagggtggtaaaccggctcaattaatcatatgggccctctctgaaggtaaaatcaccaagaaaattgcctccaaaactttctttaaagctgattcctgccaattgaaatggaatccattaggtaatgctattttatgtttagctattactgattttgattcctcaaacaaatcatattatggtgaaaacacactatacttactgtctttccaaggtgtcaacgggactttgggtggtaactctgtacgtgtttctttaaccactggacctgtccacgatttcacttggtcgccaacttcaaggcaattcggtgtcatcgctggttacatgccagcaaccatttccttttttgacttaagaggtaatgttgtccattcattacctcaacaagccaaaaataccatgcttttctctccctctggtcattacattcttatcgccgggtttggtaatttacagggctccgtggaaatcctagatcgtctcgacaaattcaagtgtgtgagtaaatttgacgctaccaacacttctgtctgcaaatggtcaccgggtggagaatttatcatgacagctaccacttcaccaagattgagagtggataacggcgttaaaatatggcatgtatcaggctctttagtatttgttaaagagttcaaggagcttttgaaggtagactggaggtcaccatgtaattacaaaactttggaaaacaaagacgaagcatttttcgagaaccatatcattaataactgggaaccgctacctgattcgaccacatcttcacttgatcctaaaatatccaataaatcagaattgcaaatacattctagcgttcaagagtacataagtcaacacccaagcagagaagcaagctccaatggaaacggatctaaggccaaagctggaggcgcttataaaccacctcacgcaagaagaacaggcggtggacgtattgtccccggagttcctcctggtgcagcaaagaagaccatcccagggctagttccgggcatgagtgccaacaaggacgccaacaccaagaacaggagaagaagagccaataaaaagtcaagtgaaacgtcacctgattctactccggccccatctgctcctgcctccacaaatgcccccacaaacaataaagaaacttctccagaggagaagaaaataagatctttactaaagaaattaagggctattgaaaccttgaaggaaagacaggccgtcggtgacaaactagaagatacgcaagttctaaaaattcaaactgaagaaaaagtgttgaaagatttggaaaagttgggttggaaggatgaataa

SEQ ID NO: 4358 - DNA, 1932 bp, Saccharomyces cerevisiae
atggattctcctgttctacagtccgcttatgacccatcaggtcagtatttgtgttatgtcactgtagctttggacaagcaacgcgttggtgtacagcccactcaaagggccacttcctccggagttgatacagtgtggaatgagaattttctgtatttagaggactcgaaattgaaggtgacgtgcttaaaatgggtaaacctggcttcttccgacacagtggctattatattgggtatgaataacggtgaaatttggctatattccgtattggccaacgaagtcacctataaattcactacggggaattcttacgaaatcaaagacatagacttgatgggtaatcaactgtggtgtatcgactccagcgacgcattctatcagttcgatctgttacaattcaaactgttacaacattttagaataaacaactgcgttcaattgaataaactaaccattgttccagcaggcgattctgttgcacaacttttggttgcatcccattccatttctttaatagacatcgaagagaaaaaagtcgtaatgacatttcccggtcatgtatctccagtgtccacattgcaagttataactaatgaatttttcatatcaggcgcagagggtgatagattcttgaacgtatatgatattcattccggtatgaccaaatgcgtccttgtggctgaatcagatatcaaggagttatctcattcaggccaagccgattctatcgcagtcactaccgaggatggtagcttggaaatttttgttgatccattggtatcgagttcaacaaagaaaagaggcaacaagtccaaaaaatccagcaaaaagattcaaatcgtcagtaaagacggcaggaaagttccaatttataacgcatttattaataaagaccttttgaacgtatcgtggttacaaaatgctactatgccttacttcaagaacttgcagtggagagaaatccctaatgaatataccgtcgaaatttccctaaattggaataataaaaataagtccgccgatcgcgatctacacggtaaagatcttgcctcagccaccaactacgtggaaggtaatgcaagagtcacctctggagataacttcaagcatgttgatgacgctataaagagctgggaaagagaattgacttctttggaacaagaacaggccaagcccccacaggccaatgaactattaacagaaacatttggtgataagctagaatcaagcaccgtcgcaaggattagtgggaaaaaaacaaatttaaaaggttccaatctcaagactgctacgacaaccgggacggtaacagtaattctgtcgcaagcactacaatcaaatgatcattcactgttggaaacagtgctcaataatcgtgacgagagggtcattagggatactatcttccgtctgaaaccagcactggctgtcattctcttagaaaggttggcagagaggattgcaagacaaacccaccgtcaaggcccattgaatgtttgggtaaaatggtgtttaatcatacacggtggctatttggtttctattccaaatttgatgtctactctatcgtcgttacattccaccttgaaaaggcgttccgacttattaccaaggctactagcactggatgcaaggttagactgtactataaataaattcaaaactttgaactatgaagcaggcgacatccactcatccgaaccagttgtcgaagaggacgaagacgacgttgaatataacgaagaactcgatgatgccggccttatagaggacggtgaagaatcttatggcagtgaagaagaagaagaaggtgatagtgacaacgaagaggaacagaagcatacctcatctaagcaagatggccgtttagaaacggagcagagcgacggcgaggaggaagccggatatagtgacgttgagatggaatag

SEQ ID NO: 4359 - DNA, 1932 bp, Saccharomyces cerevisiae
atgggttcgggcgatactagaggagaaagctctctggtagctaaaccaatcgaaattatacttaataagctaccacatgccatactagcgcaacaacaatttcaaaaatatataacgagccccatctacagatatctttccaaacttctactgttcagagaggtggcttggcccgaaagtacaaaagatacccagaaaggacaagtagggatattttcctttcaaaacaattatgcagactctgcaacaactttcagaatacttgctcatttagatgagcagcgatacccgctacccaacggtgccgctgaaaagaatttaccttctttatttgaaggattcaaagctaccgtttccatcattcaacagagactgttgttagacaatgtagacggggccacgaatagtgataaggaaaaatacgttcaattgccggatattaatactggttttgtgaataaaacgtactctagaattgacctaacacatttacttgaggatgtagaaactaacgtggaaaatctgtcaatcaataaaacgttagagatggatgagttgaccagattagattccatgatcaacgaactagaatccaggaaattaaaaatcctggaaagggttaagcacattgatagtaagtctaccaatcttgagaatgatgtaacactgataaaggatagaataaattttatcgaggaatacaatttggaagctgatcgtgaacagagcttacggaagcaaatggaagaagaaagatcatctgaagcgtcgtccttcacgcaaaatgaagaagccatatcgtcgttatgtgatgttgaaagtaaggatacgagattaaaagatttttacaagatgccccatgaaaaaagccacgataaaaacaggcaaattatctcagaaacatatagccgaaataccacggctttcagaatgacaataccccatggcgaacatggaaacagcataaccgcattagactttgatacaccatggggaaccttgtgctcatcaagctaccaagatcgtatagtaaaagtgtgggatttgaaccatgggatacaagttggagagctgcctggtcaccttgctactgttaattgcatgcaaatagataagaaaaattacaatatgttgattactggaagtaaggatgccactctgaagttatgggacttaaatctgagtagagaaatatatttggaccatagtccattgaaggagaagacagaagaaattgttacaccatgtatccataattttgagttacataaagacgaaatcacagccctgtcttttgattctgaagctttggttagcggatctagggacaaaaaaatattccactgggatttaacgacgggcaaatgtattcagcaacttgaccttatcttcacacctacacatagcgacattaaaatgcctgcacgttcattaaacaatggtgcatgtttacttggcacagaagcaccaatgataggagccctccaatgttacaactctgcattagcaacaggaacaaaagatggcattgtgcgactatgggatctaagagttggcaaaccggtgagattactagaaggccataccgatggaattacaagtttgaagtttgattccgaaaaattggtaacaggctcgatggacaatagcgtaaggatttgggatttgaggacaagctcaattcttgacgtgattgcttacgatttaccagtatcgtccttagatttcgatggtaaattaatcactgttggcgcaaacgagggaggggttaatgtctttaacatggagcgcgatgagcattggatgactcctgaaccaccgcattcactagatggggatgagctgagcagaagaattgctattgtcaagtataaagacggatttctgatcaatgggcacaacgatggagacatcaatgtatggacactttag

SEQ ID NO: 4360 - DNA, 1932 bp, Saccharomyces cerevisiae
atgtggaaattcaacaaaaagctcgcccgtcttacttaccgtctttattcaagctcaggcccaagctcgccccttcatgggaagaagaaactgccgcaaaatctgaaattcgtcgtcttgaaccctacccaatctgggctagtgaaaaatgatcagaagcagcctagacacaggccgtctaagaaacgtagccataaggaaactggagataacaacctcgatttcggctcgaaactccttgtcttcgaaaagcagaattcactagattccgcattgaactccatccgattgaagaaaccgacaagcgccagtctgccctccctggaatacaatgcccttctccaatcgcttacatcaagctacaatcgctaccaactgcgcgagttcatctccacacatcagccagactcctcttcacatctgacgcactggaagaaaagcaagctgtcccaatatataattgaaaaaatctggaattgccaaccaatttcaacacccaccactcccacaggcatcaagtccacatcattgactttccagttcgattctcctagagaaattttccttttactcatcactcaaaatggtaaaatactcaccaacttcaataagctcgggctgacattcatcatctccattcaggataacgaattgaccgtcaagggttcgcctagcttgctcaaatacgcagaaatatccttaaacaaaatatggtcaaacatcactcatgaaaatgtgcgtatgtattccctcatgccatcaaaagacgtcatcaaccttattcagaaggaaactcacactttttttgaatacctcccggacttgcaaatgtacaagatttcagccctaagcaccaagaaaatatccatggccaaagtctttttattaaatgccgtcgcttctaatcctaacacaactcaacaccaccacacaatagcctcaccagcactcaagacagaactctatccgttcaacaatactctagagaacttggactggctaaacaagtcacaagattgggcaagattacagtcagttgtccctaaaaattgcacagatctgatgactcccactgaaaacgccacaccagaattgacagatgcgcaggtcagccaattcgaatcttccttgtctaaaaatataccatctctctccccttccgactctatttcccaatctttatcaataacgctaggtcactccttacagtccgcgtctttttctagtattttccaacctctaatacataagagttttatttcaaaattactgaatctaccaatgtacaaagaatcatcatcatcagccgtacctgtgcctgtgcctcttgatcaacatctaataacaaatgcgcatcaatccttcatacagctgaacttcactcctgtgccgcccacctctggctcctcctcgtccccttttttgcagatttggttcgagattgacgaattcgataacattgttaccacctcaatgaggcctcttttgaaattacaagaaaattctgttatcttaagaactccacaatgccagacagactataagatcacgtcagattacattcaagatcttttacctgatttcgaccagaccaatccggatgcttggttatctgaacaaaaaggcctccaagaatttcttctcaagtcacactggaagttaaacaaatatcagaatcttatgaaaaaaatcaacatttctttaccagataacctaatacagcaataccaattgactgatgttttgacccatcgtgtcttgaatttacgatttcctacgaacactgcccaagatgataaatacatcattcaatattcagatatcagccgcggatttttgaacaatggctcctacagacaattagatttcatcaatgtgaaccccagtgaaacctcactaaaaacctttatcaatgatgttttaagcttttaa

SEQ ID NO: 4361 - DNA, 1932 bp, Saccharomyces cerevisiae
atgttcgggatagtttatctgaagaatcgcagtttactctgcaagaaccccttttcttcttaccctcgttatggcttcatgccctcgttcgacacccagttcagcaaccaatttcgtaaattagaaattaatattggacggaaaagatacagctcaaaaaccttgaatacaaaatatactgaccaacccgaaggcccaatttatcctttggatgtactacgcctagacatctcaaaagcactgcatgatatatccggaatagaccactcgctaatactaaatgcgcttgagtcgacaaatagtatggatagaggtgatctactgctacctcttccaaagataaaagtggctgaccctgtggccgttgccaaccgatgggccattgaactaagcacgcatgggtgtattggaaaggtttgtgcaaaagggccatttcttcagttcttcctggaccagcggtatttgatacaatcaacggtaccaaatatattacttcaaaaggggaaatatggtcagaaaaaatctcgtcatcagaaaaaagttgtagtagaattttcatcaccaaatattgccaaaccattccatgcaggccatttaagatcgactataataggtggattcctttcaaacttatatgaagcaatggggtggtccgttacacgtatgaactacctaggagactggggcagacagtttggtttgttagcagtcggttttaagagatacggcgatgaaaagacgttacaaaagcagccaattcagcatttattcgacgtctacgttaaaatcaacatggaccttgccaaggaagagataaacggaaactctaagtgtgggattagcggtgaggcccgtagttttttcaaaaacttagaaaatggggatgagaatgccattaagatatggaataggtttcgctcgttatccatccaccactatatccaaacttattcacgtttgaacattaattttgatatattctccggtgaatcacaagtgtctaaagaatctatgaatgaagccttagatatatttcgcaaaaacaatcttgttaaagaaatagacggtgcccttgtcatcgatttaacccaatggtcgaaaagattgggcagagttgttgtacaaaaatcagacggaacaactttgtacttgacaagagatgtaggggcagccatagagcgtaaaaagaatctacattttgataaaatggtgtacgtgatttcctcacagcaagatttatacatgtcccagttttttatgatattaaaaaaaatgaattttgaatgggcaaaagacttgcagcatataaattttggtatggtgcagggcatgtcgaccagaaaaggaaatgtggtattcttagataccatactagacgaggcaagggataaagctctgcaaattatggaaaataacaaaatgaaaatatctcaggtagataatccacagcgtgttgcagatttaattggcgtatctgctatcattattcaagatatgaaatcaaagcgtatcaataactatgaattcaactggaacagaatgttgtctttcgaaggtgacacagggccctatttacaatacacacattccagacttagatctttagaaaggacctccagcgactttacgacggacatgctaatacacgcagatttttcaaatttaaatgaaccacaactagttgagcttgtgaggttgctagcgcagtatccagatgtccttagacgagcattcgaaactcaagagccggccacgattgtaacatatttattcaaagtttgccatcaggtctcctcgtgctataaaaaaatatgggtttccggaaaacctgcagatattgccataccgcgactcgccgtatattcagcaagtagacaagtgttacacaatgcaatgtcgcttttgggactagtcccggttgatagaatgtaa

SEQ ID NO: 4362 - DNA, 1935 bp, Saccharomyces cerevisiae
atgaagagaaaaactgctgaagttaaaggtgagaaggagagaaattccaaacaaatttccctcgaagaggacaagataaagggtatgttcaaccctaaaatctgggacaagactttccaggatggcttgaaaaaggaaattgaagactctcagccttacaactggggtactattcatgaattggttaatgacgatcttctacgtgctgttcgtaaagaaatagaaactgagatccatttcactaaaaaagaaaccgatatctatagagtcaaccaaagtggtgacttggccaatttgtctggtctggactgggatgacttgtcccgtttgcctaatttgttcaagctgcgccagattctgtattccaagcaatatcgagatttttttggctacgtcaccaaagctggtaaattgtctggttctaagaccgacatgagcatcaacacttacacaaagggatgtcacttgttgactcatgatgacgttattggctctagaaggattagtttcattttatacctaccagatcccgacagaaaatggaaatcgcattatggtggtggtctaagactttttccaagtattttaccaaacgttccacattccgatccatctgctaaactagttccacagttcaatcaaattgcttttttcaaagttttaccgggtttctctttccacgatgtcgaagaagtcaaagttgataagcacagattatctattcaaggatggtaccatattccacaagttggcgaagaaggttacatacctggtgaagaagaagcgtgggtccgtaacaacacatccactttggcgcagattgaatctaatgtcctagaagattttgaatttccaaaggacgagagaaatattttatcatttcatgaagtgaagcactttgaaaaaatgctcaagggcgatgctggcgcaaaaactgataacacacctaaagaatctatgactagtgtgatttctgattcggttaagttgtctgaagccgagttcacctatctatctcaatacatctctcctgaacatttaagctcgaaaggtatcgaaaaactacaaaagcagtttgttgagaactcttctctacaaattgagtcgtttttaaatgacgataaatcagaattgttaaagaaggttatcaaacaaaaagagttggaacaggaatgtccttatcattcaaaagatgtgaaagctccgtggaaaacggctattcctccacacaaagcccgttatttgtacatcgacggtaaggaataccgtaatttccaaacagaagctgatattcttgaggcgctgaataacaatgatttgccaaactttcagtttactaaggacgcaattaaaattatctccgatgcttccggaaatagtagggaaaacaattttgatgcagaattagcgttgattgacctagctgtatttcacaagagcacaattttcaagaaatacctagctcttctaacttctttgtgcccagtcagtgagcaaatccttattagaaggtttaggccaggaatggatttcacattggccaccaaatgtcgctttaatgaacttttgaaaagcaatccagatataatcgatgctgtcttggaaggtactttgtgcttgacaccttctgccggttgggaatccggagagcttggtggttacgaattgtacatgatggacgacgacgaagataataagcaatacttaaaggaagacgttgaagacgcttctgtttatcgtgcggatgacagtggtgattcagtattgattaatgatccacctgcttggaatactttcaatttggtcttgagagatgaaagtgttttggagtttgttaagtacgtcagctggagcgctaaatctagtagatgggatgtcaaaatgaagtgggatgtcaaatcatgtgatgaagatggtcaggaagatgaagcgtaa

SEQ ID NO: 4363 - DNA, 1935 bp, Saccharomyces cerevisiae
atgaaggctaatggtttagataatgatccggcaaggacgggaatggaaagaacagatatagatagtgaacacccagaagcgcaaccgttgctgaacaacaaccaccggacccttggtgcaggatccgcgaatggcccagcagttaatgaaggtcgtgacattgaatccgatgggttcatcaaagatagtctctttcaaattcgcaaaggttatagaatctttattcataactccaaatggatattaaatatcctaattctaattaacaccatctggctagtcaccactttgatttcagatttctttttcaatatcaatattcttttcggattcagtaacaggtacgcaagttttaacgacttgactttaatattcatctcgatcatagctaattctttcaatctctggtttaataagctgggactgtactcagctttagattacagcttaaatgtaactctctgtgttttgacgttgttcaatctagcattgacctatctaattaaatacactaggcaaagaatcggctttgtgggcacgtttacatatttgtggacttcgttttcattttttattggggcaatattagattggtatctcttgttttacaacaactcaataaatgagccattggaggaacgcagaattgatgatgctaatattagtactttcaacgaaaaccatacaaatagtaccgaaaacagggacagaagccaatatggctctgggtcgccaacccccacccaccgctcgcagctggtccaaaacaaacatacattgacagaatgggtatccattgggttcaggaatactattaagtttttaattttaatattcttcgctttattcaccctgaatacacttttaacgacattggatacctacagattgactcacaaattaccaataaccgttcagtcgccctcgtacgaggcgttccattacgtagatgccgctaaaacctatcagttgcatataacttgttatggtgacgtatttgatcaagaaaacaacacagatttgtctgaaaataagaagcaacctatcatcttgtttgaacacggaggttatgatactggttacctttctgccacctggattgaggaactatatcatttagacaaaattcaaagatattgtctatacgatagaccagggtacgggttgagcgattctcctcccgccccaatctctattgcgatggttgcggaatctttaaggtacgcattgatcaaagatgcaaaaattaaaggtcccttcactacagtaggatacgaccttggcgggctatttacaagagtatttaccgccaagaatgtcgatattgtggatagcatgatgcttgttgaatcatggcatgaagaactattgttaaaaaactacattcaaagattactacctccaggccgtggtgatggcgacgatggcgacgatggcaatggtaatgatggggatggccgcaaccatgataagacttggttaccttcggagatagaaaggcataacgaatttagattatggtggaaaggcatttggtcgagtttaggatggagattacagacttcatggttactagctcatcatgggtctaaagaacgtatatatgggcgtgatatgaaatatcaaggacgtttcttgcgttccaagtttttggaaagcgtgacgagttcaattctaagttacagagatgtgacaaacaatgcagaatctttgcaaaatgtgaagacaagcatcgttagctctaaggaaatggtgaagaagtcggcattatggggcgattggcaaagagatttgaccaaaatttctcacaagactcaagaatggaaaatagttgaaggtgggcatgaaatatataagtatggtctgggcaaacaacaaactcaagaagtcctattaagattaataggtgagcttggcaaactaaccgaggattaa

SEQ ID NO: 4364 - DNA, 1935 bp, Saccharomyces cerevisiae
atgaatctcaatgaaagctacctagatgctgagataccgaagggtcaattgaagcatagtaaaagtgggaattttgagggtattccaatcgtggcaacgacttcagaaccaacgacatcggttaatctagatgaaacattcttcaagaaggcgcctatagcaatgccaatatgcgatgatcattctgttagtaaatctacctctgtaaattctttgaatacaacatctttggcatccagaagatctcctttgcaaacaaaaaaattgcaagctaaaaataatttattgtcagcagatttggcaaagagcaatgatgatacaacgagagcactaaacagtccaaaaaaggatttcggtccttatttggacagcgagaatgacatcaggagtcgcttggccgaaagcatatattctatggaaacatctataagaggatcggaactacagagacggccgtacgtaagtaacgaaattcctaatgtattcaagttttcgaagttcaatagtaactgcaagttaaatgagagccagactctctgtgacaaaaatttcttcatattcacgtcagcgggtaaaccgatctattgcatgcacggcaaagatgaacagatcatgtcatatacagggctcgttaatacggtaataagctacttccaagtcaatggaccatcggaattgaaaactatatccactttaacttctggtaaaaggcttacttttttggataaatcacctatattactaatggctcaatccgaaagaggcgagtcctcgaacgaattgttgaatcagttggattttttatattcgtatattctttcgtctttaagtgaacgccaattacttaggttattttccaaaagagaaaatttcgacctgagaaattatctagaaagcacagattttgaaaatttagacgaaatatgttcactaatctgtaacagaatgttcccggatttactattgaactctttacaatgcttaccatttaaccattcttcaagattaaagttgcagaatgtggttttacagcaactggagaaaaggcaggacattcccagggggaccttactgtacggcttgataattgcgcctcagaataaattgtgctgtgttcttcgacccagaggccatactttacacactacagatttacatcttctattttgcctaatatctcatcaatttcaaaatttagacgaaactcaggaactttgggtacccatttgttttcccaagttcaattcgagtggttttctttattgttatattaagtttctacctaatgatactcacagcaatgagaaatcggcactagtattaataagtgcacaaaaggatgcattcttttcattgaagtcgtttagtgacgagttgattattaaactcgaagaagagaagctattgaaaaagataaatacttcaaaagggttcaagcttagcgatataccagcaccaatggttcatcatttcatatataaatcgaagcaaaacgttcaatatgttatgccgcacttcgaagtcaacagtaacatcgcactggattcttcacaggggctagaatatgaattgaaattgaagacatactaccaacagttacatggcacggtagtgagagataatggcaatttgttaagtaggtctatgttaaattttgttagatggagttccaaagacaatgaggacttggcgatggacgaaacacaaatggatttttctgaattggatgagtacattattggaaattcatcattcaaacaagaatcggttaatatggtaggaatggcgtgggtgacgcccacttttgaattgtatctgattggaaataatgggattgttgacaaaagggttttattcaagagtgcgagaaaagtagctaattggtgtcaaaaacacgagtcgagactatttataagtgatggggccgtgttttaa

SEQ ID NO: 4365 - DNA, 1935 bp, Saccharomyces cerevisiae
atggataatgatggacccagatctatgaccattggggatgacttccaagagaacttttgtgaacgtttagaaagaattcacaatacattacattcaataaacgattgcaactcattgaatgagagtaccacaagtatatcagagacattgttagttcaattttatgatgatttggagaacgttgcctcggtaattcccgacttagtcaacaagaaaagactgggaaaagacgatattttgttgtttatggactggttattattgaaaaaatatatgctatatcaatttattagtgacgttcataatattgaggaaggttttgctcatttgttggatttactagaggatgaattctcgaaggacgatcaggatagcgacaaatacaatcgatttagcccgatgtttgacgtcatagaagaatctacacaaattaagactcagttggagccatggcttactaacttgaaggaattattggatacgtcattggaatttaacgaaatttcaaaggatcatatggatacattacataaaatcattaatagcaatatatcgtattgtctggaaattcaggaagaaaggttcgcgtccccgatacggcatactccatcatttaccctagaacaactagtcaagttattaggaacgcatacggagacaactgagccaaaggtaccaaaattttctccggcagaagatattttatcaagaaagttcttgaacctaaaaaaaaatatccctccaattgaaaaaagtttgactgatatcctacctcaaagaattgtgcaatttgggcaccggaatataacaaacataactactttgcaaacaatcttgcaaaaaaaatacgagctgataatgaaagattatagatttatgaattcagagtttagggaattgaaagtcgaactaatcgacaaacgttggaatatactctttattaatttaaatcatgaactattatacattcttgatgagatagaaaggttgcagtcgaaattactgacaacaaagtataccaaagatatcactataaggctcgagaggcaattggagagaaaatcaaaaactgtttctaagacattcaatattatttacagagcattggaattctcacttttggacgctggcgtcgcatcgaagacaaatgaattagctcaaagatggctgaatatcaagcctacagcggataaaattctaatcaaatcctccgcttcaaacaaaatagctactagcaagaagaagattccaaaaccgaaatcattaggctttgggcgaccgaatagtgttattggaactataacccaggatttccaggagagagtcgccattaatgaaggtgacagtaataaaacaccggaaaattcaactacagtggctttgaaaggtaaaaagcttggtaaagcgttactgcagaagatgaatattaaacctgcaacaagcccaaattcatcaaatgcgattaatccattttttgatccggagtcgccaaacaaaggaaaactgatactaagtagtgttcctcccttaccttatgacgaaaccgatgaaaccaccctccgtgtttctcgtggggaaaatgaaaagtcaccagactccttcattacatctcggcatgaaaataaagtacagattacagaaactcctttgatggcaaagaataagtctgtgcttgacatcgaaaaagataaatggaatcattaccggtccttgccctctaggatccctatatacaaggataaagtggtgaaagtcaccgtagaaaacacaccgatagcaaaggttttccagactccgccaacaaaaatcacgacacctaatagtcaagtttgggtcccttcgacaagaagaagaacccgattgaggcctcccacccccttatcacagttactttcaccaagagaagggcgtttagataaaaccccaacttattga

SEQ ID NO: 4366 - DNA, 1935 bp, Saccharomyces cerevisiae
atgtccaaggtctatctgaattcagacatgattaaccatttgaactccacagttcaagcttactttaacttatggttggagaagcaaaacgcaataatgcgttctcaaccccaaattattcaagataaccaaaaactgataggcattacaacgctagttgcctcaattttcactctgtatgttttggtcaagataatctccaccccagcaaagtgttcctcgtcctataagccagtcaaattctcccttcctgcaccagaggccgctcaaaataattggaagggcaagaggtctgtttccactaacatatggaatcctgaagaaccaaactttattcaatgtcattgtcccgccacaggtcaatatctaggttcttttccatcgaaaacggaagctgacatagatgaaatggtttctaaggcaggcaaagctcaatctacttggggcaattctgatttctcaagaagattgagagttttggcttctttgcatgattatattctaaataatcaagatcttattgcgagagtagcgtgcagggattcaggaaagacaatgttagacgcatcgatgggtgaaatcttggttactttagaaaaaattcaatggactataaagcacggccaaagagcgttgcaaccttcgagacgtccgggccccactaattttttcatgaagtggtataaaggtgcagaaatccgttatgaaccactgggtgtgatcagttctatcgtttcctggaactatccattccataacttattgggtccaattattgcagcattgttcacagggaatgccattgtagtaaaatgttcagaacaagttgtctggtcttcggaatttttcgtcgagctgatccgcaaatgtttggaagcttgtgatgaagatccagatttggttcagttgtgctattgtttacctccaactgaaaatgatgattccgcaaattatttcacctctcatcctggtttcaaacatatcacttttattggcagtcagcccgtagcgcactatattctaaaatgcgctgccaaatcattgacacccgtagttgtggagcttggtggtaaggatgcgtttattgtcctagactcagctaagaatttagatgctttatcttctatcatcatgaggggtactttccaatcatccggtcaaaattgtattggtattgagagggttattgtcagtaaggaaaattatgatgatttagtcaagattttgaatgaccgtatgactgcaaatccactacgccaagggtctgatattgatcatttagaaaatgttgatatgggggcaatgatatctgacaacagattcgatgaactagaagctttggttaaagatgctgttgcaaagggagctcgtttacttcaaggtggttcccgcttcaaacatccaaagtatccacaaggtcattatttccaaccaactcttttggtggatgtcactccagaaatgaaaatagcacaaaacgaagtgtttggcccaattttagtcatgatgaaagctaagaatactgaccattgtgtacaactagccaactctgcgccatttggtctaggtggttctgtgtttggtgcggatatcaaggaatgcaattacgtcgcaaatagcctacaaactggtaatgtagccattaatgattttgctacattctatgtttgtcaattaccatttggtggtatcaatggttcaggttacggtaaatttggtggtgaagaaggtcttttgggtttgtgcaatgccaaaagtgtctgttttgatactttgccttttgtctccactcaaattccaaaaccattagactaccctattcgtaacaatgctaaggcttggaattttgtaaagagtttcatcgtaggagcttatacaaattccacatggcaaagaataaagtcactgttctctttagctaaagaagccagctag

SEQ ID NO: 4367 - DNA, 1935 bp, Saccharomyces cerevisiae
atgttaccatcatggaaagcctttaaagcacataatatacttcgtattctgacccgtttccagtcaaccaaaattccagatgcagttatcggtattgatttaggtactaccaattctgcggtagctattatggaaggtaaagttccgagaattatcgaaaatgcagaaggctcaagaactactccgtctgtagtggctttcactaaagacggagaacgtttagttggtgagccagccaaacgacaatccgtcataaactcagaaaacactttgtttgctactaagcgtttaatcggccgccgtttcgaggacgctgaagtccaaagagatattaatcaggttcctttcaaaatcgtcaagcattctaatggagatgcctgggtagaggctagaaacagaacgtactcccccgcccaaataggaggttttatcttaaataaaatgaaggaaacagcggaggcttacttagcgaagagcgtcaaaaatgctgttgtcaccgttcctgcttacttcaatgatgcccaaagacaagctactaaagacgcaggacaaattattgggcttaatgtattacgtgttgtcaacgaaccaacagctgctgccctagcttacggtctagataaatcagagccaaaagtcattgctgttttcgacttgggcggtggtactttcgatatttcaatcctggacatcgataacggtatctttgaggttaaatctaccaatggtgacacccatttgggtggcgaagattttgacatttatttgttgcaagaaattatttctcatttcaagaaagaaaccggtatcgatttgagtaatgaccgtatggctgtccaaagaataagagaagccgctgaaaaggctaaaatcgaactgtcttctacactctctacagaaataaacttgcctttcataactgctgatgctgcaggcccaaagcatattcgtatgcccttttctagggttcagcttgagaatataaccgccccattgattgatagaacggttgatcctgtcaaaaaagcactgaaagacgcaagaattaccgcctcagatatatcggatgttttattagttggtggtatgtcaaggatgcccaaggttgcagatactgtaaagaaattattcggtaaggatgcatcaaaagctgttaaccctgatgaagcagtcgctttaggggccgctatacaggctgcggtcttgtctggtgaagttaccgatgttttgttgctagatgtcactcccctatcattgggtattgaaactttaggaggagtttttacaaaattaatcccaagaaattctacaattcccaataagaaatctcaaattttttcaactgcggcatcaggtcaaacatcggtggaagttaaagttttccaaggtgagagggagttagtcaaggataacaaattaataggtaattttactcttgcgggcattcctccagctccaaaaggtaccccacaaattgaagtcacttttgatatcgatgcgaacggcatcatcaacgtttcagcaaaagatctcgccagccacaaagactcttccatcactgttgccggagcgtctgggctatctgatacggagattgatcgaatggttaatgaagcggaaagatataaaaatcaggatagagccagaaggaatgccatcgaaaccgctaacaaagctgaccagctagctaatgacacagaaaattccattaaggaattcgaaggtaagctagataaaactgattctcaaagactaaaagatcaaatttcatccttaagggaattggtttctcggagtcaagctggagatgaggttaatgatgacgatgttggaacaaaaattgacaatttgcgaacttcatcgatgaaactttttgaacagttatacaagaacagtgacaatcctgaaactaagaacgggagagaaaataaataa

SEQ ID NO: 4368 - DNA, 1938 bp, Saccharomyces cerevisiae
atgatactgatctcgggatactgtcttttagtgtatagcgttattttgccagtactgatatcggcttctaagttatgtgatttggctgagttacaacgattgaacaagaatttaaaagtagacactgaatccttgccaaaataccaatggatcgctgggcagttggaacaaaactgcatgactgcggatccagcaagtgaaaatatgtcagacgtaattcaactagccaatcaaatatactacaaaattgggctgatccaattatccaacgatcaacatctaagagctattaacacatttgaaaaaatcgtttttaatgaaacttacaaaggttcttttgggaagctggcggaaaagaggctacaagagctgtatgtcgattttgggatgtgggacaaggtgcatcagaaggatgatcagtatgcgaaatatctgtccttgaatgaaaccatcagaaacaaaatatcatccaaagacgtttctgtggaggaagatatttctgagctgctacgcataacgccgtacgatgttaacgtcctctccacgcacatcgatgttctttttcacaaactagctgaagaaattgacgtttcgttagctgctgctatcattttggattacgaaacaatcctcgacaagcatttggctagcttaagcatagatacaagactttcgattcattatgtcatatctgttttacagacctttgtacttaactcagatgcgtcgttcaatataagaaaatgcctttccattgatatggactatgataaatgtaaaaaactaagcctgactatttccaaattgaacaaggtgaatccatcaaaaagacagatcctggatccagcaacatatgcatttgagaacaaaaagtttagaagttgggatagaattattgaattttatttgaaggataagaagccatttattacaccaatgaaaattcttaacaaagatacaaactttaaaaacaactacttctttttagaggaaattatcaaacaattgatagaagacgttcaactgtcgagacctttggcaaaaaatttattcgaagatcccccaataaccgatggttttgtcaaaccaaaatcatactatcataccgattatctagtatacattgattccattctttgtcaggcttctagcatgagtccggacgtcaagagagctaaactggctgcgccgttctgtaaaaagagtttgaggcattcactaacactagaaacatggaaacactatcaggatgctaagtccgagcaaaaacctttacctgagacggtattgagtgatgtatggaattccaatcctcatttgctgatgtatatggtaaactcaatacttaataaaagtaggtctaaacctcattcacagttcaaaaagcaattatatgaccagataaacaaatttttccaagataacggcctctcagagtcgaccaatccatacgtgatgaagaacttccgattattacagaaacaattacaaacctataaagagcataaacatcggaatttcaaccagcaatatttccaacaacaacaacagcagcaacaacaccaacgacatcaagcacccccagcagcgcctaactacgacccaaaaaaggactattataaaattcttggagtatcgcctagtgctagttcgaaagaaataaggaaagcatatttaaatttaaccaaaaaataccacccagacaaaataaaggccaaccataacgacaaacaagaatcaattcacgaaactatgtcacaaatcaatgaagcgtacgaaacattaagtgatgacgataaaaggaaggaatacgatctttccagatcaaacccccgccgcaacacttttcctcaggggcctaggcaaaataacatgttcaaaaatccaggaagtggcttcccattcggaaatggctttaaaatgaattttgggctttga

SEQ ID NO: 4369 - DNA, 1938 bp, Saccharomyces cerevisiae
atgctgaaatttagaattaggccagtgagacatatacggtgttataaacgacacgcatatttcttacgatataaccatacgactacccctgcacagaagttacaagcacagatcgagcaaatacctctcgaaaattacagaaatttctctatagttgcccatgttgaccatgggaagtcaaccttaagtgacagactgctggaaataacgcatgtcatcgatcccaatgcgagaaataaacaagttttggataaattggaagtcgaaagagaaagaggtattactataaaggcgcaaacatgttcgatgttttataaagataagaggaccggaaaaaactatcttttacatttaattgacacgccaggacatgtggacttcagaggtgaagtttcacggtcatatgcgtcttgtgggggagcaattcttttggttgatgcatcacaaggcatacaagcacagacggttgctaatttttatttagccttcagtttaggattgaaattaattccagtaataaacaaaattgatctaaattttacagatgttaaacaggtaaaggatcagatagtgaataactttgagctccccgaggaagatataatcggagtaagtgctaaaacaggattaaatgtagaggaactgttactaccggctataattgatcgtataccaccaccaacggggaggcctgataaacccttcagagcattattagtggattcttggtacgacgcatacttaggagcggttcttctagtgaatattgttgatggttctgtacgtaaaaatgacaaggttatttgtgctcagacaaaagaaaaatacgaagtcaaagatattggaatcatgtatcctgacagaacctctacaggtacgctaaagacaggacaggttggctatctagtgctgggaatgaaggattctaaagaagcaaaaattggagatactataatgcatttaagtaaagtaaatgaaacggaagtacttcccggatttgaagaacaaaaacccatggtatttgtgggtgctttcccggctgatgggattgaattcaaagccatggatgatgatatgagtagacttgtcctcaacgataggtcagttactttggaacgtgagacctccaatgctttgggtcaaggttggagattgggctttttaggatctttacatgcatctgtttttcgtgaacgactagaaaaagagtatggttcgaaattgatcattactcaacccacagttccttatttggtggagtttaccgatggtaagaaaaagcttataacaaatccggatgagtttccagacggagcaacaaagagggtgaacgttgctgctttccatgaaccgtttatagaggcagttatgacattgccccaggaatatttaggtagtgtcatacgcttatgcgatagtaatagaggagaacaaattgatataacatacctaaacaccaatggacaagtgatgttaaaatattaccttccgctatcgcatctagttgatgacttttttggtaaattaaaatcggtgtccagaggatttgcctctttagattatgaggatgctggctatagaatttctgatgttgtaaaactgcaactcttggttaatggaaatgcgattgatgccttgtcaagagtacttcataaatcggaagtagagagagtgggtagagaatgggtgaagaagtttaaagagtatgttaaatcacaattatatgaggtcgttatacaggcccgagctaataacaagataatagctagagaaacaattaaggcaagaagaaaagatgttctccaaaagctgcatgcttctgatgtctcacgaaggaaaaaacttttggcgaaacagaaagagggtaaaaagcatatgaaaactgtaggtaatattcaaatcaaccaagaggcatatcaggcttttttgcgccgttag

SEQ ID NO: 4370 - DNA, 1938 bp, Saccharomyces cerevisiae
atggttgaaaaacgtagtagacagagttccagtagtggctcagagttcagtgttccacctgatgtcgataacccgccactttctatccctttgaagactttatcagacagatatcagctgatcgaaaaactaggtgcaggatcatttggttgtgtaactttagccaaagcgcaatttcctttatcgaacatattgggtaaacaacatgatataaggggtactttaatggatcagcctaaaaatggtcaccaaaactatataacaaagacacaaggtgtagtggctataaagacaatgatgacaaaactgcatacactccaggattatacgagggtcagagaaattaagttcatactggcaatcccagcgaatgaccatctgatacaaatttttgaggtctttattgactctgaaaattaccaattacatatcgtaatggaatgtatggagcaaaacctatatcaaatgatgaaacatagaaggcgccgagttttttcgattccttctttgaaatctattctatcgcagatactggctgggttaaaacacatccacgaacataatttcttccacagagatttaaaacctgaaaatattcttatcacaccaagtacccagtattttgaaaaggagtacatgaaccagattggatatcaagataactatgtcattaaacttgcagattttggtttggcacgccatgttgaaaataaaaacccgtatacggcctacgtttccacaagatggtatagatcgcctgaaatattattaagaagtggttactattccaaacctttggatatttgggcattcgggtgcgtggcggtggaagttactgtattcagagctctcttccccggtgctaacgaaatcgatcagatatggaaaattttagaagttcttggtacacctatcaaacgttctgattttgttaatacaaaccacatcacagctccaccacctggtggattttgggatgatgccagtaatttggtccataaattaaacttgaaattgccttatgtagaaggttcatcgttggatcatctactttctagctcccaactatccgatttatctgaggttgtcaaaaagtgtttaagatgggatcctaatgaaagggcaacagcccaagagctttgtgaaatgccattttttgaaaacaccgtggcatcccaagtagacgcaagaggcaatgtgactaatacagaacaagcattgatttttgcaggtataaatccagtagcgaccaacacaaagcccatatattttaactcttcaacaaaattgcccgcagaaacagagtctaatgatattgatatcagcaacaacgatcacgattctcatgctatgtgctcaccaacattaaatcaagaaaaactaactttggtagaatttttaaacgaattcgttgaagaagataatgatgatcactcaatacctgatgttggaacagattctaccatttcagattctattgatgagactgaattatcaaaagaaattcgtaataatttggccctttgtcaactaccagatgaagaagtcttagatcattcattatcgaatattaggcagttgacaaatgatattgaaattataaataaagatgaagcagacaacatggaacagctattttttgacctggaaattcctgaaaaggatgagtttcagagaaaacaaccatttaatgaacatgcagatattgatgaagacatcgttctaccatatgtgaacaactcaaattacacacatacagataggtcacatcatagaggtgataatgttttgggtgatgcctctttaggcgattcgtttaattcaatgccagattttactccaagaaatttcttgatacctacattaaaaaaatcacgggaaaagttcgagcctcatctatccaattcaaaccaacattttggaaatgtaaccttctaa

SEQ ID NO: 4371 - DNA, 1938 bp, Saccharomyces cerevisiae
atgtctgatgaagataacaattatgacgacttcatgttatcggatgacgaaggcatggagtcaattgaaatggaggaagaaaccgatgatgaagacaaacaaaacattgaaataaatgaagacaatagtcaggatgatcaagatcgaggagcggcacgacataagcaacatgaacaaggcaccttcgagaaacatgacagagtagaagatatttgtgaaagaatctttgagcaaggccaagctctcaaagaagacgaacgatataaagaggctcgcgatttatttttaaagatatattacaaggaagaattttcatctgacgaaagtatagaaaggctcatgacatggaaatttaaatcacttattgagatattacgtttaagagccctacaactctattttcagaaaaacggtgcacaggatttagttctacaaattttagaagacacggcaactatgtcggtttttttacaaagaatagactttcaaattgatggaaatatatttgaattactttctgatacttttgaggtattggcacccaagtgggaaagagtattcttgttcgacatcgagaaagttgatagggaaaatatgatctgcaaaattgatttccaaaaaaacttcatggatcagtttcaatggattttaagaaagcctggcaaggattgtaaactccaaaatctccagcgtataattagaaaaaagatatttattgccgttgtttggtatcaaaggttaaccatggggaatgtattcaccccggaaatttcttcccaaatagagattcttgtgaaagataatgaatgctcttcttttgaggaaaataatgatttggaaagtgtatctatgttactgcagtattacatattggagtatatgaacactgcacgaataaacaatagaaggttgtttaagaagtgcattgacttttttgaaatgttgatatctaagtcgcttactttctcacaagaatctggactgatggtaatattatatacctctaagattgtattcattttagactctgattcagagaatgatttatcctttgcgctgatgagatattatgatcggaaagaagagctaaaaaatatgttcctctatatcttgaaacacttggaagagatgggaaaacttcgggagagggatattacctctttgtttcacaagttcattcttagcggcttcattttcacgagcatgattctagaagcaattagcacagacaagattaatccttttggtttcgaacaagtgaagattgcgctaggcagccctattgttaacgtattagaagatgtctacaggtgcttcgcacaactggaactaagacagctgaatgcaagtatatctcttattcctgaattgtccgtagtactaagtggaattattcaagatatttactatctggcgcagacattaaagttgtggagaaaaattgcacgattatactcctgtatctccataagtgacattataagtatgctgcaaataagtgatgacaatgaaatgacaagagatgatttgctaacaattttaatgaggtcaataatgaaaaatagatcggttgtgtattttaagttagatttgacaagtgatttagtctatttcggagacgagaataaagtcatgctaccgagatgttctaaagaagaatttcgtcttatgatctctcccaaggatgaagaaaccactgaaaaggccaggctaatagattttgagtacgttaacgatgtcgcgatttataataacccaacaagaataagaaccaaatcctctaaagaatttttcaatacattaagaaaatctagggaaactgtaaaattaccgagggtaagcaaccagtcgaatgaagatacttttctaccatcgtatatgaagttttccaacaagtacctcgagctgtgcaaactggcctctaacaatctggaatag

SEQ ID NO: 4372 - DNA, 1941 bp, Saccharomyces cerevisiae
atgagttacgaatctgggaggtcatcctcctcttccgagagtacacggccaccaacgctaaaagaagaacctaatggtaaaatagcttgggaagaaagtgtcaaaaaatctagggaaaataacgaaaatgacagcactctcttgaggcgaaagctaggtgagactcgaaaagcaattgaaactggaggatcatcgagaaataaactttctgctttgacacccttgaaaaaagtggttgacgagaggaaggattcggtacaaccacaggtcccttccatgggttttacttattctttgcctaatttgaagactttaaacagtttttcagatgctgagcaagcacgtataatgcaagattatctatccaggggggtaaatcaaggcaacagtaataattatgtagacccactatatcggcaattaaatccaactatgggtagtagcaggaacaggcctgtttggagtttaaatcagccgttaccgcatgtattggatcgaggcttggcagcaaagatgatacaaaagaatatggatgcaaggtcccgcgcatcatcgagacgagggtcgaccgatatttcaagggggggttctactacgtcagtgaaagactggaaaaggctccttagaggtgcagcaccgggtaaaaagcttggtgacatcgaagctcaaacgcaacgcgataatactgttggtgcagatgtgaaacctactaagttagagcctgaaaacccacaaaagccctctaacacgcatattgagaatgtttcacgtaagaaaaagcgtacttcgcataatgtcaatttttcattaggcgatgaaagctacgcatcctccatagccgatgcagaatccagaaaattaaagaacatgcaaaccctcgatggttctactccggtttatacgaagcttcctgaagaacttattgaagaggaaaataaaagtacgagtgcattagatggtaatgaaattggtgcctcagaagatgaagacgcggatataatgacatttcctaacttttgggcaaaaattcgctatcatatgcgagaaccgtttgcggagtttctcgggacactagttcttgtcatttttggtgttggtggtaatcttcaagcaactgtaacaaaaggtagtggtggttcctatgaatccctatcatttgcatgggggttcggttgtatgcttggtgtttacgtcgcaggcggtattagtggtggtcatattaaccctgctgttacgatttcaatggcaatttttcgaaaattcccctggaaaaaggtgcccgtatatattgttgctcagattatcggtgcatattttggaggagctatggcttatggttatttttggagctctatcacagaatttgagggaggtccgcacataagaacaacggcgaccggtgcgtgtttgtttactgatccaaagtcttacgtcacgtggagaaatgccttctttgacgaattcataggagcctctatacttgtgggttgtttgatggcgctattggatgatagtaatgctccacctggcaatggtatgaccgcattaattattggattcttagtcgctgcaattggtatggcccttggatatcaaacaagtttcacaatcaatcctgcaagagatctcggtcctcgcatatttgcttccatgattggctatggtccacatgcttttcatctcacacattggtggtggacatggggagcctggggtggtccaattgccggcggtattgctggagcactcatatatgacattttcatttttactggatgcgaatccccagtcaactacccagacaacggttatattgagaatagggtaggtaaacttttacatgcggagttccaccagaatgatggcactgtctcagatgaatctggtgttaacagcaacagcaacactggcagcaagaaatctgtgcctacttcgtcataa

SEQ ID NO: 4373 - DNA, 1941 bp, Saccharomyces cerevisiae
atgatgcttagaagaaatgcggtgagatcgttaaaaactatggaaataagcgtaagcaacgttgttaactccggttcgatagcaatgctgagaggtaagcttgccaacgtagttcttagcgaccgtacttaccactccagtccgatatttcataaaaatgtacctaagggcgttttggacaagaagaatgggcgagaacagcgcaaaacagaacagaatgtgtttaatgtggatccagcttctccatggcgccacgagcttctttcgtttgatgagtgtgtatcatctgctttaaagtactctaccacgcctttgcaaaatacatacaaaagaataggaaacaaccaattgaataaaaatccatcattcgccatgttttgggactccatgggcagagcaatggagttatactattctttgagagaatcgcctgatttcaatgcgtaccgggtgtcacgtttgattcatctgctgcataacggtctgaggtcgacgagagaccaattggtaaaattaagtagaaagccagactacgattcgcaatcttttcacaaggaaatgatgaactttctatgtaattcattaaaggatatatctgatgacattttgataggcaaggtgtctgtcagcggatatggagctactcatctattgacttcatttaaagagctgtcatttgacgatgactgtattcgaatttgggaagcgtcaaagaatttgtccgacgagactacttcacaggcattccaagaaccaaaagtggttggttttatgctgccattactttatgcaaaaacgcgttctctgactgagcctaacgagctatataaccaaattattcaatccaaagaatttatccatcccaatctttacagcggactgataaaagtcttcatcaaggcggaagactacgaaaaggcattatccctcttcggccaattatgtgaaaaggctgaagtgaggaattacggttatttaattgaaacgcacttaagcttcattggtgattccaagaatttaacgttggcagaaagtttctttgacaaaattatcaacgatgaaatgccatacaagattattttacaagtctctacagtgaactcttttttgcagaatatatggaaagcacagaacgattttgatcatgtttatagaatatgggaaaaggctgtaaaattttatggtaacactgttaatcctggaattttgtcctcactaaacaacacttttttcacaatattcttcgaaaactatattaatgacaatatcaatggtttccgtaagcttcaagaaatcataacgttttacagtggggtcaaaaaaattgatgaaccattttttaacgttatgttaactagagcatctatctggcacgaacgcagcataatcgattttatcgataaaaactatactttgtaccatattccaagaactattatatcatatagaatactactgaaatcattgggaagcatagacaacacgaataatgaagagattctggatagatggctggagttggtcaagaaactgaatgaattgggccaacaatatatagccaatgctgatctgtccgctttgagggatgccactgtcgtatggtcacaatcaaagagggatgaaaaggtcttttctgcaaaagctaaaggaacaccagcaacgactacgaccacagaagacgacataaaagttccgaagccattggaaaatttgaaaaatgaggattctacttcgaattcagaagacagaatagagctgtacttgaaaatattaaaaagatatacgccctactttcgcgctaccaagcaagtatataggtataccactggatgcgcagagtcatacccaatattaaatgagtatctgagcggttattctgacttgagtgccgaggacattcctgttcctcaactacatagctttattgctaaggagcaatag

SEQ ID NO: 4374 - DNA, 1941 bp, Saccharomyces cerevisiae
atgattggtgcctttaagaggaaccgtggaagttctcagtcttttgcgaaggaatgtcaaccttctacgttaaaagccaaccttgaagtggcaaaagaacttccattctcagatcgtcgcgatttcgaggatgccactcaaggttacatcggctccttatctgatgagcaaataatcggccctgacggcggtgtagtatggtgtatgaaatcttatggctttttggagcctgagacgcccgcaaatactgttaaccctagcttgtggagacaagcgcagctgaatgccattcatggcctatttaaaatcactgacaacgtttaccaggttagaggactagatatctctaatatgactataatcgaaggtaatacttctttgataatcattgatacgctttttaccacagagactgcccaagagtcgcttaaactttactatagacatcgtcctcagaaacctgtgcgtaccgtaatatatacgcatagccattcggaccactatggaggagttaaaggaattgtcaaggaagcagatgtgaaatccggagaggtgcaaataatagccccagttggcttcatggaaagtgttgtagcagaaaacattctggcagggaatgcgatgcatcgacgttcccaatatcagtttggtatgttactttctcccagtgttaagggtcatgttgattgtgggatagggaaagctgcctctcacggaacagttacactgattgcaccaactattattatagaagagcccgtcgaagaacggacaattgatggtgtagattttgtttttcagcttgcacctggatcggaagcgccttcggaaatgctcatttatatgccacaacagcgtgtgctcaacatggcagaagatgtgacacatcatatgcataacttgtatgctcttcgaggtgttgaagtacgcgacggcaaccaatgggctaaatacatcgatgcagctcgagttgctttcggtagcaaaacggacgttttaattgcccagcatcactggcccactacagggcaaatgcggatcaatgaattgctgaagaagcagcgggatatgtataaattcattcatgaccaaacacttcgattgcttaatcagggatataccagtagagatatcgccgaaactcttcgtatgccatccagtcttgagcaagaatggtcaacacgaggttactacggcactttgagtcacaatgtaaaggctgtgtatcaaaaatacctggggtggtatgatgcaaatccggctaacctaaaccctttgccacccgtagcctatgcaaagaaagcagtcgagtatatgggcggcgctgatgctgtattggcacgggcttataaagatttccagaaaggagagtttcgttgggttgcaagcgttgttaatcaattggttttcgctgacccaaataaccatcaagctcgtgagctctgtgctgacgcattggaacagctggggtatcaagcagaagccagcacgtggcgcaacgcttaccttgtaggcgccatggagttgcgccaaggtgtaccaaaaagacgaagtactggtaagcgcaacaatattgccgttttgaataacgaaatgttttttgactttcttgctgtgagattgaacgctacgaaagcagaaggtaaaattatcgttagtaattggtgtttcattaattcaaatgaacggttcgtgatcactctcgaaaactgtgccctgacctacattcagggctggcagacagatgcagatgcaacaattactctcaaaagaactacatttgaagctttattggccaatgaaattactatggttgattttttaagatcaaaagaagtcgaaatagagggtaatcgactcagaattgaagagctgttgaagttgtttgacgacttcgaccagtcctttcccgtcgttgagcctatggggggaagcacttga

SEQ ID NO: 4375 - DNA, 1944 bp, Saccharomyces cerevisiae
atgaaatatcccgcttttagcattaacagtgacacggtacacttaacggacaaccccctggacgactatcagcgtctctacctcgtcagcgtactggatagggactcgccgccggccagtttcagcgccggactcaatattagaaaggttaactataaatcctccattgctgcgcagttcacacatccaaacttcattatcagtgctcgggacgcagggaacggggaagaggcggcggcgcagaacgttctgaactgcttcgagtaccagtttcccaacctacaaacaattcagagcctagtccacgaacaaacgttgctatcgcagctcgctagctccgccactcctcactccgccttgcatctgcacgataaaaatattctgatgggtaagatcatactaccttcccggtctaacaaaacaccagtctcagcatcacccaccaagcaagaaaagaaggctctgtcaacagcatcgcgtgaaaatgccacctcctcgctgacaaagaatcagcagttcaagttgaccaaaatggaccataatctgatcaatgacaagctcatcaaccctaacaactgcgtaatatggtcgcatgactccggctatgtgttcatgacgggcatctggcggctgtatcaggatgttatgaaggggcttataaacttgcccagaggtgacagcgtttccactagccaacagcagttcttttgcaaggctgaattcgagaaaattctatctttttgcttttacaatcacagttcgttcacttctgaggaatcttcaagcgtactgttgtcgtcctccacctcttcgccgccaaagagacggacatccacagggtctaccttcttggacgccaatgcgtcttcttcatctacttcttcaacgcaggcaaacaattacatcgattttcattggaacaacatcaagcccgaactgcgggaccttatttgccagtcttacaaagacttcctgatcaatgaacttggtcctgaccaaatagacttgcccaacttaaatccggcaaattttacgaaaagaataagaggtggttacatcaaaattcagggtacttggttgccgatggaaatctcaaggttgctatgcctgcggttttgttttccgatcagatactttctggtgcctatttttggtccagatttccccaaagattgcgaatcgtggtatttggctcatcaaaacgttacatttgctagttctaccactggtgcaggtgctgctactgctgctactgctgctgctaatacaagtaccaattttacgtctactgcagtggcaagacctaggcagaagcccagacccaggccaagacaaagatctacttccatgtcccattccaaagcgcagaaacttgttattgaggacgccttgccctcattcgactcatttgtagaaaacttgggcctttcctcaaatgacaagaacttcattaaaaaaaacagcaaaaggcaaaagtcgtccacatacacctctcaaacttcttctccaatagggccaagagatccaacggtgcaaattttgtcaaacctagcatccttctacaacacccacggtcaccggtattcatatccgggaaatatctatataccacagcaaagatactctttacccccaccaaaccagctctcgtcgccacagcggcagctaaactatacttacgaccacattcacccagttccttctcagtaccagtctccaagacactacaacgtcccctcttcaccaatcgcgcctgctcctcccactttccctcaaccttatggtgatgatcactatcattttttgaaatatgctagcgaagtttataagcaacaaaaccaacgaccagctcataatacaaataccaatatggacacctctttttcgccaagggcgaacaattcactgaacaatttcaaatttaaaacaaactcaaaacaataa

SEQ ID NO: 4376 - DNA, 1944 bp, Saccharomyces cerevisiae
atgagagcatatggaaagaggggcccagttctcagaactccttttagatctaataaaggcttgccatcttcttccgatgttgaatttagtgatgacgatgtaaactccgtgattcctgatgtaagttctaccatttcgagcagtattgcagaccacccgatagagggattattggacgagcctagaaaggctcaggacagctcgtcgtcatttgatggtgcaaatgagaagccctcttcacaactggactcaaaaaggaatgaccaaaacgtcaaaattatcactagcagtgatacctcaatggcatttatgaaagatgaaaagttaagtgcctttaatttccttgatggttcaaaggcatctaagagaaaaagaagaagaacttaccaaaagcatgatgcgaacataacgtcttcaattgaaccagacgtacaagatgaagacagcattacaatgcacaatgaatttgaatcaataaggaaaatatacaatgacatcaatgaattcatattgaagctaccgagagctgacgatgatatactgaataaaatgcttgaaaatgagatgaagatggacgactctatagagaataatagcatacgcacatccaaagacaaaaaatatggcaaatttagaacaatattaataaacaaaaataaagaaaatgaaataatgggagaagaggtagatcagaaagctaacaccttgtccctaaataacgctgacaacagtaatgctgaaaaagaaggattaacttcaacaaatcactacaacgaattaaaaaatatgggagatacaataaaataccaggatgatattgagtttcttctgtccaattctaaaagtaatgacaatactacggtaccaatcaatgaatactttaaaaaacttttaaatttatccctaatgattattaatgacgaagaattttttcaatatgcgaaaagatatttcaaaaaggaaataattaagcttagttttgcgcaatttagatcggattttcctgaattaatcttattacagggttatttactacataaagttagtgaatcacaatccgatttcccgccaagctttgacaatttctctatcgaattaagtaaagatgatggtaaaatacggacaaaaaagaataagcatattaaaaaactctcacacctaaatttcgaagactttcttcggaagactcaattcaaaacgggactttattattcattatcactctgggaaatgcatggtaatttatcgttagatataatcaagagaatctccatccttgcttcaaataaggacttattcagtcggcacgttaagacttttattcctcttttagaaaaattaataaccgcttccgaattttgccacatgtatattgaacaacctgaaatgttcgattcactgataagcaacttgaataatcagtttaaggatatgcttgatgatgactcgttgattaaaatcctaatcttgttaacaaacatggaagtacataactatacgctatggaaagaggcagatatgatatttcaaagttcaatgaacacaattttggaaagcatacatccattgacagacgcgaaagttgataacatactcttgcatttagggctctgcctcaatatttgcagtagagaaaatagtcgtttaaaacttgacggcaaattatggtatgatatgaaaactatatttgttaaaatgatccgtgacggttctgacactgaaaataggttagtacagggcctgttttacttaaatttttcatttttaattaaacaacggaaagaaaatagtaatttagacccaggggagctcaatttgttactagtagagctggaagcatttaaatcggaaacatctcaatttaatgaaggtatttcaaataaaatcgaaatagcgttaaattacctaaaatcaatatacacgagtgaaagaattacaatataa

SEQ ID NO: 4377 - DNA, 1944 bp, Saccharomyces cerevisiae
atgcaactttcatggaaggatatccctactgtcgctccagcaaatgatttgctggatattgtcttgaacagaacccagagaaagacaccaactgtgatcagacctggtttcaagattacaagaatcagagcgttctatatgcgtaaagttaaatacacaggtgaaggtttcgtggaaaaatttgaggacattttaaagggttttcctaacatcaatgacgtgcatcctttccatagagatttgatggacaccctatacgaaaagaatcattacaagatatctttggcagctatatctcgtgcgaagtcccttgtggaacaagtcgccagagattatgtcagattgctaaaattcggtcaatctttatttcaatgtaaacaattgaaaagggccgctttaggtagaatggcaactatagtcaagaaattgagggacccattggcctatttggaacaagtcagacagcacattggtagattaccatcgatcgacccaaataccagaaccttgctgatctgtggttatccaaatgtcggtaagtcctcgtttttgagatgcattaccaaatcagacgtcgatgttcaaccatatgctttcacaaccaagagtttatacgttggtcattttgactacaaatacttgagatttcaagctattgacacccctggtatcctagatagacccactgaagaaatgaacaacattgaaatgcaatcgatttatgccattgcccatttacgttcttgtgttttgtacttcatggatctttccgaacaatgtggtttcaccatcgaagctcaagttaaactattccactccatcaagcctctattcgccaacaagtctgtcatggttgttatcaacaaaaccgacattatcagaccggaggatttagacgaagagcgtgcacaattactggaatctgttaaggaggttccaggtgttgaaatcatgacttcttcatgccaactggaagaaaacgttatggaagttagaaacaaagcatgtgaaaaactattggcttctagaattgagaataagttgaaatctcagtctagaatcaacaatgttctgaacaagattcatgttgctcaacctcaagcaagagatgatgtcaagagaacaccatttatcccagaatctgtcaagaatttgaagaaatacgaccctgaagatccaaacaggagaaagttggccagagacatcgaagctgaaaatggtggtgctggtgtcttcaatgttaacttgaaggacaagtacctattagaagatgatgagtggaagaatgacatcatgccagaaatcttggatggtaagaatgtttatgatttcttggaccctgaaatcgctgctaaactgcaggctcttgaagaagaagaagaaaaattggagaacgaagggttctacaattctgacgatgaggaagaaatctacgacggtttcgaagcatccgaagtagatgatatcaaggagaaagctgcatggattagaaatagacaaaagacgatgattgctgaagcaagaaataggaagtccttgaagaacaaagctatcatgccacgttctaaactaactaagtcctttggtaaaatggaagaacacatgtccactttgggccatgacatgtcagccttacaagataaacagaaccgtgctgctcgtaagaaccgttatgttgaaagaggttctgatgttgtttttggcgaccaagatgctttgacagcttccactgaaaacggtgtcaagttgagacaaaccgatagactgttggatggtgttgctgatggctccatgagatccaaggccgacaggatggccaagatggaaagaagagaaagaaatagacatgccaagcaaggtgaatctgatagacacaatgctgtttccttatcaaagcatttattcagtggtaagcgtggtgtcggtaagacagatttccgttga

SEQ ID NO: 4378 - DNA, 1944 bp, Saccharomyces cerevisiae
atggaagctggcaggagtgctgatgaagtgctataccacaatcagtcgtcagtaaagttaggtgagttagaaagatacgttattacatatgagctataccagggtgatagtattcccgctgatatcacactggattccctatgggtaaagatcaaaaataccacaaagctatcctataaaccagcctatctattgggcccatttatcttatattgtgacgtgcgagcaaaagattacgaaagctcgtataagatcatatgttcggcggataaaccagtatttcaatcaaacctacaggcacaacaaaagtttattgcagagttgtccttgcaccacattaagccacgctatgtatggatagtggatattgtcagtcaaatactatttaataaagaaactaaggtaacttttgagatagtagtcggcaattcaaaggcctctttgaaaagaaaaatacgatgtaatgattcattgcctgataaagcctgcaatattttacacacaggattatcggtgcatagacttaccaccgcagatatatggaaagtaccacgacccatagacatgtcgcaaaaatcccatttagtcattctcacgcatggttttcaatcaaacgtttcggcagatatggaatacttaatggaagaaatatacaaggctcaaatgaacaatccaaatgagcgactagttattaagggatatatgaagaatgcttgtgagactgagaagggtattaagtttttgggtgttggattggcaaactacatcatcgacgagttatatgatgactctgttgggaaaatttcatttattggtcattccctgggtggattaacacaaacttttgctatttgttacataaagaccaaatatccatatttctttaagaaagtggagccaatcaattttatctcactggcgtcaccattgctaggcattgctaccagcacgcccaattacgtaaaaatgtcattgtcgatgggtatcattggtactacggggcaagaactgggtcttaaggatggaaattatggtgataagcccctactttacctgctatccgaggaatccttaatcagtgtgcttgctcgattcaaaagaagaacactttatgctaatgccgtcaacgacggaatagttcccttgtactcctcttctttactttttttggactactctcaattacttcagaaactgggaggtcaaactacggcaccttgtgatcctctcttccagcctgaagtaagtcctattggggaacttccaaatcatagcgatgttgctaatgatgatgatggaatcaatgcatcgtcatggaacacgttttggaagagcaaggaaaataactgcgacaagaaatctaaacgcttgatgaatgcttccgtcatcaaatctatgaagtctgtgcttctatcaccatgccccgacgcaaagttcttctcagatcccgatgcaagggtcgcaacaatcatacatgataagatctacacagaaaagaatttaccgcctccatcaccaacactttatgaaggaacagcagccaaggaaggcgaaacgaggaagacgagaaaagagatggaggaaatcatagcacgccgctggcacaaggggatgcattggaggaaagtcgtggtattgctgaaaccagatgcccacaataacatcatcgtaagaagaaggttttccaacgcttacggctggccggtggttgaccaccttgttaccgcccatttccaaagagatgacccaatcgcctcaccaatgcaagataaacagtttgctgaggaagatataaacatggcaaccggaggggtggaaccaaacaagttctactcatggctcaccaagatcgaggatcctagtgtgtaccatggtggaatagtctccacagctagccagctcgccagctcctggattagcaagcattcctctgtgacagattga

SEQ ID NO: 4379 - DNA, 1944 bp, Saccharomyces cerevisiae
atggcgtcacagcaaaacaaacacgcttttctttcaaagaatagaatctttcacaatcccgataatgtgtcctcatcaaaatctcgaaaccttatggatatcacaaacacgacaaacaccatgaatggctctagaccttcgtctatgaagagttcattggctcttccacccgtaaaggattccttcccatctgtatctcgatctgcatcattaaacatcaacatgagcaaaattaaggacttaaaagaccgccaagacaaaataaggttccaaagacatactctcaggactcaattgattgagtgcgaaagagaaatcaaaaccatcaagtttcgagatctcaataagtccaggtttgaactttataagaaaaaatccaaacaagcaaagtatctcaaacaggttagagatttgacgcaaaatctgaactccaaggacggtgaacgcgctgatttaattaagaagaacaaatccgctttggcaaccttgcaggctgaactcgaccagaatctgatcttgaaaaggcaggaatctcaagaattgtacaataataagcttatcttttgggaaaatgagctgcaaataatggaaaatgtcgagcctgaccacgaaatcacagaggaaatatctcagttgaagaaaacgctgcaagagctcaacataaattgggcgaatttacagaagcaaaacttggaaagacaagtaaaccacgaatcacaattgaggaaggattttattgcattcaaagaagctaagttaaaatccatggaaaatttgacaaacaaacatcgtgaattacttgatcagatagccactctacaatcggaaagtgagaagttacacaaggagatcatggatatagatagacaagctgaatattcggaacaaaacatctcagaaataaatgaaaatataaaacaattggaattggcaaacaacccactaataagcaaatccttacaaaactcgcaagatttggaacatttacaaaaccaaatggaaaatttgaaagaaatggcctctaaacaggaaaaattttataatgatacctataacactgtggaaaaagaactcctgcggagtaggagacttgaaaactctattattgaacaaaaaggcacgatgcgctgttacgcttacgtgatggagcaaaatttgcctgagaaccttttatttgattacgaaaatggcgtaataacccaaggtctaagcgaacatgtttacaaatttaatagggtgataccgcatttaaaagtttctgaagataaatttttcactcaagagtatagcgtttaccatgatatgtgcctgaaccaaaaaaaaaatttcaacttaatatctctaagcaccactccacatggctcattgagagagtctctaataaaatttttggccgaaaaggatacaatatatcaaaaacaatatgtgatcaccttacagtttgtatttttatcagatgacgaattttctcaggacatgctcttggattattcccacaatgataaagatagcataaagttgaaatttgaaaaacactcaatttctttggattccaaacttgtcatcatagaaaatggactcgaagatttgcccttaaattttagttgtgatgaacacccaaatttacctcattctgggatgggtataatcaaggtgcagttttttcctcgagattcaaaaagcgatggcaacaatgaccccgtaccggtggacttttattttatcgagttaaataatctgaagtccattgaacagtttgataaaagcatctttaagaaggaatcatgcgagacccctattgcacttgttctgaaaaaactaatttctgatactaaatcctttttcttgctaaacttgaacgattcaaaaaatgtcaataaattattaacgatttcagaagaagttcaaacacaactttgtaaaagaaagaaaaagctcacttaa

SEQ ID NO: 4380 - DNA, 1944 bp, Saccharomyces cerevisiae
atgtcaagcgaggaacgctcgagacaaccaagtactgtttcaactttcgatttagaacccaatccttttgaacaaagcttcgcctcttccaagaaggctttgtcacttccaggcacgatctcccatccgtctctaccaaaagagctttcacgaaacaattctacctcaacgataacacaacattcccaacgttccactcatagtttgaacagtattccagaagaaaatgggaattcaaccgttacagataatagtaatcataatgacgtaaaaaaagactcacctagttttttaccaggccaacaaagacctactataatatctccgcctattctcacacctggtgggtcgaaaagattaccacctctactcctttctccctctattttatatcaggcaaattcaactacgaatcccagtcagaattcacattctgtttcagtctctaattcaaaccctagtgcaataggcgtttcttctacctccggatctctgtatccaaacagctcttctccttcagggacttcacttatacgccagccacgaaactcgaacgtgaccacaagtaattctggtaacggcttccccacgaatgattcacaaatgcctggctttttattaaacttgtccaaatctgggttgacacctaatgagtccaatatcaggaccgggttgacacccggtattcttacgcaatcttacaattatcccgtattgccgtcaattaataaaaatactataacaggtagcaaaaatgtcaacaaaagtgtcacagtgaatggaagtattgaaaaccaccctcatgttaatataatgcacccaactgtaaatggtacaccacttacgccgggattgagttctctgctaaacttaccatctactggagttttggctaatccagtattcaaatcaacacctacaacaaataccacagatggtaccgtcaacaacagcatcagtaattccaatttttccccaaatacttcaacgaaagcggctgtcaaaatggataatccggcagagttcaatgccatcgagcactccgctcataatcacaaggagaatgaaaatttaacgactcaaattgagaacaatgaccagttcaataacaaaacacgaaaaagaaagagaaggatgtctagcacaagttctacttctaaggcttcaagaaaaaattccatatcaagaaaaaactcagcagttacgactgcaccagcacaaaaagatgatgttgaaaataataaaatttcaaacaacgtaacacttgatgagaatgaagagcaagaaagaaaaagaaaggagtttttagaaagaaatagagtagctgcatctaaatttagaaaaagaaagaaagagtacatcaagaaaattgaaaatgatctacaattctatgaatctgaatatgacgatctaactcaggtcattgggaagctatgcggcataataccctcaagctcctcgaattcccaattcaatgtgaatgtttcaactccgtcatcatcatcaccaccatctacatctttaatagcattgttagagagtagcatttcaaggagtgattattcaagtgcaatgtcagtattatcaaacatgaagcaattgatatgtgaaacgaatttttaccgaaggggaggcaaaaacccaagggacgacatggatggccaagaagacagcttcaataaggacactaacgttgtcaaaagcgaaaatgcgggctatccttccgttaattcaagaccaataattctagataaaaaatactcactgaactctggagcaaatatcagcaaaagtaacacaactactaataatgtgggaaatagtgcacagaatataatcaattcatgctactctgttactaatccattggtaataaatgcaaattccgatacccatgatactaataagcatgatgtactatccactctacctcacaataattga

SEQ ID NO: 4381 - DNA, 1947 bp, Saccharomyces cerevisiae
atgatgttggagccttcacctccacctttaacaacaacggtaacaccctcccttccgtccagtttaaagaaatctgtgacagataatgaccagaataataacaacgtgcccaggaagagaaaactagcatgccagaattgccgtagaagaagaaggaaatgtaacatggaaaagccttgttcaaactgtatcaagtttcgtaccgaatgtgtattcactcaacaagacttaaggaacaaaagatattctacgacttacgtagaagctttacagagccagattcggtctttgaaagaacagttgcaaatattaagttcctcgtcttccacaattgctagcaatgctctctcctcgttaaaaaacaacagtgatcatggtgatgctcctaatgaaaaaatcttaaagtatggcgaaacagcacaatcagcactaccatcatctgaaagcaacgatgagaatgagtctgatgcgttcaccaagaaaatgccttccgagagccctccaccagttggcacaaatagtatatatccatcaaattccttgtctataataaaaaagaagacggatggaagcacaagatatcagcaacagcaggtcagcctaaaaaatttatcaagaagtccccttatcttaagatcgttgtcactctttttcaaatggctatacccgggacattaccttttcattcatagagaaactttcttaagtgctttcttcggtgatactaacactaaaagttactattgttccgaagaattggtatttgcaatcgctgcattgggatctttgatttcatacaaatcagaaactgagctttttcaacaatctgaagtgttttatcaaagagccaagacgatagtactcaaaaaaatttttcaactggaagattcttcgttagctgaatcgtcgtcctcttcgaaattagcaatcatccagactctattgtgtttggcattttatgacattggaagcggagaaaaccccatggcttggtatctttctgggctggcatttaggattgcccacgaaatcggcctacatttgaatccagaagcatggagtaatgtttatgaagacgagctgtcaataatggattttgaagtgagaagtagaatttattggggctgctacattgctgatcatttaatagcgatcctctttggaagatcaacttccttgcgtttgtccaattccactgttccagaaacagacgagctacctgaaattgagactggtatagaggagtacatatatgacccaaaagtaatattgtccactgcaaaccccttgaagaaactgattgtgttatcgagaataacggagatttttgcatccaagattttcagcccaaacgaaactctacttcaaaggagtgaatacttggccaaatttaatctggaggtatacaattggagaagggatttgccccctgaactacaatggaccaagaggtcattgatggaaatgacagattttaacccaaccatagcttacgtatggtttcattactatatcgtgctaatttcctataataaacctttcatatacgaaatcaaacaaagccgggaattggttgaaggttatgttgatgaactgtattatcttttaaaagtttggaaaaataaatttaagacgtttgagaaggccacaatttacatgatttattctgcgattttagccatccaatgcatgaagtccaacttgattaaaaaggatagaaaacaagacttcttaaattttttaagtgcgcctaccctgaattacgaacttgctagaaaattcatagaaaactctgaagatgctttgcataattcagaaactatggatttattagggactctatctcacggtaacgattttgccttagagtacaattttgactttactttattgaatgagattgatatgctgattggtggaaacaccaatgatggtttgtcgaagtaa

SEQ ID NO: 4382 - DNA, 1947 bp, Saccharomyces cerevisiae
atgccttacagccatggtaagaagcttaaaccgtctttgaaactcgcaaaaacaatctccacttcttcttttgtttcctcaacaacctctaattcattttcaccactagaagactctacatctgcatcttcgtcgacatcatcttcatcatcagggaaatcggtaaggtttgctgcacatttatacacagtcaaaaagttcaacacaaaattggcgcctatctcgatatcagaaaaagccgcttcaaatcttacaagaaatttgcataacaatgccattccactaacgttccccttcattggaggtgaagatcatcgttatagtttagacattttagattacagtgatttagaatatgacaataaggatgttgagtatgacaacgagagtgacgtagaggataatgcaatgcttatgcatgatcgtagcatgttcattgaaaaggagattctctgctttggtgaagaggagacattcgatatggcagattggaaactggtcagtaataatttgaatccattcaaaagtgactataaagtggacgttactgggttggaagacaagattttcaaatacttaaatggacaaaatataaaggttcattcattagaactatctgatcctgtaagctacgaggatatttgtagcaataattttggtaactgtcaaatctggggccttatatttgtcaataatttgaacttcgagaaaaaaatagagataaaatttactttaaataactgggcagatattcactatattaatgcacactacaacaagtctgtcacccctcatgttgacgaattcaaatttattattgatatatctgcgttgaagttaaatctaatatcaaaaaacttgatttacactaacttttttgaaaggaaaactacttgtctcctgaatttgcagttctgttgtcgttatgatgtaaatggtttcgaatatagatcattttacgataataatgactataaaaactatgaaataacgatctctttgtcagcaataaatctaaatcgtgcggtttcgaattcatcgatatttaattccaatcttgggccttccaaaatgggggctagcaatgcagaggttactatgtcgaaaaataatgaaaattctaaaaagcctctcagaaaattcattaaagatacagattactacaacgactccccgttaaagcacaaattttatcaatcgtttgaaacaaaagcggcttgtaaaaccgaacctgtatcccaaactttcaaagctgaaacaattgattgtgaaattgaaccatttaattatttctttgaaccgcctgattcccaaactaatgaggacatgtccgatagctcatatgacttatcgctacaagattttaactattgggaatttagtaaccacggactagggaaagcactggctgactcagatatcttacaatttaaaaattatccaaaaccagagccttttagcaggcctcccataatagatgacacattcacattaaataccgatgataggaccttaggttcaaaaacacaaaagcttgaagataatttggccaaagagtggaaaagcgctaagacaaggaccacgttaaacgagacgccattacacgatgatgagcatagaacttccttcacctacaccacttggaataattctaccgatacattgatgaaaagaaaagaggagcgaccagtagaatcagcctcttgttctcagttatccattgcaaccataaaggcggaagaagatttactataccaagattatatcaacagcgggagggaaagctcatctccggaaatttctcccttgaataccacaacctcattaccattttttccaggtgataatatgagtgacagctcaggagaatatgaggagagaacctctcttagccctaataaaattcacatttttcgtgattatttttataagtcgccgtcaccctaa

SEQ ID NO: 4383 - DNA, 1950 bp, Saccharomyces cerevisiae
atgccagtggaggagcctcttgctacactttcatcaattccagattctagcgcggaccaggccccaccgttaatagcagatgaatttacgttagacctgcccagaattccaagtttagaattgccacttaatgtctccacaaaacactctagtatacagaaggctataaaaatgtgtgggggcatcgaaaaagtgaaagaagcctttaaagaacatggacctatcgaatctcagcacggattacaactgtacttaaacgatgatactgatagcgacggatccaagagctattttaatgagcatcctgtaattggtaaaagagttcccttcagagatgagtcggtcatattaaaggttacaatgcctaagggaactttaagtaaaaataataatagcgtcaaagattctatcaaatccttaaaagattcgaataaattgagagtcactcctgtttccatagtagataacactataaaatttagagaaatgtcagattttcaaatcaaactggataatgtcccctctgcaagagagttcaaaagtagctttggctctctggaatggaataatttcaaaagttttgtcaattctgtaccagataatgactctcaacctcaggaaaacatcgggaatttgatcttagaccgtagcgttaaaattccgagtacagatttccaactgccgccacctcctaagttatcaatggttggtttccccctgctttataaatataaagctaatccatttgcgaaaaaaaaaaaaaacggtgtcacagaagtgaagggaacatatatcaaaaactatcagttgtttgttcatgatcttagtgataagacagttataccgtcccaagctcatgaacaagtcctgtacgattttgaggtcgcgaagaaaacaaaagtctatccaggcactaaaagtgactctaaattttatgaatcgctggaggaatgcttgaaaattttgagagagctcttcgctagacgtccaatttgggttaaaagacatcttgatgggattgtcccgaagaagatacaccatactatgaagatagcgctggcactcatatcttatcgtttcacaatggggccttggagaaatacatatatcaaatttggtatagaccccagaagttcagtggaatacgcccaatatcaaacagaatattttaagattgaaaggaaattactatcttctcccatagtgaaaaagaatgtaccaaagccaccacccctggtattcgaatcagacactccaggcggtattgacagcaggttcaaatttgatggaaaaagaataccgtggtacctgatgttgcagattgatttattaattggtgagccaaacattgcagaagtttttcacaacgtcgaatatttagataaggcgaatgaactaactggatggttcaaagaattagacttggtcaagataagaaggatagtaaaatacgaacttggttgcatggttcaaggaaattatgagtataataaatacaagttgaagtatttcaagacaatgttatttgttaaagaatccatggtacccgaaaacaagaactcagaagagggaatgggtgttaacaccaataaagatgctgatggggacataaatatggatgcaggtagtcaaatgtcctcaaatgccatagaggaggataagggtatcgctgctggtgatgattttgatgataatggcgccataactgaagagccagacgacgctgctttggaaaatgaagagatggacactgatcagaacttgaaggtgcctgcaagtatagacgatgacgtggatgacgttgatgcagatgaagaagaacaagaaagttttgatgttaaaacagcgagcttccaagatatcataaataaaatagctaaactagatcctaaaaccgcggaaacaatgaaaagcgagctcaagggatttgttgatgaagtcgatctgtaa

SEQ ID NO: 4384 - DNA, 1950 bp, Saccharomyces cerevisiae
atggtttcagcgcaagtggctaccgagctaggacagcctataccactggacactcaacatgcggtatctgtatgtttcccgacatggaaatctgtaatttcgtatgtggagaaagaccccaaagttttagggtgtttaaagtctggctaccccaggttttggatccacccctcgattcaaaagctgcgtgatattttaatagaaaagtatgctaaagaaaacgaaacgtgcttttgcttcccctcttatagagttgccaaacggtgcagagagtatgtaagaaggaagtgcgcgcatcgcaatggcaaagtaaggatattacagttagccacggcgaaacctatcaacgaggagcagaagacgtggaaaagagagtgtaagattgcggtagtgtttgtagatggggcatacgagaatatattaaaacagtattggcaatacaccggagagatcatctcaagcagactagctgaatatgttttgcatgaacttttcatggtagaaaagaaatccagccctgcagaggaaaaggaatacatagagatgcggtatggcaggaatctgaattttgcatttgccgatcgagccaaggaattgattaagaagaggatcgctacaaaggttatagataaagatgagcacgatgaggaggaaaactaccatttcttagcaggtaaccaagatgaacaggacttccaggacacgtttctggattcatccctcaatgaggctaaccacggagaagatcatgacggcgggattagcggtgaagtagacagtcaagaagaaccgcataatggccttgtttccactatacccccggagcccatcgaaatgagcacgatagaggaagagcaatccgtagaggaagatgccgggaggtgtgcattaagggtttgccctgagagagacgtttttttgtttccgagcggcatggcgtcgatattcactgcgcatagattgctgttgcaatgggactcactgcgtttgaatagatccagaaatggaagcgacgtcacctcgtcacctccgaataagaagaccgtgatttttgggttcccttatgcggatacattacatgtcttgcaagagtttaatgaaacgtatttcttgggagaaggagatgagtcttcaatgaaagaactaacaaaaattttacattccggggagcaaattcttgccgtttttatagagaccccatcaaacccactattaaaaatgggaaatttactggaactgaaaaggctttcggaattatttgggtttttcattatcattgatgaaactgtgggtggaatagttaatattgacggtctaccgtttgctgatatcgtttgcagttcattgacgaagacatttagtggggactctaacgtcattggtggttcaatggttttaaatccacaaagccgggtatacgagtttgcctcccgttttatgcaattagaagacgaatatgaagatttattatggtgcgaagacgcaatttacctggaaagaaattccagagatttcattgctagaaccatcaggatcaactacagcaccgaatacctcttagataaaatactgaagccacacgtaggcgaaaataaactattcaagaaaatctactaccctaatctaacctcaaaagaaacactaaccaactatgacatggtgaggtgtaagaaagaaggtggatacggcgggctcttttcactaacgttccatgacgaagatcatgctgcggccttttatgacaatctaaagctgaacaagggtccttccttgggcacaaatttcacactcgcattcccctatacgctcatgacatactaccacgaactcgacatggctgaaaaatttggggttgagagaaatcttctcagaatcagcgtaggcctcgaaagtcagtcaatattgggcaagatcttccaagaggcaattgataaaacggtagaaatatga

SEQ ID NO: 4385 - DNA, 1950 bp, Saccharomyces cerevisiae
atgtcattagtgcataatcagacgaatttaaacgaatccaaatttcttatagaaagggcatttagttctagttcagaaaccgttccattatcaaaggaggcaacatatcccatgccaactgcatatagtttttccgcagttaggagcaacagcgagactaacattaaaagagagaacccgcaaggttttgcaaaagaacctattatgacttctatgcttcataatttgaccatgtccacggggaaagggaacgggaatgacgtcaattctttagccccacatgatgtggatgttggcccctactgtcttttgctgaggaatttgccaaaagacattacactaagagagtgttattgtatattttcactagcaactggggtgtcaagtatagaactaaaaagggatgatagagaaccctttaatgacaatgaaaaagtcgttgtggtcaaatttggatccctttctttagtaacccattatgctaatatattaaactcgaagtctgagatttttgggcctagtttcccctttaggtctcacattgacgtagtaaatgaacaaacgcagcttccagtgagttttcaagaacatgtttcatctggcactacaaatagttctccaaagaattaccaattgtcgtccagtgcgcaaaatgaaattcaaaatcaaagttttaatactatatcatatggaaaaactagttcctctccattagggccttcagcggccaagccaaggccttcattactttcagagagatccctccgtttctcattcaatgacccattcggattggaaacaatctctcaaagaaaagaatccgtaccctttctacgaaatagcatctcacaacatgatttatcaaacgtaaccaccacaccagttccagcaggaatgccacctcagaaggacgctggcaagtcacttttgctactagaaaaggatgaaataaatgaaagtatttggaatggtgatgaattagttaatgatgttggtaattcttcatttggtgcatctttacaagagcctccgatgtcatctacgcctgtgatggagtggaatgcttcctcaactgctaatattcctctttttcaattatctagccaagaaaatcatcagtctaatctgttgcctccatcccaccattcaattagccaggatgttccacatattcaatcacaacctaatctgaacaattcaggagtaatacattccgcgacttctctaccgcattatcacttattgaaccaaattaatgcttcaactaagacacaaagtattcagcagagcgtttcgaatgttccttccaatttggacctgaatctccaaacggaaaatggccacccacaatcttctgctcctaacgggtcttcaatattcaacaaccaaaaggtgaatcaaggctttttagtgagtgaacaagacaccagtacaatatcacgacagaaagaatgttcttctacagcttctgcctctgcattttcgaaaaataacgaaacaaatgtggcaggttccacaactatttcacaggctgacctatcactactagccaaggtgccaccaccagccaatcccgcggaccaaaatcctccttgtaatactctttatgtgggtaatctacctccggatgccacggaacaagaattaaggcaattgttttctaatcagcaaggttttcgtagattatccttcaggaataaaatgaactctcacggtcatggcaacggtcatggccatggtccaatttgttttgtagaatttgaggatgttagctttgccactagagcattggcagaattatatggtagtcaactacctcacccccgcccttccctcaacaacaaaggaggtatcaggttgagcttctctaaaaatccattaggcgttagaggctcaaacagtaggagtaaatctggttacagctttaatggaagttacgggaaatcatga

SEQ ID NO: 4386 - DNA, 1950 bp, Saccharomyces cerevisiae
atgtctagagcagttggtattgatttgggaacaacttactcgtgtgttgctcatttttccaatgatagggtagagataattgcaaatgatcaaggtaataggaccactccatcgtatgtggctttcacagacaccgaaagattaattggtgacgccgccaaaaatcaagctgcaatcaatcctcataatacagtttttgatgcaaagcggttaattggtcgtaaatttgatgatcctgaagtgacgacagatgccaagcacttccctttcaaagttatatccagagatggtaaacctgtagtgcaagtagaatataagggtgaaacgaaaacatttacgcctgaggaaatttcttccatggttttaagcaaaatgaaggaaactgctgagaactatttgggaactacggtcaatgatgctgttgtaactgttcctgcatatttcaatgattctcaaagacaagccactaaggatgcaggaactattgcagggatgaacgttttacgtattatcaatgaacccactgcagcagcaattgcttatggcttggataagaaaggcagggctgagcacaatgtcctgatttttgatttgggtggtggtacttttgacgtctctttactttcaattgatgagggtgtttttgaggttaaggctaccgcaggagacactcatttaggtggtgaagattttgataataggttggtgaaccatttagccactgaattcaaaaggaaaacgaaaaaggacatctctaataatcaaagatcgttaagaagattgagaactgcggcagaaagagctaagagagcgctttcttcctcatctcaaacctcgatcgagatcgattctttatttgaaggtatggatttctacacttcgttaacaagggcaaggtttgaagagctatgtgctgatttattcagatccacattggaaccagtagaaaaggttcttaaagattcgaagctggacaagtcccaaattgatgagattgtgttagtcggtggatctaccagaatcccaaagattcagaaattagtttctgacttcttcaatggcaaagagcctaatcgttctatcaacccggatgaggctgttgcttatggtgcagccgttcaagctgccattttaaccggcgatcaatcaacaaagacacaagatttactattattggatgttgcgccattgtccctaggaattgaaactgcaggcggcataatgactaagctaattcctagaaactcaacgattccaacaaagaaatcggaaaccttctctacctatgcagataatcaacctggtgttttaattcaagtctttgaaggtgaaagaacaagaacaaaggataataacttacttggtaaattcgaattaagtggcattccgcctgctcccagaggtgtgcctcaaattgatgttacctttgatatcgacgctaatggtattcttaatgtgtctgctttggaaaagggtactggtaagagtaacaaaatcacgatcactaacgataaaggtaggctctcgaaggatgatattgataggatggtttctgaagctgaaaaatatagggctgacgatgaaagggaggcagaacgagttcaggctaagaatcagcttgaatcgtatgcatttactttgaagaataccataaacgaagcaagtttcaaagagaaagtaggtgaagatgatgcaaagagattagaaacagcgtctcaggaaaccattgactggttagatgcatcgcaggcagcctctacggacgaatataaggatagacaaaaggagttggaaggcattgccaatccaataatgacgaaattttacggtgctggtgccggcgcaggtcctggagcgggggaatccggtggattccccggatccatgcccaactcgggtgctacgggaggtggagaagatacaggtccaacagtggaagaggttgattga

SEQ ID NO: 4387 - DNA, 1950 bp, Saccharomyces cerevisiae
atgttttcggtaacgagaagaagagctgccggtgcagctgctgccatggccacagccacggggacgctgtactggatgactagccaaggtgataggccgttagtgcacaatgacccgagctacatggtgcaattccccaccgccgctccaccgcaggtctctagacgagacctgctggaccgtctggccaagacgcatcaattcgacgtgttgatcatcggtggcggggccacggggacaggatgtgccctagatgctgcgaccaggggactcaatgtggcccttgttgaaaagggggattttgcctcgggaacgtcgtccaaatctaccaagatgattcacggtggggtgcggtacttagagaaggccttctgggagttctccaaggcacaactggatctggtcatcgaggcactcaacgagcgtaaacatcttatcaacactgcccctcacctgtgcacggtgctaccaattctgatccccatctacagcacctggcaggtcccgtacatctatatgggctgtaaattctacgatttctttgccggttcccaaaacttgaaaaaatcatacctactgtccaaatccgccaccgtggagaaggctcccatgcttaccacagacaatttaaaggcctcgcttgtgtaccatgatgggtcctttaacgactcgcgtttgaacgccactttagccatcacggctgtggagaacggcgctaccgtcttgaactatgtcgaggtacaaaaattgatcaaagacccaacttctggtaaggttatcggtgccgaggcccgggacgttgagactaatgagcttgtcagaatcaacgctaaatgtgtggtcaatgccacgggcccatacagtgacgccattttgcaaatggaccgcaacccatccggtctgccggactccccgctaaacgacaactccaagatcaagtcgactttcaatcaaatcgccgtcatggacccgaaaatggtcatcccatctattggcgttcacatcgtattgccctctttttactgcccgaaggatatgggtttgttggacgtcagaacctctgatggcagagtgatgttctttttaccttggcagggcaaagtccttgccggcaccacagacatcccactaaagcaagtcccagaaaaccctatgcctacagaggctgatattcaagatatcttgaaagaactacagcactatatcgaattccccgtgaaaagagaagacgtgctaagtgcatgggctggtgtcagacctttggtcagagatccacgtacaatccccgcagacgggaagaagggctctgccactcagggcgtggtaagatcccacttcttgttcacttcggataatggcctaattactattgcaggtggtaaatggactacttacagacaaatggctgaggaaacagtcgacaaagttgtcgaagttggcggattccacaacctgaaaccttgtcacacaagagatattaagcttgctggtgcagaagaatggacgcaaaactatgtggctttattggctcaaaactaccatttatcatcaaaaatgtccaactacttggttcaaaactacggaacccgttcctctatcatttgcgaatttttcaaagaatccatggaaaataaactgcctttgtccttagccgacaaggaaaataacgtaatctactctagcgaggagaacaacttggtcaattttgatactttcagatatccattcacaatcggtgagttaaagtattccatgcagtacgaatattgtagaactcccttggacttccttttaagaagaacaagattcgccttcttggacgccaaggaagctttgaatgccgtgcatgccaccgtcaaagttatgggtgatgagttcaattggtcggagaaaaagaggcagtgggaacttgaaaaaactgtgaacttcatcaagacgtttggtgtctaa

SEQ ID NO: 4388 - DNA, 1953 bp, Saccharomyces cerevisiae
atgagtgtgtctaccgccaagaggtcgctggatgtcgtttctccgggttcattagcggagtttgagggttcaaaatctcgtcacgatgaaatagaaaatgaacatagacgtactggtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctactaaatatgaaaattccttctccggttttggccgacttggtttcgatatgagtgccaatcattacgtcgtgaatgataatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacatgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgctgacaaaatcaataatggcaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaa

SEQ ID NO: 4389 - DNA, 1953 bp, Saccharomyces cerevisiae
atgtattatggaatcagccagtttagcgaagcctacaacaaaatcttaaggaattcatcgtctcattcatcatgtcaattggtcattttcgtttcttgtcttaacatcgatgcgctgtgtgcgacgaagatgttgtcactattattcaaaaaacaattggtacaatctcaaatagtaccgatatttgggtactctgaattacgacgccactattctcaattggatgacaatataaatagtctgctattagtagggtttggaggcgttattgatctggaggctttcttagaaatcgatccccaagagtatgttatcgatacagatgaaaagtcgggggaacaaagtttcaggagagacatctacgtgttggatgctcatagaccgtggaatctcgacaatatatttggatcacaaatcatccaatgttttgacgacggtacggtggatgacacattaggcgaacaaaaagaagcatactataaattgcttgaactggacgaggagagtggtgacgatgagctctcaggtgacgagaacgataataatgggggtgacgatgaggcaactgatgccgatgaagtcacagacgaggacgaagaagacgaagatgagacaatatctaataaaagaggtaattcttcaataggaccgaatgatctctcaaaaagaaagcaacgaaagaagcaaatccatgaatatgaaggtgttttggaggaatactattctcaaggcacaacagtggttaactcgatatctgcacaaatctattcattattgtctgctatcggagaaacaaatctttcaaacctgtggttgaatatacttggtacgacctcgttagatatagcatatgctcaagtttacaatcgattataccccttattgcaagatgaagtgaagcgtctcacaccaagcagtagaaactcagtaaagacccctgatacattgacgttaaacatccaaccggattactaccttttcttactgaggcattcttcattgtacgacagtttttattattctaactatgtcaatgccaaactatccctatggaatgaaaatgggaaaaagagattgcataagatgtttgctagaatgggtataccattaagtactgcacaagaaacatggttatacatggatcattctattaagagagaacttgggataatatttgacaaaaatttggatcgttatgggttgcaagatataattagagatgggtttgttagaactcttggatatcgtgggtccataagtgccagtgaatttgtcgaagcactaacagctcttttggaagtaggtaattcaactgataaggatagtgtgaaaataaataatgacaataatgacgatacagatggagaggaagaagaagataacagcgctcaaaaattgacgaatttgagaaaaagatgggtttcgaatttttggctcagttgggatgctctagatgacagaaaggtggaactattaaaccgtggcattcaactagcacaagacttacagagagcaatttttaataccggggttgctatattggagaagaaattaatcaagcatttaagaatttatagattatgcgtcttacaagacggacccgatttagacttgtacagaaacccattgacgttattaagattaggaaattggctcatagaatgctgtgcggaatctgaagacaagcaattgttgcccatggtgcttgccagcatagatgaaaatacggacacttacttggttgctgggttaacacctaggtatcctcgcggactagacacgatacacacaaaaaaacctattttgaataatttcagcatggcgtttcaacaaataactgcagaaacggatgctaaagtgagaatagataattttgaaagttccataattgaaatacgtcgtgaagatctttcaccattcctggagaagctgaccttgagtggattgttataa

SEQ ID NO: 4390 - DNA, 1953 bp, Saccharomyces cerevisiae
atgttcacttttctcaaaattattctgtggcttttttccttggcattggcctctgctataaatatcaacgatatcacattttccaatttagaaattactccactgactgcaaataaacaacctgatcaaggttggactgccacttttgattttagtattgcagatgcgtcttccattagggagggcgatgaattcacattatcaatgccacatgtttataggattaagctattaaactcatcgcaaacagctactatttccttagcggatggtactgaggctttcaaatgctatgtttcgcaacaggctgcatacttgtatgaaaatactactttcacatgtactgctcaaaatgacctgtcctcctataatacgattgatggatccataacattttcgctaaattttagtgatggtggttccagctatgaatatgagttagaaaacgctaagtttttcaaatctgggccaatgcttgttaaacttggtaatcaaatgtcagatgtggtgaatttcgatcctgctgcttttacagagaatgtttttcactctgggcgttcaactggttacggttcttttgaaagttatcatttgggtatgtattgtccaaacggatatttcctgggtggtactgagaagattgattacgacagttccaataacaatgtcgatttggattgttcttcagttcaggtttattcatccaatgattttaatgattggtggttcccgcaaagttacaatgataccaatgctgacgtcacttgttttggtagtaatctgtggattacacttgacgaaaaactatatgatggggaaatgttatgggttaatgcattacaatctctacccgctaatgtaaacacaatagatcatgcgttagaatttcaatacacatgccttgataccatagcaaatactacgtacgctacgcaattctcgactactagggaatttattgtttatcagggtcggaacctcggtacagctagcgccaaaagctcttttatctcaaccactactactgatttaacaagtataaacactagtgcgtattccactggatccatttccacagtagaaacaggcaatcgaactacatcagaagtgatcagccatgtggtgactaccagcacaaaactgtctccaactgctactaccagcctgacaattgcacaaaccagtatctattctactgactcaaatatcacagtaggaacagatattcacaccacatcagaagtgattagtgatgtggaaaccattagcagagaaacagcttcgaccgttgtagccgctccaacctcaacaactggatggacaggcgctatgaatacttacatctcgcaatttacatcctcttctttcgcaacaatcaacagcacaccaataatctcttcatcagcagtatttgaaacctcagatgcttcaattgtcaatgtgcacactgaaaatatcacgaatactgctgctgttccatctgaagagcccacttttgtaaatgccacgagaaactccttaaattccttctgcagcagcaaacagccatccagtccctcatcttatacgtcttccccactcgtatcgtccctctccgtaagcaaaacattactaagcaccagttttacgccttctgtgccaacatctaatacatatatcaaaacgaaaaatacgggttactttgagcacacggctttgacaacatcttcagttggccttaattcttttagtgaaacagcagtctcatctcagggaacgaaaattgacacctttttagtgtcatccttgatcgcatatccttcttctgcatcaggaagccaattgtccggtatccaacagaatttcacatcaacttctctcatgatttcaacctatgaaggtaaagcgtctatatttttctcagctgagctcggttcgatcatttttctgcttttgtcgtacctgctattctaa

SEQ ID NO: 4391 - DNA, 1956 bp, Saccharomyces cerevisiae
atgagcgaatcggaagccaaatctaggtcggctacaccgccaagtaaagctaaacaagctactccaacaactacagctgcagctaatggagaaaagaaattaacaaacaaggagctaaaagaactaaagaaacaagaaaaagctgcaaagagagctgcaatgaagcaggctaatggtatatccattgaacaacagcaacaacaagcacaaatgaaaaaagagaagaaacaactacaacgtgagcaacaacagaaaagagagcaaaagcaaaaaaatgccaataaaaaaaaacaaaatgaacgaaacgtgaaaaagagcacactttttggtcatctggaaactactgaagaaagaagagcgacaattttagctttaaccagtgcagtatcatctccaaaaacttcgcgaatcaccgctgctgggttgatggtccccgtggtggctagtgcattatcaggatctaacgtattaacggcttcttccttgatgcccgtgggtccaaacgcgtcgtctactgtatctgcatcagctccagcttcaacaacaacgactcttcctgcctcttctgcagcactctctgccggtaccagttctgcgtcaacaaatactccaacagctatacaacaagagattgcttcatcaaacgcttctgatgttgccaagacattggcatctatctcgttagaggctggtgagtttaatgtcattcccggtatatcgtcagtgatccctaccgtgttagaacaatcatttgacaactccagcttgatatcgtctgttaaggaacttttattgaataaagaccttatccatccgtcgatattattattaacttctcatctagcacactataaaatcgtgggatccatcccacgttgcatagccatgctagaggttttccaaattgttatcaaagactatcaaacacctaagggaactaccttgtcacgtaacttaacaagttatttgtcacaccagattgatcttttgaaaaaagctagacctttaagtgttactatgggtaatgctatcagatggttaaagcaagaaatttcattaattgacccatctacccccgacaaagccgccaaaaaagacctttgtgagaaaattgggcagtttgctaaagaaaaaatcgaactggctgatcaactaattatagacaatgcctctacacaaattgaagaatctactactattgtgacatatggttcatcaaaggttctaactgaactgttactgcataatgcaatcagtttaaagaaaaacatcaaagtgattgtcgtcgattcgagaccactatttgaagggcggaaaatggcagaaactttaagaaatgctggtgtcaatgttatgtatgcacttattacaagtttggatacgatattcaatatggatgtggactatgtgtttttaggagcccattctatcctatctaatgggttcctatattcaagagctgggacagcaatgttggctatgagcgctaagagaagaaatatacctgtattagtctgctgcgaaagtttgaagttttcacaaagagtacaattggatagtgtcacatttaatgaactggcagatccaaatgacctggttaatatagattacgaaaatccagtcgagagacgcggtaataaaggtgcgttattaaaccaatttatcaaagaaagaaaatttgaaaagaaaaagctagcaatggagaataagccaaagggtaataaaattggcggtaagaaaggatctgaaggagaaagcaaggacgccagtaatgaagaagacagcaacagcaaaaatattttggatggttggcaagagttaccttcgttaaatattgtcaacatcttatacgatttaacaccaccagaatatattaaaaaagtgatcactgaattcggcgctttgccaccttcatctgtccctgttattttaagagagtacaaaggttccgcataa

SEQ ID NO: 4392 - DNA, 1956 bp, Saccharomyces cerevisiae
atgagtggaaaatttgttcgtgcttctaaatatagacacgtctttggccaagcggccaaaaaggaactgcaatatgaaaaactcaaagtgaccaacaacgcatgggactccaacttgctaaaaacgaatggtaaatttattgcggtgaattggaatgcctctggaggtggtgcattcgctgtcattccgatcgaggaagtgggcaaggctccagatcaagtgcctttgttcagaggccacactgcgcaggtcttggataccgattttgatccgtttaatgaccacaggattgcttccggttccgatgattctaagattggtatttgggacataccggaaaactacaaatttcacgatcatgtagatgaagatggagagccaattgatatcaaaccagtaaagtttttgacaggacacgcaaggaaagttggacatgttctttatcatcccgtcgctgagaatgtattagcatcctcttcaggtgactatactgttaaattatggaatgtggaaactggaaaggacatgattactttgaaacatccagatatggtcacatccatgtcattttcgtatgatggtaattatcttgccacagtggctcgagataagaaactacgagtctggaatatcagagaagaaaaaattgttagcgaagggcctgcccatacgggtgcaaaaaaccaaagggtggtatggttaggaaactctgacagattggctactactggtttttcaaaattgagtgatcgtcaaatcggtatttgggatgccttcaacattgaaaagggagatttgggaggcttctacactgtcgaccaatcatcaggtattttgatgcccttttatgacgaagggaataagattctttacttggtggggaaaggtgatggtaatattcgatactacgaatttcaaaacgacgagctgtttgagttgtctgaattccaatccacagaagcacagagaggctttgctgtagcgcctaagcgaatggtgaacgtcaaagaaaacgaagtcttaaaaggtttcaagactgtcgttgatcagcgtatcgaaccggtatctttctttgttccaaggagatcagaggagttccaagaagatatctacccggatgcaccttccaataagccagctttaactgctgaagagtggttttctggcaagtctgttgaaggtccaattctcgttagtatgagatctatctatgacggttccgcaccaagctttcatgaggctaaaagacctcaacagccaacaactcaagaaacagctcttgaagagaaaaaggagcagcctaaagtggagaagccaatcagcgaatccgaaaaggaggtgaaacaagaagctccaaaatctccctcaccgctaaagtcggcctcctcatcttctacaatcaaccatgtattaaaggaagataattcgatcaacaagttgttgaagaaatcctccgatattgatcaagttaacaacgccgaagatccgtctagggatacctccggatgggaagaagccgatgatgagccagctcctatcaaaatcgaaaccccagtcactccaacagaaactaaaaaggatcgcacacctaaggtcgaaccttcaaaagaattgaagccagagccagtgtctatcgcaacagatagaaaacaggagcaaagcttacctcaagaagagaagtcctctgagaaaacaaagtcccctgagcaggaaaaatccgcaacacctccttcttcaattacggctgctaagacagccattactgccagcagtaaggaagagccatccgcggcaaggacatcacctaagtcattgggtttaaaaaagtctgtcgaaaaactatctacattggttctgcaattagaagatgtagttgataaattaacgaaagcaaatcttgacaaagatgagcgcctgttaaagttggaacaaaaaattggcgaactgtcaaaatga

SEQ ID NO: 4393 - DNA, 1956 bp, Saccharomyces cerevisiae
atggcaaagaagaataagaaggataaagaggccaaaaaggcacgtgctgaactgaagaatcagaaaaaccaaaaaaagcaggagaaaaagtttcagaagaacaagaataagtctttaaacggcgaagaagatgatgaaagtgatcaagatctcgatgaaattctctctagctttagcaaaaagcaaattgaattagagcatgtagacatcacttctgtggaaaaaccctcttgtcgtactcatccgttgatgtttgcaaatccgcaacacaataaacatgaattgttcattttcggtggtgaatttacagatccagaaaccaaactaacacatttctataatgatttgtattcatactccataaagaacaactcttggaaaaaatacgtttcgcaaaatgcacctttgcccagatccagtgccgctgtcgctgtgcatccttccggaatagcactgttacacggtggtgaattttcgtccccaaaacaatctaaattctaccactattctgatacatggctgtttgactgcgttgaaaggaaattcactaagttggagtttggcggtagagactcttcacccagcgccagatcaggtcatagaattattgcttggaaaaactatttcatattatttggtggatttagagatttggggaatggtcaaacttcttacctaaatgatttgtggtgttttgatatctcaacctacaaatggaccaaattggagacaaacagcaaacctgacgctagatcgggtcattgtttcattcctacagataattctgccatattaatgggtggttactgtaaaatcattgccaaaaataataaaaatttaatgaagggaaaaatcttgaatgatgcatggaaactgaacttaacgcctgatccaaagaagtggcagtgggaaaaattaaagaatttcaagaaccagccctcaccaagagtcgggtattcgttcaatctatggaagcaaaacaagtccgttgcttttggtggtgtctacgatttacaagagacagaggaatccttagagtccgttttctataacgacctatatatgttccacctagagttgaacaaatggtctaaacttagaattaaacctcagcgtcaaacgaatagtaaaaattcacccgccacaagtaaaagaaaatctaataaagatcaagaaaaggaactgcaggatttactaaattccattctggccaagtctaatctaaatgacgacgacgatgacaatgatgacaacagcacaacgggtcctaactctatcgatgacgacgaagataacgaagatgacagtgatttggacaaccaagaagatattaccatctcaaatcaattacctcacccaagatttaacgcagcaacttgtgtagtgggcgactcgttgttcatttacagtggtgtctgggaactgggcgaaaaagattatcctataaactcattttatagtatagatttgaacaagttggatggtgtcaaggtttactgggaagacctatctgccatcgaagaagcaaagagactaggtgatagagattcggacgaagatgagtttgaatacgaggacgatgaggaggatgaggacgacggcgaagaggaacaagatgcaggaccccttgaaggtgatgaagatgaggaaagcgagagcgacgatgacaaacaagcgcagatggagattccagacgaaaggtcttggctaccacacccaaaaccgttcgaaactttaagagcattctacttaagggaaggtgcaaatttcttaacctggtctatttctaacaacagaaaccttaagggtaaacagttaaagacgaagtcatttgagttatgtgaagaccgttggtgggaaagaagagatcaggtgacccttgaggaagagcgtctggaggatacaggcggaatcattgaaagagatacgactactaaaccttccaaaagaaggtaa

SEQ ID NO: 4394 - DNA, 1956 bp, Saccharomyces cerevisiae
atgggattaaagaaattttttaagattaagcctccagaggaagcgacaccagaacagaacaaggatactttgatggaactgggtattagtgtcaaaaaccctagcaagaaaagaaaagagaaatttgccgcctacggtaaatttgcaaatgataaagctgaagataaggtatacgcgccaccaggttatgagcagtatgctaggccacaggatgaacttgaggatttgaatgcttctcccttagatgccaatgctaacgaggcaactgctggttctaatagaggttcaagtggcacgcaagatctcggaaatggagcagaatccaattctatgcaagatccgtacgctatcgaaaatgatgattaccgatatgatgacgatccttatgcaaggtttcaagctaataaaagtaatgggagaggtagcgtcaatgctgcgccttatggtgattatggaggggggtacaatggcacatctctgaattcatataataacgatggcccgtatagtaaccaaaatacttcaaacagctgggtgaatgcgaatggccgtaatagtttaaatcattcaaacagcactttaaacgtagggccttcgaggcaaacaaggcaaccgccggtttcaacgtcgaccaacagcttatcgcttgaccaaagaagtcccttagcaaacccgatgcaagaaaagagaaatccttacgctgatatgaatagttatggcggggcgtatgactccaatactaatagatctagcggtactcgacaaggaagctccaagaatgcaaatccatacgcctctatggcgaacgactcatatagtaatggaaatttgaacaggtctgcaaatccatattctagtagaagtgtgcgtcaaccgcaatcgcaacaagctccaatgacttatacgccctcttttattgcttctgatgaagcagcacgcaatagtgaagttgatttaaatgaagaacctagaacaggtgaatttgattttgaagaagtttatgctgacaagtctgcagaaaatagagcggcattagatgagcctgatttgaatgcagtaatgacgaatgaagattcaatagatttaaatgcgtccgaagttgatcatagttcaagacagcagcagcagcaacagtggttcatggatgagcagcaacagcaacagcaacactttaacgcaacaaataaccaatatggagatcaaaggggttacaaaacatttgaagaaatacaaaaagaagaggaggctcgccagcagcaggaagaagatgaagcagtagatgaaatcaagcaggagatcaaatttacgaaacagagttccgtagcctctactagaaatacactaaaaatggctcaagacgccgaaagagcaggtatgaacacattgggtatgctgggtcatcaaagtgaacaattgaataacgtagaaggaaacttagatttaatgaaggtgcaaaataaagttgcagatgaaaaagttgcagaactaaaaaaattgaaccgtagtatattggctgtccatgtttctaatccgtttaattccaagagaaggagaagggagagggaagagcagctgaagaataggaaaattgaagaaaaattaatgagagagcaaacaagtcaacaattgtctcagtccactcaaagaatagagggtgctatgaacgcaaataataacataagtgaggtgcgggaaagatatcagaggaagaatgttctagaaaaggcaaagagatatcagtttgagaatgatgaagaagatgacgaaatggaattggaaattgataggaatttggaccagattcagcaggttagcaacagattgaagaaaatggccttgaccactggtaaagaattagactctcagcaaaaacgtctcaacaacattgaggaaagcactgatgatctagatatcaatctccatatgaataccaacaggttggcaggtatcagatag

SEQ ID NO: 4395 - DNA, 1959 bp, Saccharomyces cerevisiae
atgtcgtctcctattaatgattatttcattgattataaccctctttttccaatctttgctacaagaattgcgaaaggccttgctatttacagagtctcggatcacgctaggcttgcagtaattccaataagaaatataaacttggtggcgaattacgattgggatacaactactggtaaatttttgtccatcttttttaaggatgggacgatcagaatccatgacatttttaaagacggtcgattagtttcattcctaagaattccgagtacaaaaatatcaaaaggtatatgggaccgaattccattaagatacgaaccaaataatcgagattttgcatgtaacatcattgatgatttaccaaagctaataaggtttgtaaaggactccaaaaggataaacattgtcccttacactcaaccgaatagcttgtggagaggtcctgatgaggatgatctagatagtaatgaaaaactagacgttcacgtagtattcaatgagggaaatgataaaattacagttttttttaatggtgattacgctgttttcttgtcggtggataatattgaaaacgaaaattctttaaaatcaattatcaaagttcaagatggcttttaccagtgcttctatgaggatggaactgtacaaactttaaatttaggacctttattacagagcaaatcatcagtgaacctgctgaattatataatggtaataaaagagcttataggttatatgcttactcatctcgagttcattaaccgggaactggcaacaccttatttagatttcgtcaaaagattgtgtgatgaagcctacggatatggcaaactcaaatcggaattagaagccctctttttacttggagagatctcatgtgacttggaagactggctttgcaattcagtaggtgagaagaactttaaaaggtggaagtatttaggttgtgaagcttaccaaaaaactgttcagattttaactttaatatttgtacccgcatgtgaaagaatcattatttatgtggagaagttaagggcaatattacaagccttttctatacagaataagctcagttatacgtcagatttgacagctgttgaagtgctcctaaaaagttcacagaaattgttaactatgacattaaattcaataataggcttggggagggacgaaacactttttgagaagtttttcatatggttcaacgacagacttcatgaagcgctagatgaagattataaactgaaatttcaatttgaggatgatctttactttggatacgatttactaagttactttgacagaatcttatctaaaaaaggtacggaacctagctcaataatcgacgtgaaactttatagagacctaattaacagcatgtctgatatggaaaaagatattgcacaaagtaatgttaattctcatattcaacagcatattctggttgatttaaaaacggatgtttttgcgcaaaaatatccatcttcgcaaataaatttgcttgatgccataaaattaccaaagcataattacatagtctaccttattcaggtaacaaaacacaacagtgctcaagaacctttctcagaagaaaacaaaaagaaactatatataggtactctgaaagatgagaatttaggcattatatcaaaggaatcgtcagtcaagattccggcgctattcaagagctataggttgagcagtacaaggtttgtgccgaatagggtccatagcttgcttcgggatattggattgtcagatagtaactatcatagtagccacgtcaccgattataggggagaaaactatgaaaacgaggaagatgatggcacaatagctattcctgcttacatcagggagaatagggaaaatgatgatttcatagcatgcaccgcgaaggtatcggtggatggaagaagcgcatccctagtgtttccaaaagaaaaacaaaatgtttga

SEQ ID NO: 4396 - DNA, 1962 bp, Saccharomyces cerevisiae
atggaccaaaaaggtatgttctggctttattttcaattatccgcccttcgttaggggtgttttagatcattttgattaacaattctatttatgatagcaattgtccttgataactctaaaagtggtagtaaacagacaaaatcgagtggcaaaatgcaaacgcaaacagatactaatgctgaagttctaaacaccgataacagtatcaaaaaagaaacaggaagtgattctgaggatcttttcaataaattttcaaacaaaaaaacgaacaggaaaatacccaacatcgctgaagaattagcgaaaaacagaaactacgtaaaaggtgcgtctccgtctcccattataatttctggttcctcttcaacttctccatcaggaccctcttcctccagtacaaacccgatggggataccaacgaatcgatttaataaaaatactgtagaactatatcagcattcaccatcccccgtgatgactactaacaagactgatacagaggaaaagagacaaaacaatagaaatatggataataaaaacaccccagaaagaggatcttcttcctttgctgctaagcaactaaaaatatcatccttgttaactatatcctccaatgaagatagtaaaactttgcatataaacgatactaatggcaacaaaaatagtaatgccgccagtaataatattccatcggcttatgcagaactccatacagagggaaatagcattgaatcactaataaaacccccaagctctcccagaaataaatctctaacgcccaaagttatcttgccaacacagaatatggatggtacaattgcaaaggatcctcatttaggtgataatacaccaggaatactcatagcaaaaactagttctcccgtaaatttggatgttgaaagcactgcacaatctctgggaaaatttaacaagtccactaattctttgaaagctgccctaacaaaagctcctgcagaaaaggtctctttaaaacgtagcattagttcagttacaaacagtgattctaatattagctccagcaaaaagcctacgtctgaaaaagctaaaaaatcaagttcagcatcagcaatactaccaaagccaacaacgaccaagacatcaaaaaaagctgctagcaatagtagcgattctaccagaaaaaaaaacgcctcgaacaagactacatcagccataaagaaagagtcaaatgccggctccaaattgaacactgttaagaaggaaaatagctctttatcttctatcaaagccactgagaaagaaaaagataaaggtggaaatagcacggaagcaaaaaactctaccagcaacgttagaaaggaaccaactgcaaaatccccaaaaaggttagtagccgcaccgacagtcagtccaccaaaaattctacaaacggcagaaaccaaagcaaaggaaccctcgatattgattgacgttccattgtatcaagctgatacaaacgactacctagacgaaaacggtcaggttatttttaatttatcaactttaataaaagagaagtatcacccgaaaagtaaagaactagcacaacttaaagactctaaaagaaatttattaatgcaattatccgatcattctaacggctcactagaaaaggaaaaagatgaagaaggagatgtaatagaacttgatgatgatgaggatatggaagaagatgaaggggaaatagatacagaaactaatactgtaactaccaccatctctccgaagaagaagtcgcatcctatgaaaggtaaaaatttgattggtaaatatgacgttgaagatccgttcattgatgattcggagttattgtgggaggaacagcgtgctgccaccaaggacggtttttttgtttactttggtccattaatcgaaaaaggtcactatgcaagtttggagcgtgcaaatggtaccatgaaaagaggtggtgttaaaaataaataa

SEQ ID NO: 4397 - DNA, 1965 bp, Saccharomyces cerevisiae
atgccaaataatactcttaaacaaggctccaaaattgaaaatgtttctccctctaaaggtcatgtcccaagtttttggaagcagttcataaacaaccctaagagtatgtcatccgaaaatattacagtccctagatcaccaacttctctttcaaggaatgctcaaccaactactttaaaacggcctccattatcttcaagaccatattcatataataccccaaccaaagataggaaatccttttccaaatccgcgaaacagaacaataacaataacaacgctaattccggaacatcgcctcacgcagagttcaaaaattacagagatatgtttttatctaatagaaatggtttcacaggtagggttttcggtgttactttagcagaatcgttgagcgtcgccagtgcagaggtcattgttcaaagtgagttggtgagttttggtcggatacccatcgtggtagccaagtgcggcgcatacttaaaagcaaatggattggagacctcgggtatatttcgtatagcgggcaatggtaaaagagtaaaagcccttcaatacatattctcgtcgccacctgattatggtaccaaattcaacgattgggaaacatatacagtgcacgatgttgcatcgctcctgaggagataccttaataatttggccgaaccactaatacctttatccctatatgaacaattcagaaacccgctacgatctagaccaagaatcctaaggcatatgttgacccacgaagtttctcatccgaatgcgaataaaacaaataatgtaacagtaaaatcaagtagacagaactataatgatgatggtgctaatgatggtgacatcgaaaaggaggacgctaaagatgatgaagaaaaaagacgaagaaaaatacgtcataagagaaggctgacccgcgatataagggcagctatcaaggaatatgaagagctctttgttaccttatcaaatgacacgaaacagctaactatatacctactcgatttactgagtctttttgcaaggcaatcacagtttaacctaatgtctggtagaaacttggcggccatcttccaaccttcaatattatcgcatcctcaacatgatatggaccccaaagaatacgagttatcccgactagtagtggaatttttgattgaatactcgtacaagctattaccccatcttttgaagttggctaaaagggaacaacaggaacggttgtcaaccgaaaataagaaaaataatggagataaacagaaaactgatcctatagaaataccaaagatcacctcatcggattcgccaccaatagtttcttccaataaaaacccaccggcgattgacaataacaataaactagaccatacgacgttatcgccaatatctacttcgataccggagaactcatcagacctacagacttcaaaaatgttaaagcctccgaagcaaagaagaccacactcaaaatcgtttggttctactccggttcctccggatgttattgctagtaataaaagaagaacgagtttattcccgtggttacataaaccgggaattttgagtgacacaggagacaatggcgacttaactgctactgaagctgaaggtgatgattatgaagaagaaaatgttgatccatacggtcagtctccatctagcgtacactcaggttctttgcccaaacagcattatctgccaattcctcgaatgaacagatcgttgagtggaaacagtaccaattcgtcctttaacactagacctatttcaatgatcctgaccagtggtaatgataattccgctgatcaattagaattactaagtaacactcatagcaataatgagcgcagtaatgctttaccattaaccgaagatgatggggatgaaagaaattcaagatcacgcaagagggaatcatggtttcaaagactaacaagccgttcaggctctgctaacagggcttga

SEQ ID NO: 4398 - DNA, 1965 bp, Saccharomyces cerevisiae
atgctacagatcaactccaggcttgcagttattgatggatggctggtagacactgtgaagcgaaaaccaataaattttcggagtcctgaagtaagattactgttacccaatgacgatgactacaaaaagctatcacaacaaaacttggtggactggacgcgattaaagaaggattctaattcggtgctcgttggagtgaaatctatggaactatttaaacacataaagctagttttgcgagagtttttcttgttagaagatggaagaataattctgaagaggatcagaagcaaattacgttacaaagttgtcaagaaattaacttgtaaatgctgcaggttatatttaccaaaatggggcaccgtgtacatacatccgatgctaaaagataaagaaaagcccttagcgggggtatgtgaattttcattggatgtaaaccctgatcgggagtatccccttattgagatcaatgttagtcatcaatacattataattgagggcttccttctatacttaaatgaaaggaggctctataggtggaacgataacaatttgaggagtcaggttggcttaacaaaatgggcccatttaagaaaaacttacaatccggtaagccttgacatactttatagtttgaattcaaatttttattttgtaaaggatgatctgctatttcaattattaggaaagagggtatttgttaaattttgtaaagtaatggaaaatggaaaatgcggtaaggctccactgtggtatcgtgtgaagagaacgacaactgccaaagcaacacatattgcatatgccatatcaaattcaacagccccagattcattcaaaagtaaaaataacgattataggtttattgtcagggaaaagccaattgtggagaatactatctccaacctggattattcagacataaaaaaacagcagtttactgaagcagaggttgtaaaaagaaagatctcagcagatatttctcaaatagagaatgtgcatacgcaatttaatagtcaaaaggaaaaaaataatatcagggtgaataaggtttctagcgaggtcctagatcaaatttcgaaatttcctgtgtccagagtcaccttactgttgatgtctgctggtcaagataaaaattatattgaacttgttgaagaattggcaagaaggttggaaaaaatatgcatagaaaaaaccacacaatctttagaagagataagggatacttttcaggcgaatcctgagatgcaggctagctttgataaggaatattaccagagcattgaagaatataaaattacactcgaacttattaaggaagaccttttgattactctgataaaacaaatggaaaatatgtgggcagctgaaaaaaagtttagtacagaggaggagtatgtttcgccgaggtttttagtagcagatggatttctaatcgacctagcagaggaaaaaccgattaacccaaaggatccgcgcttactgacactgctaaaagatcatcagcgtgccatgattgaccaaatgaatttagttaagtggaatgacttcaaaaaatatcaagatcctatcccgctgaaagccaaaaccttatttaaattttgtaaacaaataaagaaaaaattcctacgaggtgcggacttcaagttacatacattacctacagaagcaaatttaaagtatgagccggagcggatgacagttttgtgttcctgtgtccctattcttttggatgaccaaactgtccaatatctgtatgatgacagcattattcctgaatttgaagcaacatcttcatatgcaacaaagcagtcaaagtgtgggcggaaaatgtctttgcaaatggagcctgacctcctttttcaagaggccattagacggatgcgacatttaactgcttatgacgttttgagaagaaactatattgcggcatttgaggagctatatatgggaaactgtaacgattaa

SEQ ID NO: 4399 - DNA, 1965 bp, Saccharomyces cerevisiae
atgcttgctgctaaaaacatactaaacaggtcaagcttgtctagctctttccgtattgccacacgtttgcagtcaaccaaggttcaaggttccgtcatcggtatcgatttgggtaccaccaactctgcggttgccattatggaaggtaaagttccaaaaattattgaaaacgccgaaggttccagaactactccttctgtagtagctttcactaaagagggagaacgtttggttggtattccagccaagcgtcaagccgtagtgaacccagaaaacaccctatttgctaccaagcgtttgattggtcgtcgtttcgaagacgctgaagtgcaaagagatatcaagcaagttccatacaagatcgtcaagcactccaacggggatgcttgggttgaggccagaggtcaaacttactcaccagcccaaatcggtgggttcgtcttgaacaagatgaaggaaacagctgaggcctacttgggtaagccagttaagaatgctgttgtcactgtcccagcttatttcaacgactctcaaagacaagctactaaagacgcaggccaaattgttggtttgaacgttttacgtgtcgtcaatgaaccaaccgccgctgccttagcttacggtttggaaaaatccgactctaaagttgttgccgttttcgatttgggtggtggtactttcgatatctccatcttagatattgacaacggtgtttttgaagttaagtccactaacggtgacactcatttgggtggtgaagatttcgacatctatttgttgagagagattgtttctcgtttcaagaccgaaactggtattgatttggaaaatgaccgtatggctatccaaagaattagagaagctgctgaaaaggctaagattgagctatcttctaccgtttccactgaaatcaacctgccatttatcactgctgatgcctcaggtccaaagcatatcaacatgaagttctccagggctcaattcgagactttgacagccccactagttaagagaactgtcgacccagtcaagaaggctttgaaagacgccggtttgtctacttcagacatatctgaagtcttattggtcggtggtatgtccagaatgcctaaggttgtcgaaaccgttaaatctttgtttggtaaggacccatctaaggccgtcaacccagatgaagctgttgccattggtgctgctgtgcaaggtgctgtcttgtccggtgaggttactgacgtcttattattagatgttaccccattgtctctaggtatcgaaactttaggtggtgttttcacaagattgattccaagaaacactactattccaacaaagaaatctcaaatcttctccactgccgctgctggtcaaacttctgttgaaatcagagttttccaaggtgaaagagaattggttagagacaacaaattgattggtaacttcactttagccggtatcccacctgctccaaagggtgtcccacaaatcgaagtcacttttgacatcgatgccgatggtattattaacgtttctgctagagacaaagctacaaacaaagattcttctattactgttgccggttcttctggtttgtccgaaaacgaaattgaacaaatggttaacgacgctgaaaaattcaagtctcaagatgaagctagaaaacaagccatcgaaactgccaacaaggctgaccaattggccaacgatactgaaaactccttgaaagaatttgaaggtaaggttgacaaggctgaagcccaaaaggttagggatcaaatcacttccttgaaggagttggttgctagagtacaaggtggcgaagaggttaacgctgaggagttaaagaccaagaccgaagaattgcaaacttcctcgatgaaattgtttgaacaattatacaagaacgactctaacaacaacaacaacaacaacggcaacaatgccgaatctggtgaaactaagcagtaa

SEQ ID NO: 4400 - DNA, 1965 bp, Saccharomyces cerevisiae
atggacgagttactgggagaagcgcttagtgcagagaaccaaacaggtgagagcactgtcgaatctgagaagttggtcacccccgaagatgttatgaccatatcatccttggaacagagaaccttgaatcccgatttgtttctttacaaagagttggtgaaggcacatctgggtgaaagagcagcttctgtaattgggatgttggttgcgctgggcagattgagtgtgcgcgagttagtggagaaaatagatggtatggatgtagacagcgtcaagacgacactagtctcattaactcaattaaggtgtgttaagtacctgcaagaaacagcaatatccgggaaaaaaacgacttattattactataacgaggaagggatacacattttactctactcagggttgattattgacgaaattattacgcaaatgcgtgtaaacgacgaagaggagcataaacagctggtggctgaaattgtacaaaacgttatatcattagggtccttaacagtggaagattatctaagtagtgtcacgtcagattccatgaagtacaccatttcatcactattcgtgcaactgtgtgaaatgggatatcttattcaaatatcaaaattgcattataccccaatcgaagatctctggcaatttttatatgaaaaacattacaaaaatattcccagaaactccccgttgtccgatttgaagaaaagatcccaagccaagatgaatgcgaaaactgattttgccaaaatcataaataaaccaaatgagctttcacaaatcttaacggttgatccaaagacctcattgaggattgttaaacctacagtctctctgacgattaatttggatagatttatgaaaggtagaagatctaaacaattgattaacttggccaagacaagagtcggctccgtcacagctcaagtttacaaaattgcattaagactcacagagcaaaagtctcctaaaattagagatccactaactcaaactgggcttttacaagatttggaggaagcaaaatcgtttcaagacgaagccgaacttgttgaggagaagacaccagggcttacctttaatgctattgacttggcaagacatctccccgcagaattggacttgcgtggaagcttattatctagaaagccctctgacaataaaaagcgttctggctcaaacgctgctgcatcattacccagtaaaaaattaaaaaccgaagatggatttgtgatcccggcgctacctgctgctgtttccaaatctcttcaagaaagtggagatacacaagaagaagacgaagaggaggaggatttggatgcagacactgaggatcctcactcagcttctttgataaatagtcatttaaaaatcctagcatcatcaaatttcccctttttgaacgaaaccaaaccaggtgtttactatgttccatatagcaaactaatgccagtattaaagtcatctgtttatgagtatgttatcgcgtctacgttgggaccctcagcaatgcgtttaagccgttgtattcgtgataacaagctggtgtctgagaaaattatcaactcaactgcgttaatgaaggaaaaggatataagatctacattagcatctttaattagatacaattctgtggaaatccaggaagttccaagaacagccgatagatcagcatcaagggcagtttttttgtttagatgcaaagaaacgcattcctataatttcatgagacaaaacttggaatggaatatggcaaatttactttttaaaaaggagaaattaaagcaagaaaactctacattattaaaaaaggcaaatagagatgatgttaaaggaagagagaacgaactactattaccaagcgaattgaatcaattaaagatggtcaatgaaagagagctaaatgttttcgctcgtttatcgaggttgctatcgctttgggaagttttccaaatggcatga

SEQ ID NO: 4401 - DNA, 1965 bp, Saccharomyces cerevisiae
atgtttttacctcgtctcgttcggtacaggaccgagaggtttataaaaatggtacctaccaggaccttgcgacgaatcaaccacagcagcagggatccaattcaaaaacaggtcttggcccttatcaaagcaaatgcgaatttaaatgacaatgacaagttgaaaatacggaaatattggtctgacatggcggactacaaaagtcttcggaaacaagaaaatagcttactggaaagctctatattacacgaggtcaagatcgaagatttcatcagtttcatcaatcgcacaaaaacctcatctatgactacaagaggaatttatagaagagaatgtttgtaccaatgcaagaaaaacttggatctagtcaatcaagtggtctcccaagtttcatccgtaagacatcaaaagcccttgactacgcaattggatactatgcgctggtgtgttgatgatgccatcggcacaggagacatagttatggctgccgaccttttcctgctgtactacagattatttacagatgataaaaagctagacgaacaatatgctaagaaaataatatcagtattagcgtacccaaacccactgcatgatcatgttcatctagtcaaatatttacaactgaactctctgttcgaaagtataaccggaggcggaataaagttaacgaggtttcaattagaaactctttctaataaggccctcggcttaagtaatgaagccccgcaattatgcaaggctatactgaacaaactgatgaatataaactattctttgactaacgatttgaagcttcgggatgatcaagtgctgcttgcgtacaagtccattgatgaaaattatagaagaggaaatgttgcaagtgtgtattctatttggaacaaaatcaaagagcactatgtttccatttctgcacatgattccagaatcatttataaagtcttcaagatttgtacccataatagagcctatagatctatatgtagcgaaatgttttggcaattaactccagagtactattgtaataaccctttgatattaccggcaattattgacttcattacaaagcaagactctttaacaatggccaaggaactcatgcagaacattaacagatacactttacccgaaaaccatcatattgtctggcttaacaagagatgtctttcttcattgctaagaatgcatttgaaatttaacgattctaacggtgtagatagggttttgaagcaaataacaacaaatttcagggcgctttcgcaagaaaattatcaagcaataattattcaccttttcaaaacacaaaacctcgatcatatcgctaaggcagtcaaattactcgatactataccccccggacaagcaatgttagcctatgggtcaataattaacgaagtagttgattggaaattggcttcaaaggtcaagttcaccgataatttgatggcacttgtaaacgatttgttgacgaaggcacatgattttgatcctgaccacagaaactctctttggaatgtggtttccgctttatacattaaaaaactttgtcattataaaaagcgagatggtaaatttgttgccaatgccaagaaggatatcgatttggcaaaactactttatataaatgctgcaaagagaagtaaaacatactggacaaaatcgaactgtaacccattcattgcatcctccccatgtgatgtcaaattaaaagtgaataatcaaaacaggtttactattttaaggaatattgcattaagcgcactgcagataggaagaacagacatttttctttgggcgtgcgcagaactataccagaacggtatgacgattgaggaattgaagttagactggaatttcatcttaaaacatcaaattagaaattcagagttcaaaacaaacaaggagatcatacaagatattaaaaagcatggtgtgtcggctgtcaaacgttacttaagatga

SEQ ID NO: 4402 - DNA, 1968 bp, Saccharomyces cerevisiae
atgaagggcgtaaaaaaggaaggatggatatcttataaagttgatggattgttttcgttcttatggcaaaagagatacttggtactgaatgattcgtatttagcattttacaaaagtgataagtgcaatgaggaaccagtcttatctgtgcctttgactagtataacaaatgttagcagaatacaattgaaacaaaattgttttgagattcttcgggcaacagatcaaaaagagaacatatcccccataaactcctacttttatgaatcaaattccaaaagatcgatattcatttccacaagaaccgaacgggatttgcatggctggcttgatgccatttttgccaaatgtcctctccttagtggtgtttcatcaccaacaaattttacacacaaagtacacgttgggttcgacccaaaagtgggaaactttgttggagtacctgatagttgggctaaactactacaaacctcagaaattacgtacgacgattggaacagaaactcaaaagctgttattaaagcactgcaattttatgaagattacaatggactggacacaatgcaattcaatgatcacctcaacacaagcttagacttgaaacctttaaaaagtccgacaaggtatattataaacaagaggactaattccatcaagagatcagtaagtaggacgctccgaaaaggcaaaacagattccattttacccgtctatcaatcagaacttaaaccattcccaaggcctagtgatgatgattataagtttaccaacatagaggacaataaagtacgcgaagaaggcagggtgcatgttagtaaagaaagcacggcagattcccagacaaagcagttaggaaagaaggaacagaaagtcattcaaagccatctgcgaaggcatgataataattcaacatttagacctcatcgactagcaccatctgcacctgctacaaaaaatcatgatagtaaaactaaatggcataaggaggatctccttgaacttaagaataatgatgattcgaatgaaataataatgaagatgaaaactgttgcaattgatgtaaacccaagaccgtatttccaactggtagaaaaggctggtcaaggagcaagtggtgcagtatacctgtcaaagcgaataaaattacctcaagaaaatgacccgagattcttgaaatcacattgccaccgagtcgtaggcgaaagagtggccattaagcagatacgtttatctgaacaaccaaagaaacaattgattatgaatgaactcctagtgatgaatgattcgcgccaagaaaatatcgttaatttccttgaagcctatattattgatgacgaagagttatgggtgataatggagtacatggaaggtggctgcttaacagatatattggatgctgtagcaaggagcaataccggtgagcactcatcgccgttaaacgaaaaccaaatggcatatatagtaaaagagacgtgccaaggtttgaagtttttgcataacaagaaaattatccatcgagatatcaaatctgataatatccttctgaattcccaagggttagtgaaaattacagacttcggtttttgtgtggaattaacagaaaaaagaagcaagcgtgccacaatggtaggtactccatattggatggcacctgaaatagtgaatcaaaagggatatgatgaaaaagtcgacgtttggtctctagggataatgcttattgagatgatagaaggtgaaccgccttacctaaatgaggatcctttgaaggcgctgtatctgatagctaacaacggttcaccaaaattgcgtcatccagagtcagtgtccaagcaaaccaaacaattcttagatgcctgtttgcaagtgaatgtcgaatcaagagcatccgtgagaaaactactaacgtttgaatttttgtcaatggcatgcagccctgagcagctcaaagtatccttaaagtggcattga

SEQ ID NO: 4403 - DNA, 1968 bp, Saccharomyces cerevisiae
atgatacagacgccaagggagttgttgaatccacggtacacgtaccataccatctttagcgacgtgtgcaagacccgattcaaccatttagttacgaggttgtttttcatatgttctattatccaaactgtggtgatttcactgctggcgttgccacactcaccgttatgggaactggcattggcatttattcccaatattttagctcttaacctagtttcccttttgatcattgtgacaagaaaaaattacatgcatgtaaagaattttgggttcgctaattcacttactttcattctaggccaattgttatcagtaaagtttcttgtataccagggagtctatagcatgggcagcatccttttatcattcgtactgggtgtggttttcggacgtggcggatctggatggaagccatactataagctgtttatttggctagtcgttcccacgatttacaacctacaacatcatgtcactgacgctgacaaattgtcgttcaactgcgaaaactttttccaggccccacaagactacgtattagagcgtgtcaagaggattatggagaagtcagtcattctaagtgtaatcagcatgttcgtattaccaatctttaccacagtatttttttccaggcaaaaatcgggattatttgattcatttacgaatggcgtgctagctgtcacaaatttactaataatctcctgcattatcttcatcactttcgaattcataaatatagcatttgacgcacatatgtccataggttgtctgcacaagggcaagctaatttcgaatttgtcgtcgacgccgatggaaaccctgcttagtgggctttctgcagacaagccatttactaggttgactgcctaccaggaactagcgtatagggccacttcactggatccatcattgcgagcaccaatatatcactccaagttcagaagcagtagtggtaatacttggtcattaatcctcaatgaatgcttgaagaccattcagataaacaatgaaaaggttgtgcagtacctaagatcagtacaagatcttgggggctctgcaactgctagacataaaaaaaaagtagaaaatctagattatatgtatgagaacgggaaactaacaagcgccaacgaaagactctttgggaaccgaccctctatgatggcgccattacgggataacggcttattagatgaatcaccaaacaggctgagggtaagaactgacgatagtgtattgcttaaccgcggaaacaagaaaaggcataggtcctcgtattacgacaacgatttagatgaaacgacacaaacttttaacggctctattttcacccacgaaacaacatttatgaccgctatgcgtctgatgttaaaaaaactgaaaaattctataatgtcgtttattttcccttcctacgcagaaagacaatcatctgatgaaagcgacaattacagactattaccaaatggctccaacaaagcccaaatctcgataattgacatatggtccatttccaagaaaaggcaagctgagaagctggttccattgcccatatgccacgcaaatagtgtggtagcactgacaggactgctgatccgatcaaagacagaagatccaaaaggcggtatcattgcatccgttggggatattcttaagactttggagaggtccatctgtgcactgggtgaatttgccgattgggatccggaatcgatggcatacactgccttccaaacacaaaggacagcccaagatagagtacaacaagacagtgaagacgaagatagcatgaaagacactactgacatgatcagtgttctttatcagctgtccaccagtgcttttatggagattgtacttgaatacaatgttgctctgaacgacgtatatttggatgcagacgtggccaagttggcgaactggtttctagaagtgtacgcctcaggcaaccctaatgctacgtaa

SEQ ID NO: 4404 - DNA, 1968 bp, Saccharomyces cerevisiae
atggatttactacgcattttagacacgaaaccaatacctacaattgttgatgctactactctgggaatctcaggaaatacttccggtgattattggctgccaactacaatgtcgctttatcaaaaagaactcacggatcaaatagtatcattacactactcagatatcttgagatacttcgaaacgtcacactacaaagaggacgtcattctcgaatctatgaagaccatgtgtttaaatggttcactggtagcaacccatccatacctactaatagatcattatatgcctaaatcgttaataactcgtgatgttcctgcacatttagcggaaaatagtggaaagttcagcgttttgagagatctcataaatcttgttcaagaatatgaaactgaaacggccattgtttgtagacctgggagaacaatggacttactggaagccttactattgggaaataaggtgcatatcaaaagatatgacggtcattctatcaagtcaaaacaaaaggcaaatgacttctcgtgtacagttcatttgttttcttctgaaggaattaatttcacaaaatatccgataaaatccaaggctcgattcgacatgctgatctgcttagatactacagtggatacaagtcaaaaagatattcaatatttgttgcaatataagagggagaggaagggtttagaaagatatgctccaattgttaggctagtggccattaattcaattgatcattgtaggttattctttggtaaaaaatttgacaagaacagtagagaatacttggagaacgttaccgcagctatggtaattttaagagatcgactgggcacacttccacctgatttgaggcccatttattcacaaaagctgcattatttagtagaatggttggaaaacccaacagtaccgtggccattaccagatatttaccctttaaaacaatatacttccatggatgtagaaaggtctttgttaacggaagtacatttcaaaaagtcagatgatcaactagaggatgctttttccaactgttccaaaaaaagaggacgccatggtgctaataaggcagcatcttcaactgttgccggaattgaggataatattactccaagtttttactctaccaaaagattaaagaacgattattatacaaatcctttaaaacaagacatgacacaactaacaggtattactacagctgacaactcctcgaatgtaaattaccacttatcaagtggaatcataacacacaaactgattcaatcaatgggagaagtgtatatggatatttgcgttcagaaacaggagctggatgattattcttgccttgatgatttgcaaaatgatcatctgaaatttttctcaaatgaagatgagaaaattataaaagaatatgaaaccgtattgcgaaccaataatgaaaacttaaataggtcgcatgaactagaagttgaaaacaatttgaagttttcccaaatcgaaacactggaaaaagacattgaaactttaaagggaagtttgatggcccaaggtgaaacattatcaaagttaaaagacgctttcgttaaaacagacaatgtacaagacgagatcgagaaagaagaaagggtaagtgtatcaagggatactgagaagaaatatatggaacaagaaatcaaaagagccgttgatgctataagggaaaatgaggaggagacacacaaacttaatgagaaacaaaatggattagaaagtgagttgaaattgaaattcgaaaagtctgaaatctctacaaaagaattgaatgagaaaattggctttttgaaaaaggaattaaagcttgagaatgatctaaacgaggagttagtgggacagttatcgaagacgatggacaacttggaaaacttaacaattccacgagttcgtactcaaaatggtaacacaaaaaaaaaatccagggcaaaaaaaccaggaaatgtataa

SEQ ID NO: 4405 - DNA, 1971 bp, Saccharomyces cerevisiae
atgaaagtgctatgtgtcgcagagaaaaattctatagcgaaggcagtttcacagatcctaggaggaggcagatcaacttcaagggattccggctacatgtatgtaaagaactatgatttcatgtttagtgggttcccgtttgccagaaatggggctaactgcgaagttaccatgactagtgttgcagggcacctaacaggcattgatttcagccatgattcgcatgggtggggaaaatgcgccatccaagagttatttgatgcgccactgaacgagattatgaataacaaccaaaaaaagatagcaagcaacatcaagcgagaagcgaggaatgcagactatctgatgatatggacagattgcgaccgggaaggagagtacatcggttgggagatatggcaggaggccaagagaggcaacaggctcatacaaaatgatcaagtataccgggcagtcttttcgcatctcgaaagacaacacatattaaatgcagcacgaaacccaagtcgattggatatgaagagtgtgcacgctgtaggcacgcggattgaaatcgatcttcgagcaggtgttacattcaccagactcttaacagaaacgctacgaaataaactgagaaaccaagccaccatgaccaaggatggtgcaaaacaccgcggtggtaacaagaacgactcacaagtcgtatcgtatggtacatgccagtttccaacgctcggctttgtagtagacaggtttgaaagaatacgaaattttgttcccgaagagttctggtatatccaattggtagtcgaaaacaaagacaacggcggaacaacaacgttccagtgggacaggggccacttgttcgaccggctgagcgtgttaacgttttacgagacatgcatcgaaaccgccggcaatgttgctcaagtagtagacttgaaatcaaagccaacaacgaaatacagacctttacctctgaccacagtggagctacaaaaaaactgcgcccggtacctgcgtctgaacgccaaacaatcactagacgcagcagaaaagctataccaaaaggggttcatatcgtatccaagaacagagactgatactttcccacacgcaatggacctaaaatccttggtcgaaaagcaagctcaattggaccaactcgctgcaggcggcagaaccgcctgggcatcgtacgcggcatcgctgctccaacccgaaaacacaagtaacaataacaagttcaagtttccacgaagcggctcccatgacgacaaagcgcatccaccaatccaccccatcgtaagtctggggcctgaagcaaatgtttcgccagtggaaagaagagtatacgagtacgtggccaggcactttttggcatgctgctcagaggacgccaagggccaatcgatgacccttgtgttggactgggccgttgaacgtttctcagcttcaggtctcgtagtcctagagagaaatttcctcgatgtttacccttgggcccgatgggaaaccaccaagcagttaccgcggcttgaaatgaatgccctcgtagacatcgcgaaggccgaaatgaaggcgggcactacggcgccgcccaagccgatgactgagagtgaactcattctcctcatggatacaaacggcattggcacagacgccaccattgcggagcacatagacaagatccaagtacgtaattacgttaggagcgagaaagtaggcaaggaaacctacttacaacccacgaccctgggtgtctcactagtgcacggcttcgaggccatcggcctcgaagactcctttgcaaagcccttccagcgcagagaaatggagcaagacctcaagaaaatctgcgaaggtcatgcctccaagactgatgttgtaaaggacatagtcgagaagtataggaagtactggcacaagacgaatgcctgcaagaatactctcttgcaagtttatgaccgtgtcaaggcatccatgtaa

SEQ ID NO: 4406 - DNA, 1971 bp, Saccharomyces cerevisiae
atgaacaatgtacacataattaaacctttatcacttccacagaggttttttagttgtattttccatcctctattactgatattctttacttctgttattttaactatttggggttccttttcagtcattgacattacaatggcaaaaatgtctcacgcacaggtcaaacgaaatgataccgtctcaacctttgcatctatttcaactgctacagcgacagccacaacaacggccacaacaacggccacaatgacagcagtcacaacacagcatgccatatattctgccaacagttactctttaaataaaacattcattgataatacaattgatcagtatttcgaaagcaaactacggagtattgaatctacggtaggtacggatatgcaagaaaaattcaagtcatacacagacgacatactggataataaacaaaaacttatcaacgaccaaataagtttggaaactgaattgattaaggaagttcttgaggtaaacaatacaatttttaacgaactactcactaaatcacagctgataaatgacacatggaatgaaatatcagaagacgcaatgaccattgataaggattccatttcacaaatggcatcaaacctactgttaaattactccatgtttgacagtatttttgggaactactcaaggaaattgaaatcattgcagaacttcaatggcactatcactgacttttctactcaattagatacctctagtaccttaagtttgaattttctacgaaattccactgactggcttcagttgaaaaggaactttactgcaaacttacagaatgaaatttccattttatctggggggagtaccgaggttacatcgtctacttcaataattaaacggtctctgaaaacaaatagcgaggaaaacagtgtactaagtgcagtaaaaaatcacgttttccgtaaatgtaagagaatgacaataattttcacagtcatgtactttgcatttgtgattttgctcatggcaatcgaaagaattctgtttcagctggaaaatcagcaagtaaacctggttatgtcccaaattaatggcctgacaggacaaaccaattttactaaatacaacaaagttttgaaaagcttaattactactctgaatctcagtacactttatccaattccctaccaattaacaaagcttatcaatcaaaaaatatttaaaagagaaccagaaaaaatcgatgacaaaaaagtcaaaaaatcaaaactattttactgtaactggtggataatctcaaatggggctcacctgtggctgtttggttttttgatgttattaattcattggcagatagtgacgcgattaacaaactttgaagtacccagtttgcctacattccacaaaagagcgggaccttcgctatacaaaagggaagtttggacagatggaaatataacaactacgatagagggtttcattaatgacagcgtatcattattgtgtgaaaatttccaaatggaagtgaatgaaaagttcattacagcaaatttaagccttcaaactgaccccaatttgaaagtgcaatcaacggacatcctaaatctttgggttaacgacacaaacactcagtttgaaaaatatcttaatgagagttctcaaaattggcaggggatagacctgcaggttgagcctctgttaggcagcgattcaattaatgagttcctgggtcagtatttcctaccgacatacgaagttacgaatacaaattcttcatttgcactggacattcaaaaatatggtataattaatcgaggaattaatataaccaacgcatcggtagcggcattgtcttcactgtcaaaacgccaaataaaggataaggagcaaaaacaaacgtactttttacacactgtttataagtggggacttttagcagtttgcctgactatattgttccaccacatgcttatatttataatattaaagttgtaa

SEQ ID NO: 4407 - DNA, 1971 bp, Saccharomyces cerevisiae
atgatggcaactccggctactgatcttatttccgataatgataaatataacaagcaatgtctttctgattcaagtgatagtggtagtgatgtaagctttttttccgtaaatgaaagcgaaggtgaattggatacaatggagaaagtggataccttgattggaggtgcaagagttataagcaataaagtagaaaaagacagcgatagtgaacaaaggggaagaaagaaggaaacaactgggcccaataactatcataatttagaagagaagcaagcgagtgccatttctcttgacgctgatgatgaagatctcgatgaaattatttcttattcgcatgacgggaactatgacagctctcataaaactttctccttttccttaccatttggtaatacaaatttccgatcaagttcaccattagccataattaaaactgtgcttcccaagactccagatgagttcatcaaaaagaatctaagaaagaatgagatcaagcaaaaactgaaaaaatcaacctccatttcttccttggaagagatagaattatttaaatacgaaaggggcattgataattcaaggttaagggctgttaaagaatctttggaaatggatgccttgaagaactccattaagcaaataacagcagacccattcgacaaaactcatgacggatattaccgttcgcgtttagaatctatatggaatgaattggaaggagatgtcgttataatgggtggatatcgaggtagtgtgctaagggatgctactactcataagcgaatttggatcccattaaaggcaggtttgaatatgacgaaagtcgatttattgatcggacctaatgacgaagatgaacttaaaactcagaaggagattgtccctgatggaatgctaacacatatagggcctgttgatatctctaagaggttgataaagaggctagacgcaaatcctaatttaaatgttcagcagtttggctatgattggagattatccttggacatatctgccaagcatttaacgactaaactagaggaaatttacaataagcaaaaaaataagaagggaatatacatcattgcccattcaatgggcggattggtcgcacataaagtgttgcaagactgtactcatttgataagaggtattatttacgtgggttccccaagccaatgtccaaatattttaggtcctattaggtttggagatgatgtgatgtggaataaaactattttcactaaagaaaccaacttttttatgagaagtagtttctattttctaccgttagatggtagatgttttgttgacaaaattaccttagagaggtatgatttcgatttttttgatacagatgtttggaaaacccttggcttgtcacctctcgtcaatgagaaaagagaggaatcagctcacgaaaaatcaaaattattaccaaggaaaacgaaatcagcgctttcgcttaaagctaccctaaacgcaactaccaagtttgtcctaaatgcacctgttgttaggaatgtagccggcaataataaacaggtaccaagggatgtgcctttcgatgaagtcttccatacatcttatgaagatagctgtgaatatttagcgagaactttaaaacgtacaaagaattatttggatagcttagattacgacccgaacaaagaatatcctccattggccatggtttacggtaacaaggttcccactgttagaggtgctaaagtgaacggtatacaagatataaaagatgggaattatgaagatttttactatggtccgggcgacggtgttgttcaccataaatggttattgcctgaacagagaggctttccagttgtttgtaaaatcgccagttcttcaggtcatgttagcttaatgacggatttgaaatcaatggcaaaagcattcatatctatcgtcgacagcgaaaaagaaggaagaagatctcgaacacgaacttcttcatga

SEQ ID NO: 4408 - DNA, 1971 bp, Saccharomyces cerevisiae
atgcactggaatataatttcgaaagagcaaagtagctcttctgtatcgttaccaactctagacagcagtgaaccctgtcacatcgaagttatcctcagggcgatacccgaaaaaggattacaaaacaatgagtcgaccttcaaaatagacccatatgaaaatactgtgctatttcgcacaaacaatccgttacatgagacaaccaaggagacccattcaacatttcaattcgataaggtattcgatgctaacgccactcaagaagatgttcagaaatttctggtgcatccaataataaatgatgttttgaatggttataacggtactgtaataacatatggaccaagtttcagcggaaagtcctattcccttattggatcaaaagaaagcgaaggaattctaccgaacatatgcaagaccttgtttgatacgctagaaaaaaatgaagaaacaaagggagatagttttagcgtaagtgttttggcattcgaaatatatatggagaaaacgtatgacttattggtacctttacctgaaagaaaaccattaaagcttcaccgttcttcaagcaaaatggacttagaaatcaaagatatttgtccggcacatgtcggatcgtatgaagacttaagaagctacattcaggcagtccaaaacgtcggcaataggatggcatgtggcgacaagacagagagatcaagatcacacctagtttttcaattacacgtagaacaaaggaatagaaaagatgatatattaaaaaatagttctttatatctggttgatttacacggggcagagaagttcgataaaagaactgaaagtacgctatcacaagatgcgttaaaaaaattaaaccaatctattgaggcgttgaaaaacactgtgcggtccttgtcaatgaaagagcgtgattcagcctacagcgcaaaaggatcacatagttctgcttaccgtgaatcgcaattaactgaagtgttaaaagattcccttgggggaaataggaaaacaaaggtgatattgacatgtttcttaagtaatgttccaactaccctatcaacactagaatttggtgacagtattagacagatcaataacaaggttacagataacaccacaggtttaaatctgaaaaaaaaaatggatctatttattcaggacatgaaaattaaggatgataattatgttgcccaaattaatatactaaaggctgaaatagactctttaaaaagccttcacaataaatctcttcccgaagacgacgagaaaaaaatgttagaaaatacaaagaaagaaaatatcaaactaaagcttcaattagacagtattacccaattattgagtagttctaccaatgaagatcctaacaatcgtattgacgaagaagtttctgaaatattaacgaaaagatgcgaacagattgctcagcttgagttatcttttgatcgacagatgaattccaattctaagttgcagcaagagttagaatacaaaaagtcaaaagaggaagccttagagtctatgaacgttaggctactagaacaaattcagcttcaggaaagagagattcaagagcttttaactactaacgccatcttaaagggtgaactagaaactcacactaaacttactgaaacacgcagtgaaaggataaaatctttggaaagttctgtcaaagagctttctcttaataaatctgcaatcccatctcctagaagagggtctatgagctcgtcatcaggaaatactatgttgcatatcgaggagggttctgaaatatcaaatagcccttggtcagccaatacttcctcaaaacctttagtatggggcgcgagaaaggtttcttctagcagtatagcaaccactggatcacaggagtcttttgtggcaagaccgttcaagaagggattaaacctccattcgataaaagtcacttcgagtactccaaaaagtccctcttctggaagctga

SEQ ID NO: 4409 - DNA, 1971 bp, Saccharomyces cerevisiae
atggcacctttaaccaagaagacaaacggaaaacgttctgctaaagaagttagtcattcagaaaagaaattagccaaaaaacctagaatttctattgattcgtctgatgaagaatcagaactatccaaaaaggaagatgctgtatcctcttcatcagatgatgatgatttggatgatttaagtaccagtgactctgaagcagaagaagaagctgacgaattagatatttccgatgacagtgaggaacatgaaaatgagaatgaagagaaagaaggaaaggacaaatctgaaggaggtgaaaatggaaatcacactgaacaaagaaaactgctaaaagaaaggaaaatgcaaagaaaatctggtacccaagtgcaacaaattaaatccgtctgggaaagattgcgtgtgaagaccccacctttaccaaaacagattcgtgaaaaactttccaacgaaatctgggagctatctaaggactgtatcagtgatcttgtcttaaagcatgatgcttcccgtattgttcaaactttagtcaagtattcgtccaaagatcgtcgtgaacaaattgtcgatgctttaaagggaaaattttatgttctagccacatctgcgtacggtaagtatctattggttaagttactgcattatggttcaagaagttcaaggcaaactataataaatgaattacacggttctttgagaaaattaatgagacatcgtgagggtgcctacgttgttgaagatttatttgttctttatgccacacatgaacaaagacaacaaatgattaaagagttttggggctctgaatatgctgtatttagagaaacccacaaagatttgaccattgagaaagtttgtgaaagtagcattgaaaaaaggaatattatcgccagaaacttgattggtaccattaccgcatcagtagaaaagggttccaccggctttcaaattctacatgctgctatgagagaatatgtgaaaatagccaacgaaaaggaaatatctgaaatgatcgaattgcttcatgaacaattcgctgaattggtgcatactccagaaggttcagacgttgcttgtactttggttgctagagctaacgccaaggaaagaaagttaattttaaaggctttgaaaaaccacgccgaaaaattgatcaaaaatgagtacggtaatattgtcttcattacaattctgaactgtgttgacgatacagttttagtattcaagactttcagtcctactgttaaggaacatttgcaagaattcataattgataagtttggtagaaggccttggttatacatactattaggtttggacggtaagtatttctcacctatcgtcaagaatgaattattgagatacattgaactgtccaaagccacctctaagaaggatcctttacaaagaaggcacgaacttttgtcaaaattcgcccccatgtttttaagcactatatcaaaagattattccagtatattgacagagaatctaggctgtcagttcattgccgaagttctaataaacgatgagttgtacgcgcagctgaatgaaaaagaccaagaaaagtatcaacaggtcttaaacaacattttaactacttttaagggtgacataaccgaagaagagcacccaatacatagagcattttctactagactattaaaggcactaattcaaggtggtaaatggaataacaaagaaaaaaaggtcataccattaaaaaatgttcaaggcttaggcgttccatttgctgaaaagttatacgatgaaattattgactcctccaacttgttagaatggattaataacgctgatagttcatttacaattgttgcactgtatgaaacgttaaaagatcaaaaagaagggaaaccatttttgaaggatttgagaggagttcagagtaaaatcaccactgatgaaagtaacaaaggctctcagcttttggctaaattgttaaaataa

SEQ ID NO: 4410 - DNA, 1971 bp, Saccharomyces cerevisiae
atgtcttaccaacggaacagtgcaagagcctctcttgacctcagaagtcaatatcaacaactggaaggcagaatgaggtcagaacattttaatcccgcctatcaacagcagcaacaaaaaggccagaacatacccctgtcactaccctcgtcgcttgcgcaacgcaatcctataccttaccctatcgacgctgtgacttccgatcccactatcccggctcagttgaacgtatatgatcacgatcggcaaaattcgatagtcgatgctgcggctggcaccaatacgacgcactctttgaactctaataatattccatcatcacaaaataataatattaataataacaatatcaataatgttggttccttcactgacccttccatgctaacgctgccaaaaatgtctttacatagccaccagaagcagtatgattctaaccaaaacgatcctaggtcccctctggcgatactgataccgacttctgcgcagcccactgatgtcttgtctgctaggttttctgcctggagaaatgttattcgtgccatcttggtatatctctctgagaccgcctcaatacaggacgaaatagttagacagcaactgaggttgtcccatgctgtgcagttcccctttttcagcattgaaaaccaatatcaaccggtctctaatgaagacaagtccatgcagaaattttttctgcccttaggaagtggatccgttcaagatttgcccacgatgctgaccaagtatcatgataatctggcctctttggcatcgaaaagttccaaggagttgaccagtgaaattatacccaggctagaggatttgagaagagatttactagtcaagattaaagaaattaaggctttgcaatctgattttaaaaattcctgtaacaaagagcttcagcaaactaaacacttgatgaagctttttaatgaatcattaaaagaatgtaaattaggtacaccaaagagtgacccatttttgataaaattgcaattggaaaagcaaatcaaaagacagttggtggaagaaaattatttgcacgaggcattcgataacttgcagaattcaggggcccagttagaaagtgttattgtaatggaaatacagaacggattgaccagctacgctagaattcttggcaaagaagcccaagttgtatttgactcagttatctctaaattagattccacgatactgaacaaaaacacgaatcttgaatgggatagtttcattctaaggaatatttccaattttgtgcctccaaatttacccatgaggaggtttaaagagatctcgtatagcaatcaaaacgatccttttacttttgaagttaaatctgggtttctggagaaaagatcaaaatttttaaagtcatactcacgtgggttttatgtcctcactccaagctttttacatgaatttaagacaccagataagcataaattttccacaccgttaatgtcaataccattagtggaatgtactgtcactgagcattccaaaaagacgaaatccaactcagagcagggcaagaacaagtttatattgcgtacgaattctaacggactaatacataggggtcacaactgggtattcaaagtagactcttatgacgatatgatagaatggtttggaaatatcaaagccttatcaagtttgcccaactatgacgacaaatgcaaatatgtgagtaaagttgccaaactgtctaaagaaaaagccaagagtaatgaaaacaccacggagagcgtgaccccccaggtaactaatgagcaacatacgagatacgatgatgtgagtagtagcaattttcccttgaattccattccaaaattagacaatttgacaatcactaacaccacgtcatcgataccggaaacgaatgattcacaaattcagaatagggttcctgaattttacattgaaaatgtagattcccctagaaaaagcaatcagctgtga

SEQ ID NO: 4411 - DNA, 1974 bp, Saccharomyces cerevisiae
atgaggtcaggcgatgcagagattaaaggaattaagcccaaagttattgaggaatattctttatctcagggaagtggtccttccaacgattcatggaaaagtttaatgtcgtccgcgaaggacactcctttgcagtatgatcacatgaatcgcgaaagtctaaaaaaatacttcaatccgaatgcacaactcattgaagatcctttggataaaccgattcagtatagagtgtgcgaaaaatgtgggaaacccttagctttgacagcaattgtagaccacttagaaaaccattgtgcgggagcatctggaaaaagtagcacagatccaagagatgagagtactagggaaacgatacgaaatggagtagaatcaactgggagaaataataacgacgatgacaatagcaatgataataacaatgatgatgatgatgatgacgataacgacgacaacgaagatgatgatgacgctgatgatgacgacgataattccaatggtgccaattacaagaagaatgactcttcttttaaccctttgaaaagatccacatctatggaatctgcgaacacaccaaatatggacacgaaaagatcgaaaactgggactcctcaaaccttcagctcttccataaaaaaacaaaagaaagtcaaacaaagaaacccaactgaaaagcatttaattgatttcaacaaacagtgtggtgtagagttgccggaaggtggttactgtgcacgttcgctgacatgtaagtcccattcaatgggtgcaaagagggctgtctctggtcgttccaagccctacgacgtcttgctagcagattatcatagagaacatcaaacaaaaattggtgcagctgctgagaaacgtgctaagcaacaagaattacaaaaattacaaaagcagatacaaaaagagcagaaaaaacatactcagcaacagaaacaaggtcaaaggtctaagcaaagaaatgtgaatggtgggaaatcagccaaaaatggtggtaagagtactgtacacaatggtaacaatatcaatgagataggacacgttaacctaactcctgaagaggaaacaacacaggttctaaatggggtatcccgatctttcccactgccactagagtcaacggtactatcgtcagttagatacaggactaaatattttagaatgagggaaatgtttgcttcctccttttctgtgaaaccaggatatacatctccaggttacggtgcgatccattctcgtgtaggatgcttggatttggatagaacaacagattacaaatttcgtgttaggactccacagccaattaatcacctcacaaaccaaaacctcaatccgaaacaaatacaaagactacaacaacagagagctctacaggctcagcttctttctcaacaacagcaacagcagcaacagcagcagcaacatcactcaccccaagcgcaggcccaggccagtacccaacaacctactcaaggtatggtgcccaatcatttccccggcggggcaacgaattcatcatttaatgccaatgtgtcgagcaagcaaattcagcagcagcagcagcagcagcagcacaagtctcaagacacaggtctcacgccgctggagatacaatcacaacaacaaaaactacgacaacaacaactacaacaacagaagtttgaagctgctgcttcatatttagccaacgctaccaaattaatgcaagaatcaaatcaagatagccatttatctggcacccacaacaataatagtagtaaaaacggtaacaataacctcatgacgatgaaagcctccataagctctcccaatactagcgtaaatagtatccaatctccccctagtgtcaacagcgtcaatggctccgggcaaggtgtatctaccggtattaatgtctctggcaataacgggagaattgaagtaggtattggaaattctgtgaacccctacaatggcagaataaattaa

SEQ ID NO: 4412 - DNA, 1974 bp, Saccharomyces cerevisiae
atgagtgataatggttcccccgcggttcttccaaaaaccgaatttaataaatacaaaatcggcaaagtgaagagtacaccagccatccagcgagatgcgaagactaacttaacatacatcaaactaagaaaaagaagtagtgagaaagtttacgggtgtacagttttccagaatcattatcgtgaggatgaaaaattaggacaaggaacatttggtgaggtttataagggaattcatttagagactcaaagacaagtggcaatgaaaaaaattatagttagcgttgaaaaagatctgtttcctataactgcacaacgagaaattactattttaaagcgtttaaaccacaaaaatattattaaactaatcgaaatggtgtatgaccattcaccggatattacaaatgcggcatccagcaacctacataagtcattctacatgatcctgccgtatatggtagcagatctgtcgggcgttttgcataatccgagaatcaacttagagatgtgcgatataaagaatatgatgctacaaatattagaaggcctaaattatattcattgtgcaaaattcatgcatagggatataaagacagcaaatattttgattgaccacaacggtgttttaaagcttgctgattttggtttagcaagattatattatggctgtcctccaaacttaaagtatcctggtggtgcaggttccggcgccaaatatacatcagtagtcgtaacgagatggtatagagcacctgagttggtgcttggtgataaacagtatacaacagctgttgatatatggggtgtcggatgcgttttcgcagaattttttgagaaaaaacctattttacagggaaaaacggatattgatcagggacatgttattttcaaactacttggtacaccgacagaagaagattgggccgtggctagatatttgccaggtgctgaactaacaacaactaattacaagccaacgttgagggaaagatttggtaaatatctaagtgaaacaggtctagattttttaggacagttgttagcgttagatccttacaagaggttgaccgctatgtctgctaaacaccatccttggtttaaagaggaccctttaccatcagagaagataacattaccgacggaagaaagtcatgaagctgatattaagaggtacaaggaagaaatgcaccaatcattgtcccaaagagtacctactgcgccaagaggtcatatagttgaaaagggtgaatcacctgtcgtgaaaaatcttggggcgatcccaagaggccccaagaaagatgacgcaagttttttgcctccatcaaagaacgtattggctaagccgcctccttcgaaaataagagaactacatcaaaatcctagaccgtatcatgtgaacagcggatatgctaaaactgcgattccaccgccagcagcccctgcaggagttaatagatacggacccaacaatagttccagaaataatcgcttcagcggcaacagcactgcacccaacaacagcaggaatcccgtaaatcgatttcatcctgagacaaatgtcagctctaaatataataaagtacctttgccattggggcctcagtcaagataccagggtaattcaaatgagtcccggtacaaaaactcgccaaatgactctagatatcataaccctaggtacgtgaacaagccggaaaccaacttcaataggcaaccacagaaatatagtcgccaagaatccaatgcgccaatcaataaaaattataatccttcaaacggttctcgcaatatggctggtgatcatcatcaaggctcgagaccttctcatccacaattcccaatctcgccctcacaggggcagcatcagcttacgagtaaaccaatagagaaaaaaaatggaagctttaaggatgaaagagcgaaaccagatgagtctaaggagttccaaaatagtgatattgcagatctatattag

SEQ ID NO: 4413 - DNA, 1974 bp, Saccharomyces cerevisiae
atgcttaaatctggtagactcaactttctcaagttgaatatcaattcacgattactatactcaacgaaccctcaactgactaagaaggtcattggtatcgacctgggtaccacgaatagtgctgttgcatatatccgtgattctaacgacaaaaaatcagctacaatcatagaaaatgatgaaggacaacgaaccacaccatctatagttgcctttgatgtcaaaagctcgccacagaataaagatcaaatgaaaactcttgtagggatggcagctaaaaggcaaaatgctattaattctgaaaacactttctttgctacaaagagacttattggccgtgcattcaacgacaaggaagttcagcgagatatggctgttatgccatataagattgtcaaatgtgagtcaaatgggcaagcctatctcagcacgtctaatggtctcattcaatcaccaagccagatagcatctatattactgaaatacctgaaacaaacttcagaagaatacttaggcgaaaaggttaatttggcagttattacagttccagcatattttaatgattctcaaaggcaagccacaaaagatgccggcaagttagctggcctaaatgttttgagagttattaacgaaccaactgcggccgccttaagctttggaattgatgataagaggaataatggattaattgcagtttacgatttgggtggtggtacatttgacatatccatcttggacattgaagatggcgtgtttgaggttcgtgctactaatggtgacacgcatttaggtggagaagattttgacaacgtcattgtaaactatattatagataccttcattcatgaaaaccctgaaattacacgggaagaaattacgaagaacagggagacaatgcaaaggttaaaagatgtttctgaaagagctaagatagatttatcccatgtgaagaaaacttttatcgaacttccatttgtatacaaaagcaaacatctacgagtgccaatgacagaggaagagctggataatatgactttgtcattaatcaacaggactatcccacctgtgaagcaagcattgaaagatgccgatatcgaaccggaggatatagatgaagtaatccttgttggtggtatgacccgtatgccaaagattagatctgttgtaaaagatctttttggtaagtctccaaattctagtgttaacccagatgaaacagttgctttaggagcagctattcaaggtggtattctatccggtgaaataaagaatgtcttacttttggatgtgacaccattgacattagggattgaaacatttggaggagcgttctcacccttgatacctagaaatacgacagttccagtaaaaaaaacagagatatttagtactggtgttgatgggcaagcgggtgttgatatcaaagtttttcagggtgaaagagggttagtgcgtaacaacaagttgattggtgatttgaaacttacaggaatcacccctttgcctaaaggcattccccaaatatatgttacttttgatatcgatgcggatggtatcatcaacgtatctgccgctgagaaaagtagtgggaaacaacaatccattactgtaataccaaattctgggttaagcgaagaggaaattgcaaaacttattgaagaagcaaatgcaaatagggcacaagataacttgatcaggcaaaggttagagcttatctctaaggctgacattatgataagtgatactgagaatttatttaaaagatatgaaaaactgatttctagcgaaaaagagtattctaatatcgtagaggacatcaaagctctgagacaagctataaagaattttaaggctaacgaaaatgacatgtcaattgatgtaaacggaataaaaaaagctacggatgcgctacagggtagggcattaaaattattccaaagcgcaacaaaaaaccagcagaatcaaggtaaataa

SEQ ID NO: 4414 - DNA, 1974 bp, Saccharomyces cerevisiae
atgtccatcagagatttatatcatgcgagggcttccccttttatatcgttagaattcttccctccaaagactgaattagggacgagaaatttgatggaacgtatgcatcgtatgactgctttagatccactgtttatcacggttacttggggagcaggtggtactactgcggaaaagactctgacattagcttccttggcacagcagacactaaatataccagtttgtatgcatttgacctgtacaaacacagaaaaagccatcattgatgatgcgctggatagatgttataatgcaggaatcaggaatattttggctcttcgaggtgacccacctattggggaagattggctagattctcaatcgaacgaatcaccttttaaatatgcggttgatttagttcgttatatcaagcaaagctacggagacaagttctgcgtcggtgttgcagcatatccagaaggtcattgtgaaggtgaagcagaaggtcacgagcaagacccattgaaggatttggtatatttaaaagaaaaagttgaagctggggccgattttgtgataacacaactgttttacgacgttgaaaaattcttaacttttgaaatgctatttcgggaacggatttcgcaagatttgccccttttccctgggttgatgcctattaactcctatctgcttttccacagagcagcaaagttatcacatgcatctattccacctgcaatactgagtaggttccccccagaaatccaatcggatgataatgccgtgaagtccattggtgtggacattcttatcgaattgattcaggaaatatatcaaagaacatctggtagaattaaagggtttcatttctatacattaaatttggaaaaggctattgctcaaattgtctcgcaatctcccgtcttatcccatatcgtaaatgaatctagcgaagaagagggagaagatgaaaccagtggcgaaataggaagcatagaaaatgtgccaatagaagatgctgacggggatattgtgttggatgattcgaatgaagaaactgtagcaaaccggaaaaggagaaggcattcaagtcttgattcggccaagttgattttcaatagggctatcgtcactgaaaaaggcttacgctataataatgagaatggttccatgccatctaaaaaggctttaatatctatttctaaaggtcacggaactttgggtcgtgatgccacttgggatgagttccccaatggtagatttggtgactccaggtctcccgcatatggtgaaatagacggttatgggccatccatcaaggtaagcaaaagcaaagcgcttgaactatggggtataccaaagacaattggcgatttaaaagatatttttataaaatatttggaaggttcaacggatgcgattccctggtctgacctgggtttatcagctgaaacggcgttaatacaagaagaactaatccaactaaactatcgcggatatttgactttggcatcgcaacctgccacaaatgctacattgagtagtgataaaatattcggctgggggcccgcgaaagggaggttgtatcagaaggcattcgtagaaatgtttattcatagacagcaatgggaaacaactttgaaacccaagctagaccattacgggcgtcggaaattcagttattacgcgggcgattcatctggttcatttgaaacgaacctagacccgcacagctctagcgttgtaacatggggtgtttttcccaacagtccggtcaaacagactacaatcattgaagaagagtcattcaaggcatggagagatgaagcgtttagtatctggtccgagtgggccaagttatttccaaggaacaccccagccaatattcttctaagactagtgcataaagactactgtcttgtctcaattgttcatcacgacttcaaagaaaccgacgagctatgggaaatgttactcgaccaagcctaa

SEQ ID NO: 4415 - DNA, 1977 bp, Saccharomyces cerevisiae
atgttggcccgttccagggtgtgcttgcagacaatcactagacggttggcagactttccagaagccaatgctattaagaaaaaatttctctttaggaaggacacctcgaccatcaaacagttaaaaggactgtctagcggccagaaaatagtactcaatggatggatagagcagaagccaaaaagagttgggaaaaatttgatcttcggacttttaagggactctaacggtgacattatccagttggttgataacaaatcgttgttgaaaggctttactttagaggatgtggttcaagccgtaggtatactctctttgaagaggaagctatcaaatgaggacgcagatgagtacgaagtgcaattggaggatattactgtgttaaatgcatctaataaaaaaccagcgcaaatgcaggattttaaattgtcagccatatacccacctgagttccgctatttgcaattgagaaatcccaaatatcaagattttttaaagaagaggtcatctatctctaaggaaataagaaactccttcaacaattttgattttacggaggtcgagaccccaatgttatttaaagctaccccagaaggcgcaagagagtttctggttccaacaaggacaaagagatccgatggtaaaccatcgttttatgctctagatcagagccctcaacaatacaagcaactcttaatggctagtggtgtcaacaaatattatcaaatggcaaggtgctttagagatgaagatttaagagcagacaggcagcctgagtttacacaggttgatatggaaatggcctttgctaattctgaagatgtcatgaaaatcatagaaaagacagtttctggggtatggagtaaattttccaaaaaacgaggattattgactttagacagtaagggtacattagtgcctgcgaaaaaggaaaacggcacagtatctatctttcgtatgacctacgaacaagccatgacctcatatggtattgacaagccagatttgagagcgccagatttgaagattatcaatttaggcgagttcaatgcctttagtcatttgaacaaaaaatttcccgtttttgaagtaattattctaagaagtgccttttcaaatatggaagagtacaaagaacgatggtcgtttctgacaaataacagtaattacaattatagagttccaatagtgctaccaattgaaaatgacgaacaagctaattcaaattggtttgagaattttcatgcaattgccacgtttgaaaacccacatctaataaccaaatttctgaaactgaaaaaaggtgacattgtatgcggttgtacgagagagccaaaccattccattttcgagaatcctactcccctgggaagattgagacagttggtgctacaaagtgagcatgggaaaaatatctatcatgctgtcaataaggatgttgcctcatggattgtggatttcccgttattttctcccgttataattgaagataagtctggtaaaaaagaaaagcttgcatatccggagtacgaaaaggatagactatgttccacgcatcatccttttactatggtgaagcttaaagactacgaaaaattagaaaagacgccggaaaagtgcttgggtcggcattatgacctcgtagttaacggtgtggaacttggtggtggctcaacaagaattcacgatccaagattacaagactatattttcgaagatatcctcaaaatagataatgcatatgaactatttggccatttactgaatgcttttgatatgggaacaccgccacacgctggatttgctattggttttgatcgtatgtgcgctatgatctgtgaaactgagagtataagggacgtaatcgccttcccaaaaagtattaccggggctgatttggttgtcaagagtccaagtgtgatacctgaaagcattctggaaccttacaatatcaagtatagtaattcaaaaaaatga

SEQ ID NO: 4416 - DNA, 1980 bp, Saccharomyces cerevisiae
atgcaaaaactcctctttgtcttttctgtgttattgacagtagtactagcaacagcaccatttcaggtacaatgtcctagctctccacttattagggaggccaaagtaagttaaactctttgccactttaacaaatatgggccaaaactaaccgaatataccaaaacttcgtattcctttgtttattagcatgaactctgtccagaagaaaccttgtatctgaagaaaaaaaaaattaaaacgaagaataaactgattcagtttttaaaatccttgacagaggcaaagtttagttcgaagttttataaacgcgtgttgaaagatcctccaaaaattgggattgctatatctggcggcgggtacagatccatgttagtaggtaccggatttatttcccaaatgaacgattatggcctttttgaatattcggattatattgctggattatcaggcggaagttggatcttgatggatttggtagttcaaaattttgaagtaaaatccctgctacaagagtgggaccttgaagaggatcttttattaggcataccggaattcgatatttccgaagaagaaattgttaccaatgcaaaaaaggagtataatgataatgatttgaagatgaagaagcgtcaggggggttctctgattacaagctcttcaaatttttatgaacaaatagaggagatcatgaattccatagaagaaatcccagaagactatatgataacgaagagaaacttgaatccattagcaagactaaaaaaaatattctttcctaacaacactttcactggaactgatgcgaagattgaaacctttaaaaaagtgctagacttttacaaaagtttgcatttgaaaattaagcctaaaaaaatggagggtttccaaatatcgttcaccgattattggggtaaagcaatcgttcaaagactaaaaaaaaatttcgatgacgatcccaaccattccttttcgttttcgaagcttgtaaactcgtctaaaaaatttaaggaatgcagtgtgccgatcccaatattcgttgcaaattgcaaaaatggacttctttcaaacgttatatttgaatttacgccctttgaatttggatcttgggaaaatatcctcagacttttcgtcaagttgccctatttgggctcaaaaattgtttctggaaaggccgagaagtgtattaataactttgatgatctaggttttattactgcgacgtcttcttcaatattcaacaatgtgctcatcttcatctggaatttggcttctcagtcctccagagaagcaatgaaagctttgaatatggttatgggaatttttggcctaggtaaagaggaaatatttagtatttcgaaagactcctcgagattagagacagactatgccgtatatcaacccaatcccttttatctttatcctgaaaaagacaatgtcctaactaacaaaaatcatttataccttgtagacggcggagaagacggcgagaatattccactcagaacattggtgattcctgaaagggaactagatgtaatttttgttctggattctagttcggatattgacaactatccaaacggctccaagttaaaaaggatattcgaaaaattagatgaagagaacgttcattaccaatttccgaacaatgtaaaaacattcactcaccccattgttataggatgcaatgctaccaaaagaactggacatgattcatttttgccaattataatttatcatgccaatgcgaatcatggaaacgcatctaatacgtcgacattcaaaataacttacaatcagtctgaagttagcagtatgttacccactggaaggggagtgtttagcaatgattatgacctttattataaaaattgcttaggctgtatattaaccaaaagaacaatggacaggctcccaagaaaaaagaaattttcgccattttgcttacaatgctttaaagactactgttactcataa

SEQ ID NO: 4417 - DNA, 1980 bp, Saccharomyces cerevisiae
atgccaaactctcatggtaatgtattgaataatatctctttaaatagcaagcaaaatcccagatcgatttctaaaagttgcccaaatgataaagatgcaaggcagaaaagcttcaaaacgatatcagcccaagcactagtacgcgtgcaaggagctggatataagctcggtgatgtgaaattaaaggatgctgaagtcaaagaaaagaatagcctcaaaaaatacgattgtaaaaatgcaactcaagaaaagaaagaacaagagcaagtatttgaaaaaactgttgcaaagggaagcgtgcaaaaatatatcacgaaaacttcaaagacaaatagtttgtttataggaaatctgaaatcaactgtcactgaagaaatgctaaggaagatattcaaaaggtatcaatcttttgaatctgctaaagtgtgtcgtgattttctcaccaaaaaatcattgggttatggctatttgaatttcaaggataaaaacgatgcagaatctgcaaggaaagaatttaattatacggttttttttggtcaagaagttaaaataatgccatctatgaaaaatacattatttagaaaaaacatcggaacaaatgtttttttctctaacttaccactggaaaatccccaactgaccacaagatcattttatctaataatgatcgagtacggaaatgtactgtcatgtcttctagaaagaagaaaaaacattgggttcgtttatttcgataacgatatttctgctagaaatgtaatcaaaaaatacaataaccaagaattttttggaaataaaattatatgtggattgcattttgacaaagaagtaagaactagacctgaatttacaaaaagaaaaaaaatgattggctccgacatagttatcgaagacgaactattggctagcaataatttatcagataatgctcgttcgaaaacaatattagtcaaaaatttaccatctgacacaacacaagaagaggtcttggattacttcagcactattggccccataaaatctgtattcatctctgaaaagcaggcgaacacaccacataaagcgttcgtcacatataaaaatgaagaagaatctaaaaaggcacagaaatgtttgaataaaacaatttttaaaaaccataccatttgggttggtcctggtaaagataagcctgttcataatcaaattggaacgaacaagaaaacaaaggtttatctaaaaaatttaagcttcaattgcaataaggagtttatttctcaactatgtttacaagaaaaaataagattcagtgaaattaagatcacaaactataactcattaaattggacattttgtggacatgttgagtgtttttctcgtagtgatgctgagagattatttaatattttggataggagactaattggaagtagtttggttgaggcatcatggtcaaagaataatgataatatactaaatgagatagactatgacgatggtaacaacaatgaaaattataagaaattaatcaacattagttccatgatgcgtttccgcacacaagagttatcagctcatcaaaagggattaacgtcacagtttcaacaagtagtttccccattctcatcatattcaaattcctacacaaacatgaactctctcgtagctacgccgatgaaacctcatccagcatttaatttaattacaaatactgttgacgaaaaactgcatcagcctaagagaactaaacaggagaatgcagaaatacttgagtccttaaaaaaaattataaacagaaatttacaacgtataagtatttctggtttaaataaagaagaaaatctgcgcagcatttccgagtttatttttgacgtattttgggagcatgactcagaaaggctatcgcactttttattaatgacaaatacttcattagaatcacagaaaattctacaaaaacaagtcactagagctgctgaaagcctcggatttacagtttga

SEQ ID NO: 4418 - DNA, 1980 bp, Saccharomyces cerevisiae
atgccttcttctttgacaaaaaccgaatctaactcagatcctcgaacaaacatacagcaggtaccaaaagccttggacaaaaatgtaactaatagcggcaacttggattcgacttcttcttcgacagggtcaataacagaggacgaaaaaagatcagaaccgaatgcagattccaataacatgacagggggcgagccaattgacccaagagatctcgattgggacgggcccgatgacccagacaatccgcataattggtcctctttgaagaaatggtatactactatgacttcagcttttctttgtttggtcgtcacaatgggtagttccctatatgtttcttccgtaccagaattggtagaaagatatcacgttagtcagactttggcgcttgctggtttaactttctatcttctgggtttatcgactgtcatcggcgctccattaagtgaagtgtttggtcgtaagcctgtctatttattttccctacctgtgtcaatgcttttcaccatgggtgttgggttatccaatggccacatgagaataattctacccctaaggtttttatcaggtgtctttgcatcccccgccttatccgttggatcaggtaccatcctggatatctttgacgtggaccaggtctccgtcgcaatgacatactttgttctatctccattcttagggccagttttatctcctattatggcaggatttgctactgaagccaaaggctggcgttggtctgaatggatccaattgattgcgggcggtctaatcttgccatttattgcgctcatgccagagacccataaaggtattattttaagaaagcgtgccaagaagagaaatatagccttgaagaagttcagcagggaagctcagaaagaatttttaaaaaccactgtcactattacaatcttaaggcctttaaaaatgcttgtcgttgaacctattgtatttgttttcagtgtttatgtcgctttcatattcgccattttatttggatttttcgaagcatacgctgtcatttatcgtggtgtttaccacatgtctatggggatatctggcttgccatttattggtattggtgtcgggttatggataggtgctttcttttacctttacatcgacagaaaatatctcttccctaaaccaccagctggcactcaaccactcaccgaaaaagagagaacttctaaaaggactaccccttacagaggtgcaagagacgctgaaacaggtgaattgctacccgttgttccagaaaaatttttaattgcctgtaaatttggttctgtagctttgcctatcggcctgttttggcaagcctggactgctagatcagatgtccactggatggctcctgtggctgccggtgtgccatttggttttggtttaattttgatttttttcagcgttttaatgtacttctctacatgctatccgccattaactgtggcatcctgtttggctgccaataatctattaagatacgttatgagtagtgtattcccattgtttaccatccaaatgtacacaaagatgaaaatcaaatgggcaagcactttatttgcattagtttgcgttgtgatgattccaattccatgggtttttgaaaaatgggggagcaaattaagacacaagtcacaatttggttatgccgccatggaaaaggaggctgagaccgaaggtggtatagatgacgtaaatgctgtcgatggtgaattgaatctaacaaggatgaccacgttaaggaccatggaaacagacccttcgactagagaaaaaccaggtgaaaggctatctctgcgcaggacccatacgcagcccgttcctgcctcgtttgatcgcgaggacgggcaacatgcgcaaaatcgtaatgaacccatttccaatagtttatactcagctatcaaggataatgaagacggttattcgtatacggaaatggccaccgatgcttccgccagaatggtttga

SEQ ID NO: 4419 - DNA, 1980 bp, Saccharomyces cerevisiae
atggatagtacgaatttgaacaaacggcccttattacaatatagtctcagttcattgggctcgcaaataacaaaatggagctcatctagaccgacttcgccagttcgtaaggcgagaagcactgaaaatgactttctttccaagcaagatacgtctagtatcctcccaagtatcaacgacgacggcggtgaacagtggtacgaaaagttcaagcccaattgtttggagcaagtggccatacataaaagaaaacttaaagatgtacaagaagctttagatgccatgtttttacctaacgccaagcataggatcctactactgtctggccccagtggatgctctaaaagtacggtcataaaagaactctcaaaaatcttagttcctaaatacagacaaaacagcaacggaacgtcctttcgaagcaccccgaacgagcataaagtgaccgagtttagaggtgattgtatagtcaacgatcttcctcagatggaaagctttagtgagttcttaaaaggcgcacggtatcttgtgatgtccaacctgtcattaatacttatcgaggaccttcccaacgtcttccatatagataccagacgtcgatttcaacaacttatattacagtggctatatagttcggagcctctattacctccccttgttatatgtataactgaatgtgaaattccagagaacgataataattatcgcaaatttggtattgattatacatttagtgcagaaaccataatgaacaaagaaatattgatgcatccaaggttgaaaagaattaagtttaatccaattaacagcactttattaaaaaagcacttgaaatttatttgtgtacagaatatgaaaatgttgaaggagaaaaataaatggaataaaagacaggaagtcatagattatattgcgcaagagactggtgatattaggtcggccattacgacccttcaattttgggcgacatcaagtggaagtttgccgatttcaacccgagaatccaccatatcatactttcatgccattgggaaggtgatacatggttcccatagcacgaataacgataacgaaatgattaataacctcttcgaaaattcgaacaatttgttatcgaaagaggatttcaaattaggaatattagagaactataacacatttaataaaggcgaattcagcatttctgatgcatcatcaattgtggattgcctgagcgagtgtgataatatgaatggtctaccagaatccaatgagtatggtttacgagaagtgcgcaaaacctttcgtaacatcagtaaacaaggccataatcatggaacggtttattttccaagagaatggaaagtaagaaaattacaaaattcatttaaagttcaagctgaagattggttaaatgttagtctttataagtacaacgcggtacattctttcaggaatataactctagaatttggctactacgcacctctaattagaaagtgtcagagttataaaaaaaaatacattctctattatttgaagaatcttccgagtggctcctcggggcccaaacaaaccatggacaaatttagtgatataatgaaagttgagaacggaatcgacgttgtggatcggataggcgggcctatcgaagcactatctgtggaggatggactagcaccattgatggataatgatagcaataattgtgaccatttagaggatcaaaaaaaggaaagggacagaaggcttcgcatgttgattgaccaatatgaaagaaatgtgatgatggctaacgacgatcttgaagacgaagaaacttcttttaatgatgaccctattgtcgatagcgatagcgataacagcaataatattggcaatgaaacatttggtagaagcgacgaagacgagtctctatgtgaaattctgtcccagagacagccgcgtaaagcgccagttatcagtgagtccctttcagattcagatctggaaatactctaa

SEQ ID NO: 4420 - DNA, 1983 bp, Saccharomyces cerevisiae
atgagcttgcacattagtaaactgattgagcaatatcgttccactaaggacaatgaccttaaatatatgcttttaaggcaaaactttaaaattaacgacatagaggatgagctggctcctcttgttaacgaattgctgctcccggtattggtcgaagaacaagacatggaaattctcaacctagtatcgtttcaagtgctccccgatttagttctttctatgatcagcgaccctgcagctgctcagttgggatgggtaataagcttgatatgcgaccctttattaaaccaaagcatgatacatgcaaatcgttcttttgttctgattgagacactaagaaatgtgttacaaaaaattgaaaactcccctcatttagattaccaccaaccagtaaacagttcattagagtttatctccaaatttattgttgaaatgaaaaggcatatgtgtgatgtggatgctgcgcagctttcacattcactttctgaaagcaatatgctaatttacatagaatcccttaatctattgctaaaatttagcttcttttcagacgcggcaagtccttcagtaatggtcacactgccctttgatattttgaatgacgtttttacaattgcgcaggactattctgctacgaatacaaatgaaagcattgataggatcacagaaaaattacttttgacttctacgcaattaactcatccggtggacctggaaaatttatgccccaaaatgaagtacaatactttagcagcagtttctcgaatatggtacaaatttggccccatagtcgataaattatttactaaccggctattaccggttctattccccccgcaaatgggagaagaatgtaacgtcgaagatgttctcgaaatagttcataacttccatccatatttttctattcgtaggctaaaggataataggcctctattgtcagattcgactattagccagctaagagagggtttgtttggtatgctcagcatattaaacgactcgctgacaaggacgcaaaatgaaaacgaccatggtagcgacaatctgatcgacagtgacgacggatttggctcagacaacgatcctgaacaacaagcgtacctcgatgaactcgtatcagaaggttatgacgaaaacatgtatgacggtgatacggatgacgaagacgcagatgatataaacgttgaaaaaaatgatgaagccaccaaagacattacagaaacgaacaaaatccttttaatcttttctgagttacattatcctcaggaggagcgcttctctgaactgttggttgagttgcagactaagatcgctataaacacatccttaattgataaaattctttcaaaagagacaacagaattacccactcacaatggggaaatcgcagatttgaacgaaattctaaatgaagtgaaaggcaataaaccaattagaaaaaacgttattttttgtacgttagcgcatactttgtcgttgcaatccggttccgaattgtctgttctacagctatcaatagaggttattgatcatctgctggttaaaaatcattcaaataacatcactcgtggcgagcaatttcaattgattaagttgatattaccccatctaaaaacaaataaatcttttattgatacattaaaagcaggaaattttacccaaaaaattgatgaaggagtgaccttaagaacaatgattctttctctactactacaactattcccactggattactctatgctaggtgagattttacccactattgcgcgatattctgtaagggataaggatcttggggtgagagatctgtccttccaattgctggaccaaattctacgcacatactataattacctaattggtatcgattgggaatggtataaagatgacttctatcaagttttgcaagaaacttgtattaaaaaagacataaataccaacctcttgctacaatttcctccttatctccctcatgactag

SEQ ID NO: 4421 - DNA, 1983 bp, Saccharomyces cerevisiae
atgagtgctgctccattggattacaaaaaggctttagaacatttgaagacatacagttccaaggacggtctttctgtccaggaattgatggactccacaactagaggtgggttgacctacaatgattttttggtcttaccaggcttggtcaatttcccatcttctgctgtcagtttgcaaaccaaattgaccaagaaaatcactttgaacactccttttgtctcttctcctatggacacagtcactgaagctgatatggctatttatatggctttattgggtggtattggtttcatccatcacaactgtactccaaaggaacaggcttccatggtcaagaaagttaaaatgtttgaaaacggtttcatcaattctccaatagtaatttctccaaccaccactgttggtgaagttaaggttatgaagagaaagtttggtttctctggcttcccagttactggtatgttataatagacaaaatttttggtattatgtttctttcattagaatgcgctttttaatcatccataaagttttccaaggtgtgaaaaagatctaagatgatgatcaactttttatatcaataactttcgttctactgactgtgatcaaacgatcttgtagagaacttttactctgaattaaatcatattcgcacctttttcggaaagcccattatgtgtgattaattgacgtgcagtgcacttgaggaacttaatatatgtgataaaaaaatatgtggcttattttactaacattgctatgtaaatactgttattttttttcttttctggctgggctgaaaatttcttcagtcttcataaagttgagaaaataaaaggaaacaagtacatctttttgaacacagaagacggtaagtgtccaggtaagttagttgggttagtcacctctcgtgatatacaattcttagaagatgattctttggttgtttctgaagtcatgactaaaaatccagttactggcatcaagggtattactttgaaagaaggtaatgaaatcctaaaacaaaccaagaaaggtaaattgcttatcgttgatgataacggtaacctcgtttccatgttgtcaagagcggatttgatgaagaatcaaaactacccgttagcttctaaatccgccaccaccaagcaattgctatgtggtgctgcaattggtactatcgaagctgataaggaaagattaagactattagtcgaagcaggtttggatgttgttatcttagattcctctcaaggtaactctgttttccaattgaacatgatcaaatggattaaagaaactttcccagatttggaaatcattgctggtaacgttgccaccagagaacaagctgctaacttgattgctgccggtgccgatggtttaagaattggtatgggttctgggtctatttgtatcactcaagaagttatggcttgtggtagaccacaaggtacagctgtctacaacgtttgtcaatttgctaaccaatttggcgttccatgtatggctgatggtggtgtccaaaacattggccacatcaccaaggctttggcccttggttcctccaccgtcatgatgggtggtatgttagctggtactaccgagtcaccaggtgaatacttctacaaggatggtaagagattgaaggcttatcgtggtatggggtccattgacgccatgcaaaagaccggtaacaagggtaatgcctctacttctcgttatttctctgagtcagacagtgtcttggttgcacaaggtgtttctggggctgtcgtagacaaaggttccatcaagaagtttattccatatttgtacaacggtttacaacattcttgtcaagacattggttgcgaatctctaacttcattgaaagagaatgttcaaaatggtgaagttagatttgaattcagaaccgcttctgctcaattagaaggtggtgtccataatttgcactcctatgaaaaacgtctatacaattga

SEQ ID NO: 4422 - DNA, 1983 bp, Saccharomyces cerevisiae
atgctgttgtgtaatagaaaagtccccaagactttaaatacctgttttatactgcatatattcactctgttaacactgggtgtgttagtgtccggaatgccgtcaaaaatggtatcattcgcctctcaggagactttgcagagaataaataatctccttcgagggtctgccaatcgagatgttgacattattgcagaatatttgaaaaaagacgacgatgatgatggcggcgataaggatcaccataacatcgatattgaccctttacctcgccgtcctagtttaacgcctgataggcaacttctaaaagtcggtttgcatggtgctataagttcagatttagaagtctgtagtaatttgactataaatgaggtactcctgaaatttcccggttctaacgctgcagacgctgcagtaacacaagctctttgtaagggtatggtgaatttttttaatagtgggattggaggtggtggctacgtagttttttctggcaaagacgatgaagatcatctatccattgattttagagaaaaagcacccatggattcacataagttcatgttcgaaaactgctctctatgctcaaaaatagggggtcttgctgtcggtgttccaggtgaattgatgggtctctatcgcctctttaaagaaagaggtagcggccaagttgattggcgtgatctaattgaaccagtcgcaaagctgggaagcgtgggttggcaaataggcgaagcactcggtgccactttagaactttatgaggatgttttcctgacattgaaggaagattggtcgtttgtattgaattctacccatgacggtgttttgaaagaaggcgattggatcaagaggccggcactatctaacatgctaatggaactggctaaaaatggttccgtggccccattttatgaccccgatcactggattgcaaaatccatgattgatactgtcgcaaaatacaatggaataatgaacttgcaggatgtttcatcgtatgatgttcatgttactaaaccactgtccatgaaaattaggaagggcgccaatttcatccctgataacgatatgaccgtattaacaagtagcggctcaagttccggggctgcactacttgcggcgttaaggataatggataatttccagaatcaagaagggggcgattatgaaaaagaaactacctatcatttgcttgaaagcatgaaatggatggcaagcgcaagaagcaggttaggcgattttgaaggcgaagcattacctaagcatatagaagaggtattggatccagaatgggctttgaaagcagtgaaatcaatcaaaagaaactctcaagacggaaattttaaaactttagaaaactggacgctttatgatccggcatacgatatcaataacccgcatggaactgcccacttcagtatagtagattcacatgggaatgctgtttccttgacaaccaccatcaacttgttgttcggttccttagtacacgacccaaaaaccggggtgatcttcaataatgaaatggacgatttcgctcaattcaacaaatctaatagttttgaattggcaccctccatatacaactttcccgagcccgggaaaagacccctatcatccactgcacccactattgtgctgtcagaattaggcatcccagacctcgtggtcggcgcttccggcggctcaagaatcactacgagtgttttacaaacaattgtgaggacgtactggtataacatgcctatattggaaacgatagcctatccacgtatacaccaccagttactgcccgaccgcatagaactggaaagcttccccatgatcggtaaagccgtactaagcactctcaaggaaatgggatatacgatgaaagaagtatttcccaagagcgtagttaatgctatacgcaatgtcaggggagaatggcatgcggtgagtgactattggagaaaaagaggaatctcctccgtatactaa

SEQ ID NO: 4423 - DNA, 1986 bp, Saccharomyces cerevisiae
atgagcggttttaaatgctatttgcaattgggtgacaggctctctcaaatatggctaaataagtatactttggttttgctgctagcaatgctgaagcttctgtttttctccaaatccatacaacatgcgatagaagtctcggaaacgtatattttgtccaattgttacagtattgattcactatactccaagatgacagacaacacgccgcactatttaggtatcatggggaattatcttatcgagaagggtatggaggagactgttaaagctacgctagagacgttatcacttatagtatatgcgagcgaggggctggtaaactttgccattgacctgtatttgggcacttatgcctgtttgattgttagtgccgttgatggtaccgtggacgttgctactaacattacagaaaaactgattagcttagtcaatgatacagtttcaagtgtggctaatgaattggatacgggcttgaatgacatctccaaaataatcaataaagtgatcaaggccgcatccaaagtagagaattttttcacaggtgatgacgatgacagtaacatgacgtcgtcaatcaaaagcgtcaacttaaccatatctgcgcttcacaatttatacattccttcctcaatcaacgataagcttgaagagttatcggcaaagacgccggactttgcccaggttaagaatacaaccaagaacctgatctcggttcccttcaatgaagttcggaagaatatcaaggccgtgaatgccagcaatataatcggagatacctccgttttgtacgtacctcccgtgtcccttgacaacagtactgggatttgctcatccaatcaatcagaaattttggccttttattccatcttgggacatgtcctgaaaatagccaccgtagtgtgcattaccgtattgatatgcttcgctgttggtgcgatggcgcccgttgcatggaatgaaatcaagctctggaggcgcctttgcggaatgagagaccattacatgctgagcaggcaagattcgtatacgtccttttccagtgaaaacacgcacgaattgaaagatccatttagagatcctcctatacaaaatggccaatatgatgtcattgcaagctatcagcagtgctttcaaacatggaacacaagaatagcaggctggatgacaaatcttgttacctttggaaaatcaccagagaacattgacccaaagactaaacaaaaaatagaatgggtagtggcttatatgacctccgaaagagcactgtgtgttcttggaattggacttttgggaattttagtgtgcatatgccaatttgtcatgatagcactgttaaaacacaagataagccattcattgacttctaatgatggtgacggcgttcaaaatttgctgaagtctagcactgccgtcgatatagagaaccaaatgagcctttggagcgttcagactaataaatatataaatactacggagaccaatatcaatcaggaagtattcgggtggataaacacgacaacactttctgtgaacaatacagtggccaccatgatctctgatatagacacaactttagcagatgtattcaatggaacactgctatataacccaatgaaaaccgtggtcggatgtgccattgaaaataagctctacacaatagagaaggcaatgacgtggattcacgacaaggctcagctgcatatcccgagaattaatgggacacaaatcaagcaagctctggcaaagcaaaccgacaacagcactatacccactgcaagctccacttctgccgccacagaaaacttactggagaaccttgtgaatgatatgagagaaggacttttaaaaattctccgagcttaccaccgtataactctgggagaactcacggtagccttggtcattcttgcggtgtggctcgtacaattgcccatagctctggtaattctccgattacgtcttcgcaaagccacctttgactga

SEQ ID NO: 4424 - DNA, 1986 bp, Saccharomyces cerevisiae
atgagtgaactgcttgccattccacttaagcgaactttagaagtggactttgccacggagttgtcaaaactaattgatactacttcctttcaaacggcatcctttttccaatcagacatactcaaagttgttgatgcaagaaacaatgcgattgcacccgatatctcaatcgacggtctttctgcactgaaggaatactatgtaatattgttgcaattagagaaaaagtttcccaataatcaaatagaatttacatggtttcaaacgctatcacaaaaatctcgtggtactagtcaatactcattacaatgggaaaaattaaccattatttataatattggttgcatgtattcactgttggctctaaatagcaacaatgatgcagccgaatccctcaaaacgtcatgtctgtacttccagaatgccgccggatgctttaaacatgttttagaccaccaaaaaaatcttgagacaatcccagtggtagatgacgccacattgaacgctttaacctccctgatgctagcacaagcgcaagaatgcttctggtttaaagccgtgcaagataaacacaaggactccttaatcgcgaagttgtcacaacagatcgtggacttctactgcgaggctattaatgacgcccaaagggggaaacttattagaagtgattggataaaccacttaaaggctaaaaaggcttactttagtgcggtgacttattacagaatagccttatcttttaatgagaagaagcagttcggaaatgttgtgaaagctctgcaaatgggattgcaatttataaatgaatcaacactatcttcgcaagctaagtttaaaactgttgtcgaatcttctctgaaagaagcccaaagagacaatgaattcatctacttacaagaagttccttcggaattaccatcgatcaaaccagctctcatggttaaaccatcttcttcagcaacattgttgccttctattaaaaaggatgagactttattcaaagacctaatccctatagaagtgatggaatattgcacagcatacaatgaaaggcaagatgaatacgttgaacaacgtgttaccaatccccttgcttccctaaataaactattgaaggagtccttgactactttccaaataccacaagggcttacaaaggtgagtgaagcagaactgagtcattaccaggcatcactgaataatcttctcattaataataaaaatgtgcaggtacaactcgataacattgagcaaattttaaatgaagaagcatttactgacaatcagctccgactaaaacacggaaccttaaattggactttacccgaatcttcaactactaacacagcatattatgaaaaactaaaaaagctgagaggataccttgatgaaggtagtgcgattgacaaacaaacaaatgaactatttcaaagcatcgataaaaatttgattggatcagagatcaggttaccggaatctaatgatcctctaacgaataagattaagatgatcatacaggaaagaaatgattatattgataggacgaggcggaaatcttcagaatatagaatacttccaaagatcattacatcgtataaaaaaaatggaacagtcgactttgaacccattttcataggccatttaaaatactttgacgaagatttaagatacgttaatagtacaaaggaagaaaatatcaaacttattgaggaagtaaacctaagtaagaagaataaccccggcagaagcgggattgaaccaaagaaaatggtaagaatagatcccagagagctatatattgaagatctgagatattccttcaaactgcttgatgaggtgaaagaaaatttaagtgccggcacagcattttacgaaaatttaattacttctaccagcaatctgtacaatgaggtacaggaatatgatacagcaagaagagcagaaaaagctaggcttgataagagtttgacatttgaagaccaatga

SEQ ID NO: 4425 - DNA, 1986 bp, Saccharomyces cerevisiae
atgcaaagttcagtttattttgaccaaacagggtcatttgcgtccagtagcgacaacgttgtgtctagtaccaccaacacacacaacatttctcccagtcatcgttccagtttgaatctgaacactacttctcatccccacgaagcgtcgggtagaggaagcgcaagtggggagttgtatttgaatgacacaaactcacccttagcgatatcttctatgctaaacacacttgcccttggaagtatgccccaagacattgcaagcagcaacattagcaatcacgataacaacattaaggggagctacagcctaaaattgtcaaatgtagccaaggatattactctcagagaatgctatgcaatcttcgctcttgctgaaggtgtgaaaagtatagaattacagaaaaaaaactcttcatcaagcatcacttctgcctcattagaagacgagaatgatatttttatcattgccagatttgagttattgaatctagctattaattatgccgttattttgaattcgaaaaatgaactctttggacccagttttcccaataaaacaaccgttgaaataatagatgacacaacaaaaaacttggtttcattcccatcatctgccattttcaatgacacctcaagattgaataaatcgaactcgggaatgaaaaggccaagtctgttatcacaaagatccaggttttcattcagcgatccattttccaatgattctcctttaagccaacagcaatctcaacagcagcagcaacagccacaacagccacaacaacactctacgcaaaaacattcaccacaacaatgtaatcaacaacaagtgaattcttcaataccgttatcttctcaaggccaggttattgggttacattctaaccattcacatcaagatttgtctgtggaatcaacaattcaaacatctgatattggcaaatctttccttttgagagataacactgaaattaatgaaaagatatggggcacaagcggtataccttccagcatcaacggttacatgagcactccccaaccttctacgccaactttagaatggggaaatacttctgcatcccaacatggttcttcgttctttttaccctctgcagcatcgacagccattgcacctacgaatagcaacaccagtgccaatgcaaacgccagctccaacaatggagccagcaataatggtgctaaccaggcactctctgccagctcgcaacaaccaatgatgcaaattggtaacacgattaacacttccctaacctcttcaaattcattgcctccatacggtttaatgtcttctcaatcgcagcacatttcaaatatggtaaacacctctgatatgaacattacacctcaaaaacagaacagatttatgcaacaaccccaaccagagcatatgtatcctgtgaatcaaagtaacactcctcaaaaagtaccgcccgcaagattaagttcaagtagaaattcacacaagaataactctactacctcattatcctcaaatattactggatctgcctcgatttctcaggctgatttgtcactactagccagaattccacctcctgccaaccctgctgatcaaaatccaccttgtaataccctttatgtagggaatttaccctccgacgctactgagcaagaactaagacagctattttctggtcaagaaggcttcagaagactatcattcaggaataagaataccacatctaatggtcatagtcacggaccgatgtgcttcgttgaattcgatgatgtcagttttgcaaccagagcgttagctgaattgtatggtagacagttacctcgctccactgtgagcagtaagggaggtatcagattaagcttttcaaaaaacccactgggtgttaggggcccaaacagcagaagaggaggcagtggtaacccaaatcctaatgtaaatatgctttccagttacaattctaatgttggtcatataaaaaactaa

SEQ ID NO: 4426 - DNA, 1986 bp, Saccharomyces cerevisiae
atgggcacactgtttcgaagaaatgtccagaaccaaaagagtgattctgatgaaaacaataaagggggttctgttcataacaagcgagagagcagaaaccacattcatcatcaacagggattaggccataagagaagaaggggtattagtggcagtgcaaaaagaaatgagcgtggcaaagatttcgacaggaaaagagacgggaacggtagaaaacgttggagagattccagaagactgattttcattcttggtgcattcttaggtgtacttttgccgtttagctttggcgcttatcatgttcataatagcgatagcgacttgtttgacaactttgtaaattttgattcacttaaagtgtatttggatgattggaaagatgttctcccacaaggtataagttcgtttattgatgatattcaggctggtaactactccacatcttctttagatgatctcagtgaaaattttgccgttggtaaacaactcttacgtgattataatatcgaggccaaacatcctgttgtaatggttcctggtgtcatttctacgggaattgaaagctggggagttattggagacgatgagtgcgatagttctgcgcattttcgtaaacggctgtggggaagtttttacatgctgagaacaatggttatggataaagtttgttggttgaaacatgtaatgttagatcctgaaacaggtctggacccaccgaactttacgctacgtgcagcacagggcttcgaatcaactgattatttcatcgcagggtattggatttggaacaaagttttccaaaatctgggagtaattggctatgaacccaataaaatgacgagtgctgcgtatgattggaggcttgcatatttagatctagaaagacgcgataggtactttacgaagctaaaggaacaaatcgaactgtttcatcaattgagtggtgaaaaagtttgtttaattggacattctatgggttctcagattatcttttactttatgaaatgggtcgaggctgaaggccctctttacggtaatggtggtcgtggctgggttaacgaacacatagattcattcattaatgcagcagggacgcttctgggcgctccaaaggcagttccagctctaattagtggtgaaatgaaagataccattcaattaaatacgttagccatgtatggtttggaaaagttcttctcaagaattgagagagtaaaaatgttacaaacgtggggtggtataccatcaatgctaccaaagggagaagaggtcatttggggggatatgaagtcatcttcagaggatgcattgaataacaacactgacacatacggcaatttcattcgatttgaaaggaatacgagcgatgctttcaacaaaaatttgacaatgaaagacgccattaacatgacattatcgatatcacctgaatggctccaaagaagagtacatgagcagtactcgttcggctattccaagaatgaagaagagttaagaaaaaatgagctacaccacaagcactggtcgaatccaatggaagtaccacttccagaagctccccacatgaaaatctattgtatatacggggtgaacaacccaactgaaagggcatatgtatataaggaagaggatgactcctctgctctgaatttgaccatcgactacgaaagcaagcaacctgtattcctcaccgagggggacggaaccgttccgctcgtggcgcattcaatgtgtcacaaatgggcccagggtgcttcaccgtacaaccctgccggaattaacgttactattgtggaaatgaaacaccagccagatcgatttgatatacgtggtggagcaaaaagcgccgaacacgtagacatcctcggcagcgcggagttgaacgattacatcttgaaaattgcaagcggtaatggcgatctcgtcgagccacgccaattgtctaatttgagccagtgggtttctcagatgcccttcccaatgtaa

SEQ ID NO: 4427 - DNA, 1986 bp, Saccharomyces cerevisiae
atgtcaaggaaatctatagtgcaaataagaagatctgaagtaaagcggaaacgaagtagcaccgctagcagtacaagtgaggggaaaactcttcataagaacacacatacatcctctaaaaggcagagaactttgacagaattcaacatcccaacttcatcgaacttacctgtccgttccagttcatattcattctcaaggttcagttgttcaacatccaataagaatacagagccagtaattattaacgatgacgatcacaatagcatttgccttgaagacactgcaaaggtcgaaatcaccatagacacagacgaggaagaactagttagcttgcatgataacgaagtcagcgcaatagaaaataggaccgaagatcgaatagtaacggaattggaggagcaagtaaatgttaaagtctctacagaagttattcaatgtcctatttgtctagaaaacctttctcatttagaattgtacgaaagagagacacactgtgatacttgcataggcagtgacccgagcaatatgggaacacctaaaaagaatatcaggagctttatttctaatccatcatctcctgcaaaaacgaagagggatatagctacgtcaaaaaaaccaacaagagtaaaacttgttttaccaagtttcaagataattaagttcaataatggccacgaaatagttgtggatggtttcaattataaggccagcgagactatctctcagtactttctttctcattttcattctgatcactatattggactcaaaaaatcttggaacaatcctgatgagaatccgatcaagaaaacactttactgttctaagatcactgcaatattagtaaatttaaaattcaaaattccaatggatgaaatccaaattttacccatgaataaacgcttttggataacagataccatttcagtagttacgttggacgctaaccattgtcccggtgcaataataatgcttttccaggagtttctggcaaattcgtatgataagcctataagacaaattcttcacacgggggattttcgaagcaacgccaaaatgattgagacaattcagaagtggttggccgagacagcgaatgaaactattgaccaagtttatttagatacaacatatatgactatgggatacaactttccttcacaacattctgtgtgcgagactgtggctgattttacattacggcttataaaacatggtaaaaacaaaacatttggagattcacaaaggaacctttttcactttcagagaaagaaaacattgacaactcatcgttacagggtcctatttcttgtgggaacatatactattggaaaagagaagctagccatcaagatatgtgaatttttgaaaacaaaattatttgttatgccgaattccgttaaattttcaatgatgctaacagttttacaaaacaacgaaaatcaaaatgacatgtgggacgaaagcttactcaccagcaatttacatgaatcatccgtacatttggtacctataagagtgttgaaaagtcaagaaaccatagaagcttacttgaaaagtttaaaagaattggaaacagactatgtgaaagacattgaagatgttgtcgggtttatacctaccgggtggagtcacaattttggtttaaaatatcaaaagaaaaacgatgatgatgagaatgaaatgagtggcaatacagaatattgcttagaactaatgaagaatgatcgagataatgatgatgagaatgggtttgaaatctcgagtatattgaggcaatacaaaaagtacaacaaatttcaagtttttaacgtaccatattctgaacacagtagttttaacgatttagtgaaatttggttgtaaattgaagtgttctgaagtcattcccactgtgaatctaaacaatttatggaaagtgaggtatatgacgaattggtttcaatgttgggaaaacgttaggaaaacgcgggcggctaaataa

SEQ ID NO: 4428 - DNA, 1989 bp, Saccharomyces cerevisiae
atgaaggacttgagattacaggggccctacagaaagtacattccctataatattttccaacaatgtggaattggtcacttaaagacgcttgattatattttcgcgtttttgattgttattaccaatttcacattaatatggaaatcgcactcttcttcattctggaaccgaccatgggacaataatagtgaacaagaactttcccaattaattcagttttacctagacaaggctttttacatccatgaattgccaccatttacaatacagttctactccattattcgaagattaaagatcgcagaaaatttaagatacgtttctttgtttttgaattcatcgactttaggttttcttttcctgataacaaggagaatcaattgctctcgtttaatttcagcaacaggtttgctgatattatccaactgggaaactttcagaaatgagggcactattatatcatttgacagtttagaatggtgtctgttctcagtagtaatttacagttttataagcatttcaattgcaaaactgggaactacgaattggtttgctaatgtgattacattatctatttctttagggctggcaatctcttctaaatttattggaattgtcacttgggccttcgtaattctttcttttgtacgtcaatttgatagactgataagcgacgttaaagttacgaccatccaaataataaaatttgtcattctctgtctattattcgttttgattatccctggttccatcttcataataagttattcgaacttactttcgaattttaagacagacacgccacaattttcaaaatatatgagcacatatttcaagtcctatttaagaggccctcaagtacaaccgagtcgattgtactatggatcaacgatcacattacgtcatttagattctatggtcggatatcttgcttctcacgatatttcgtatccatcagatgttgacgaacagttagtagcgttatcatttgaagaattcgcggcagacaatgaatggttaatagaacatcctacattaaatttgagtttttctgaggtataccatgctgatcaattgatacctgtagaatttggtcaaagtataaaactaagacacaaatctactggaaaattattgagagccagcactgctaaacctcccatcagcgagcaggactatgactttcaaatttcatgcacgaaagattcaaactacgaaggaggaatggatgagagatgggatgttctcctgattaaagatgaaatcaacaatgataaaaaggataacgcagatgataaatacattaaaccgcttcaatcagagatacgcttttacaataacggccagagatgtgggctattgggccatgatcttcggttacctgaatggggccgctttgagcaagaagtcctatgtatggagtacccagtaataccaagaaccacttttctaatagactcagtacaactaccagtcgatttccaagtcccaatgatagaatattatatcggcaaaataagttcttcagcagaattcaatcataccttatcttggtcacaatttctttatcttttcaaagaatatattttcaaacaatacaagtacaattactatattaaatacggtaaaaataaggtcacttttgaagatgcgttcgccgtggaaaaatggccaattacgttagacacagactctccagtttggtttaattttgcatggtatggatccttactctcgatgatcattttcatgtgcgtgcaatgtaagagaatgatatcttggaatccgtggacaactgctgaaccttccttttctatcaaatgggaggtctacaatgaatttggctgggagtgcattgtcggttggtttttacatttttacatcttcacaatgagtccacacttcaacttggggaaaaaactgtacttccaaagttttttctttagtgtattgtgtcttttagaatcgttagattgccttgcaaagtaa

SEQ ID NO: 4429 - DNA, 1989 bp, Saccharomyces cerevisiae
atgacagtctcacacaatcattctacgaagatatcccaacaaccaatctcctcggtatcagcatttaagttcttcggaaagaagctgttaagttcaagccatgggaacaagttgaagaaaaaggcgtctctacctccagacttccactctacaagtactaatgacagcgaatcctccagcccaaaactgccgaattcgttgaaaacctctcgccgtgcaaactctttcgctcacacaaccaacagcaagagatctttatcttccgcctcaaccaagatcctacctccggccggctccagcacgtccatctcaagaggaaacagacattcgtccacttcgcgtaatctctcaaactccaagttcagtagcgaacgattagtgtacaatccatacggcgtctcaaccccaagcacgtcactctcgtccgtctctacctccatgaagaaagaccctgatctgggcttctaccttcacgatggggattccaaaatccgcatgctgccgatcccaattgtggacccaaacgagtatctgcccgacgagatgaaggaggcaagcatccagttgagcgataacttcgtctttgatgatgagaataagaccatcggatggggcggttcgtgcgaagtgcgcaagatccgctccaagtaccgcaagaaggacgtatttgctctaaagaagctcaatatgatctataatgaaacgcccgagaaattctacaagcgctgctcaaaggagtttatcatcgcaaagcagctaagtcatcatgttcacatcacaaatactttccttctagtcaaggtgcccaccaccgtctacaccactcgcgggtgggggttcgtcatggagctaggtctacgagatttgttcgcgatgatacaaaaatcgggctggcgcagcgtggccctagcagaaaagttttgtatattcaaacaggtggcgtgtggtgtcaagttttgccacgatcagggcatcgcccaccgtgatttgaaaccggaaaatgtactgctatccccggacggcgtgtgcaagctgacagattttggtatctcagactggtaccacacggatccacacgacctgtccagccctgtcaagaagtgcgcagggatgatcggctcgccgccgtatgctcccccggaggtcatgttctacgactccaagaagcactacgatacggaattgcaacagccgtatgacccacgcgctctagactgttatggcctgggtattatcctcatgaccctcgtcaacaacgtcattccatttttggaatcctgcagcttcgacactggtttccgcgattactgtgacgcttatgaaaactttatccgtcttcacgatcgcgcattccgcaatcgcggcaattaccgcccggggccgggaatggagtatcacttggctagaaatttcaagaacggacatgcatctcgcgtggcatggcggctcgctgacccagaagccgccacccgctacaccatcgacgacctcttcgaagacccatggttccaaggaattgagacttgtgttgatgccaacgacaaatatgtgtgtaagaaacctattatcaaaaccactacgtacgagaatccgcggggtttccatatcgctacagatgttgctgcaaccacacccacctcaaacccattccttaagaaccgagtccccatcaggtcaatggtagatatagccgcccatccttccccaacggccacggttttagcgtcgtcgcctccgccgcctcctccggcgactcatgtgccagccgaggccttatttacacttagggaaaccccgccgccccagctagcaaccctcacgcttagcgaagaacctcccgcaactcccgcaccttccgcaccttccgcaccttccgctcgcgtccgtggccactccccgcacagggtagtgcatcaccatctgaacattgtcaacagcttggtccatagttctagcgcggcgtcttctcaagttccggcttcgacctag

SEQ ID NO: 4430 - DNA, 1989 bp, Saccharomyces cerevisiae
atgactaaagaaacgattcgggtagttatttgcggtgatgaaggggttggtaaatccagtctgattgtatcattaacaaaagctgaattcataccgaccatacaggacgtgctgccacccatcagtatcccaagagatttctcatcatcacctacatattctcctaagaatacagtacttatagacacttcagattcggacctcatagctttagaccatgagttgaagtccgccgacgtaatttggcttgtgtattgcgatcacgaatcgtatgaccatgtttctctcttttggttgcctcatttcagatccctggggttgaatattcctgtcattctctgcaaaaataaatgtgattccatatcgaatgttaatgccaatgcaatggtcgtgtcagagaacagtgatgatgatatcgataccaaagtggaggatgaagaatttatcccaatattaatggagtttaaagaaatcgacacttgcattaagacaagtgccaagacacagtttgatcttaaccaagcgttttatctttgccaaagggctataacacacccaatatcacctttatttgatgccatggtaggtgaactaaagccattggctgtcatggctttaaaaagaatttttcttttaagcgatttaaaccaggactcatatttagatgacaacgaaatcttgggcttacaaaaaaagtgcttcaataagagtatcgatgtaaacgaactgaattttattaaagatttgcttttggatatttccaagcacgatcaagagtacattaaccgcaagctatacgtaccgggaaaaggcatcaccaaagatggtttccttgtactgaacaaaatatacgctgaaagggggagacacgaaactacatgggctatcctaagaactttccattacacagattccttgtgtattaatgacaaaattctccatccgaggttggttgtccctgacacttccagtgtggaattgagccccaagggctacagatttcttgtagatatttttttgaagtttgatatcgacaatgatggtggtttgaataatcaagaattacatcgtctatttaagtgcacaccagggctgcctaaactatggacctcaacgaatttccccttctccactgtcgtaaacaacaagggttgcatcaccttacaaggctggctagcacaatggagtatgacgactttcttgaactatagcacaactaccgcttacttggtgtattttggctttcaggaagatgcaagactagccctacaagtaaccaagccaaggaaaatgagacgccgttccgggaaactttacagatccaatatcaatgacagaaaagtgttcaattgctttgtcattggaaagccatgttgcggcaaaagctctttgctagaggccttcttgggcagatctttctcggaggagtattctccgacaatcaaaccaagaattgcagtcaatagtttagaactcaaaggtgggaaacagtactatttgattttgcaagaacttggagaacaggaatacgccatactagagaataaggataagttaaaagaatgtgacgtaatctgtctaacatacgattccagcgacccagaatcattctcctacttagtttcgcttctagacaaattcacacatttacaagatctaccgttggtatttgtagcttctaaggcagatttggataagcagcaacaaaggtgtcaaatccaaccagatgaactggcagacgagctatttgtgaaccacccactgcacatatcatccagatggctaagttcccttaatgaattgtttattaaaatcacagaagctgctcttgatcctggcaaaaacactccgggattgccagaagaaacagcagcaaaagatgtcgactacagacaaacggctctcatttttgggtccactgttggattcgtagcactatgttcctttacgttaatgaaattattcaaatcatcaaaattctcaaaataa

SEQ ID NO: 4431 - DNA, 1989 bp, Saccharomyces cerevisiae
atgagttataaggctaaccaaccatctcctggggagatgccgaaaaggtcaccttccatcctggtgacagatgcaagaacatccaagaatagaatgagtgcaccgttcgctggacacgctgctggtagtaggaagaatatggaaaacgcaggagttacgaagtctcaaggagttcgctcttccgctattggcccttctccgctgcagagttttactcatccaagaaggcgatcgtctggcaggtttagcgatatatccatagataatattctttctgataattcagatattccctctgccagaagagaggaaaggctatccagctcttcaagcgataggcctcgccaatatgagcggttaagttcgcgtagaaagatgatcaatcccctgcctccaagaacatcgaagacgtcacaaaagttagtgttgataccggaagacgacaacttgaaccactttcaaactctaccaacgaacgcgctggataggcaaagaccgaaagtgggctctatgaagtctaattccttcgatcggctacctcgatactcaaaagaaaagtccatggcaagaatcaccgcatataatgttgctgatggcttcaatctcaaccaattgtataagtttctgcaggaaactcatgaggtttcaccaagattgtatgatgagtgtctatacgttgcgtatactttgccacttctaccaggtaaaggcggttttagaatcaaatcaaatttatctaagaaaacaatgggtggaaagacattaattgataatttaattgatacaagcgaacagagagatcatcattatgaatattactcaggtgtggaaactgtggaagatgcaaataataattacgaactagaaaccagtggaaataacaataacgctaatcaagacaccacaacagttcccgatcatctaccaaatccagttggtcagcaagactcttttaatcctatggaaccacaattttttgcggaagaaactcccttagagatagagaaacgggaaaggacagaaagaataaacatgctgaagaaggaggaaaacgacagtgatgcaagttgtggcaacgataataataataaaaataatgataagagtaaactttatgctgttgagggaaacgatcagtatgtacagtcctctcgttcaccagcttcgccatcatcaatatctacgccatcgccaccatcttcatcacagaatgattttgatcgtgtatataaaatgcatagggacaacgaccatgaaggcaatgatagacatgcagaaattttcatttttcactatggcgttattgttttttggaactttactgaaattcaagagaaaaatattcttggtgatataacatttgcagattataagaatttaatgatccggccgctggatgaacaagatattgaaactgaacaattccatttcgaatatgacagagataccgagagaccgagaattttcaatgatattgtcacattacgttcaggtgaccacattatcgagctgacactatcacatgcgattgcgcaatcttcgaaattatcaaggtttgaatccagaatttcgccgattttaatatcagtcacaaaactacctaaaagactagcattatatggtacccttgggttaaaaagggaacagcttttgaaaaaatcagggaagctctttaaattgagagtggatgttaacctttcatccaccatattggatacacccgagtttttttggtcgttcgaaccaagtttgcatccactgtacgtggcaatgagggagtatttagaaattgaccaaagagtacaagtattaaatgatcgttgcaaagttttcttggaattctttgatatatgcgttgactctgttgctgaaagaaacatggctcgtgttacatggtggtttattcttgtcattttatttggagttatattttcattaacagagattttcgttcgttatgtaattattcatcgtcatacttctacatag

SEQ ID NO: 4432 - DNA, 1992 bp, Saccharomyces cerevisiae
atgaagttactttttaaaagatattcgtctagtcatattggtaagctgattaaggactctttaatcactcctgaaatactaccacagctagggcgacagccatcatcgcataaacgtttaccaaataacaaaagaactaactcaataactgataaatggttgaaggatgcgctaacaagaaaagataaactgaatgaagataagctccaaaatgtaaatttacgattaaatgtggtactgactactctacagaagcttcgtacatccgataatcctgctttgtattttgcgttgttgaatcgtattggcacaggtcacataaaatggctaaataaaagtggccgacagattgatgcattcccacctgatcggctgcctttggaattttatcatgagctatctaatatgctctataaactatcgcttcggtccgcaaatgacaaaattgcactagctaaattttcattgcaattattggatcgctattattttcttaaaaccaaatctttaactatagaaggaaaatttcgggcaaacataaaatttttgaggaattgtactcttttaattgttaaatcccaatcgaactactacttaagggcaatacagcggttgttcgcggaaaattcggagggtcaattattagccaatttatcccagctggcattttatgtggagacctcccaatggacaagtatgttggatattttatcctcatgtgtaccggattctggtttaagaggttcgaaggagcgtgaaagagctattcaattgttggagttatttagtccatgcctagtcaaaagtctaaaagtaatgatagcacaaaatatggagaatgaagcttgtcagattttaaggagcttgtctgaatggaactttcattttgatcagcatgattcctccaacttgatacaattatcccagaaccattcttgcctcaaagttattgaaaccatgaatggattatcatcaactaccgctgtcactaggcaattcggacttgaaaaattaccaactgacgtgagtttgaagcagagcatacatattttatcaaaagataatttcgaacctctcaagcaagattcatttcttcaatttctatcgtttaaattaagtgatttgcctctgaacttagaagtatggaaaaagcacattaaggaggttgatgaccaaatgcaggctgagtccaacctgcattccttaagagctttttttattgatatgctactgtgtcacttatctgtgcgcaaggatttcgattttatgctttcattggtcgagcacatagtatacgaaaaaaatttatggcagccattattactcacagataatatagttggaaacaaagaaaattccacttttcattgcctctttcatggcgcctctcaagatatttctaccaaacttactctactggcattgtataaccagttgaatgaaatcggctatcaatttacctcccacgattttctctcgatgttgaaagtctgcaaaaactactctgattctgattttttctattttgctttctataatttgttggttacacaaagtcacaaattttttcttttcgataagtttagtgataagttttcgtggaggttgccaatacaaatcggagatgcaatttctgaatggctatccagcttagaaattgatatacaagaaaacaccgatagagttttgcagataacagatgacgtcggcgaatggtatgttgagaataaaccatttaagtcagaaaaagggaccattcaaccaataaacataatggaattgcgcaaaatttttggggagcgaaaaactctatttcatatggattcagaaattttccaaaaatctaaagcaaaaagagataaagaaatgcggaatgaagctttatttaccgcaaatgatgcggaatataattttgctgcggatgtatcctatgcaaagagagtagaaaatctattttcttacataagatctaagcaaatgcaacaaaaataa

SEQ ID NO: 4433 - DNA, 1992 bp, Saccharomyces cerevisiae
atgacgcttggtaatagacgccatgggcggaataatgagggaagctctaatatgaatatgaatcgtaacgaccttgacgatgtttcccattacgagatgaaggaaatacaaccaaaggaaaaacaaattggctctatagaaccggaaaatgaagtagaatattttgaaaaaacagtggaaaaaaccattgaaaatatggaatatgaaggtgaacatcatgcatcttacttacggaggttcattgactcgtttagaagagcggaaggctcgcatgcaaattccccagactcgagcaactctaatgggactactcctatatccacaaaagattccagctctcaattggacaatgagttgaatcggaagagctcatacatcactgttgatggtattaaacagtcaccacaagaacaagaacagaaacaagaaaatttgaaaaagagtataaagccccgtcatacggtgatgatgtccctagggactggtattggtactggtttgctggtcggtaactccaaagttttgaacaatgcaggtccgggtggtttgatcattggttatgctattatgggtagttgtgtttactgtattattcaagcttgtggtgaattagcggttatatacagtgatttgattggtggatttaatacatatcctttgtttttggtcgaccctgcacttggcttttctgttgcttggcttttttgcttacaatggctatgtgtttgtcctctagaattggtcactgcatccatgactatcaaatattggacgacatctgtgaacccggatgttttcgttgttatcttctacgtactaatcgttgttatcaacgtttttggagctaagggttatgcagaggcagatttcttcttcaattgttgtaaaattctgatgatagttggatttttcattctcgccattattattgattgtggtggtgcaggtaccgatggttacataggtagcaaatattggcgtgatcccggagccttccgtggtgatacacccatccagaggttcaaaggtgtcgttgccacatttgtcacagcagcgttcgcctttggtatgagtgaacagctggctatgactgccagtgaacaatccaatccaagaaaggctattccatcggcggcaaagaaaatgatttatagaattctgtttgtgttcttggcgtctttaacgttagttggtttccttgtaccttacacctcagatcaattgctaggggccgcaggttcagccactaaagcgtcgccctacgtcatcgctgtctcctctcatggtgttcgtgtggttcctcatttcataaacgctgtcatcctgttgtctgttctttccgttgctaacggtgccttctataccagttctcgtattttgatgtcgttggccaaacaaggtaatgcacccaaatgtttcgattacatcgatagggaaggtagacctgctgctgctatgcttgtcagtgcattatttggtgtcattgcattctgtgcctcatctaaaaaggaagaggacgttttcacctggttgttagcaatctccggtttgtctcaattattcacgtggattaccatttgtttgtctcacattaggtttagaagagctatgaaagtgcaaggaaggtccttaggagaggttggttataaatctcaagtcggtgtctgggggtcggcttacgctgtccttatgatggtgttagctttaatcgcccaattttgggttgccattgccccaattggtggaggaggtaagttaagtgcccaatcattttttgagaattatttggctatgccaatctggattgctttatacatcttttacaaagtttggaaaaaagattggagtttattcattcccgctgataaagtagacttagtttctcatagaaacatctttgatgaagaattattaaaacaagaagatgaagaatataaagagagattaagaaacggaccatactggaaaagagttcttgatttctggtgttaa

SEQ ID NO: 4434 - DNA, 1992 bp, Saccharomyces cerevisiae
atgccatttcaagattattttcagaagaaaaaagcagcgttcattaacagaaacaataaaagtaacgcagatgcttcagcgctacgagatattaacgatattaacataaatttcgccgccaagagcaaaaactacgtgttcccgctaacaaagctccccgatgagctcatgcaagaagtattctctcatttgccgcaaccagaccgcttgcagctttgccttgtgaacaaaaggttgaataagatcgctaccaaactgctttatagaagaatatatttgaacgactcaaatgtagtgaagagtgacttcatgcatctcgcaattaattggaccctactgaacttgccgtcttcgttgaaagaagaggagtcccgcgatatcgccaactgcaaattgaaaaaacttatagaaacactgcaaaataatattcacattactgaagtcatccagtggataaggatcaactgggatttggactctaccttgcaaaggtccattctcagcatcctttgcaatcagggcaagtccttgcaaagactagaaaacgtcactgacccggcttgtaacgatatcatctccaatggtcacttttccaggagcaacgtctcaagtttcgacatggctcctccaaattcattgcctgagatggttgttcccgaaaattacattccgaatctcaccaaatatctttcacagcgtatctcttctcggctttctcatatgactttattcatcgaccctttaaaactgttcaattatctttaccctttagatatcaagttacaaatcatcgatttaaaattgcattggaggagggagttttacaataatgattattttgttaaaaagatacgacccggcaatcctctgactaaactatcggaggtttttgacaagaggacattgaaaattcttaccatcatttcttggaatgacactttgttaaaacgcgagacagaaatgctgaaagattttaaagaatttgagaacctggaagatttgtctttgatttctattaagcaggatgttcatatcctcgtagatctttttagttcgttaaccaatttgaaaagactaaaaatggatttcttagaggagtatgtacctgaacccacaaatcctcacatatttctctccattcttttagcttgctccaaattgcaattcatagatctgagatacgacggtcttatcccacaaatcatcaatattcaagaaaataagttccaactaaatcagcaatgcaactgcacaaactgtcaaatagtattcagtgacattctgaagggcaaaatattcatgttccctgaagactactatattcacgatcttcaagacattgctgcaaaggatatttttaaaatgatgaaatacctatctttgttaccatactctaaagcttgtgatgcttatccgagcgttagaacacaaccaatgaatttgactaattttgtgaccaagatgaaccgcaaccttttggaatatagaaattctaaatcccagttggtgcccaaaatcgttaataacccacatcaacactccaccgtgacttccacatcaaccgctcatatgagcgagcccgaaatgataataatcgatgacgatgatgatgatgatgaaattaatgcggccattcctccaagtagtgatgacacagcagctacaatttccactgacctggaacttcctcatgaatcattgaccaaaagagatattattatgtgttatcacgctcttatccatcacttcaagtcgatttacgttacttttttgaaaagttttcctcatttgagattcttgatgttgaatgacattcccacaatagttatggaggagaataatgaacgtatttttgaacccgtcttttatcattatgattataagagtaatctgtatggatggtcaaaggaatcgaacaagaatctggagaacgacagcaacaacaacaataataattctgataccattgcaagaatagccactgttatgtaa

SEQ ID NO: 4435 - DNA, 1992 bp, Saccharomyces cerevisiae
atgcctacaaattacgagtatgatgaggctagtgagacgtggccgtccttcattttaacggggctcttgatggtcgtcgggcctatgacactgcttcaaatataccaaattttttttggggccaatgctgaagatgggaattcagggaagagtaaggagtttaatgaggaagttttcaagaacttgaatgaagaatacaccagtgatgaaatcaaacaatttagaaggaagtttgataaaaatagtaataagaagtccaaaatatggagcaggagaaatattataattattgtgggttggatcttagttgcaattcttctgcaaaggattaatagtaatgacgcgattaaagacgctgctacaaaattatttgatccttatgaaatccttggtatctctactagtgcttccgatagagacatcaaatctgcttatagaaaattatctgttaaatttcatccagataaattagcaaagggcctaacacctgatgagaaaagtgtgatggaagaaacttatgttcagattacgaaggcttacgaatcccttactgacgaattggttaggcaaaactatttgaaatacggtcatccagatggcccacaatctacttcacatggtatcgctctaccaagatttttggtagatggaagtgcatctccattattagtggtttgttatgttgcgctactaggtttaatcttgccatattttgttagtagatggtgggcaagaacacaatcgtatactaagaagggaatacataatgtgacggcttctaattttgttagtaacttagtcaattacaagccatctgagattgtcaccacagatttgatcttacactggttatcatttgctcatgaatttaaacaattcttcccggatttgcaaccaacggattttgaaaaacttttgcaagatcatattaaccgcagagatagtggtaaacttaacaatgcgaaatttagaatagtggccaaatgtcactctttgttacacggtttattggatattgcttgtggattcagaaatttagatattgcattgggtgcaatcaatactttcaagtgtattgttcaggctgtaccattaacaccaaactgtcaaatccttcaattgccgaacgtagataaagagcactttattaccaaaaccggagatattcatacattaggtaaattgtttactttagaagatgccaagattggtgaggttcttggaataaaggatcaagcaaagttaaacgaaactttgagagttgcatcgcatattccaaatctaaagatcatcaaggcagacttccttgtcccaggtgagaaccaagtaacaccatcatctaccccatacatttctttgaaagtactggttcgttctgctaaacagccattgataccaactagcttaattcctgaagaaaatttaacagaacctcaagattttgaatctcaaagagatccatttgctatgatgagtaaacagccactcgtcccatattcctttgcaccatttttccctacaaagagacgtgggagttggtgctgtctggtaagttctcaaaaagatggtaaaatacttcaaacgccaattatcattgaaaagctatcttacaagaacttgaacgatgacaaagatttctttgataagaggataaaaatggatttaaccaaacacgaaaaattcgatataaatgattgggaaatcgggaccataaaaattccattaggtcagcctgcacctgaaactgttggtgatttcttttttagagtaatcgttaaatccacagattatttcactacagatttggatattaccatgaatatgaaagttcgtgattctcctgcagtggaacaagtagaggtgtattctgaggaggatgatgagtactctactgatgacgacgaaaccgaaagtgatgatgaaagtgatgctagcgattatactgatatcgatacggatacagaagctgaagatgatgaatcaccagaatag

SEQ ID NO: 4436 - DNA, 1992 bp, Saccharomyces cerevisiae
atgcgtgcgcacagaatcgatacatttctcataagagaaaacatcaaactggagatcatacatgaatcgaattcctattttggtggagaacatatatcaattgctttccgatttaagcacctaggctcacagcatgaattgttcaactataaagaaaagcttctcactgtcgataaagctgttgaagagaagttggaacaacaagcgaaagtgcaagatgatggtgaaggcacgatggaaaatcaaacctggtccctaaaatcattactaggtgccttcaaaagaacaggcgaacctgaagagagtgtggatgtggataacatgaaaatgctaaatgagagtaagatgttaagagaaaaaatacagaagcaaatgtattttcatcaacctgtaacgttaatatccggttatgttcaaatatcgggggtctttcaatacgattcagaggtaatttcagagtcaaaatttaaacaagatgaagtaaaaatggtaggactagatattgtacctggacatacgacaaattctgttcttgcattggaagatggagaacatttcaaaggtaaaagaaatttaaccaactacctcaactcagattatacaaatgtgaccaatggtcttcttttctcagaaagcggttctaggggaagaacaggtacctataacgaacggaccttaatgatatcaaacgataccagtataaaaacattacctcttcttttaataccacagacgcttttattttctgaaatttctttagaaccaggtgaagtaagaacattctattttaaatccacaaagctgccaaaagatatatgcccaagttattcatcgtcaaaagtggcatcaataaattacacgctggaggttggtgcggatgtactttctgatgataatatcgagaaattttcaaatagagtcccaataacaatagcaccatatattagttcgaatgccgaacagtacacatcacgtctggataagcctgctatcatattaaagacaggtaacataaaggaactaaagccacgtttgtttactcgaaaagtttctacggcttctgctgtatcatttggtaggagaaaatcttctataattgacattgattctccattagaagataatgaatttgtcaagcgtgtcaaaaaaaacttcattgaactggtggaatctaaccaaaatgtgtcaagagatatagacgaacttattgacttgcaaatgggggtacagttcggaaaggatgaggattcttcggatcctgaacccaacgactcacacttttcgaacgaaatggtgacgtctgcagagtctagcctgagaagcgatgctgtaactaagaggagaaaaagttattcggtacgcgataacatttctaacctcgagcaaaagatgtggaacgattgttctctcgttaagtcagatgagaattctaatcttctacctcagctaattaatttacagaacgcatatcaaattaacagaaataatgagactatggcaaaagtatccttatcagcacctttttataagacaactgatgatataaatttagtcattgaattagatccgataacgacgcctttacttaaagtgacttcgttgactgtatccttagaatcgtttgaaattataaatccaaaatataagactgaaggaaaaggaatagggagcaaaccaaaaggaaactcggtgtatgagaaacattttatttgtttcgatgagtgcaagtccgtatcggtgaaattacttcctccaagatcgcctacaaaccagattaccggacaattcaagacagatgtttttcaacataagtggatgataggactaaaatttgtaataattgcaaagacagaaagtatcactttggatcaattttatgaggataaaaagggcatcctattccattcaaaagagaatttagaaggtgaagagtttacatgttacgttcccattccaatactgtgtacatccgaagatttcatgggatggtaa

SEQ ID NO: 4437 - DNA, 1992 bp, Saccharomyces cerevisiae
atggatcacagaaaccttgatccgaaaacgctgaaggtcagccaattgagaagagttttggtagaaaatgatgttgcgttccctgccaacgctaggaagcctgtcttggtgaaattgtttgaggagaaagtgaggcaacgtctccaatcttcacctgaggcctcaaaggttagaactagcattcaaaaggttgtgaagtctggggcaaaaaacgcagatcgcaaaaagacattaaagagtaaaaagcttgaatcaagttctagtgagagtaaaactgtcaaagatgaaaatgttgaaactaacaagaggaaaagggaacaaattagtacggataatgaagcgaagatgcaaatacaggaagagaagtctcctaaaaagaaaagaaagaaaagatctagtaaggccaataaaccaccagagtctcctccacaatctaagtcagatgggaaagcaacttctgctgatttaacttctgaactggaaactgtagaagaacttcataagaaagattcttcggatgacaaaccaagggtaaaagagcttccaaaaccagaattgccgaatttaaaagtatcaaacgaatttttagctcaactaaataaagagttagctagtgcagctacggagaattatgatcattctataaaatccacggacttatcgtctatcagaatcgaaacagaagagcctgttggtccttcaactggagcagaaacaagaaatgaaagtgaggtgatggagaatatcaatttggaagtccaacctgaggtgaaggaagcaaaagaagaactaacaaaaatatcagaaacttttgataatcaagacgaagaggatactagtaggttatcgtcgaaaaaaaatatacgaagtccaaaaggtcgcaccaggcacttcattgccaacaaaactaaaagagggatagatattatgaaaccgtttattgcacatctcttcatttggttatggaatggtgctattttcctttcaataatatgtcctattctttttggtctttggtatcgagaacagagaattcaagtaggatattgcggtcatgaaaagcccctgaaatctcttgcaatctcagctttccctcagactgaaagggtagattcagtgttgcaagcttatcgaccaaattgtctcgaatgtcctgagcatggaatatgttcttcttttatgaatgttgagtgtgaaccaggctatgagcctaaaagttctattttagaaacgtatggtattattccttttccaaaatattgtgccaaagatgaaagtaaagaaaaggaggttgatgaactggtttggaaagtaaatgaatatcttaaaaagaagaatgcacaacatgaatgtggtgaaggagagaatctctttgagagtggtgaaacggaaaccaaattatatgatatattctctcattctagaccgtcatgggaaagtcaaagggaattcaatgatcattggaaaaatgtgcttgaaatattaaagaaaaaagatgatattatctggctgccattagattttgaaactaatggaaaaagagagaaatctaaatctaataacactaactatatttatcgttcaacttcaaaaaaatgggttacgttgcaatgtcatttagaaggggatatacaggagtatataacgaaatatggtggttctttatttatcaccctaggcgtccttttccttatcaaaaaaatacaatcgacacttgacaattacgttcaaggagagcagataattgagaaattggtaaaagaggcaattgataaattgaaagatgtaaagaagaacaaaggtgaagaaccttttctgacaacagttcaactaagagctactttattgagcgacataccaaatataaaagaacagaataatctatgggctcaaacgaaagaaaaaatcatgaaagagcaatcagagaatatagaattatatcttcttgaagaaaatggagagatcatgacatgttgggaatggaaagaatga

SEQ ID NO: 4438 - DNA, 1992 bp, Saccharomyces cerevisiae
atggctaagagaaatagatctcaatttcgcattcaggaaaggactgcaaagaaaagaaagcacgaagattccttgttagaaggcaatgttttccaaaatgcaccggaagatatggatgaaaataccatatatagcgcaaaaggctcatcctgggatgaagaagaacaggattacgaaatggttcctcggaagaatcggtctgatacatcaaatcttgttgaaggcctgcctataaaagttaacggtaaagttgaaagaaaattgcataaagcccaagaaaaaccaaaggacgatgatgaggaagacgaagactctaatgactcttcagaagatgatgagggacctaatgaagaacaagaagcagaggcaaaggaggatgagcctgatacggaggaaaaaattctgcaactaaaagaagacattgccgatttagtcactaaagttatggaggagcctgaagaaaatactgctgcgttggggcgtctatgtaaaatggtggaatctaaaaatcctaatacttgtaagttttccatgttggctttggtccccgtgtttaagagtatcataccaggctatagaattcgaccactaactgaaactgaaaagaaggaaaaagtttctaaagaagtctccaagcttagaaactttgagcaagccttagtttataactacaaaaattacgtcggaagattacagagtctttcaaaaactcccagtaatgctgctcctatacaggtttcattagggattttggccactcaagccgcaaaagaattgatttcaacggcatcccatttcaactttagaacagacattttcactttactgttgcgtagaatttgtaaaccaagaatttcaacagatccaacttccattcaaataatccagacatttgaaactctattaaatgaggacgaagagggctcaatatcattcgagatactaagaattttcaacaaaatactaaagacgaggaacttcaacatcgaagaatctgttttaaatatgttattatcgttagatgtcttacatgactatgaccctaatactaaattgaaaggtaacgttagcgctcctaagctcaaaaagaaagatagggtccatctttctaagaagcaaagaaaagctcgaaaagagatgcaacaaattgaggaagaaatgcgtaacgctgagcaagctgtttctgcggaggaaagagaaagaaaccaatccgaaattctaaaaatcgttttcactatatatttgaatatcttgaaaaacaatgcaaaaacactcattggatcggttttggaaggtctaacgaagtttggtaatatggccaactttgatctattaggggacttcctcgaagtaatgaaagaacttattagtgacactgaattcgataacctttcctctgctgaggtccgtaaggctttgctttgtatcgttagtgcattctcacttatttcaaatacacaatatatgaaagttaatgtggatttgtccaaattcgtcgatgggctttacgcgctattaccttatatctgtcttgatgcagacatcgaattatcttatagatcgctaaggttggctgacccactcaataacgaaataataaaaccatcagttaacgtttctaccaaagcagaacttctgctaaaggctctggaccatgtatttttccgctctaaatcagggactaaagaaagggctacggcgtttaccaaaagattgtacatgtgcatcagccataccccagaaaaaacaagtattgccattcttaaatttattgataaattaatgaatagatatccagaaatttcaggcctttactcttccgaggatagaataggcaacggtcatttcataatggaagccgataatccttcaaggagtaacccagaggcagcaaccttatgggataatgctcttcttgaaaagcattattgtcctgtagttacaaaggggctacgctctctatcatctagatctaaagagtgttctaaatag

SEQ ID NO: 4439 - DNA, 1993 bp, Saccharomyces cerevisiae
atgggtactggtaagaaagagaaatctagacgtattcgtgaaggtgacaccaaagatggtaatcttcgtgtgaagggtgaaaatttctacagagactccaagagagtcaaattcctgaatatgtacactagtgggaaggagatcaggaataagaaaggtaatttaattagggccgcttctttccaggactccacaataccggatgcgagggtccaaccagatcgtcgttggttcggtaacacaagagtgatatctcaggacgcactgcagcatttcagaagtgcattgggtgaaacccaaaaagatacatatcaagttcttctgagaagaaataagcttcccatgtcattgttggaagaaaaggacgcagatgaatccccaaaagccagaattttggataccgaaagttatgctgatgcgtttgggcccaaagcccaaagaaagagaccacgtcttgctgcatccaatctagaggacttggtcaaggctacaaatgaagacattaccaagtatgaggaaaagcaagtcttagatgccacattaggactaatggggaaccaggaagacaaagaaaatgggtggacctccgcagcaaaagaagctattttcagtaagggtcaatccaaacgtatttggaacgaattatataaagtcatcgattcgtctgacgtggtaatacatgttctagatgcaagggatccattgggtacccgttgtaagtccgtggaagagtatatgaagaaggaaacaccacacaagcatttaatttatgttcttaataagtgtgatttggtacctacctgggttgcagtatgttaacttttttttttttttttttgattctttccaaccaagaggatagcacgagagattttttttttcgatagagtatgatttttattaccaaacctttttgtcagggtgcttctctatccgttttaggataaacttatctacagaagtgtctgttactgttttggaagagtaatactgttcgcttatccatatttccccgttctggggaagcctcatgggtaaattagaaggacaacctttgttttaaaggtataccttcgctttttagaacagcgaggatcttatgagttgagcttttgttatttgagactttatctcgggctccatacaatatgttcgtagtaaagatcctcacaattttctactttttttttttttttagtttaatccactcttcgaaacaatcaatctcggctataacaatgattattacattctcttggggcaaaagattacctattatgaaacaaaatgtattttttactaacagaaggtttttttttttcaattctaactttacaagtaggcagcttgggtcaaacatttgtcaaaggaacgtccaactttggcgtttcacgcatctattaccaactctttcggtaaaggttcgttaattcagttgctacgtcagttctcacagttgcatactgatagaaagcaaatatctgtagggtttatcggctatccaaacactggtaaatcgtccatcattaacacattgagaaagaaaaaggtgtgtcaagttgcaccaatccctggtgaaactaaggtctggcaatatattactcttatgaaaagaatttttttgattgattgtccaggtattgtgccgccttctagtaaagactccgaagaagacattttattcagaggtgttgtcagagtcgaacacgtcacacacccagaacaatatattccaggtgttttaaaacgttgtcaggtaaagcacttggaaagaacttacgagatctcaggatggaaggatgccacggagtttattgaaattctggcaaggaaacaaggtagattactgaagggtggtgagcctgatgagtctggtgtttctaagcaaatattgaatgattttaatagaggtaaaatcccttggttcgtccttccacctgaaaaggaaggggaagaaaaaccaaagaagaaagaagttgagaagacggcatag

SEQ ID NO: 4440 - DNA, 1995 bp, Saccharomyces cerevisiae
atgaagttgcagagtttgttggtttctgctgcagttttgacttctctaacagagaacgttaacgcttggtcaccaaataacagttacgtccctgcgaacgtaacctgtgatgatgatattaacttagtcagagaagcatctggtttgtcagataacgaaacagaatggctgaaaaaaagagatgcatacaccaaggaggctttgcattcttttttgaatagggccacttcgaatttcagtgacacttccttgctatccactctttttggtagcaactcttccaatatgcctaagattgccgtcgcctgttctggtggtggttaccgtgccatgttgtctggtgctggtatgcttgctgctatggacaatcgtactgatggcgcaaatgagcatggtcttggtgggctgctgcaaggtgcaacttacttggcaggtctgtcgggtggtaactggttaacaagtactttggcttggaacaactggacgtctgtgcaagctatcgtggataatacaacagaatctaactcaatttgggacatctctcattcaattcttaccccagacggcattaacatctttaagactgggagtagatgggacgacatatcagatgacgttcaggataaaaaagacgccggtttcaacatctctttggcggatgtttggggccgtgctcttgcgtacaatttttggccaagcttacaccgtggtggtgtagggtacacatggtcaactttaagggaagctgatgtcttcaagaatggagaaatgcccttccctatcactgttgcagacggtagatacccaggtaccaccgtgataaacttgaatgccactcttttcgaatttaatccctttgaaatgggttcatgggaccccactttgaacgcatttacggatgtgaagtatttaggtaccaacgttacaaacggtaaaccagttaataaaggccaatgcattgccgggtttgataacactggtttcataacagccacttcatctacgttgtttaaccaatttttactaagattgaattctaccgatttaccttcatttattgctaacttagccaccgatttcctggaagatttatccgacaatagtgacgatattgcaatttacgccccaaatccattcaaggaagctaattttcttcaaaagaacgcaacctccagtattatcgaatcagaatatctatttttggttgatggtggtgaagataaccaaaatattcctttagttccattgttgcaaaaggaacgtgaactagatgttatttttgcattagacaattctgctgatactgacgactattggccagatggtgcttcattagttaacacttatcagcgtcaatttggcagccaaggtctcaatttgtctttcccatatgttccagatgtgaacacatttgtcaacttggggttgaacaaaaagccaaccttttttggttgtgatgcaagaaatttgacagacttggagtacattccaccattaattgtttacattccaaattcaagacattcatttaatggtaaccaaagtacttttaagatgtcatactccgattcagaacgtcttggtatgattaagaatgggtttgaagctgccacaatgggtaattttactgatgattctgatttcttgggctgtgttggttgcgccattatcagacgtaagcaacaaaacttgaatgctacattgccctctgaatgcagccagtgttttaccaactactgctggaacggtactattgacagcaggtcagtctcaggtgtaggaaatgatgattattcttcttctgcttccttgtctgcctccgccgctgctgcctctgcctctgcctctgcctctgcttccgcctctgcctctgcttctgggtcttccactcataagaaaaatgcgggcaatgctttggtgaattattctaacttaaacactaacacttttattggtgtcttaagtgtcattagtgccgtcttcggtctaatttag

SEQ ID NO: 4441 - DNA, 1995 bp, Saccharomyces cerevisiae
atggtcacgactccattgcattcctcgccgaaaagcagtctgaaatcttcaacgacctcactgcgctcagtacatactcagtctggtcgtatggggcctagtgagcctaagcacagaacaaccaaatcctggtctatatggggaggtaatgacgaggaagaaccggagttatctaataaaaataaaggaaaggaaaccgcccaagacaacagtcaagaaaatgacaatgtttcaaatgagggaacacgcttgcacgataatcaacaaacaacgattttaaaggaaaccaccaggatcgagaagggtgagaaggacaaaaaagacagaaatgcagctatagtagaaaaaaacacaagaccacgagcatggccattcttttggggccgtaacaaaaaagatccggagccgacgcataacattcccactgatgcggataataacactttatcacgtttagcaaatagtctaaatccggctcctctaaccaacacttacataccttataaacctgatgctatattgatcagagataaaggtgtcaaaactgctaagaaattaacagatgacataggcaatcagtttcctaacattgttgtaccaagtttcgatattttaccgaaacaaaccatatggaatacagtcacatccacaatttggaagtggaagactgaatactgggatagaagaccttcatcaagggtacgagagggggaagaacaggtgcagcactcacaaaatcagttaaaagaggaaacaaacacagttgcaaacgaggcaaaagatgaggagcggttggaacacaacagaggatctctatttagggttgatccatggaaaaaaataaaccttctatcagattaccaatctaggcccatcagagttctcattgtcggcgttcatgggttctttccaacaaaaattattagaccgtttattggtgagccaacgggtacatctaccaagtttgtcacagaagctgaggaaatagtgaaggaatattttgatcaacataaagtacccattgaaataagcaagatcgctcttgaaagagaaggagagatatttgatagagtagatttcttctacgaagttatgaagcattggagcaaagaaataaacaattctgattttatttattttgttagccattcgcaggggtgtccggtaaccattatgcttttagcgaagctgatcaaaaacggcataataaaccttgataattctcaatttttcaacgatgaaattcagttttgttcgtccaaaaaaattatctcggtcttggccatggcaggtatcaataatggtccattctacggtgcagatcaaactttgtttgttcgtgcttaccagacgattgaaaaagactcattgagggagttattcgagtttcaaaagtttgattccaaacaatcgcaaagcttcatagaaggcctaagaacaatcatatcaaataacgttaagattacatttgtgggatccatcaatgatcaactggtccctctgtattcatccacatgtctttttgccaaccatcccaatatatttcgggccatttttattgatagaggatcacaaactccagcatttatcactcgcatagttaaaattgctggttcactcttaaacctgggttataacgatcacggaatcataaaggaaataagcggatctctggcgggcaccctgacaggaggtggtcactctaccatttataatgagaaacaggtctaccatctgggcatcaaatttgcattagaaacaaccgatttgtccgaaatgtatccaattgagtactcaccatataaattgtctgagttaggagccaacccctatcgtctgccatggtgtatgaggggattgatgtacgagtccaacaagcatttcagtaatgaagaaatcaagatgttgtttaaggaatttgaggaatgggagcctgagacaaagcaattgaaggacataaaaaacaggcttaatggtttgaaatatcgactctga

SEQ ID NO: 4442 - DNA, 1995 bp, Saccharomyces cerevisiae
atgttgacctctatattgataaaaggtcgcacacctgttcttgcaagcagaaatttattagcagctctctcgaattgcaaccatattacttgggctgtttcaagaagattatacaatgatggaaacagagatcaaagaaattttggtaggaatcagagaaacaacaacagtaacaggtatagaaactcccgtttcaattctcgcccaaggacaaggtctagagaagacgatgatgaagtgcactttgataagaccactttttccaaactaattcacgtcccaaaagaagataatagtaaagaagtaacgctggactctttactggaggaaggagtccttgataaagaaatacataaagccattaccaggatggaatttcccggtttaactcctgtacagcaaaagactatcaaaccaatattatccagtgaagaccatgatgttatcgcaagagctaaaaccggtacaggtaagacatttgccttcttgattccaattttccagcatttgataaatacgaagttcgattctcaatatatggtaaaagctgttattgtcgcaccaacaagagatttggccttgcaaatcgaagcagaggtgaaaaaaatccacgatatgaattatggcttgaaaaagtacgcttgtgtctctttagttggtggtactgacttcagggcagctatgaataaaatgaataagttgagaccaaacattgtaattgccactccagggagattgattgatgttttggaaaaatactccaacaaattttttaggttcgtagattacaaagtgctagatgaagctgacagattgctagaaattggattcagggatgatttagaaactatttctggtattttaaatgaaaagaactccaaatcagccgataatatcaagactttgttgttctctgctactctggacgacaaagtacaaaagttggcaaacaatatcatgaataaaaaagaatgtctctttttagacacagtagataagaatgaacctgaagcacatgaaagaattgatcagtctgtcgtcatttcagaaaagtttgccaatagtatatttgctgctgtggagcatataaagaaacaaataaaggaaagagattctaattacaaagccattatttttgcaccaactgttaaattcacatcctttttgtgcagtattttaaagaatgaatttaagaaagatttaccaattttggaatttcatggtaaaattactcaaaataaaagaacaagtttagttaaaagattcaaaaaagatgaatccggtattttggtttgtacggatgtgggagcccgtggtatggatttcccaaacgtccacgaagttttgcaaattggtgttccatctgagttggctaattatattcatagaattggtagaacagccagaagtgggaaagaaggatcttctgtgctattcatttgtaaagatgaattgccatttgttagagagttggaagatgcaaaaaatatagtcattgccaaacaagaaaaatatgagcccagtgaagaaataaaatctgaggtcctagaggcagtgaccgaagaaccggaagacatatcagatattgtaataagtttaatctcatcctacagatcctgtatcaaggaatacaggttttctgaaaggcgcatacttcctgaaattgcttccacttatggtgtactgttaaatgatcctcaattaaagattccagtatccagaaggtttttagataaattaggtttgagccgtagtccaattggtaaggcaatgtttgaaattagagactatagtagtagagatggaaataacaagtcctacgattatgatgatgattcagaaatttctttcagaggcaacaaaaactataataataggagccaaaatagagattacgatgacgaaccgtttagacgcagcaacaacaatagacgctcattctcccgtagtaatgataaaaataattactccagtagaaacagcaacatatattag

SEQ ID NO: 4443 - DNA, 1998 bp, Saccharomyces cerevisiae
atgaagcataacaggcagatgccagatgaaagcttggaaaacataaaagtgctactgaatcctaaattaggaaagccagtcaagtcacttacgagtgcacaatcaaaagcttgctatcatacgctgatcagtaataaaaatttgaacaagacaagtgatgaatacgaaaagttattggcaaactatatcctcctttgtgatgaaaaatacctatgtaaaaccgtaattccagattcccgattttgggctatattgtgtgataattgccaaaagctaaggtcagaaacgttggtagcaaatctcattaggatttttaatgtagcccttaaatgccaagattctaataagaatgaagttattgtgagcatctgccacatctccagagagaactctcagctcattggaatacttttacaacttttgtcccaaagacctattcatataccgttgtttacggacactatactatgcataaccctatttttaaaatgctcacttacattatgtgagacatcactatcacacgccgtagaatttgtacccagaatcctcattttgctatttcagtataactttccagcttccatgtctgaattactttacatagaagacttgcaaccactaatccttgaagaatttgtaccgttaaagcagaggctaataaattttctatcttcggttagtattgatgattattcctgttcgcttaaagctgatcttcttacagccatcaaagataactccgtattccaaaaagggttagaaatggaaatgggcgatcttcccagtataaatttattaaatgcgtatgatacattcacattcttaaacagtcctaatgggtctttcaagagactttacactgaacaattgttgtttggcgagaacgatttccctctttatgaagcaatatttaaactttcagaccaatttagaagacttttcaatctaagtgggaaaaaagagaaccaatactcagactcagagcgtgatttaaaattacaaattgctaccgctgttctcaatcgacaaacatgtttttacaaaacactcgagttgtttttgagattttggatagaatcattagcaaaatcgcaaagtgatttggtttcactgttaaatttagctattatcactttaaaatatgtttgtttgtcatccagtgatttggaagcagcaatacagacgaaatcccttctcaagacccaagttgttgcacttgactctatgagatataaatttgcaagaacattacaattagactcaatcaaaaaagaacagtatcgaacctggtcatctagtatcgctagcttcgataccatgctatcaggccaggttcgtgattacgttcgtcatcaaagacttcttcaattgcaaaagggaacgtgggtttacgcagagaacccactgaatcctgaagctggcacgcctaaagtctacttcctcatagtttcagataaccacgcaaatttattagccagagaattcgaaacacaaacaaacgatttaccttatctattcgacaataaaattttaacaagtccaggttctgaggcattagctaatggcagaacaaaagttgttgttttgaaacatataacctctttcaaaagcatagaacttactacaccgagtcgtcggacgagcagtaatgtttacatcaaattagatgaagccaatgtgtacactggagttgaattaaaagatcgtaacgacaggacagttttgaaattttatttagacacagaagagggaagatatatatggctagacggattgaaattgatatctccattccagcatgaagatatatcagaagacacgaaagaacaaatagacactttatttgatttgaggaaaaatgttcagatgataaatttgaacgttcgtcaggacatcatagtgcctccacctgaaccaagcgacgaggacgaagatgaagaattttataacttggaaacgttaaagaaagtaacccaaaatttttattttgattaa

SEQ ID NO: 4444 - DNA, 2001 bp, Saccharomyces cerevisiae
atggaagagactgcgaagaaaccagctagtgccacagtaagtgcgaagtcgtcgcacgatggtggcaccgacgatttggcgcacctttttagcacgccagagatcaagaaggtgctaaattccgatgtggcaattaacgctttgttgagccgtttaaagcagtcgttgttgacttgtgaagagtttatgaaatttattagaaagaaatacgccttcgaagaagagcacgttcaggagctctccaagcaatataagcactttttcaacattcagggttccacaaattcatccttaaaaaagatgattcacgaagttttgggattcgatggcaagatggctcaagtaaagcagagttatatcaccgccttgcagaaaatgtactccgagattagtagtcttttattaacaatgacaaaattaagaaagtctgtcaaggagaacagcaaaaggctggaaaaggatgtttctgatgccatacacagcgcagaaaaggcgcaatctcgttacaattcgttgtgccaagattgggacaaattgaggatgactgacccaacaaaaacaaagctgaccttgagaggttccaaaactacgaaggaacaagaagaagaattgttaagaaaaatcgataacgccgatctggaatataagcaaaaagtagatcattctaattctttgagaaacacattcataacgaaggagagacctagaattgttcaagaattaaaagatttgattttagaaatagacacagcgatgactatccaattgcagaagtacacgatatggacggaaaatttggttctgaatacaggtgttacaataagcccattggactccaccaaatctatgaaatcatttgctggatctgtttccaatgaacgtgatctttacagttttttgaacaagtataaccaaacaggaaaacattccctactgatcaacaaaaacttgatccctgtatcatacaaaaagcatccatcaatgaatcatggtcagaaaaataagagccccccaaagtttgccgtggacccttcaagaaactccatcccgaagagaatgatatccactcataatgaatctccatttttgagcagtagtagtaacactgccgctgttccgaatgctaatcttaacagtgctacaccgtccttaaataccaacaagcagttaccacctactatggcttcatctatttcttccactagcaatgcggctggcgctatgtcaccgtcttcttccattgtaacaagcgacaccacatcatccataacaaagaccctggatcctggcaacaatagtccacaaattccagaagaattgattaactctttagactcggatcgcccgatttctcacattcagactaacaacaatatgccacccggtgttcaaaaaaatttcaaaacatttggtgtaccgctagaatcactgatagaattcgaacaagacatggtccctgcgatagtgcgccaatgcatatacgttattgataaatttgggcttgatcaagaaggaatttatagaaaatcggcaaatgtacttgatgtcagcaagttgaaggaggaaattgataaggatcccgcaaacatttccatgattctaccatcaaagccacattctgattcggatatttatttagtaggatcactgctgaaaactttttttgcgtcgctgcctgatagtgttttaccaaaggccctatcatcggagatcaaggtttgtttacaaattgaagacccaacaacaagaaaaaattttatgcacggactaatatataacctccccgacgcacaatactggacgttaagggctcttgtctttcatttgaaaagagtgttggcacatgaagcccaaaacagaatgaatttaagggctctttgtataatttggggtccaactattgcgcctgcaaatccagatgacgctaatgatgtaaattttcaaattatggcaatggaagtattattagaggtttcagatcaagcttttgagcctgaataa

SEQ ID NO: 4445 - DNA, 2001 bp, Saccharomyces cerevisiae
atggatatcgagcctactttcaaagggtacattgaagatgaagatgacgctttgcttattcttcaagcaactttggatggcaagttaaagcatataccaagaaggccttatgaaatagaaagaccttatttgatcgtatcaggtagtatattcgtttttattgaagagatatcgggcatcaagagatggactgatggcgtttcttggtctccatcaagaatatcaggcaagtttctaatatacaaggaactagacaaggaaaacgccgggtctaatgctaatgctacttcgagtggcagtactgattccgccgtcattacggatggaacttctggcgcgagaaataacccttcttcgtcgaaaatcaagctacctcctttgaagaatcaccagtttgatttgccacctactatgggccattcaagttttgagtcagagcaagacacctccatttctccatcaaaccgttcgaacttacctttaaagtatactggcctggtgaagaagacaatatctgtgaagctgaagagacctccattcaactcgattgaaaatttacatattgtctcttattattctgtaaaagatataaaacaaaattgtctagtgactcctaaagcttctccttttttgaaagatgttagaccttcacaggaactaattgtcgcgatgggaaatacaaccttaggcaacgtgaaaaacaattccactaccaccggtaatggtcctaataatataaacaataaaagcaactcttccactcccctgaatactgttatttccacgaataacaatagtgctaatataaatgctgctggcagtaatcaatttactagtgcaaacaaaaattattattataaaaatgatgaaagctctggatacccaatcactcaatttgctcccgcattaccatcaacaactttgatgtatacggcgaatccaccttatatcactcaatctcctgataacactaacgctactggtatgaatacacatgttaataataacaataataatagtaataacagtagtaatagtaataatagtaacaataataataataataataataataataataataacaataataataatattaataatattaataatgtcaatactaatgcagggaacggtaacaatccaaatagattccataacgcctcttttgcttataacaccaccggtgactttattaatccgcaacaacaaggacaaatttcttatccattttattatacaacaattccgataaacaatcctaactattataccacacaacctccaaaccctgtaacaaacgcttcaacgaacgagaatcaaggctattccacctcctcaactcaacacccttattatgggcatcctactgaaagtcaatcagcatcagcagccgcaggcgctactggcactcctggtacagccgagaatgtccttcccgtatccagtatgcagccactactccatcaagccaataataatagtgcaagctctgctacctctacagctccttatccggtgtattctatgaatgtgaatgttccttattacaattcttctgcttctgcatacaagagggcacaagaaaatactacttcaaatacgaatgcagaaccttctggtgctacaagcactaactcaggcaccatgctatcaaatcctgcatacgctaattctcagtacactccatcgcaagtgtattaccagggattcccccaatatgccatggcaagtgctcaaaatccgtctatgtatcaacaccagcaccaacatcctttgcccactgtatatccaatagcgacgcctcaacaaaatataatgagctctggtcacactttgagcactattggatctgatcctcaacatcatcactatcaacaagagcccaacgaccacaaaaacttcgctatgggtcacgcgaacaataatatcttaaacatcaccaataatgatacgatgaacaacctcaatacaaacacttcaactactacacaataa

SEQ ID NO: 4446 - DNA, 2001 bp, Saccharomyces cerevisiae
atggctgtggaggaaattgcgtcccgcaaggacattagtttaagagatatgcaaatctctgccatattaaaaatgctgtttttaaataaggatttgaacaacaacgacaacatcaccaccatcacagacgatatttttaaccagcaggagatcatctggaaggtgttgatactggacatcaagagcactgctaccatatcttctgttctcagagtcaatgacctgctgaaagctggtatcaccgttcattccttgattaaacaagacagatctcccttgccagatgtccctgccatatatttcgtctcccccacaaaggaaaacattgacattatagtcaatgacttgaaaagcgacaagtattctgaattttacatcaactttacctcatctctgcccagaaacctcctggaagatttggctcaacaagtctccatcacgggtaaatctgataaaatcaaacaagtttacgaccaatacctggacttcattgtaactgaaccggaactgttctcactagaaatttcaaacgcatacttgacattgaatgacccgaaaaccacagaagaggaaatcacgggcttatgcgccaacatcgcggacggtttattcaacactgtcttaacgatcaattctatccccattataagagcagctaagggtgggcctgctgagatcatcgctgagaaactgggtacaaaattacgtgatttcgtcatcaataccaattcctcctccacttccactttgcagggaaatgattctctggaaagaggagtgttgattattttggatagaaacatagattttgcctccatgttttcacattcgtggatttatcagtgcatggtctttgatattttcaaattatcaagaaacaccgttactattccacttgaaagtaaggaaaacggaactgacaataccaccgcaaaaccattagccacgaaaaaatatgatatagagccaaacgattttttttggatggaaaactctcatttgccattcccagaagctgcagagaacgttgaagcggcattgaatacgtacaaggaggaagccgcagaaattactaggaaaactggtgttaccaacatatcagatttggacccaaactcgaataatgatacggttcaaattcaggaagtcgtaaagaaactgccagagttaacagctaagaaaaatactattgatacacatatgaatatttttgctgcattgttgtcacaattggaaagtaaaagtcttgatactttctttgaagttgaacaagaccctggaagcaccaaaacaagatctaggtttttggatatactaaaagatggtaagacaaacaatcttgaggacaaactgagatcgtttattgttctttacttgacatcaacgacaggcttaccaaaggattttgtccaaaatgtggaaaactatttcaaggaaaacgattacgatatcaatgctttaaaatatgtttataagctaagagagttcatgcaattatcaaatatgtcgttacaaaataaatctttggaagatggatccgattccgctttcaaaccaagcaacttaacattatccggtatctatggcttaactgaaggcaaattacaaggaggtgtaggaagtttaatatcaggtattaagaagttactgcctgaaaagaaaaccatcccgataacaaatgttgttgatgcgataatggaccctttaaacagctctcaaaaaaatttggagactactgacagttacctatacatcgacccaaaaattacaaggggttcccataccagaaagccaaaaagacaatcttataataagtcactagtgtttgtagttggtggcggtaactacctagaatatcaaaacctccaagaatgggcacattcccagttgcataatcccaaaaaagtcatgtatggtagcacagccattaccacaccagctgaattcttaaatgagatttctcgccttggcgcaagtaatagcagcaacaacgatgcataa

SEQ ID NO: 4447 - DNA, 2001 bp, Saccharomyces cerevisiae
atgggaaagactaaaacaagaggcagaagacaccaagacaaacagagaaaggacgaatttgaacccagttcaaattctgcgaaggagcacatccagcaagaagagtctacttacaatgacgaagccgaaattaaagagactcagccacaaatgttttttggtgtgctagatagagaagaactggagtatttcaagcaagccgaatcgactttgcaattagacgccttcgaagcacctgaggaaaagtttcaattcgtcacgagcattattgaggaagcaaaaggtaaagaactgaaattggttacttcccaaataacttcgaaattgatggaacgagttattcttgaatgtgatgagactcagttaaaagacattttccaatctttcaatggcgttttcttcgggttgtcatgtcataaatatgcttcccatgttttagagactttatttgttagaagtgccgccttggtagaaagagaacttttaacaccaagttttgataacaatgaaaaagaagggccttatgtgactatggaaaatatgtttctctttatgttgaatgaactgaaaccgcacttgaaaactatgatgaaccatcagtatgcatcacatgttttgagattgctaatattaattttgtcttccaagacattgcctaattcaactaaagcgaactctactttacgttccaaaaagtcaaaaattgcaagaaaaatgattgacattaaagataatgacgatttcaataaagtttaccaaacaccggaatctttcaaatctgaacttcgtgacataataactactttatacaaaggatttactaatggtgccgagtcgcgttctgatatttcgcaatctactatcaccaaatttagagagtacagtgtggataaagtggcttcccctgtaattcagctcattattcaagtcgaaggtatttttgacagggaccgttcattttggagattggtcttcaatacagcagatgagaaggatcctaaggaggaatcattcctggaatatttactgtcagatcctgtcggttctcatttcttagaaaatgtgattggctctgccaggctaaaatatgttgaaagactttatcgtttatatatgaaagaccgtattgtgaaactagcaaaaagggatactacaggtgcctttgtagtgcgtgcattgctggaacatttgaaggagaaggacgtaaaacagatattggatgcagtagttcctgaattaagcatgcttttaaactcaaatatggattttggtactgctattatcaacgcaagcaataaacaaggtggttacttaagggatgatgtcattgctcaattaatacaaaaatattatccagaaaagtctgatgcaaagaatattttggaaagttgcctgttgttgagtgcatcgactttgggcaataccagagatgactggccaacagcagaagaaagaagacgatcagttttcttggaacaattaattgactacgacgacaagtttttgaatattaccattgacagcatgttggctctgcctgaggaaaggttgatacaaatgtgttaccatggagtattttcgcatgttgttgagcacgtactacaaactactagggtggacataattaagagaaaaatgctattgaacatactgtctaaagagtctgtaaatttggcatgcaatgtatatggctctcatataatggacaaattgtgggaatttacggcaaaattaacattatataaggagcgtattgctagagcattagttttagaaactgagaaggtgaagaatagtatttatggcaggcaagtgtggaagaattggaaactggaattatatgttagaaaaatgtgggattggaaaaaactaattaaggagcaagaatttgaaatatttccaaattctaaaccgctacagccaaagccagaaaagcactcaagagaaagaaataattcgaaggaaggaagcgccttcaaaaagcaaaagcactatagataa

SEQ ID NO: 4448 - DNA, 2004 bp, Saccharomyces cerevisiae
atgagtgtagaagatatcaagaaggctagagccgctgttccatttaacagagaacagctagaaagtgttttgagaggaagatttttttatgccccagcttttgacttgtacggtggggtttctggtttatatgactatggtccaccaggttgtgcattccaaaacaacatcattgacgcctggagaaagcattttattttggaagaagatatgttggaagttgattgtactatgttaactccatatgaggttttgaagacctcaggtcatgttgacaaattttctgattggatgtgtagagatttgaagactggtgagattttcagagctgaccatttagtcgaagaagttttggaagctcgcttaaagggtgaccaagaagccagaggtttagtcgaggatgctaatgccgctgctaaggacgatgccgaaaagaagaagagaaagaaaaaagttaaacaaattaaagcagtcaaattggatgacgacgttgtcaaagaatatgaagaaattttggctaaaatagatggttattccggcccagaattaggtgaattgatggaaaaatacgatatcggtaacccagtcaccggagaaactttagaatctccaagggcttttaacctgatgtttgaaacggctattggcccatctggtcaattaaagggttacttgaggccagaaactgcccaaggtcaattcttgaattttaacaagttgttagaatttaacaacagtaagaccccttttgcctcagcctctatcggtaaatcatttagaaatgagatttccccaagggccggtttattaagagtccgtgaatttttgatggcagagattgaacatttcgttgacccattggacaaatctcatccaaaatttaatgaaatcaaagacatcaagctttcctttttgcctcgtgatgttcaagaagctggttctactgaaccaattgtcaagacagttggtgaagcagttgcttcaagaatggtcgataatgaaactttgggttactttattgccagaatttaccaatttttgatgaaaattggtgttgatgagtccaaattgagattccgtcaacatatggctaatgaaatggcacattatgctgctgactgttgggatggtgaattgaagacatcttacgggtggattgaatgtgtcggatgtgctgatagatctgcctatgatttgaccgttcattccaaaaagaccaaagaaaaattggttgttagacaaaaattagataatccaattgaagtcaccaagtgggaaattgatttgacgaaaaaattgttcggtccaaaattcagaaaagatgcaccaaaagttgaatctcatctattgaatatgtctcaagatgacttggcttccaaggctgagttattgaaggcaaatggcaagtttactataaaggttgatggtgttgatggcgaagtcgagttggacgataaattggttaaaatcgaacaaagaacaaaggttgaacacgttagagaatatgttcctagtgtcattgaaccatctttcggtattggccgtatcatctactccgtttttgagcactctttctggaacagaccagaagacaatgccagaagtgttctttccttcccacctttggttgctccaacaaaggttcttttagttcctttatctaaccacaaagatttagttcctgttactactgaagtcgccaaaatcttaagaaagtctcaaatcccatttaagattgatgattctggagtttccattggtaaaagatatgcccgtaatgacgaattaggtactccattcggtgtcaccattgactttgaatctgccaaagaccattctgtcactttgagagaaagagattccaccaagcaagttagaggttccgtcgaaaatgtcatcaaggctatccgcgatatcacttacaatggtgcttcttgggaagaaggtaccaaggatttgactccttttattgcccaagctgaagctgaagctgaaactgactaa

SEQ ID NO: 4449 - DNA, 2004 bp, Saccharomyces cerevisiae
atgagtttagtaccatatgaagaaggttcgctgattttagatgatcctaattctaaatcagtggtggttgttaatccaacctcaggaactttatcatttttccaacaggacaacagtaataatgactctgaactaaatgaagaccagactgcatctttatcagcactggactttccttcagggattcatcaatacaaaagccctattgcttcctatgtgtgcccgcaatgtggtacggaaattaaccctgatattataaacagaagacaacttcatcgtcgagcctctgctggagtagaatcagaaagcagtaggctcagtattccagagaacactgtgccacttggatttgaatttgccaattcaagcttttcaagaagatattttcagtcattggaaagaaatcatcggcactacgccctacaaaacgatagtaacaataagcagggacagttcagcaaaaacaaatactttattccagatgatttgtttatccccggatactttcgtaaatttttcaaaatattgtctttgctgggaaatggtgcaagaggttctgtttacaaagttgtacacacaattggtaatactgaattaggtgtttttgcactaaaaaaaatacctattggaaatgatatggaatggtttaataagtgcatacgggaagtgaaagcgttgagttcgctaactcacaaaagtgccaatttgattacgtataatcatgtgtggctcgaaatggattcttcggttggatttgtcagatccattgatgggagccaatcggattcacaagaagaagttccttgtattttcattttacaacagtattgcagtggcggcaatttagaagactgtattctaagaaaagtgttcaataggttctcagataccgaatcacctgaagagaggaaaaaaaaatttagaactcgcaagaaaaatcacggtaaatcaggagaagttggcctatctacggaacagctcgtatccattataagggatattgcaagaggtttacacgaactgcacagtattggcctaatacatagggacttgaaaccatccaactgtttattattgactccatttaaaagtgacaatgagaatgacaacgtatacgacagggaacacaattcagatgagtttttcccatcaattgttattggcgatttgggggaaagtcagttggaaggagagtccagattgggtactggttgcacaggaacattagagtttacagcaccagaccttattatccaggggagaccagtttcttcttctacgttgccttcaagatcgagtcacacatacaatgaatacacctttgcttccgatatgtattctctaggaatgatttgctattttattgtcttcggtgaattgccctttgaaccacagttggatatagttgatttgaaggtacgcatcaaaaattttaggttcgacactgaaggtatgattgaaaagcatcaagcgatgaaattgaaaccaatagaccgtagaatatttcacctaatggacgctcttttacaaccaaataatgatgctagacccacagcgaagacagtggaggagacgttagatgaaatgctaataaattccaaacccggcaaaaaattctggaaagaaaatgtggatagcactttgaacttcagtacaatctcggaagtgaatgagaataccaacagttttactgatgattatattgacggagacaacgttactttatcattaccagcaccagaggaaaatttgagcaccgtatcaacccaaaacctccaaaagtattctgctttaaatagaacaatccaggtttgttacaaactagtttctatgatattaacgataatcatatttaagtgtaccaaaacggggtcgtggctctcttatatgtcactgatattgttgggaatggtttttaaatcaccagctgatgaaagaggtaagcatgcaagagcgttggttttactggccttcatcgccgcatgcaaaaaatacatatactaa

SEQ ID NO: 4450 - DNA, 2004 bp, Saccharomyces cerevisiae
atgatttacaaaatggcacacgtacagcttttgttgttgtatttttttgtgtcaacagtcaaagccttctatttaccaggtgtagcgcctaccacttacagggaaaatgacaacatcccattgctcgttaatcatttaactccatcaatgaattatcaacacaaagatgaggacggtaataacgtttctggcgataaagaaaatttcttgtactcatacgactactattacaatagattccatttttgtcagcctgaaaaagtcgaaaagcaacctgaatccttgggatccgttatatttggtgatcgaatttataattcaccattccaattgaatatgttacaagaaaaagagtgtgaatccctgtgtaagaccgtaattccgggagatgatgctaaattcatcaataaattgataaaaaatggcttcttccaaaactggcttattgatggattaccggctgcaagagaggtttatgatggcagaactaagactagtttttatggtgctggcttcaaccttggttttgtacaggtaactcaaggaaccgacattgaggctactccaaaaggggcagaaaccaccgataaggatgtggaattggaaacacgtaatgatcgtaacatggtgaaaacttacgaattgccttactttgccaaccatttcgatattatgattgaatatcacgatcgtggtgaaggtaactatcgtgtagttggtgttatcgtcgaaccggtttccataaaacgttccagtccaggtacatgtgaaacgactggcagcccattgatgctagacgaaggaaatgataatgaagtttattttacttattccgttaaattcaatgaatcagcgacttcttgggccaccaggtgggacaaatatttacacgtatatgatccttctattcaatggttttctttgataaatttctccttagttgttgtcttattgtcatctgttgttatccattcgctattgcgcgcactgaaaagtgatttcgcacgttacaacgagttaaatttggacgatgattttcaagaagattcgggttggaaattgaatcatggtgatgtttttcgttcgccaagtcaatcgctaaccctttcaattttggttggttcaggagttcaattatttttgatggtaacttgcagtatcttcttcgctgcattgggtttcctatcacctagttctagaggttccttagccactgttatgtttatcttatatgcattattcgggtttgtcggctcttatacatctatgggcatctacaaatttttcaatgggccatactggaaggcaaacttgatattgactccacttctagttcctggtgctattctgctaataattattgcgttgaactttttcttaatgtttgttcattcttctggtgtcataccagcaagtactctgttttttatggtttttctatggtttttgttctcaatcccattatcatttgctggttcattgattgccaggaaaagatgtcactgggatgaacatccaaccaagacaaaccaaatcgcaagacaaatacccttccagccttggtatttaaagactataccagctactttgattgctggtatctttccatttggctccatcgccgttgagttgtatttcatatacacaagtttatggtttaataagattttttacatgtttggtttcctctttttctctttcctcctattaactttgacaagttcactcgtcactattttgatcacttatcattccttatgcctggagaactggaagtggcaatggagaggattcataattggaggcgccggttgtgctttgtatgtgtttattcattctattttattcaccaaatttaagttgggtggattcacgactattgtcttatacgtgggatactcctcagtcatttcattactctgctgtttggtaacggggtcaattggctttatcagcagtatgctctttgttagaaaaatctactcatccattaaagttgactag

SEQ ID NO: 4451 - DNA, 2007 bp, Saccharomyces cerevisiae
atggaaacatgggaagtcatagcatcggtaaaagaagcaacaaaaggccttgacttgagcttagatcatccacttattattaaatccgaggacgtgcccagtaacattctccaattactgcaacagaagaatcgacgtcaattgaaacacatctgcatgaaatcaagaaaagagtattttctactagaggaatatgggccaggattttgggttaagtggccgtacaattatttcaatggttacagcttaccagaaaggcgtacggaagttgtaacgacagttgaaagagaaagagctaagcgtgaaacgttaaaaacatgggacgaattgaaatttaaagagcttcttcatttatggtcagaagaacccaagggctcgtgtaagcttgagaaggacaaagaccttaaactggatatgaatcccccagatatgaaaggcgaatcaaaaattaatgactactattcagaccctaaagagtacatagaaagtaagtattatgatgctcttttttccatacatacgcctctcgcatatttcgtcaagtcaaatttagtaaggctcaaaaatacctgccgaaccaagtacggaagtgacagttacaaaatagcctatcaagccatgctgcaaaaatttcttctctcaattgtacaattcaaagatagacatgataacaggcttttattagagcccttttctagtcccatagcagatgaaaaaaggaagaactgtctcacaaaatttgttatccaagatgaaaacaaaaacagctcaaccattgctgatttatgtgttgtattaaaatcccgcgaaataaagctacaaatattattgctattagagataataggattgaacgatttagattggaattttagagattttgagaaaaagtataaattaaaattgaagaaaagatcacttaatttgacaaaaaagggattagttcgtcgaagatcgaagaaaaaaaccagcgaaaaagacaaaggaatcgagagaataacaacatctttggattattgtgaacagttagacttgtacttagatagagcatgcatcttggacattctactatcaagtgaaacgcccaacccagatgccatagaagcatcaaatggaacaatacaagagcataaaaaaaatatcctagacaaaagcaaagaagcctcattggttgggttcataaattatgttcttattccatatttcaacaaaaaggtaccacacgccgttgaatttataattcaaaagctcaagggaccaagcatgagaccaaagagagccctgaaaaaggtcaacgatagcacaaatgtatcgtcacctaatactgtagaaacgtataacaggttatccacgagtcaacgtgcctctcgctcttcaatcattaattccgtcccatcttcacccgcattgagaagggtggacgctaatttgttcagcagaaaatctatagcttcgcccacccctgaacttttgaattctagaacgaactctaacttgaatgaatttctcgaaagtgaaactagaagcttaaagcgcccttcacaattgggaaggacgaagtctgatctaacgatgaatcatttacaaaaacggcagttttctgtctctgacttaagcacaacaagagtaccgaattcatcaactatcacactcaaaacgcctttctcgcactcaactattaatgcatacaaaactatgaataactcttttcgcagagttgggaaacgtaaagatatcaatgaaacgatacgcctacatgaacgtgtagactctgaggaaaacgtacaagttcaagccactcctgctgtgaaaaaaagaactgtgacacctaataaaaaggcgcaacttcaaagcatcattgaatcgccgctaaatttcaaggatgatgatacgcatgaaggcagaaaaaatacctccaatattacctctactcccactaataagcccccggaaaatagctcaaaaaggagagtaagaagacgtttatttgctccagaatccacatag

SEQ ID NO: 4452 - DNA, 2007 bp, Saccharomyces cerevisiae
atggaagacaagtttgctaacctcagtctccatgagaaaactggtaagtcatctatccaattaaacgagcaaacaggctcagataatggctctgctgtcaagagaacatcttcgacgtcctcgcactacaataacatcaacgctgaccttcatgctcgtgtaaaagcttttcaagaacaacgtgcattgaaaaggtctgccagcgtgggcagtaatcaaagcgagcaagacaaaggcagttcacaatcacctaaacatattcagcagattgttaataagccattgccgcctcttcccgtagcaggaagttctaaggtttcacaaagaatgagtagccaagtcgtgcaagcgtcctccaagagcactcttaagaacgttctggacaatcaagaaacacaaaacattaccgacgtaaatattaacatcgatacaaccaaaattaccgccacaacaattggtgtaaatactggcctacctgctactgacattacgccgtcagtttctaatactgcatcagcaacacataaggcgcaattgctgaatcctaacagaagggcaccaagaaggccgctttctacccagcaccctacaagaccaaatgttgccccgcataaggcccctgctataatcaacacaccaaaacaaagtttaagtgcccgtcgagggctcaaattaccaccaggaggaatgtcattaaaaatgcccactaaaacagctcaacagccgcagcagtttgccccaagcccttcaaacaaaaaacatatagaaaccttatcaaacagcaaagttgttgaagggaaaagatcgaatccgggttctttgataaatggtgtgcaaagcacatccacctcatcaagtaccgaaggcccacatgacactgtaggcactacacccagaactggaaacagcaacaactcttcaaattctggtagtagtggtggtggtggtcttttcgcaaatttctcgaaatacgtggatatcaaatccggctctttgaattttgcaggcaaactatcgctatcctctaaaggaatagatttcagcaatggttctagttcgagaattacattggacgaactagaatttttggatgaactgggtcatggtaactatggtaacgtctcaaaggtactgcataagcccacaaatgttattatggcgacgaaggaagtccgtttggagctagatgaggctaaatttagacaaattttaatggaactagaagttttgcataaatgcaattctccctatattgtggatttttatggtgcattctttattgagggcgccgtctacatgtgtatggaatacatggatggtggttccttggataaaatatacgacgaatcatctgaaatcggcggcattgatgaacctcagctagcgtttattgccaatgctgtcattcatggactaaaagaactcaaagagcagcataatatcatacacagagatgtcaaaccaacaaatattttatgttcagccaaccaaggcaccgtaaagctgtgcgatttcggtgtttctggtaatttggtggcatctttagcgaagactaatattggttgtcagtcatacatggcacctgaacgaatcaaatcgttgaatccagatagagccacctataccgtacagtcagacatctggtctttaggtttaagcattctggaaatggcactaggtagatatccgtatccaccagaaacatacgacaacattttctctcaattgagcgctattgttgatgggccgccaccgagattaccttcagataaattcagttctgacgcacaagattttgtttctttatgtctacaaaagattccggaaagaagacctacatacgcagctttaacagagcatccttggttagtaaaatacagaaaccaggatgtccacatgagtgagtatatcactgaacgattagaaaggcgcaacaaaatcttacgggaacgtggtgagaatggtttatctaaaaatgtaccggcattacatatgggtggtttatag

SEQ ID NO: 4453 - DNA, 2007 bp, Saccharomyces cerevisiae
atggagaccagttcttttgagaatgctcctcctgcagccatcaatgatgctcaggataataatataaatacggagactaatgaccaggaaacaaatcagcaatctatcgaaactagagatgcaattgacaaagaaaacggtgtgcaaacggaaactggtgagaactctgcaaaaaatgccgaacaaaacgtttcttctacaaatttgaataatgcccccaccaatggtgctttggacgatgatgttatcccaaatgctattgttattaaaaacattccgtttgctattaaaaaagagcaattgttagacattattgaagaaatggatcttccccttccttatgccttcaattaccactttgataacggtattttcagaggactagcctttgcgaatttcaccactcctgaagaaactactcaagtgataacttctttgaatggaaaggaaatcagcgggaggaaattgaaagtggaatataaaaaaatgcttccccaagctgaaagagaaagaatcgagagggagaagagagagaaaagaggacaattagaagaacaacacagatcgtcatctaatctttctttggattctttatctaaaatgagtggaagcggaaacaataatacttctaacaatcaattattctcgactctaatgaacggcattaatgctaatagcatgatgaacagtccaatgaataataccattaacaataacagttctaataacaacaatagtggtaacatcattctgaaccaaccttcactttctgcccaacatacttcttcatcgttgtaccaaacaaacgttaataatcaagcccagatgtccactgagagattttatgcgcctttaccatcaacttccactttgcctctcccaccccaacaactggacttcaatgaccctgacactttggaaatttattcccaattattgttatttaaggatagagaaaagtattattacgagttggcttatcccatgggtatatccgcttcccacaagagaattatcaatgttttgtgctcgtacttagggctagtagaagtatatgatccaagatttattattatcagaagaaagattctggatcatgctaatttacaatctcatttgcaacaacaaggtcaaatgacatctgctcatcctttgcagccaaactccactggcggctccatgaataggtcacaatcttatacaagtttgttacaggcccatgcagcagctgcagcgaatagtattagcaatcaggccgttaacaattcttccaacagcaatactattaacagtaataacggtaacggtaacaatgtcatcattaataacaatagcgccagctcaacaccaaaaatttcttcacagggacaattctccatgcaaccaacactaacctcacctaaaatgaacatacaccatagttctcaatacaattccgcagaccaaccgcaacaacctcaaccacaaacacagcaaaatgttcagtcagctgcgcaacaacaacaatcttttttaagacaacaagctactttaacaccatcctcaagaattccatccggttattctgccaaccattatcaaatcaattccgttaatcccttactgagaaattctcaaatttcacctccaaattcacaaatcccaatcaacagccaaaccctatcccaagcgcaaccaccagcacagtcccaaactcaacaacgggtaccagtggcataccaaaatgcttcattgtcttcccagcagttgtacaaccttaacggcccatcttcagcaaactcacagtcccaactgcttccacagcacacaaatggctcagtacattctaatttctcatatcagtcttatcacgatgagtccatgttgtccgcacacaatttgaatagtgccgacttgatctataaatctttgagtcactctggactagatgatggcttggaacagggcttgaatcgttctttaagcggactggatttacaaaaccaaaacaagaagaatctatggtaa

SEQ ID NO: 4454 - DNA, 2007 bp, Saccharomyces cerevisiae
atggagcaaaacgctgaaaaacgctctattgttggcgacgacaactcaaccgtgaagagacaagacacttccccgtccaaaggtattgcacatatcaaaccagaatatattgtaccattgaagcagaatgaaaaccagaaggtcgccatctatgatgaagagatgtcttccgacagaatgacaaacgagtttgcaggtgggactaataagaaaaataagaacggaagaggtaagaagcgtgggcaaaacaagaatagagataacaggcaggtcaaggaacagaatgtcttgtgcccacgcttgatccatggcgatatatctaaatgctcctttggtgataactgtaggtttgttcacgatatcaatctgtacctttcaacaaaaaagcctgaagttgaaagtaatatatttccttcctgtccggtcttcaactcgttgggattttgccccatgggattcaaatgcagatttttatcgtctcatctgaataaagaagataatatcctaatatcgaagaaggagattgatccagatgcgcaaacaatatggtccgttaaaggtgaggtaaaccatatctcaccggaaagaaaactcgatcttataaaaagaagatttcctttcacaaaaagtaatgaaatattggaaatcatcgactctttccaacaagaatgtagagattccatgaagccagaagaagaagttgagtcaacgccacagctgaagaaacaagacccagatgtggaacaaccagttgccccccaagtcgaacagaggaacaaagaattgtcagaacatagaatgaaacagcgtgaagtatacttgaagtacaaggacactcgttattttgctcaagaaaaaaagccactggatttgtaccacaaaaaaatcgtgtcgccattgacaaccgtaggcaatttaccataccgtcgtctaatgagaaagttaggtgcagatgtgacatattcggaaatggccttggcagttcccttaattcaaggaactaattctgagtgggcgttacctaaagctcacacatcagagttccccgggttcggggttcaagtggcctgttctaaagcctggcaggcggcaaaggctgcagaagcactcgcaaactccgtcagtgaaataagtgaaatcaacttaaactctggctgccccatcgatttgctatacagacaaggttctggtagcgccctgctggataaccctgcaagaatgattcgttgtttaaacgcgatgaactacgtatcgaaagatattcctatcacggtgaagatcagaacaggtacaaaggaaggtcatcctatcgcggaagggttagtcaaaagactggttaacgaaactgatgtggctgcgattaccttacacggtaggtctaggcaacaaaggtacactaagtctgcggattgggactacgtgagtcaagtggctgacaccttgagatccgccgaagcggatttcatcgaaaccgaacaaggcaaagaaggcagggattccaagaacagaattcaatttgtcggaaatggtgatgtcaacaattttgaagactggtaccgctatttgaacggaaatgaaaatattgatagtgttatggttgctcgaggggccctgatcaaaccatggatttttgaagaggttgagtcgcagcagtatctagacaagacaagtacggaaagattagacattttaagggattatgcgcagttctctatggaacactggggcaccgacgaatacggcatttctcaatgtcgtagattcttctgcgagttcatgtccttttttcataggtatgtccccatgggtatttgtgaaagataccctgtgaagttgaatgagagaccgccaaactggtgtggaagagacgaacttgaaactctaatgggtagtacggatgttaatgattggatcaagctaagtgatctatttttcggtaaaaccgacgagaactttgtatttgtccccaaacataagagcagctcttatgcaaacagagattcctaa

SEQ ID NO: 4455 - DNA, 2007 bp, Saccharomyces cerevisiae
atggagcggcctggcttggtattgcaggaccttccacccgaaatcctgataaacatcttttctcacttagacgaaaaggacttgttcacgttgcaagaactttctacgcatttccggaacttaattcacgatgaagaactttggaagaacctgtttaagtctagagttcacacgactcatttccccacattttctcagtcttcgaaatttagtgtagagtatattgaaaggacacggggtcttcatcattggcagcataacaaggctataagaaccaaatacacaataattccgacgagaaactgggatcagcccagtatagaacgcatagtgtttgattatccacgagttgcagcttataatgatggtaccattacaattttacagttacaaaatcacaaaaggcagaagaaatttaagaaattgatttatattccatgtacaacaccacaaggttgttctaccatggacttcaatattaatgctgcagtgtttggtaggtttgacggcagagtgtttggaaaactgctaagtaacaaatcgtacttaacgcccgtgatggaatttacgggaaggcatagtgcaggcgttactgccatttgtaattcagaatcctgggacacgtcaagagaggactggtctgttagtggctctgaaaacggtgaaattatatggtggtgcgaaaataagcttgttaagatgtggaaggtttctaatagggtaatttggaaactggctttttttaaagattggaccttaattatggatgatgaaaagctgtacattatccatcaaatgcaggaattgcacagtattgatattcctaaggatctggacgaacagcctatgagggtacggtttttcaagatggatttcggttccatgactttggtacttgctgacctgaataacgtttatacaatatcggtcaatcccaatggtaacttcggcaatttgagaaagttggagatgcctgaacaaatatgcgcagttgaaatagatgaaaaaacttctcaaagggaacaaaactggcaatttgctggtgatgacggctgctatatcagtcttttgacgacacagaacactttatacattatcaatataagagatctttcttcgtcaggcttaaaagttcaatgtaagataagttttgatgagcaggtatacgtatcgcaggtgacaaatttaatagttgtggtagcattgccaaatgttcttcaaatattgaacgcgatgacaggcgagttaataaagacagtgttgaaaaccgagaagtttcccgaatttttgaaggtatcgcaggataaaatcattatgggaagcggtaacgttttgaattatttaaagtttgtttcaagtgattcaaagaaacatcaccattccactaaaggtaaaaacacagtaagcaataagtggaatgaaactttgaacacggagctgcaatattatgatgaagatgaagaccttagaagaaaaagacagtcagaaatatcaagattgatcgatgcgtatggtggagaccttgaactttcaggcgacaccgatgaagaaaacgacattcagttgagaattgcactcttagaatcacaggaggcgcaagcacggaatcaagctgaagcgggggagcctgtcggagatgatgaagatgagcagttaagaagggcgctggaggaatctcaactgatatatgagacgcaaacgaatagctctgcgaatcatggtaataatacgaatgatgagatagatgaagatgatgaagagtttctcagagccatcagacaatcaagagtggaggacgaaaggagaagacatcttagaaatcatactacaggtcgacgaaatgggcccttgagcgacgataattttgctacatatggtgcagcagagtcatccgaacgaacctcaactgagaacactatcggtagttctgttggcgttgatgctagtaataatgttgatgaagacttacaattggccattgcgttgtcattgagtgaaatcaattga

SEQ ID NO: 4456 - DNA, 2007 bp, Saccharomyces cerevisiae
atgtcagatccatttgcacatttactgacttctttgaagaataaggactctgcatctgcatccaaggaaacaactcctcagagcagcaattcgccttccattactggttccgctgttgcagatgttgcaaggacggataaaagccccaatgatagtctgcattcaatttcagctcctccgctgataccgtcaccgaaggtagatttttctgcacctcctttggtcccaactaatagcaccactaaatctaatactgccaacaacacacctccctcggctcttgccaataccgatgacgacttcaatcaactatttggtatgggcacagtaactacaacggatacgatccaaaaaccggatgaggattactatggaagcaaggaagaccacctttacaatggtgatgacgccttagttgatgaagttaaggatatggaaatagcaagattgatgtctctaggtttatcaattgaagaagccactgagttttacgaaaatgacgtaacttatgaaagatatttggagattttaaagtcaaagcaaaaggagcgcaacgatctagctataagaaagaaagaaagtggtataaaaatggaaaagtcaggattatccaacattgttggtacagatagcaataatttattcagcatggccactgattttttcaataagggtaagaaactggtagaccaatggacctccttcccacctgaggcaaatgatagactgaataattactcaaaaactcatgataaggttgaggattatgatttgcctcaagtaaacgactcacccaatagaattttgtttgaagataatgaagtcgtagagaacttaccacctgccgataatccggatcaagatcttttaactgatttcgaaacaaagattgatataacaaagaggacagcgcctgatgtctcccactcctcctcaccgacttctggtatactaattgaagaaaattcgcgaagaaatgagcccctgatagaggatagtcttctcgacttttcagaaggaaatctcaccaatagtaaaagcaatgaagatagcaccctcttcaatgaaaacagcaacactgactctacaatacccatctcagatattgaattatcggggtataacgaatttaaggcgaaaggtactagtttgttcaagaacggggattatattaactcattacaagaatatgaaaagtctttaaatacattgcctttaaatcatccattgaggatcattgcattatcaaacattattgcctcgcaactgaaaatcggtgagtactctaagtccatagaaaactccagcatggctttggaattattcccatcaagcaaagctaagtggaagaataaaatctcaaatagtgaccctgaaagatcatttaacgacatctggccaaagattatgattaggcgtgctgagtcttttgaacatttagaaagtttcaaaaaagcactagaaacataccaagagctgattaagaagaatttttttgatgataaaatcatgcagggaaaaagaagatgccaagactttattaatcctccccctgttaaaaaatccatgcccgttaagaagaagacaacgacaacctcgcctgcaacaaaaaaacagaacttaaccgcttcttcttcaaattctccaatttctgttgatagcacttcagaaataaaaaaacgggagctagaaaacgctaaactggcgctatatgataaagtatttgagaaaattagctcctggaaggatggcaaagacgatgacattcgtcatctgttagcaaatttatccagcttactaacatggtgcaattggaaggatgtctctatgcaagatttggttatgcctaagagggtcaaaattacatacatgaaagctgtagccaagacacatcctgataagataccagagtccttgtccctggaaaataagatgattgcagagaatattttcagtactttaagtattgcttgggataagttcaaactgcagaatgacattaactga

SEQ ID NO: 4457 - DNA, 2010 bp, Saccharomyces cerevisiae
atgagctacagttatgaagcttgtttttgggacccaaacgacaatggtgtgaacatccttctgggtcacatttctcagggaataagatcttgcgactcaatgatacttttctttaagcagcgtagtgagcttgagaaggactatgccaggcggcttggagccatcacgggaaaactagacaaagacattggaacaaacatggattatggaaagttgaatgaaacatttaatgtggtgctcagtgttgagaaagctcgagcacaatcgcattccaagcaaagtgagattcttttcagacagatttacacggatactaaggcatttgccgctaacttgcaagcaagatatactacattgagtggaaagattgaaaggttgcggatggacaagttcaacaagaaaaaggggtgtgaggtgttgcaaaagaaattacaggatgcccagattagattcagagacttgcaattgaacgagaataatatgattggggccaagagagtagaacacaacaagagagaactattgaaatgggaatcgaactctcaggaatataaggttcaactagacgttcttaagcaagaatataaggcatcgcagaaattctggatacacgagtgggcgcaattatcctgcgaactgcaagaaatggagaacgctagaatatcctttttacaatcgaaattacaacagttcgcaacctcatcgatggaaacatatattttagagcaaacaaaaatggacatgttaacaaatcatctgaactcattcacggcagcggatgaaatatcgacgttttcaaaagaaaatggaactggtagactgaaacataagacttccaaaggtgacatgaattctagcgccaactgggctcaaatgagcagtatctccacgacaagtaaaaaaaccgaatcgtatatggacaatataaggaaactatcttctcagctgaaggaaaccgaaaataaaaggaaactagcttcaatagacaaatatgagaaaccattgccatctccagaagtcaccatggctacacaatttagaaattccacacccgtcatacgtaatgagacaaaagtggttgctaacccaacattatctttgaggtcttcacccgtccagttacagagcaatgtggatgactccgtgttaaggcagaaacctgataaaccaaggccgattgttggggaagaacaacttaaacctgatgaagattcgaaaaatcctgatgaaaaaggtctaatggtgcataaaagaaatcaatctctcagctcaccatcagaatcaagttcttctaatccaacggattttagccacatcaaaaagagacaaagtatggaatctatgactacatccgtaagttcaatggccaatagtatagacgactcacagagatttgccaaatcatggaactcgtcaaataggaaaagaaaatctatgagccatttgcaagtaccctcatccgcttcttcgaggtcggatgatgggggaagaacgcctaactctgcgcacaacctcaatgaagatgattataacacgaggagagataccagtacaagcacaattttgttcaaacctcctgtggcagtaagaggaacgtctagggggcacacgcatagacaatccatgataatgcaagattcaagtaatccaattgaagatgccttgtacgaaatggaaagaatccaaagtagttctaaaccaggtacaaaaacaggaaacatcatggatgagagaggtgtggtcagggatagaggtattactgttaccttgcctattgtcaccagtgaaggttttccagtcattgaatatgccaaggccatgtatccattgattggaaatgaggcacctggattagcgaatttccataagggcgactatctgctaattactgagattgttaataaagattggtataaaggtgaagtttatgataatgaccgtatagatagaaatcataggataggattaattccctataatttcattcagctactgcatcaaggtctttga

SEQ ID NO: 4458 - DNA, 2010 bp, Saccharomyces cerevisiae
atgagtaatcctcaaaaagctctaaacgactttctgtccagtgaatctgttcatacacatgatagttctaggaaacaatctaataagcagtcatccgacgaaggacgctcttcatcacaaccttcacatcatcactctggtggtactaacaacaataataacaataataataataataataacagtaacaacaacaacaacggcaacgatgggggaaatgatgacgactatgattatgaaatgcaagattatagaccttctccgcaaagtgcgcggcctactcccacgtatgttccacaatattctgtagaaagtgggactgctttcccgattcaagaggttattcctagcgcatacattaacacacaagatataaaccataaagataacggtccgccgagtgcaagcagtaatagagcattcaggcctagagggcagaccacagtgtcggccaacgtgcttaacattgaagatttttacaaaaatgcagacgatgcgcataccatcccggagtcacatttatcgagaaggagaagtaggtcgagggctacgagtaatgctgggcacagtgccaatacaggcgccacgaatggcaggactactggtgcccaaactaatatggaaagcaatgaatcaccacgtaacgtccccattatggtgaagccaaagacattataccagaaccctcaaacacctacagtcttgccctccacataccatccaattaataaatggtcttccgtcaaaaacacttatttgaaggaatttttagccgagtttatgggaacaatggttatgattattttcggtagtgctgttgtttgtcaggtcaatgttgctgggaaaatacagcaggacaatttcaacgtggctttggataaccttaacgttaccgggtcttctgcagaaacgatagacgctatgaagagtttaacatccttggtttcatccgttgcgggcggtacctttgatgatgtggcattgggctgggctgctgccgtggtgatgggctatttctgcgctggtggtagtgccatctcaggtgctcatttgaatccgtctattacattagccaatttggtgtatagaggttttcccctgaagaaagttccttattactttgctggacaattgatcggtgccttcacaggcgctttgatcttgtttatttggtacaaaagggtgttacaagaggcatatagcgattggtggatgaatgaaagtgttgcgggaatgttttgcgtttttccaaagccttatctaagttcaggacggcaatttttttccgaatttttatgtggagctatgttacaagcaggaacatttgcgctgaccgatccttatacgtgtttgtcctctgatgttttcccattgatgatgtttattttgattttcattatcaatgcttccatggcttatcagacaggtacagcaatgaatttggctcgtgatctgggcccacgtcttgcactatatgcagttggatttgatcataaaatgctttgggtgcatcatcatcatttcttttgggttcccatggtaggcccatttattggtgcgttaatgggggggttggtttacgatgtctgtatttatcagggtcatgaatctccagtcaactggtctttaccagtttataaggaaatgattatgagagcctggtttagaaggcctggttggaagaagagaaatagagcaagaagaacatcggacctgagtgacttctcatacaataacgatgatgatgaggaatttggagaaagaatggctcttcaaaagacaaagaccaagtcatctatttcagacaacgaaaatgaagcaggagaaaagaaagtgcaatttaaatctgttcagcgcggcaaaagaacgtttggtggtataccaacaattcttgaagaagaagattccattgaaactgcttcgctaggtgcgacgacgactgattctattgggttatccgacacatcatcagaagattcgcattatggtaatgctaagaaggtaacatga

SEQ ID NO: 4459 - DNA, 2010 bp, Saccharomyces cerevisiae
atgctgcgtgtaacaaccttggcgtcttcgtgtacttcatttcccttacaggtcctcaggaggcggttgaccatatcttctttgacaagcttccaacccacaaccaagacacaggtcgtggtcatcggtgctggacatgcaggctgcgaagctgcagctgcgtcatctaggactggtgcgcatactactctcattacaccatcgttaacagatattggtaagtgttcgtgcaacccctctattggtggagtgggtaagggcatccttgtaaaggaaatcgacgctctcgatgggctgatgggcaaagtaactgatctcgctggagtgcaattcaaaatgctgaacagaagcaagggtcctgctgtgtgggggcccagagcccagatagacagagagttatataagaaatacatgcaaagggaactttccgacaagaaagcacaccccaacttgtctctgctgcagaacaaagttgctgacttgatcttgtatgaccccggatgtggccacaaggtcatcaaaggtgtggttctggatgacggtacccaggttggggcagatcaggtcataatcactacaggtacgtttctcagtgcagaaattcacatcggcgacaagcgtattgcagcaggaagaattggcgagcagccaacatatgggatcagcaatactctacaaaatgaggtgggctttcagttagggcgtttgaaaacaggcactccggctaggctggccaaggaatccattgatttcagcgctctggaggtccagaagggagatgcgttgcctgtccctatgagttttctgaatgaaaccgtgtcagtcgaacccacgaagcaactggattgctttggcacacataccacacctcaaatgcacgactttttgcgcaataacttgcatcaatccattcatattcaggacacgaccatcaaaggcccccgctattgtccctccatcgaagctaagattctaaggtttcctgatagatcttcccataagatatggttggaaccagaaggtttcaactccgacgtcatttatccgaacgggatatccaattctatgcctgaggatgtccagttacaaatgatgaggctcatcccgggcatggcaaacgttgagatcttgcagccggcatacggcgtggaatacgactacgtagacccacggcaattaaagcctagcttggaaacaaaattggtggatggactattcttggccggacaaataaatggtactacaggctacgaggaagccgctgcacaggggatcattgcaggtatcaatgcaggattactatcgcgccaagaacgggagcaattggtcttgaaaaggtccgaagcgtacattggtgtgctcattgacgatctaatcaataatggcgtcatagaaccatatagaatgtttacttccagatcagaattcagaatcagcgtaagagccgataacgcagacttcagactgacgcccattggtgctcaactagggattatatctcctgtccgtttaagtcaatattcaagagacaagcacctatatgatgaaacaatacgggcgcttcaaaatttcaagctaagctctcaaaaatggtctagcttactacaggctaatatcgcgccacaggctgaaaacagatctgcttgggaaatattcagattcaaagatatggatctacataaactctacgagtgcattcccgatttacccattaatttgctggacatcccaatgcatgttgtcaccaaaattaacattcaaggtaaatacgaaccttacattgtcaaacagaaccagtttgtgaaggcatttcaggcagacgaaaatatgctgttgccgcaagattacgattaccgtcagttacccacgctttccactgaatgcaaactactcttgaaccgcgtacagccattgaccataggccaagcaagacggattcaaggtatcactgcggcagccctatttgaactctaccgtgtggcacggaagccaagccaaccagtcatgtaa

SEQ ID NO: 4460 - DNA, 2010 bp, Saccharomyces cerevisiae
atgcttagaaccagactatccgtttccgttgctgctagatcgcaactaaccagatccttgacagcatcaaggacagcaccattaagaagatggcctattcagcaatcgcgtttatattcttctaacactagatcgcataaagctaccacaacaagagaaaatactttccaaaagccatacagcgacgaggaggtcactaaaacacccgtcggttctcgcgccagaaagatcttcgaagctcctcacccacatgccactcgtttgactgtagaaggtgccatagaatgtcccttggagagctttcaacttttaaactctcctttatttaacaagggttctgcatttacacaagaagaaagggaagcgtttaatttagaagcattgctaccaccacaagtgaacactttggacgaacaactggaaagaagctacaagcagttatgctatttgaagacgcccttggccaaaaacgacttcatgacgtctttgagagtacagaacaaagtcctatattttgcattaataaggagacatatcaaggaattagttcctatcatttacaccccaaccgaaggtgatgctattgctgcctattcccacaggttcagaaagccagaaggtgtgtttttagacattaccgaacctgattccatcgaatgtagattggctacatacggtggagacaaagatgtagactacatcgttgtgtcggattcggaaggtattctgggaattggtgaccaaggtatcggtggtgtacgtattgctatctccaaattggcattgatgacgctgtgcggtggtattcatcccggccgtgtgctacctgtgtgtttggacgtcggtactaacaacaagaaactagcccgtgacgaattgtacatgggtaacaagttctccagaatcaggggtaagcaatatgacgacttcttggaaaaattcatcaaggccgttaagaaagtgtatccaagcgccgttctgcatttcgaagatttcggtgttaagaacgctagaagattactagaaaagtacaggtacgaattgccatcattcaacgatgacattcagggcaccggtgccgtcgtgatggcctcgttgattgctgctttgaaacataccaacagagacttgaaagacaccagagtgcttatttacggtgccgggtctgcgggcctcggtatcgcagatcaaattgtgaatcatatggtcacgcacggcgttgacaaggaagaagcgcgcaagaaaatcttcttgatggacagacgtgggttaattctacaatcttacgaggctaactccactcccgcccaacacgtatacgctaagagtgatgcggaatgggctggtatcaacacccgctctttacatgatgtggtggagaacgtcaaaccaacgtgtttggttggctgctccacacaagcaggcgcattcactcaagatgtcgtagaagaaatgcacaagcacaatcctagaccgatcattttcccattatccaaccctactagactacacgaagccgttcctgccgatttaatgaagtggaccaacaacaacgctcttgtagctaccggatctcctttcccacctgttgatggttaccgtatctcggagaacaacaattgttactctttcccaggtatcggtttaggtgccgtactatcgcgtgccaccaccatcacagacaagatgatctccgctgcagtggaccaactagccgaattgtcgccactaagagagggcgactcgagacctgggttgctacccggcctggacaccatcaccaacacttctgcgcgtctagctaccgctgtgatcttgcaagcactcgaggagggaaccgcccgtatcgagcaagaacaagtaccgggaggagctcccggcgaaactgtcaaggttcctcgtgactttgacgaatgtttacagtgggtcaaagcccaaatgtgggagcctgtgtacagacctatgatcaaggtccaacatgacccatcggtgcacaccaaccaattgtag

SEQ ID NO: 4461 - DNA, 2010 bp, Saccharomyces cerevisiae
atgtctcccatacaggttgttgtctttgccttgtcaaggattttcctgctattattcagacttatcaagctaattataacccctatccagaaatcactgggttatctatttggtaattattttgatgaattagaccgtaaatatagatacaaggaggattggtatattattccttactttttgaaaagcgtgttttgttatatcattgatgtgagaagacataggtttcaaaactggtacttatttattaaacaggtccaacaaaatggtgaccatttagcgattagttacacccgtcccatggccgaaaagggagaatttcaactcgaaacctttacgtatattgaaacttataacatagtgttgagattgtctcatattttgcattttgattataacgttcaggccggtgactacgtggcaatcgattgtactaataaacctcttttcgtatttttatggctttctttgtggaacattggggctattccagcttttttaaactataatactaaaggcactccgctggttcactccctaaagatttccaatattacgcaggtatttattgaccctgatgccagtaatccgatcagagaatcggaagaagaaatcaaaaacgcacttcctgatgttaaattaaactatcttgaagaacaagacttaatgcatgaacttttaaattcgcaatcaccggaattcttacaacaagacaacgttaggacaccactaggcttgaccgattttaaaccctctatgttaatttatacatctggaaccactggtttgcctaaatccgctattatgtcttggagaaaatcctccgtaggttgtcaagtttttggtcatgttttacatatgactaatgaaagcactgtgttcacagccatgccattgttccattcaactgctgccttattaggtgcgtgcgccattctatctcacggtggttgccttgcgttatcgcataaattttctgccagtacattttggaagcaagtttatttaacaggagccacgcacatccaatatgtcggagaagtctgtagatacctgttacatacgccaatttctaagtatgaaaagatgcataaggtgaaggttgcttatggtaacgggctgagacctgacatctggcaggacttcaggaagaggttcaacatagaagttattggtgaattctatgccgcaactgaagctccttttgctacaactaccttccagaaaggtgactttggaattggcgcatgtaggaactatggtactataattcaatggtttttgtcattccaacaaacattggtaaggatggacccaaatgacgattccgttatatatagaaattccaagggtttctgcgaagtggcccctgttggcgaaccaggagaaatgttaatgagaatctttttccctaaaaaaccagaaacatcttttcaaggttatcttggtaatgccaaggaaacaaagtccaaagttgtgagggatgtcttcagacgtggcgatgcttggtatagatgtggagatttattaaaagcggacgaatatggattatggtatttccttgatagaatgggtgatactttcagatggaaatctgaaaatgtttccactactgaagtagaagatcagttgacggccagtaacaaagaacaatatgcacaagttctagttgttggtattaaagtacctaaatatgaaggtagagctggttttgcagttattaaactaactgacaactctcttgacatcactgcaaagaccaaattattaaatgattccttgagccggttaaatctaccgtcttatgctatgcccctatttgttaaatttgttgatgaaattaaaatgacagataatcataaaattttgaagaaggtttatagagagcaaaaattaccaaagggtttggatggaaatgacactattttttggctcaagaattacaagcgctatgaagtcttgaccgctgctgattgggaagccatcgatgcacaaacaattaaattatga

SEQ ID NO: 4462 - DNA, 2013 bp, Saccharomyces cerevisiae
atgaggatctgtcattcgagaactctctcaaacttaaaggatcttccgataacgtcaaggagagcaatgcattcggccattgtcaattactccacccaaaaggcccaatttcccgtagagacaaataatggggaacactattgggcggaaaagccgaacaaattctaccagaacaaaaggcccaattttcaaggcattacctttgctaaacaacaagacttaccatcattacccgtgcccgaattgaagtctacacttgacaagtatttgcaaaccatccgcccattttgcaatgatgtagaaacttttgaaagacagcagctgttatgtaaggacttctcggagcacatggggcctatcttacaagaccgattgaaagagtatgccaacgataaaagaaactggatggccaagttttgggatgaacaatcctatttacaatacaacgatcctattgttccatacgtctcttatttttattctcatatgccattaccgaatcatttatcgaagatcgataatgatcctttgattaaggctactgcgattatctcaaccgtggttaaattcatcgaagctattaaagatgaatctttacccgtagaaattatcaaaggtatgccattttgtatgaatagtttttcattgatgtttaacacttcgagattgcctggtaagccagaggataaccaagatacaaatattttttattcagtttatgagaacaactttgtaactatcgcttataaagggaagttttacaaactgatgacccatgacgggaatgacaaaccgctttccgaaaacgaaatctggaggcaactgtactctgtggtattccaaggatcgcagtccgatcccaaactaggtggcattggttctctcacctctttacctcgtgatcaatggcgtgaagtacatctggagcttatgaaggatcctatttctcaggattcactagaaacaatccataagtcttcctttatgctatgtttggatcttgaccaatcccctgtcactttggaagaaaagtcaagaaattgctggcacggtgatggtattaacagattctacgataagtctttacagttcctggtcaccggtaatggttcatcaggtttcttagctgaacactcgaagatggatggtacgccaacattgtttttaaataactacgtttgtcagcagttgaataaactagatgtggatgacttcatgagaaaagtaattacgccatcatctacggtggcaatgaaacctatggaactgcccttcattatcacaccgaagattcataaagcaatcgaatctgcccaactacaatttaaggaaacaattggtgagcatgacctacgtgtttggcactacaacaaatacggaaaaacgtttataaaacgccatggcatgtcacctgatgcatttattcaacaagttatccaactggcggttttcaaatatctgaaacgacaactaccaacttacgaggctgcttccacgagaaaatacttcaaaggccgtactgaaactggtagatctgtgtccaccgcctccttagaatttgtttctaaatggcaaaatggcgatgttcctattgcagaaaagattcaggctttgaaacattctgcaaaagagcattctacgtacctgaaaaatgctgcaaatggtaatggtgtcgatcgtcatttcttcggtctaaagaatatgctaaaatctaatgatgaccaaattccgccccttttcaaagatcccttatttaattattcttcaacttggttgatctccacatctcaactatcttcggaatattttgacggttatggttggtctcaagtaaatgacaacgggtttggactggcatacatgttgaataacgagtggctgcatatcaatattgtcaacaaaccagccaagagtggagccagtgttaacagattacactattatttatctcaagctgctgatgaaatttttgacgccttggaaaatgagaataaacgaaaagcaaagttatga

SEQ ID NO: 4463 - DNA, 2013 bp, Saccharomyces cerevisiae
atggtagaaccggacatgcagaagaaggcaagtggtggcagtggcggttccgagatggatactttaaatgctaccagcaacagtagtaaacaaggagtttcaaataataaaaggaatccggtcagtaaaaagaaaccagggaataaggtctctgatggaagagataatgcacataattatcacggggaaggccgcagaaaaagtagcaaacaacagaggtcaagaacgccctataaggagactagtactaggatcaatgatcaagatatagatttatctatccaggaagaaattcttggtggtaatttcaaattacgaggcaggaaaactcaagtttccattaatcatttgttgaatttccagttacctgaagtcgaaagggaaaaaagtaggtcctcttcaagtaagaaatcgaataggagacgcgatgagcacgtacatttacacggtgacacatttgttaatgttaattaccgtcttttggtagatgatcgttttgactacccagagcaaaactgtaacccgaacgttcctgtcgatcaagaaaagattctaagagtcatagtgccaaagggtcagaattgttctatttgtctgagcgaggaaccggtggctcccagaatggttacttgtggccatattttctgtctaagttgtctcttgaactttttctccattgaagaaaccgtcaaaaataaagagactgggtactcaaagaagaagaaatataaagaatgcccgctttgtggaagtattattggccctaaaagggtcaagcctgttctgtatgaggacgactttgatgtaaccaggttaaatcaaaaacccgaacctggtgccacagtacatctacaactgatgtgtaaaccacacggttcactattacctttgccagtagccttacatttagaccctctaaaatgtggaaatttccctcccgcaaacttaggatcaataaagcattatgcgcatattatgaagtgtggcgtgtcttactccttggagctctatcaaaaggacattgttgctattcaggaacaatatgaaatcgacaaggccatttataatgatagtggaaaatttgttaagcagtcgattgaaaatatcaatgatcaaatttcgacgttgctggctgcaaccactgatttgagcccactttccaacgatattaacaacggtttggacaattttcattttgatgacgatctcttgaccaaatacgatgattcttccgcttattttttctaccagacgttggtggcatcgtccacgaaatacttcttatctccactggatgtaaaaatcttattgactattttccactattattccaagtttccagaaagcatcgagacgacagtcgaaaatatacattatgatacagtggtaacggagcaattaatccgccgctacaagtacatcggccaccttccaatcggcactgagattgcccttttagacttggactggcgtaaaataccattccttcccaaggaaatttacgaacagtttgctcatgagctaaaacaacgtcgaagaaaattcacaatgaaaaagcaaaaggaagataaggaaaagaaactatatgaaaaaaggttggaacaagaacatgccgagttctacagaaaggaaaatggcaattctctcaagtttgaagactctgtacagatggctacccattatgaatccattgtaagctcttccatacctctcaactccttaggaatttctatgctgggtccaccgacaaattcctgctctactcctcaaaagcaagcgccctcccacacgaaaagaacaatttgggggacatcaattgcagtgacggaagacgaaaaagcatcaaaggagaacaaagaatttcaagatatgttattgcagcgaataaggcaggaagatagttcggatgtcacagattcgacggattctcctcctacaagtaatggtaagcgaggcaggaagaagaaaggtaaagtcatgctattcagcagcaatcatcaagccttgggttag

SEQ ID NO: 4464 - DNA, 2013 bp, Saccharomyces cerevisiae
atgtccatttcaaccagtttgaactcagcttccattcatttgagcagcatggacacccatcctcagctacactcactcactcgtcagccacactcgtcgtcaacagctatgtccaagaacgaagcccaggaatcttcgccctctctgccagcttcctcttcatcgtcgacttcggcatcggcatctgcgtcttccaagaattcgagcaagaacccttcctcttgggaccctcaagatgatctgctgctacgtcatttaaaggaggtcaagaaaatgggctggaaggatatttcgcaatacttcccaaacaggactcctaacgcgtgtcagttcagatggagaaggttgaagtctggtaacttgaagtcgaacaagactgctttgatcgacatcaacacctatacgggcccactcaagatcacccacggcgatgagactgccaacgctcagcaaaagcccagcaagaaggtagaagaaaacgtattaacggaagatactgctgagttcactacaacgtcatccatcccgattccctccagaaagacctcgttgccttcgtttcacgcatcgatgtcattttctcaatctccgtccaatgtgactcccactacgattgtctcaaacgctgcttcttccatgccgttcgctcctcccacgctgccggccgcactccctcatcatcctcatcaacacctacaccaccatccccatcataagactctaaagccaaggtcaaactctcactccttcaccaattctttgaaccaagaccccatcgttcggtctaatgatgaggagaagtatggattcattcctaaagtattcgttagatccagaagaagttcgtttgcctatccacaacaggtagcaataaccactactccgtcttctccaaactcttcgcatgtcttactaagctcaaagtcaagaaggggctcgcttgcgaattggtccagaagatcatcgtttaatgtttcaagtaacaacacttcaagacggtcttcaatgattcttgcaccaaattccgtgtcaaacatattcaatgtcaacaatagcggcagtaacactgcttctacttctaataccaactcaagaagggaatctgtcatcaagaaggaatttcagcaaagattaaacaacttaagtaacagtggaggtcctacctccaacaacgggcccattttccccaactcttatacctttatggatctcccacattcttcatcggtgtcatcgtcatccactttgcataagtctaaacgaggttcgttttctggccattctatgaagtcatcgtgtaatccgactaatctatggtcaaaagatgaagacgctttgctaatggaaaacaaaaagagaaacctatccgttatggaactatccattcttttgccgcagagaactgaggtggaaattcaatggagattaaacgccttgtcaagtgatgcggatatgttgtctcctacacattcacctcaaaaaactctgtccaagaaaacttgtccaagaatgttcaaaagtggttctaccactgatgatgacaaaggtagcgacaaagaggacgttatgggtgatggtagtaacgatgatgacgaagataatgtagacccgctgcaccgtgctaaacaatccagtaacaagactgtcttttcatccagcagttccaacatatcctccaaagacgtttcaccggatccgatcttttcaccggatcccgcagatgattcatcgaatacttctgatgctggttctaggtgcaccataacctccgataccagctcctcggctgcaaccatgaatcgcacccctaattccaaaaacccgcaagatattgctttgttaaacaactttcgttctgaagccattactccgagaccgaagccttcttccacaactacatccatcactaccgaaaccaccaataacatgataaaccactctagttctacaactactaccacaaacaacagtccgctgccaagcataaacactatcttcaaggatatgctgtga

SEQ ID NO: 4465 - DNA, 2016 bp, Saccharomyces cerevisiae
atgatggataatcaggctgtaaagtcactgctagaaatgggtattccacacgaagtagctgtggacgccctccaaagaactggcggtaatttggaggcagcagttaacttcatcttttcgaacgagctgccggagcaagcggaaatgggtgaggagaatgatggcagtcagcctaggatttctgagaacaaaatagtggctggaaccaagccctgcgatgttccgaacaacggggaccaagacattgatatgccggatgtgagtggtgtcgatgttgattatgatgacgatgaagacatcacggatgaacgcagcggttctaatagcaccagcggatgcagggttactgctcagaactacgatcgttattctatatcggagacatccattcctcccccctcttatagtatagtacaacacaacgagttcaagtcgaacgtgggcgatcctacggttgtgttgccgctacccttgaatagtctaattgagagctattttgggctgtttgcgttgctcacggccgtgtatttcccacacgtgttcttgaaaccggactttaaggatttgaactatagggcagactggttcaagggctcatcgtttacggagcccaaatacagacttgcatattgcgaggcagaagatggttccactacgtcggagatcgtgctggccagcggacctaatgaagggttgcaaccgcatctgctctggcagttgcaaaaactcatctccgtggttaacacgcgaaagtgtgaaagagcctttgtttcggccaaggtgtttacgtcgtccttggaaccgcaattgaggtccaagctggccgattccgagcatctttatgaggtgctcccagcgtttatcaaatcattggcagtggatttggaaatgtgtcctgggatcagagaccgggaaacaagaagtctctttatatcttctgctttgcatactccgaacaagaatgaacctccaatggagacgtttttgtccttgtttcattttcttcctgaagagtacgattctaatctatataaaatgttcaacgttttattgtaccccgaagaagaggaagaagaagaagacgtgattcgtggtggcgagcaagaagaggcgagatatgtggaaccggagaatactttgaaggaggtggcacccgtattaacaatcctgttcaatgaactagaaacaaatacagaatcagtgtctctacccaatggcgtggatataccgcttgagttttacccacagctttacaccaaacagtgcaaagaccaactaataagacatattatttctaaacgaaagcaagcgcggaccagatccagatgcttgcttcaagagatcaacgagttaaagagttaccaaggcaaaaacatatccactattctagagtcgacgctggcgtatctacaaacaattcctgacgatgctaataatgaagcagcaaagcagatcgcatcgttgaaagatacattaaattctgcgagagccgctaaaatggaggaatataaggacttggcgtccaaactgcatggagaatggaacctttcacatccagagacacacataatcaacactgcaaagcaattgggactgatcgaaaatccctacatcctcacaatggcagcactatcgccatattcatactttatcagaagcagaaacggtgcatggtcatggatacaaagtaatacgttgggaacagaattcaaggtgaaaaaatgttcgtcgccttctgtcgttcaagaagccatcaagcatggcacgaagtacgcaagtgaaactccgctgatgttcatatactgtgaagagggtaaaattcccacggaagaagtagtcgcggaagcgttgaaaagcaatagcgggtgcttaaaatttgctgaggatgaccaaaattcattaaaaacattgcgttcgcaatttttcgatggtatgggagatcctgaacaagccaccaacaatattaacaatggtaacgataatgacaatgacgatgacatcgattctgataattag

SEQ ID NO: 4466 - DNA, 2016 bp, Saccharomyces cerevisiae
atgtcttcagttgatgtactgttaacagtaggtaagttggatgcctcattggcgttactgactactcaggatcatcatgttattgagtttcctacagtattattaccagaaaatgttaaagctggatctatcataaaaatgcaagtttcacaaaatttagaggaggaaaaaaaacaaaggaatcattttaagagtatacaagccaaaattttggagaagtatggtacccataaaccggagagcccagttttgaaaattgttaacgttacgcaaacgagctgtgttctagcatgggatccattgaaacttggctcagcaaaattgaaatcactgatcctttataggaagggaatacgttcaatggtaattccaaatccattcaaagtgactaccacgaaaatatccggtctttccgttgatacgccatacgaatttcaattgaaactgataaccacgtcaggaacattatggtctgaaaaggttatattgcgtacacataagatgactgacatgtctggtatcactgtatgtttgggtccattggatccattgaaagaaatttcagacttacagatatcccaatgtttgtctcacatcggggcgagacctttacaacgtcatgttgcgatagatactacgcattttgtctgtaacgatctagacaatgaagaaagcaatgaagagcttataagggcaaaacataacaacataccaattgtcagaccggaatgggtgagagcttgtgaggttgagaaaagaatcgttggtgttagaggattttacttagatgcagatcaaagtatactgaaaaactacacattcccaccagttaatgaggaagaactttcgtactcaaaggagaatgagccggtagccgaagtagcggatgaaaataagatgcccgaggacacaacagatgtcgaacaggttgcatcacctaatgacaatgagagtaatccttcagaagctaaggaacaaggagaaaagagtggacatgaaactgccccagtaagtcctgtagaagatccattgcatgcttcgacggctttggagaatgaaaccaccatcgaaaccgtcaacccctccgtaagaagtttgaaaagcgaacctgttggtactcccaatatagaggaaaacaaagcggactcttccgcagaagccgtggtagaagaaccgaatgaagctgtggctgaaagttctccaaatgaagaagcaacgggacagaaaagtgaggataccgatacacattctaacgaacaagctgataatggatttgtacagactgaagaagtagctgaaaacaacataaccacagaaagtgcaggggaaaataacgaacctgcagatgatgcagcaatggaatttggacgtccagaagctgaaattgaaactccagaagtaaatgagtctatagaagatgccaatgaacctgcggaggattccaatgaacctgtggaggattccaacaaacctgtgaaggattccaacaaacctgtggaggattccaacaaacctgtggaggattccaacaaacctgtggaggattccaacaaacctgtggaggatgccaatgaacctgtggaagataccagtgaacctgtggaggatgccggtgaacccgtacaagaaaccaacgagtttactaccgacattgcctctccaagacatcaagaagaagatatagaacttgaagccgaacctaaagatgctaccgaaagtgttgcagtcgagccatccaatgaagatgtaaaaccagaagaaaaaggttcagaggcagaagacgatatcaacaacgtttccaaggaggctgcctctggtgagagtactacccaccaaaaaactgaggcctctgcttctcttgaaagcagtgccgtcacggaagaacaagagacaacggaagccgaagtaaatacagatgacgttttgtccactaaagaagctaaaaaaaatactggcaacagcaacagtaataagaagaagaataagaagaataagaagaaagggaaaaagaaatga

SEQ ID NO: 4467 - DNA, 2016 bp, Saccharomyces cerevisiae
atgttcttgcttccatttgtcattcgtcattccagctctatttacctgcccacgcttcgatttcgaggtttacttactgtaatctcaagaaacatacacatttccacccctcataaaatgttgcctctttcaattgagcagagaagaccttcccgctcccccgaatacgatcagtctactttatcaaattataaggacttcgcagttcttcacaccgatttaaacctgtctgtttccttcgaaaagtcagccatttcagggagcgttacattccaattgaaaaaactgcacgaaggtaaaaataaatcggatgaattacatctggatacatcctatttggatgtccaggaggttcatattgatggttccaaggcagattttcaaattgagcaaagaaaggagccattgggctccaggttagtcatcaataacgcttcttgcaacgataactttaccttgaatattcaatttcgtacgactgacaagtgcaccgctttgcaatggttgaacagcaagcaaaccaagggcggtaaaccgtacgtgttttcacagttggaagctattcatgcgaggtctttgttcccctgctttgatactccctctgtgaagtctactttcactgcatctatcgagtccccactaccagtggttttttcaggcatcaggattgaagatacaagcaaggatactaatatttacagatttgaacagaaagtccctatcccagcctacctgatcggtattgcttccggtgatttgtcaagcgctccaattggacctcgttccacagtttacactgaaccatttcgtttgaaagattgtcaatgggaatttgaaaacgatgtagagaaattcattcaaactgcagagaaaattatctttgaatacgagtggggcacttatgatatcttagttaacgtcgattcgtacccttacggcggtatggagtctccgaatatgacttttgctacgcccaccttgattgcacatgacagatccaacattgatgtcatcgcccatgaacttgctcactcatggtctggtaacttagtgaccaattgttcgtggaatcatttttggttgaatgaaggttggaccgtttacttagaaagaagaattattggtgccattcatggcgaaccaactagacatttcagtgctctgattggttggagcgatttgcagaattctattgattctatgaaagatcctgaaagattttccactttggtacaaaacttgaacgataacactgaccctgacgatgccttttccactgttccgtacgaaaaggggttcaacttactatttcacttggaaactattttgggtggtaaggctgaatttgatccatttattagacactatttcaagaagtttgccaaaaaatcattggatactttccagtttttggatactttgtatgagttctatcccgaaaagaaagaaattttggattccgttgactgggaaacttggctgtataaaccaggtatgccaccaaggcctcattttattacggctttggctgataatgtttatcaattggctgacaagtgggtcgaaatggctcaacatttgaaaaccacagaggatttccggtctgaatttaacgctattgacattaaggattttaattcaaatcaattggttttgttcttggaaactttgacacaaaatggccattccaacaagaaaccaaaagattttgactgggccaagtttcccgtggcatctagggcactgttagatatctatcaagataacattgttaaatcacagaacgcggaagttgttttcaagatgttcaaatttcagatctttgccaagctgcaagaagaatataagcatttggccgattggttgggaactgtaggtagaatgaagtttgtccgtcccggttacagactattaaactctgtagaccgtcgattggcacttgcaactttcgacaaattcaaggacacgtatcatccaatctgtaaagctcttgtgaaacaagatttaggtctttga

SEQ ID NO: 4468 - DNA, 2019 bp, Saccharomyces cerevisiae
atgaaacgaggtgtttggttgctgatttattgctatgcaactttaactaaaggattttccttgccaggcctatctcccacaacatatcactcaggcgatgaaatcccgctattggtgaaccgcttgactccatcaatttactttcagcatcaagatgaggaaggtaacgatgtttcaggcgataaagaacattttctttactcctatgattactataataagaggtttcatttttgtagaccagagcacgttgagaaacagcctgagtcgttaggttcagtcatatttggtgacagaatttacaattccccattccaattgaacatgttagaggagaaagagtgtgttgcactttgtaaaagcacgattccgggaaaagatgccaaatttatcaacacccttattaaaagtggatttttccaaaactggctcgtggatggattgccagcagcaagaaaggcttatgatagcagaacaaaaacaaactattacggcacaggatttgagttaggttttacagatgttaagcaaaccgttgacggtaaagcagttcccagtacgatggaagagcttacttcagaggcctcaaatgaggatgttatattggatgctcgactgcccaagaatgttaagcctaatttagttaaaacggtagaattaccttactttgtaaatcattttgacattgaagtggaatttcacgatcgtggaaacgataattaccgagttgttggtgtcattgtaaaccctgtatctatcgaaagatcgtcacctggcgcgtgttctacaacgggaaaacctctgatactagacgaggataaggataacgaggtttacttcacttattctgttaaatttgttgcctctgatacagtgtgggctacgagatgggataagtatctacatatttatgacccgcagatacaatggttttcattaataaatttttccgttattgttattttgttgtcatctgttgtaatgcattctctattacgggctttgaaaagcgatctcgctcgttataacgaactaaacttggataatgaattccatgaagattctggctggaaattgggccatggtgacgtatttagaaccccatctaagtcgatgctgctatccattcttgtgggatccggtatgcagttatttttgatggtcatgtgtagcattttttttgccgcagtaggtcttgtgtcgcctgtttccagaggatccctgccaactgtaatgtttgttctttatgcattatttggatttgtaggatcctacgcctcaatgggtgtctacaaattttttcgtggaccctattggaaggcgaatatgatattaacgccaatattacttcctggagcaatttttttactgattgtaataatgaacttctttttgttatttgcacattcttcaggtgtcatcccagcgagaagcctattctttatcattcttctatggtttttagtttctgttccgttgtcgtttgcgggttcaattgttgctcataagcagtgtaattgggatgagcatccaactaaaacaaaccaaatcgccagacagattccatatcaaccctggtacttgagaacagcacaagcaaccttaatcgctggaattttcagtttcggatcaatagcggttgagctgtacttcatttactccagtttatggttcaacaaaattttttatatgtttggatttttactcttttcattcttattgttgaccttgacaacctcattagttaccatcttgatcacatattactcgttatgtctagaaaactggctatggcaatggagaagttttattattggtggtttaggatgttcaatctatacgttcatccactccatactatttactaagttcaagcttggtggagttattactgtcgtgctctatctcggatattcacttattatatctgcattatgttgtgtcgtcactggagcgattggtttttttagtagtatgttttttattaggaagatatactctgccattaaagttgagtga

SEQ ID NO: 4469 - DNA, 2019 bp, Saccharomyces cerevisiae
atgaagcaggagcagtcccacgaaggcgactcatacagcacggaattcataaatctctttggcaaagataccgcaacacaccctagcagcaacaacggtgctaataataatggcatggggagcacgaactcgttggaccagtttgtggcaacagcctcatcgtcatcttctctggtgaccagcagcgagaataggcgccccctaataggtgacgttaccaataggggcaacactaacctatatgaccacgctgtcacgccagaaatactcttagaacagttggcctacgtggataacttcataccatctctggataacgagttctctaatgtggattggaatgtgaataccacccataataatgcaaacaataatggcgcggacactttcagcagcataaatgcaaatccttttgacttggatgaacaactagccattgagttgagtgcgtttgccgacgattctttcatcttcccagacgaggataagccgagcaataacaataacaacagcaataatggtaatgacgaccatagcaaccacgacgtattgcatgaggacccttctaccaataatagacaaagaaatcctcacttcttgactcaaagaaggaatactttcctaacttcccaatacgaccaatcaaagtctcgattttcgtccaaaaacaaaagaaatggcaataacggcgaaacaaacaactttggcgacaatatgcaaaataaccatccttttgagccaaactttatgggaagcccttctcagtttcccgctgacgcaactaatatgacatcaatcgaccatggcggcttcacaaatgttgacattacatcaactgagaacaatactaccggtgacaatggagtggatgcgctatcaaatctactacataggacaacacacacaccgaaccgctcctcccccctaagcaatgtcacttctgctcaaaattcctcttcacaacaacgaaaacattcggaaagcaaagtcgatagtaacagcgataataacagctccaacaaagcccccaatataactgttcctgactattcaattataccaacctctgttttagtaactctattaccgagggtcaacgtgcccaacggcgcatataactcgttgatcagcgcgggatttgacaatgatcaaatagatgctatagccgcaataatggcgtatcatcatcaaaaaaagattagggaaaataacagtaataataataaaaacatcaacaccaatgacagtcaagaggcacccattctaaaaaacatcaacgaacttttaagtgtcttaataccaccctctccggctgaaactgctgcgccaactaccttatcaacgtcgccttcgttcaatgagcacggtgtagtagcagaggcttcttttctaagctccattttggaactgggcataaagcatccaaaaagtaataatattcacaatcaacgacaaccttcacgaaacgatcataaaatatcaagagagagtgacggtaacaatggaaacgataatgtccatcataataacgctgttattaagtcaagtacgacgcgtggagacgaaattgccaagatacgatccgagccaactttaaatgcaagttcttctgatcacaaggaaaatagtttaaaaagatcacactccggagatttgaaaaataaaaaagtacccgtcgaccgcaagtattctgataatgaagacgatgaatatgacgatgcagatttacacggctttgaaaagaagcaactgatcaagaaagagttaggggacgacgatgaagatttattgatacagtcgaaaaaatctcatcaaaaaaaaaaactaaaggaaaaggagttagaatcatcgatacatgaactgaccgaaattgcagcatccttacaaaaacggatacatacgttagaaacggaaaacaagcttttaaagaatttagttctgagtagcggtgaaacggaaggaataaaaaaagctgaaagcttaaagaagcaaatttttgagaaggttcagaaagaataa

SEQ ID NO: 4470 - DNA, 2019 bp, Saccharomyces cerevisiae
atgatgtctaacgttgctaacgcctcccaaagacaggaaaatccatatattattccattgcctccttcatccacagtggaaacttctactgaacccccaagaacgttatggatgggagatttggatccgtccttcgacgaggccacgattgaggagatatggtcaaaactggataaaaaagttatcgttaaactaattagagccaaaaaaaatttgttgattccttgtagctccacctcaagtagtaataacaacacaagtgaggagaatgctgaaaaccagcaatctgcatcaaacagcactgatcagttagataattcccaaatgattaatattaatggaatatccttcattgatccttccactactcaattacatcatgccggatactgttttgtcgaatttgaaactcaaaaggacgctaaatttgccctgtcattaaatgctacacctttacctaatttttattccccaacaactaactcccaaactaatccaacgttcaaaaggactttcagattgaattgggcgtctggagctactttacaaagttctataccatctaccccagaattttccttgtttgttggtgatctttctcccaccgccactgaagctgatttgttatctcttttccaaacgaggttcaaatctgttaaaaccgtccgcgtgatgactgaccctttaacaggatcatctcgttgttttggatttgtcagattcggtgatgaagatgagcgccgcagggcactgattgagatgagtgggaaatggtttcaaggaagggccttaagagtcgcttatgccacgccaagaaataatatgatgctgcagttacaggaacaacaacaacagcaacaacaattgcagcaacagcatcagcagctagatcaggaggataataatggccctctcttgattaagactgcaaataatctcattcaaaacaatagcaacatgcttcctctcaatgccttgcataacgcgcctccaatgcatttgaatgagggcggcatttcaaacatgcgtgtaaatgattcactaccttcaaacacctataatacagaccccactaatactactgtttttgtgggaggactggtaccaaaaactaccgaatttcaattacgttcactattcaaaccctttggacccattctaaatgtcaggattcccaatggtaaaaactgtgggtttgttaaattcgagaagaggattgatgctgaagcttcaatacaaggcctgcaaggctttattgtgggcggcagtccaataagattatcatggggacgcccatccagttcaaatgctaaaacaaattcgaccatcatgggggcaagccaatatatgtcctcaaatggcctgagagcgccatctgcggcttcttcagtcgataactccaaacaaattcttgaacaatatgcggaagataaaaggcgactctttttacatcagcagcagcagcagcagcagcagcagcaacaggatggtaacttttctatggagcaaatggcgcacaacaactattacaactacaataattacgattatcacaggaacaagaatggcagccatagcgacctcgttaatctgcagagatctaatgtcccgtatatgcaagaagacggtgcactgtacccacaccaatattcaagtccctcatactcgctccatccgacgggcaaccaattctccaatgctactaataacttacctcaatttgggaacgcgatgtcaatttctatgcaactgcccaatggcaacagcaataaaacggcctcaagcatgaacacaaaccctaacacaaacatgatcatgaattctaacatgaacatgaacatgaacgtaaatccagtaccatacggaatgggaaacggtgcaaatatgtatgacgtgtccaggatgatgactcctcccttaaatatagccccgaattccaataattcgaaatcgagcatcatgaacaagcatcctaataggaacaatgttccgccaattcatccttctcttctacattga

SEQ ID NO: 4471 - DNA, 2019 bp, Saccharomyces cerevisiae
atggcagtaataccggcaaagaaaagaggaagacctagaaaatctgtggtagcagaagttccctatgatagcttggcaagcccagtatctgaaaactcaggcagtaaaaggccgaggagaaacgcatctaagaaagcagttgcaaatttcgcacaattagtgcatgctggtcgcgatgatgtgataaatactacacaagtcaataatgttgatgacaccgacgatgatgattttgtattgaatgatgaaggtgatggtgaggaaagtgacaatgttgagatagaatttgagaatgagttagagtctactaaaaatgaggtggcggatttaaacagtagtggaagtggagcttctgttagacccagtggaagaagaaatactgtacagaaacttcgtttgaagaagaattcgactaaaaatatgaagagcagctccccagggtcaagtctaggacagaagggccgtcccatcaggctcctaaaagatctttcgagtgcaagagacaagattgaaagaatttatggactgaataaggaaaagttattgttgctagcaaaagttaaggaaggctttgaaactagcgttttcgatttcccattcaagaatattcagcctgattctccatattttgtatgcttagatccaccgtgtaaaaaggaaagtgcatataataaagtcataggggataaaaacagaaccgtatatcatgaaattaataagactgaatttgagaatatgatcaaattgagaacgaagagattgaagttacttatcggggaagttgatgcagaggtatccactggcgataaaatagagtttccggtgcttgctaacggcaaaaggcgcggctttatttacaacgtaggaggattggtaacagatattgcatggcttaatatagaggaaaatactgatataggcaaggatatacaatatttagccgtcgcggtatcacagtacatggatgagcctttgaacgagcatttagaaatgtttgacaaggagaagcactcctcctgtatacaaattttcaaaatgaatacttctactctacattgcgtaaaagttcaaaccattgtacactcatttggtgaagtgtgggatcttaaatggcacgaaggatgtcacgcacctcatctggttggctgtttatcattcgtaagccaggaagggacaataaattttttggaaattattgataatgcaaccgatgttcacgtgtttaagatgtgtgagaagccttctttgactttatccctggcagacagtttgataactacttttgattttttatctcctactactgttgtttgtggctttaagaacggatttgtagcagagtttgacttgactgatcctgaagtgccttcattttatgaccaagtccatgactcctacatattatccgtttcaacagcctattcagattttgaagatacagtcgtcagtacagttgcggtggacggctacttttacattttcaatccaaaagacattgctacaacaaagaccacggtgtccagattcaggggaagtaatttggttccagttgtttattgtcctcaaatctactcgtatatttactcagatggtgcaagttccttaagggctgtgccgtctagggctgctttcgcagttcatcctttagtgtcgcgagagacgaccataacggccattggggtgtcaagattacatccaatggtccttgctggatcagcagatggaagtcttattataaccaacgcagctaggcgccttttgcatggcattaaaaacagttcagcaactcaaaagtcattaaggctttggaaatgggattatagcataaaagatgacaaatatagaattgatagttcttatgaagtgtatccgctgacggtcaacgatgttagtaaagctaaaatagatgcgcacggcattaatataacatgtacaaaatggaatgaaacgagcgctggaggcaaatgttatgcattttctaatagtgctggactattaacactcgaatacctgtcatga

SEQ ID NO: 4472 - DNA, 2022 bp, Saccharomyces cerevisiae
atgtcaacgcactcaaacgactacttttctgcttcttccggaatggtctctgagacatcgtccgaggtttcttcgataaactcttcacagcctgtatcattctctaaggcttctattgctgctccggttccatgctctgatctacacagcaccaagtcgaacgatgcatcgagaaaattgtctattagtaggacgttaactaatcggctcaacgacattaaaaaggctgtcgatgacgacaacttgcagacggaagaaaattccgcagacgttaataaaatattagaatctagatttgacgtggccgatgccattaggctacagcacaatgagtcagtccagtcaaagttaaacatcccagtcacacacaccacgactgcaggcgcctcgttgtcggcaccatcttcctctgctttctctgcttcttctattcaaaatgatactacagaacataaagcttccatggactccaaactcatgaggaatagactatatccggcttccacgaaacactccggtaaggatcttgaggcccaaggaataaccgaattcgagcctgatgaaccgactgtaaaaaaagtattcaccaacaagtctaccgggcagctggaactgccccccgacggtggttatggctgggtcgtgacattctgtgtgttcttgaccatgttttccacgtggggctgcaacgcatccttcggtgtcgaccttgcctactacttaaaccatgatacttaccctggtgcttcgaagtacgattatgccttaattgctggcctaactgtctttctcggtcaactcttatccccccttgtgatggcactgatgagaataattggtctgcggaccaccatgctttttggtgatgctgtaatgcttgccgcatatctcttggcctcctttactaccaagttatggcaattgtatgtcacccaaggttttatggtcggttgttcaatatcactgattttcgttccagcaacaaccgtcttaccaggatggttcttgaaaaaaagagctgtcgcaatgggtgtctcattattgggtaccggtgctggtggtgtcgtttacggtttggctacaaacaaaatgctttctgactttggaaatacccggtggtgccttcgtatcataggcatatcgtgtagcataagtgttctagttgctattgcgctcttaaaagaaagaaaccctacacctgccataggattgaaatcgcctcgggccatgtttgaacagctcaaagcaatgttttcattaaaggttataactaagccatttgtggtacttattgcattatggttcatgttcgcattatttgcctacaatatgatggtttttactttatcttcatacgcaatctcgaaaggattatcatcgcacgacgcttccacattgactgccattttgaacggctcgcaatccatcggaagacctctgatgggtttagcgggagataagtttggtagggcaaacgtaacgatcgtattaaccactttgttaacaatatatatgtttgcgttctggatccccgctcatacgtttgttcaactcatctttttttcaattctagttggctcatgcgttggtgtcgccaacgtcatgaataccgttctgattgccgatatggttaaaccagaagagtttttgcccgcttgggccttcgtcaactactgtggtgcgcctttcttattggtttgtgaggtgattgcccaggcattgacggtggagaaagataagagcaatccttacttacatgcacaaattttttgcggttgctgctttattgccgcactaattttaatttctatccttcgtgaatattctatcaggatgaaattaacggaaagacaagctatgacaaacgagaagttaaaagaatggaaggcaagcgaatacgataccgattctgccgatgaagattggggtaaattaaaagaaagaaagactaaatatgaccttcttttaggtccgggcattaaaaaatacttcctaagaatggtatatccaatgaaggtctag

SEQ ID NO: 4473 - DNA, 2025 bp, Saccharomyces cerevisiae
atgacaaacaaatctagcctgaagaacaataggaaaggggttgcttcgaatactctctctggagctgagcaggccaatataggttcatcggcaatgcctgacacaaattctacgggaccattttcttccgtttctagtctggacactcctgtagtaaggaaatcaactagtcccactggttcacaaactaagtcaatcatgaatgctagcggaacttctggggcagttgtaagtaatacaccagagccagggttaaaaaggataccaactgttacattcagcgatccaaagttgggtagtctcaggtcggatgtggagcaaactccacctaaccaggtggccagacagtccagcgaaaagaaagcaacgtctgtacacatcgcagcggagggtgcaaatcaaggaagaaacttgaaagacataaatacaaaagtaccaaaagatggcgaggcttctgcttcttctttttcgactccaacctctattctctccaatgctgatatggggaataacatatccagcctgctggctaaaaagctaagtttcaccggtggaacagattctattttaaactctgacaatagttccgatagccccagaaaggagcacccacatttctacgtggaagatcctttacacaccccatcagttagatcaaggtctaacagtactagtcctcgcccctctgtggtagtgaatacatttaaccccatcaacattgaacgagagggctccatatcaaagactggagagcccacattgttggagtctgtcttggaagaagcaatgtctcccaatgcagtctcaaatcccttgaagagagaaaatattatgaccaatatggatccaaggcttccccaagatgacggcaagctacacgttctttttggggcaacaggttctttgtctgttttcaaactcaagcacatgatcagaaaattagaagaaatttacggaagggacaaaatatgcatacaagttatactaactaactcagcaaccaaattttttgcaatgaagtatatgaggaaaaataagaaacaacacaatagtatcgatacttctttcaacagcaccaattctaatgctggcaatataactggtaacaagaaaaaagtagcctctcttgaaaaatttagcattcagaagacgtcttcaaactcagcggcttctcagacaaataataaacaggaggaagaaaaacaaatggcctctactactggatttccttcgacacttggtggtagtcgtacgtacagcaactcttcaaacgttgtatcgcaacatcctcaaattgaactgccagcacatatacaattttggacagaccaagacgagtgggatgtatggcgacaacgaactgatcctgtattacacatagaactacgtcgttgggcagatatactagttgtcgcaccattaaccgcaaacacgttggccaagattgcccttggtttatgtgacaaccttttgacaagtgtaataagggcatggaatccaacgtttcccatattcctagcgccttcaatgggtagcggtacgttcaattccataatgactaaaaaacattttcgaattattcaagaagagatgccttgggtaactgtatttaaaccctcagaaaaagtcatgggcataaacggtgacatcgggttaagtgggatgatggatgcaaatgagattgttggcaagatagtcgtcaaactaggtggttatcccgatgtttctgcgggaaaggaagaagaagaggatgaagataacgatgaggaggatgataataagaagaacgatactggtggtaaagatgaagataatgacgacgacgacgatgacgatgatgatgatgacgatgatgacgacgacgacgacgacgacgacgacgacgacgacgacgatgatgatgatgacgacgatgatgacgacgatgatgacgacgacgacgacgacgatgaagatgacgaagacgaagatgaagacgatgaaggaaaaaagaaagaagataaaggagggctacagcgatcttaa

SEQ ID NO: 4474 - DNA, 2025 bp, Saccharomyces cerevisiae
atgagtaggaaaaattctaagaaactaaaagtctattacttacctgtaacgctaacccaatttcaaaaggatttatcagaaattttgatatccctgcacgccaagtcattcaaagcaagcataataggagaaccacaggcagatgcagtgaacaagccttccggcttacctgctggccctgaaacacatccgtatccaacgctatcacaaaggcaattaacctatatctttgattcaaacataagagcaatagccaatcatccttcccttctagtggaccattatatgcctcgacagcttttgagaatggagcccacggaaagctctattgctgggagccacaagtttcaagttctcaaccagctcattaattcgatatgctttagagacagagagggctcaccaaacgaagttataaaatgtgccatcatcgcacacagcataaaggaattagatttgctagaaggtttaatattaggcaagaaattcagaaccaagagactttccggtacatctctttataatgagaaacacaaattccctaatctacctacggtcgattccacaataaataaagatggaacaccaaattctgtaagcagcacaagctctaattccaattcgacctcttatacaggttattctaaggacgactatgattactcagtgaaaagaaacctgaaaaaaagaaaaataaatacggatgactggctgtttttagccactaccaaacatctcaaacacgatcaatacctattggctaactatgatatagatatgataattagttttgatccaatgttggaagttgaattgcccgctttgcaggtactgaggaataatgccaataaggatattccgataataaagctattagtacaaaattctccagatcattacttgttagattctgaaatcaagaattcaagtgttaaatcgtcgcatttgagcaataacggtcatgtcgatgatagccaagaatatgaagagatcaaatcctccttactatattttttgcaagcaaggaatgctccggtgaacaactgtgagattgattatattaaattggtaaagtgttgtttagaggggaaagattgcaataacattttaccggttttggatttgataacgttagatgaggcctccaaagattcgagcgattctgggttttggcagcctcaattaacaaaattgcaatattcgtctacagaattgcccctttgggacggaccattggatatcaaaacctaccaaacagagttaatgcatagagccgtcataagattgcgagatatacaggacgagtatgccaaaggcactgttccactgtacgagaaacgattaaacgaaactcaacggcagaaccagttggacgaaataaagaattctgttggtcttacattcaagaaaaaacaagaagtggaaaaatccattaatgactctgaaaaaaggttgaagcatgcgatgacagaatctaccaagctacaaaataaaataaatcacttactgaaaaataggcaggaactagagaatttcaacaaattgccctcgaatactatttcatcagaaaatcatctggaagagggatctgccttagcagacaagttgaaggaatacatagacaaaaatgcgactctttttaataagttaaaggaactccaacaagcaaatgcggaaaaatcaaagctcaatgatgaactacgttccaaatatcaaatagaatcttcaaaagccgcagagtccgcgcaaacattgaaaattttgcaagaatcaatgaagtctttagaaaacgaagttaatggtccactgactaaattttccacagaaagcttgaagaaggagctggaacgtttacagaatgattttcagtcgcttaaagcaagaaacaaattcttaaagaattacataaccttaatgaaccgacagtacgacttaaaaaacaaaaacaacgtccaggtggaaaaagctgccgcaaatggtacacggtttagatcaacaagatccaatacccctaattacacatga

SEQ ID NO: 4475 - DNA, 2025 bp, Saccharomyces cerevisiae
atggaaccaattgatgacatactttttgaggttactgatgcgttcaaaactcagaaggaggatcttcttgagttggtaacattgattgatatatatggcgagcaagttaaccaagaggggagctatgaagaaaagacgagattcattgaaactttgaatacattgttagaggataatccgagtactactggtgaaatcggttgggatctgcctaagggattattgaagttcttgtcaaaggataatgtcgatgtaaatggaagactaggtacgaatatgattgtccaaggtgtaatgaagtgtttctatgccatctcaatccaaggcgagcccaaaaaatgtttaattactgggttggagttgctttcatccctttgttcaaaagatttttccaagagtgatcaacagaataaggaagactttgttgataaaaaggccaatacgttacctcctgaaggagtaatcgaaaattcctctaatcgaaaagattttccatcctacggtgaaagcaagagttcaaatgaatttttcttgaagttgaaatcctacattttatttgaattcataggggcgagtctgaaaaggatttctactctgtttccttcgaaatatctgggagctgctgtgtcaacaattgagaaatttgtgtatagtcatgcggacacttttgaagatgcccttttccttcttcgtagggtgtacacattctgcaggaactatattccccctgatccaccaaaagatatacaattgaacgaagattttactcgagagatgtttgataaagttgtggaggaagaaagtgaattacaggttagactattgcgtaggctttgtacttttggtatttcgacacccataaaaactgtcaccaccaatgccgacgtgaaatactattgtgcactaaatcaacagaagtttgaattatctgcatattacaccgaatatcttgagctattttgcaggtattaccaaatggcgttctcgcttgatgttgatatagagggagaatttcagaatgtgataaaagaatgtaggattatttataagtctgtaccccaggagatttccgctgttaatgatgaagcaaagttggttttggaaagaatggtatataaattggcttatacattcgaagtacaaaaggccgctaaagaaaaaaatgttggtttggactataatggtgtaatattattttctggtatccactatttggaaaccaatcaacatttagtaaaggaaatgaatataacggatgccatttatctctacttgagatttacaactccatcattatattctaaagtttactataatgtagcagttgaatcagttagtcgctactggctatggtatgctattacaaccgagcccttggaggatgtaaaaaaagaattgaagaatctttcagtgtttgttacaaaaacattattgcatgttctacttcaaaagaactgtattcaggtcaatcagcagttaagaatgataactttcactcttctcaccagattactatgtttaatacctgaaaaagttgcatttgagtttatcttagatgtgcttaagacatctccccttccattggctaagacgtccgtattatgtgtttttaaagacctttcaaggcgacgcatctccaccaaggataacgattctgagacggatttgattgtcgaaaaattatccaaactgaaggtcaatgatagtaacaaagctcagcaaagtaacatcagacattatatccaactagattcttccaaaatgaaagctgttcatgactgttgtctgcagactatccaagattcatttacggcagatgccaagaagagtgatatattattactgctaacttacttgaatattttcattgtgctaaaaaaaacatgggatgaagatctactgaagattgtttgttcgaagattgattctaatttgaagtcagtcgaacctgataaacttccgaagtataaggaaattgtggataaaaacgaatctctaaatgactattttactggtataaaatga

SEQ ID NO: 4476 - DNA, 2025 bp, Saccharomyces cerevisiae
atggttgtagtgggtaagagtgaagtgcgcaatgtaagcatgagtaggccgaagaagaaatcattgattgccatcctgtcgacctgtgttttgtttttcctcgtgtttataattggtgctaaatttcaatatgtttccgttttctccaaattcttagatgacaggggggacaacgagtcacttcaattgctcaatgacatagaatttacaaggctaggactgacacctagggagccagtaattatcaaagacgtaaagacagggaaggagagaaaattacatggacggttccttcatattaccgatattcatcctgacccttattatgtggaaggaagctctattgatgcagtttgtcacacaggaaaaccaagcaaaaaaaaggatgtggcacccaagtttgggaaggcaatgtctggatgtgattctcccgttattttaatggaagaaactctgagatggattaaagaaaatcttagagataagattgattttgtcatttggacgggtgataatatcagacatgacaatgaccggaaacatccaagaacagaagcacaaatttttgatatgaacaatatcgttgctgataaaatgacagaattatttagtgctggcaatgaagaagatccaagagattttgatgtgtctgtcattccaagtcttggaaacaatgatgtctttccacataacatgtttgcactaggaccaactctacaaactagagaatattataggatttggaaaaattttgttccgcagcagcagcaaagaacttttgataggagtgcttcatttttgactgaagttattccagggaagcttgctgtcctgtcaattaacacgctgtacttattcaaggccaatccgttagttgacaattgtaattcaaaaaaagaaccaggttaccaacttttactttggttcggttatgtattagaagaactaaggagtaggggaatgaaagtatggttaagtggacatgtacctccaatcgcaaaaaatttcgatcagtcgtgctacgataagttcacgctatggactcacgaatacagggatataatcattggaggattatacggtcacatgaatattgaccacttcatcccaacggatggtaaaaaagctagaaaatcgttattgaaagccatggagcaatccactcgtgttcaacaaggagaagacagtaatgaagaggacgaagaaactgaattgaatagaattctggatcacgctatggcggcaaaagaagtttttttaatgggagcgaaaccatctaacaaagaagcatatatgaacaccgtccgcgacacatactatcggaaagtgtggaataagctggaaagagtggatgaaaaaaatgttgaaaatgagaagaaaaagaaagaaaagaaggacaaaaaaaagaaaaagccaatcactagaaaagagctcattgaacgctattccattgtgaacataggtggttcagtcattccaactttcaatccttcctttaggatctgggaatataacatcaccgacatagtgaatgactccaattttgcagtttcggagtataagccctgggatgaatttttcgagtcactaaataagattatggaagactctttgctagaagatgaaatggacagcagtaatatcgaggttgggatcaaccgcgagaagatgggcgaaaagaaaaacaagaagaaaaagaaaaatgacaagactatgccaattgagatgccagacaaatacgaactcggccctgcatatgtaccgcagttattcactccgacgcgtttcgtccaattctacgccgacttggaaaaaatcaatcaagaattacataattcatttgttgaatctaaggatattttcaggtatgagatagaatatacctcagacgagaaaccatactcaatggattcgttaacagtaggaagttatttggatcttgcaggcagattatacgaaaacaaacctgcatgggaaaaatacgtcgaatggtcatttgcgtcttctggatataaagatgattaa

SEQ ID NO: 4477 - DNA, 2025 bp, Saccharomyces cerevisiae
atgtcggatgtagataactgggaacccgtatcagataatgaggacagtactgattctgtgaaacaattgggtcccccctttgagcatgcaagtaacaatgacaatgccggcgatactgaagctgagtcactgcaagaagtgcccctaaatacagagaccaacgacgtacgcaagaatttagtagtgattacaaaccaaagtgccgccgatgaacaccctacagagatcaagcacgatcaatcaaggacttcttcgacgtcctcgttcttcagtggaatgatctcttcgtttaagtcaaacgtgccatccccagtttctagatcaactacgccaacttcgccagtttcgcaaccaagcattatatcacatagaagggagccttccatggggtccaaaagaagatcaagccgccgtatcagtaatgccacaattgctgaaataggctctcccttgcaacaggtggaaaagcctgatgaggtcaagacaagactcactccttcccaaatgaaagaagacaattacgatcatagacgattcgtggaagaacgttacatggacacaccttatcactatgcgtctgagcaaagaaataaagactttcatgagacattcaagtccgttcctaaagatgacagactactggatgattttaattgtgggctgaatagagagctgctttaccaggggaaactatacataacagaaacgcatctctgcttcaactccaatgttcttggttggattgctaaagtactgattgcgttcgaagatgtcacgtttatggaaaaaacttctgctgctgggttgttccccagcgcaatatccatcgaaacaaagatgggcaaaactctctttaatggttttatatccagggatgctgcatttggattaatgaaagaagtgtggtcaagaaccttgttgcagaaggacatggccagcgaaaacatcaatactaaagcagaaaagtcaggaaatggcaaagagattgatgatgcaataaactccatcgatgaggaaaacaatgataaagacgctaatgataatgacactaatgaaaatgacgatgaaaatatctctacaaatgagactacccccaatagtacgagttcctcgccggataaagaaaaagagaaagcgtataaactgcgtgccgattcctcgtatcagtatgatggtccaatatatcatcattcaacaagctttccggctgaacctatggccaataacgagtttgttctcaaggagttaccattcgattgtgcacctggtatactttttgagatcatgttcaactcagagcaaaacgaatttcttctagattttttacggggtcaagaaggttcacaaattaccactattccaaatttcacgagcattgacggatcttccatgactttgaagcgtgagtattcatacgagaaagcattgcactttcctgcggggcccaagtccacgacatgttatgttgctgaggtaataaagagaaaagatcctgatacttactatgaggttatcagtagcatacgcactccgaacgtgcccagtggtggtagtttctcaactaagacaaggtatctaatccgttggaatgacgaaataacgtgtctgttacgggtatccttttgggtggaatggactggttccagttggatcaaaggtatggttgaaaatggatgcaagaatggtcaattggaggctgcgcaattaatggagcgtattctttccaagttcatcaagaacaatgtcgaagagtgccaaattactatcagcaaggaggaagaggagcaagatgataaagaagtaaaaaataagttgaaagaggttgaccttgaacaaccaagagaagcggttgttacggctcccgcaattgcagagcagcaaggtctcaaggtcaccatggaaacatggttgttcttatacttgattgtggtcgttttgctattgtttaatctgttctacatacgttcaattgctgtctcattacatcaactggtgaagctgcaattggtagaactgaagttgtga

SEQ ID NO: 4478 - DNA, 2028 bp, Saccharomyces cerevisiae
atgaattttaaaatactcctcccgatttgtgctttattgacacttacaacatttctgttgaccattattgcaactgcgggttctacctcaaattataagccaataacgaacatttatatcggtgatgctgatatatcaaaaatcaacgttacaaaagttatgccacaagttggcccaattttgactgtgttaggttctgctctaaccgctccaaatacaacggtggataccatcttcggcgctcttaaggcaatcgcttctaccgaagccttgtctcctttactgcacttgttgtctaatgctgctaacacttcagccacattatcatctttgacacagttggctccaatggctttgctaggaaccaataccgctactaccacgaccttctccgctcttgatgagttattgactacctctaaaaacacaaccgaactcttggatgggtttagcacattgatgtcatctatgtcaaccaacacttcttctacttcggcttccttagaaaatactgttctaaccctattagtggattcgaccaatcctataggcactactgagtctttgatcactttaaataatatgaccacagaagaaaagacaaaattgtcgcctgtattcgagttattcgcaagttccaagaacattactgccacatgcgatgcgttagaaaccataatgaactctaccattccaacttcaacggtctcctcattgttttctagtctaaaaaccagtcttgcggaaggtggcaatgctactgaaactattatgcaattaggctccctcgttccttcgagtttaaaaccagctgtccaagctgttgttactctgtttgatgaaactacatctcaaaatgtaacattatccgtattgagcactatgattgccgaaaacattacccaatcatcttccgctaaagctgccatgggtgctttgactgacttgttgaattacactacaaaccaaacagagctgctaacatctgtcgaaagtttggccctctctaaagaagccgcttcctctactaaccaattggtggcacttgatgaaatcctttctgcaagtgctaacgcatccacagttgtttccataatccctactttggaatcccaattggccaataacaccgtattacttaagtacgttccatacttgttcagcctattagctgcgtcaagcgaccccgtgtcaagtttctcttctctggttaatatcaccaaatgggcagaaactaatgccgctacatttatgcccatgttgaaaattttaaactctgctgtaaacatgacaactatcacaccagaacaactcaaggaaatgactccttctatccttgaatatctacacatccctgtcatataccgtttgtccattttcacaatgtgtcgtgctcacttaaacagaacaatgtactcgtgtagcaagtcacacgctgttcaaaacatggatttccggtcgattgtttacaacaacattgaaggctcggactttaaaccttatatggatgccctgaacatcggtaaggacgatttgcatttagatggtgaattacaagacagacaacacatgtatgtcccagcagtgaaagcagctttagctatgaacttaatgtgcataatcacatccttcttcttaatggtattcttgttgctactaagtagacgttccgtggtgagtcaaaaattatggttggcattgggctttatttcctgttggatatgtattttcagcgggttgggaagcacaatctttagcgtcatccttaatatgatgaaatccggctccaagaaggacaattacgatgtcattatttctggctcttctccattttatggcctaatgtggtctggatttgtatttgccgtccttgtatttctctgcattgcatactgctggtggagcagcagaaagggagctgccatcgtggaagctgagaaagctgttcaagaaagtgactctactacctcaagaatcattgaagaacacgaaagccccattgatgctgaaaaaaactttgcaaggtaa

SEQ ID NO: 4479 - DNA, 2028 bp, Saccharomyces cerevisiae
atggactacgaggataatctagaagcacctgtttgggacgaactaaatcatgagggagataaaactcagagcctcgtttcaaattcaattgaatcaattggtcaaatatctacaaatgaagaaagaaaagacaatgagcttttagagaccacagcttcatttgcggacaagatagacttggatagtgcgccagaatggaaagaccctggtttgtcggtggctggtaatccgcaactagaggagcatgacaattccaaagctgacgatcttattaattctttagcccctgaacaggatccgattgctgatctcaagaatagcactacacaatttattgcaacaagagaatccggtggcgcattgttcactggaaacgccaactctcccttagtttttgacgatacgatatacgatgctaacacttcaccaaatacttcaaaaagcatctctggaagaagatccggcaaaccacgaattctgtttgattccgccagagctcaaagaaactccaaacgcaaccattctctgaaagcgaagagaacaactgcttccgatgataccatcaaaacaccctttactgatcccttaaagaaagctgaaaaagagaatgaatttgttgaagagccattggacgataggaatgaaaggagagaaaacaatgagggcaagttcacagcttctgttgaaaaaaatatccttgagcaagtggacaggcctttatacaatcttcctcagacaggtgctaatatttcaagtcctgctgaggtcgaggaaaactcagaaaagtttggaaaaaccaagattggctcaaaggtgccaccaaccgaaaaggctgtggctttcaaagttgaagttaaagacccggtcaaagtaggagagctaacatccattcatgtggagtatactgtaatcagtgaatcatcattacttgagctaaaatatgcacaggtaagcaggcgttacagagatttcaggtggctatatcgtcaattgcagaacaaccattggggtaaagtaataccaccaccaccagagaagcaatcagtaggcagttttaaggaaaatttcattgaaaatagaagatttcaaatggaaagcatgttaaaaaaaatatgtcaagatccggttctacaaaaggacaaagattttctactctttttgacaagtgatgactttagttcagagtctaaaaaaagggcatttttgactggatctggcgctattaatgatagcaacgatctgtcagaagtccggataagtgagatacaactactaggtgcagaggatgctgccgaggtcttaaaaaatgggggtatcgacgcggaatcgcacaagggatttatgagtatatcgttttcatcactgcccaagtacaacgaggcagatgaattctttatcgaaaagaaacaaaagattgatgaactggaagataatttaaaaaaattgagcaaatctttggaaatggtcgacacctcaagaaacaccctggctgcatcaacagaagaattctctagtatggtagaaaccctagcgtctttgaacgtgagtgaacctaattcggaactgctgaataattttgctgatgttcataaaagcataaaaagctctcttgagagaagctctttgcaagagactttgacgatgggtgtgatgctggacgactatattaggtcattggcaagcgtaaaagcaattttcaatcagagatccaaattggggtatttcttggtagtaatagaaaatgacatgaataagaaacactcacaattgggcaaattgggtcaaaatattcattcagaaaaattcagagaaatgagaaaggaatttcaaacattggagagaaggtataaccttacaaaaaaacaatggcaagcggtaggagataaaataaaagatgaattccaaggtttctctactgataaaattcgggaattccgaaacggcatggaaatatcactagaagcggccattgaatctcaaaaagaatgcatcgagctttgggagacattctaccaaaccaatctttag

SEQ ID NO: 4480 - DNA, 2028 bp, Saccharomyces cerevisiae
atggtatcagccaacggcgacttgcacttgccaatttctaacgaacagtgcatgccggaaaacaatggatctcttggatttgaggcccccactccgagacagattctcagggttacgttaaatttgaaatacttaattgataaggtcgtacctattgtttacgatcccaatgatattgtttgtgaccattctgagattttatctccaaaagttgtgaagctggcttatgaagcatgtggcgggaaccctaaagacaaggccaacaaaagaaaatatcaatctgtcattattttttcacttcttaaagtttgtgagtggtattccatattggccactatggaagtgcacaatgccaaactttacgaaaccagaaatttagcctcacaacagttatgtaaattgttaattgaaagggaggagacaagagacctgcagtttcttttcatgcagttactgctgcgtcggtacgtaatcaacgagaacgatgaagatcaagaaccgttgaatgccttggaacttgccacagatatgcactgtactacagtgataggatcgagtggatttcagcgttgtttaaaatggatatggagaggatggatagtccaaaatggcttggatcccacaacttttatcaaggacgattcactggcggaagtgtcattgatctctcatttcaaccccgtaagattaaaggcgcctgtataccaaaattatttgcagatgatcttctcatttttgtttctagggctttataccttggtggttaatggtaaggactctgagagagtccaatctttcgatttgttagaaagcatattttatgttttcaatactggtttcatcttggatgagctcactaagctttattatattggttatgcgcacctatcgttttggaatttatttaatgataccacatatttgataatcacgtttgctatggggttccgtgcaatgagcgtaacgccccttaatgcaaaatactcttcagaagattgggataaaatatcatatagagtcttatcctgtgcagcaccatttgtgtggtcgagactcctactataccttgaatcacaaaggtttattgggattatgttggttatcctaaaacatatgatgaaagaatccattgtatttttcttccttctattcttaataatgataggattcactcaaggtttcttaggtttggattccgcagatggtaagagagatatcaccggacccatcctgggtaatttaacaatcaccgttttgggtcttggtagttttgatgttttcgaagaattcgctcccccatatgcggcaatactgtattatggttactattttattgtttcggttatccttttgaatatattaattgctttgtattcgactgcgtaccaaaaagttattgacaatgcagatgacgagtacatggctttgatgtcacaaaagacgttgagatacattagagcacctgatgaagatgtctatgtttctccattgaacttaattgaagtgttcatgacacctatctttcgtattcttccaccgaagcgtgctaaagatttgagctatactgtaatgacaatagtgtacagcccatttttgttgcttatttctgttaaagaaactcgggaggctagaaggataaaatataacaggatgaaaaggttaaacgatgatgccaatgaatatgatactccatgggatttgacagatggctacttggatgatgatgacggtttgttttctgataaccgaaattctggcatgagagccacccagttaaagaattcccgttcgctaaaactgcaaagaacagcagagcaggaagatgtccattttaaagtccctaagaagtggtataaaaacgttaaaaaatgcagtccctccttcgaacagtatgataacgatgacactgaagatgatgctggtgaagataaagatgaagtcaaagagctcactaagaaagtggaaaacttgacagctgtaattaccgatctactcgaaaaattagacataaaggataagaaagagtaa

SEQ ID NO: 4481 - DNA, 2031 bp, Saccharomyces cerevisiae
atgaattttgatgcggtagcagatcaacagatgactgacagaaggtattttgctctcgaagtagcagaaagcgatgatgccgacagctcattaaattcttcatccatgggaagccccgcagtggatgtaggaagaaaagtttacaaaatcacttcgcacaagggttcagcagaagatgagagtcaatccttttttacttcttcagattctccaacatccaaaacaaggcctgtaggtaaaaccatcgaaaacgatgattactatggtaaaagatcttctacaggttcatcgctcaaacaactcttcaataaaattaatattaatgataccgctcactcttcaaacaaagaaaatgtatctcagtcggtgctatcggaaaacaagctgctctctccatctaaaaggttgtcgaagcaaggtcttacaaaggtgactaactccaagtttcgtacacccttgagacctatttcaaaccaatcgactttatcaagggatgagcctgttaaagattttagatcacttaagtttcggagcggtagtgatttcaaatgctggggtgacgagaagacaagttctcatgttcattcatccagtgtgaactcagttaattcctttacttctaccacctcttcttcaaagtggaagttctggaaaaatgataacctattgtcgaggtcgctatcttccagatctgtgaatgaccaagatccgaactttgttcagccaaaaccaaccaattcgttacaaaagaagtcttcaatttcaagttttcacaattctatttttggtggtggcaaacacacagagaagaagaggaattctggatttattatgcccgatcatcagagcacgaaggagctaaaccacaaacattcatcatcgaacctttcctttagaagtttgaagcataaaacatcacattcttcactaaataagctcaaagtaaggcgtaaaggaaatacacaagaactgaatcatccgatcaaaaaaacttgccaaatatcattgcctgttccagaccaagtctcaaaggacaagattcaactgaaattgaaaaattcaacatcattggcatccttatcttcagaagtcactcccataaacactttggactacaatgattcaattttgcaacaaatattacaactttgtgatgttaagtatatattacatgatctacgtgaagctcagtcattaggcttgtttacgttgaatactagatcggttcagctgtctcataacttttggcaaacttatcatagcgatatgcaaacttcactcatttgcaagaaagtatgtctaggggctctaagtgatttgactacttcaaacttgatatccttacatgaattgaaatcattacggttaatacaaggaactagcggtgtcgccaatttactgcaagcttatgttgtgccctcaaatcaatgtgaaaatgaccaaaacttgatactgtacttatttttcaaataccagggaactcctctatcaaggtgctctaacattgattactctcaagcattgtctattttctggcagtgcagcagtattttatatgttgctgaatccaaatttcagctcgaacacaggaatctaactttggaccatattttgatagactctaaagggaatgttactttaattgatatgaagtgctgtcgtttcttgaatatagacaacaataaggcttcctatacaagattagaccatcattatttcttccaaggccgggggactcttcaattcgagatatatgaactgatgagaagcatgctgcctcagccaatatcctgggctacatttgaaccaagaacaaacctattatggttatatcacctaagtagcagcctgctaaaaatggccaaaaaagccgtagtcagcggcgctttgaaccgggaagaaaatatcttaatcgagttgacgcacttactcgatcctgctcgaaaacattccaaaacaattttcaaaaaggaacttgttataagaacttgcggtgatttgttatctttgaagggagaaataatgcagtaa

SEQ ID NO: 4482 - DNA, 2031 bp, Saccharomyces cerevisiae
atgctcagaagacacggattattctggttaaagacatgtccccgtctaaatgttcttctaaatcaatccataccgatacctcatttgcttcatagccgtgatatttgccagcaaagatggtatgcaaaagggaaaagaaggaaccagatttccaagaaagagttaaagcctctcaatttttctattccgaattatatttctgtgaataaattggccaatttgttaaattgtcgtgtggaaagattaatcaaagatttgacagcattaggtttcgaaaatattacaaccacgtatatattatcaaaagaatacgtcgaattgattttacaagaatacaactttgcccttccgaatctgtcaacgtctacaaatttagataatgtttatgatgagctaaaatctcctgtaaacccaaaattattaaccaaaagagcccccgtggtaactataatgggccatgttgatcatggtaagaccactatcatagactatctaaggaaatcttctgttgtggctcaagaacatggtggaatcacgcaacacattggtgcctttcaaataacagctccgaagtctgggaaaaagatcacatttttagacacccctggccatgctgcctttttgaaaatgagagaaagaggtgcaaatattactgatattattgttttggtggtatctgtagaagattctctgatgccccagacattagaagccataaaacatgccaaaaattcaggaaatgaaatgataattgcaataacgaaaatagatagaattccacagccaaaagaacgtgaaaaaaaaattgaaaaagttataaatgatttgattgttcaaggaataccagtagagaaaattggcggagacgttcaagtgatcccgataagtgccaaaactggtgagaacatggaccttttagaggaatcaatagtcctattaagtgaagtaatggatataagagctgaaaactcccctaaaactatcgcagagggttggattatcgaaagtcaagttaaaaaacaggtcggaaatgtggcgaccgtcttggttaagaagggcactttacaaaaagggaaaattctaatttgtggtaatacattctgcaagatcaaaaatttaattgatgataagggcataccgattcttaaggcaacaccatcatatgctacagaggttcttggttggaaagatgtaccccatgttggagatgaggtcattcaggtaaagagcgaagcgatcgctaaaaagttcatcagtaaaaggcaagatcttatcgaagttcaaaaaaactctagtatcgttgaaaaattaaatgaagaaagggcccttgccaaagagcaacacctaaataaggaactggaacatgagaatactgtccaggaacacgaacaaaatactggtcctaaacttattaattacatcatcaaatgtgatgtctctggctcagcagaagcggtttcagaaagcatttcctctctaggaaatgacgaagtgagatgtaatgttatctcttcttctgttggtatacctacggaaagtgacttaaagatggcgcaaataacggagagtacaattctatgcttcaatttggggaatttgccgagtgaggtgatcaacaatcgtgctggcatcaaaataaaacagtacaatgttatctataagctaattgaagacgtcactgaaacactaactgaaaatctaaagcccatctttgaaaaaaagatcgtttcaactgttgacgttcgtgaaacttttgactttaggttaaagaaaaaaattattaggattgcaggttgcaaagtaaacaacggtgtcatcaaaaagaattcattggtgcaggtagttagaggtcctaacgaagatgtaatttttgatgggaaaatctctactttgaagcacaataaagatgacgtagcagaagtttcaaaagggcatgaatgtggaatcacttttgagagtggattcgagggtttcaaaccaggtgataagatcctagtttatgaaaacgtgcgagttcctcgttacttgtaa

SEQ ID NO: 4483 - DNA, 2031 bp, Saccharomyces cerevisiae
atgggtagacggaagattgaaatccagagaatttctgatgacagaaatagggctgtcacgtttataaaacgtaaagctggcctttttaagaaggcccatgaactatccgttctttgtcaagtagacatagccgtcattatactggggtccaataacacgttctatgagttttcctctgtggatacgaatgatttaatctatcactaccaaaatgacaaaaacttgcttcacgaagtgaaagatccttccgattatggagactttcacaaaagtgcatccgttaacataaatcaagacctactcaggtcgtctatgtcaaataagccttcgaaatcaaatgttaaaggaatgaaccagtcagaaaatgatgatgatgagaacaatgatgaggacgacgatgatcatggcaattttgagaggaattcaaatatgcattcgaataaaaaagcctctgataaaaatataccgagtgcacacatgaagttgttatccccgaccgcactcatttcaaagatggatggtagtgagcaaaataaacgtcatcctgagaacgcgctgccgcctttacaacatttgaaaagattgaaaccggatcctttgcaaataagtagaactccgcaacagcaacagcagcaaaatatatcgagaccataccatagtagcatgtacaatcttaaccagccttcatccagttcatcttctccttccacgatggattttccaaaattaccaagctttcaaaactcttcctttaatggtcgtcctccacccatttccatttcaccgaacaagttcagtaagccatttacaaatgcatcctcaaggacccctaaacaggagcacaaaattaacaatagtggcagcaataataatgacaacagcaactacactcagtcaccatctaattctttggaagactctattcagcagactgtcaaagcaagaaggaaattgtccgccagaccggtacttcgtgtgagaattccgaacaacaatttcagcagtaattccgctattccaagtgaaccctcctctgcctcctccacatcggccaacggcaatagtatgggctcttcgcagataatgaaagaaaacaaaacaagtaggtctagcaaaatttctccactatccgcatctgcctcaggccccttaactctccaaaaaggtaataatggcagaatggtaataaaattgccaaatgcaaatgcgcctaacggttctaacaatggtaatggcagtaacaataacaatcacccttatcctttcggaagtgggtcttcacctcttttttctgcaacacagccatacattgccactcccttgcaaccatcgaatattcctggcggacctttccaacaaaatacatcttttttagctcaaagacaaacccagcaataccaacaaatgtctttcaaaaaacagagccaaacagtaccattaactacaacattaaccggacgccccccttcaactttttccggccctgaaaccagcaatggccctccaactggttcactgccatcgaagttcgtacatgatttgatgagtaattctccaaatgtttcttctatatcgatgtttccagactggtcaatgggacccaacagtgccaagccgggaaacacaaacaatcctggtactttccctcccgtacagacggccgtaaacaacggcaactccagcaatatcagcagcactaacaacactaacaacaacaacaacaataacaacaacaacagcagcaacaacaacagcaacaacggcaacgacaataacagtaacaatagcaataacagttactatagtaataatgaagatgcacccgtaaatggagctgctatttcagaacatactaccgatggtgactcgaacaatcagtccaactcaagtacatatgatgctgctgccaccgcatataatggaaataccgggctgactccatacataaatactgctcaaacaccactaggcactaaattctttaatttttcgactgatatttcaggagaaaaaaattcaagcaaaatataa

SEQ ID NO: 4484 - DNA, 2031 bp, Saccharomyces cerevisiae
atgtctacaaatatattgcaacatgttaagcaattgctccataacagagatgtatttagcttttttcacaacaagactggaaatcttaattacctagataacacaactcagaaaccggaagtttttgtaagtccaaattctacaatagtttcagccccaactttggactcttttcaagcattgatggagaaaggtaacttcaccactttgcaactagctaaggtaggaattagaatgtttttctcctattcggtaagtaagtatgctgttctatgttttagtaccgccattattttgaataggttgactgtaatgtcttcattgagatcaaattctacaaacattcgtttacctctttggtcaaaaactttgctccatttagtagccactctttcactggttaaagcacttttacaaattctgagtcaatttggactcatgcatgaactgcacgtgagtgatacagatttttatgctttaagtgtctatttatttgtagctctgtctgactgcattgaaatttttatttcttcaacgacgaacgttccttcattaatatgctctgatttttccatatggggtttatcattgaatctttatatcatatccaaaatgcccgcggggcagcagcatattggcgataatgttgaactactaggagcggtttttcacagattagtaattcatttggtagaattgtttcatataagagcctatagattatgtggagaagttatattaaacgcgggtttttttaccgcattcgtcactaggacctatttgaacggattagattttattaacatctgtctcattcacaattatttccctggctttttctatatttccaccatattactggcgtctataggcattttcctgaaggctttgttcaccagtaatccgttccgatcattatattcaagatataaaaacttggaaaaatggtggagatcaaataattacaatggagaagaggagtttaacgaaatagctctttcattgtgtctacttttaacgtcgaatgactataaaatatttaagaaatcagacaacgtaaaatccgttgatgaagtcgctgctttcagtaatagttatgtggttagtggacatttaaaccaactccagtcgacaccagaggatctgttatctcgtaaggaaatgactaccgattcccagttaccaggttttgcgaggacatatttaggcctttttgaattagtaagaaccattattttgacgtattctagactcctaaaaaatcttctgtggagtaaaaattttgagagcagtatagataagaaaccgagagtgggaaagcgtaaaaagagggatttaaacaaatatgttacagaaaaaaactataaaaagtttttatataaaccggacgtcaaagagcttaatattgagagtgatctcagaagcctggagttattgcttcctgaagacgattcatcaaaagactactttccccccagaaaaatcgatgaaagtgtttcagatgaagagtttgatagtgatatggaaagtcagttgattattgatgaagaaaaagaattaacacatttatcaagtaatgctgtcgattctgatgatttagaggaaatagcctggaacatctccatgtggtctattttaaattatgaaatggatgtccataataaggttaatggaccgttgactagatcacaatatggtaaaagaaacccacaaggtgtactagtcgatgttgttattgaacgccttctgcatcatacaaactccaggtatatgtacaaacgtttaaatatgaaggacgatgacaaattagagttcaagtttgattttgcctttgatagttgcgacgaagtggaggaaatggatctctcctgcctaatctgcaaagttaataaaagaaatattgtaacttggccctgtagatgccttgcattatgcgatgattgtaggatatctctgggttataaaggatttgctacatgcgtcagctgtgatagtgaggtgaagggttacagtaagttgaatatagtctag

SEQ ID NO: 4485 - DNA, 2031 bp, Saccharomyces cerevisiae
atgtctgactcctcagaagccactgtaaagagaccccttgatgctcacgtaggaccttccgaaaatgctgcaaagaagttgaaaattgagcaacgtactcaggcagatggtattcacgaagcagatgtcggtattactttgttcttatctccagaattgccaggatttagaggccaaattaagcagcgttatactgactttttggtcaacgaaatagatcaagaaggtaaggtcattcacttaactgataaaggatttaaaatgccaaagaaaccacaacgctctaaagaagaggtcaatgcagaaaaggagtctgaagcagctagaagacaagaattcaacgtcgaccccgaattaagaaatcaattggtggagatatttggtgaggaagatgtattgaaaatagaatccgtttatcgcacggctaataaaatggaaacggcaaaaaatttcgaagataaatctgttagaactaaaattcaccaactgttacgtgaggcatttaaaaatgaattagaatctgtgactactgatactaacacttttaagattgcaagatcaaatagaaattcaagaaccaataaacaagagaaaattaaccaaaccagggacgctaacggtgtagaaaattggggatatggtcccagtaaagattttattcacttcactctacataaagaaaataaggatactatggaagctgtcaatgttataacaaagttgttaagagttccaagccgtgtaattagatatgcaggtactaaggatcgtagagcagtaacgtgccaaagggtttcgatttcaaagattggtttggatagactaaatgctttaaataggactttaaaaggaatgattatcggaaattacaatttttcggatgcaagtttgaatctgggagacttgaagggaaatgagttcgttgttgttattagagatgttaccaccggcaatagtgaggtatcactggaagaaattgtgtctaacggctgtaagtctttatcagaaaatgggtttatcaattattttggtatgcagagattcggtacattcagtatttctacgcacacaattggtagagaattgctcctttcaaactggaagaaggctgctgagttgattttatctgaccaggataacgtgcttcctaaatctaaggaagctaggaagatttgggcagaaactaaggacgcggctttagcattgaagcagatgccaagacagtgtctcgcagaaaatgcgttactatattctttatctaatcaaagaaaagaagaagatggaacttattctgagaacgcttattatactgctattatgaaaattcccagaaatttgagaactatgtatgtacatgcctaccaaagttacgtctggaattctattgctagtaagcggatagaactacatggtttgaagttagttgtaggtgaccttgtcattgatactagtgaaaagtcaccactaatttctgggattgacgatgaagactttgatgaagatgtccgtgaagctcagttcattcgtgcaaaagcagtaactcaagaggatatcgactcagttaagtataccatggaagatgtcgtgttaccatcgccgggttttgatgtgctttatccttccaacgaagaattgaagcaactgtatgtggatatattgaaagcagataatatggacccatttaatatgagaagaaaagttcgcgatttttcattggctggctcttatagaactgttattcaaaagccaaagagtttagagtatagaataattcactatgatgatccttctcaacaattggtgaacactgatttggacatcctgaataacaccagagcaaaagaaagcggccagaagtatatgaaagccaagttggacagatatatgccagataaaggcggtgagaagactgcggtggtgttaaaatttcaattaggaacctccgcatatgccaccatggcattacgtgaactcatgaagcttgagacttctcgccgtggcgacatgtgtgatgttaaggagaatatctaa

SEQ ID NO: 4486 - DNA, 2034 bp, Saccharomyces cerevisiae
atgcattcctggcgaatatccaagtttaagttaggaaggtccaaagaagatgatgggagtagtgaagatgaaaatgaaaaatcgtggggtaatggcctgtttcatttccaccatggagaaaaacatcacgatggtagcccgaagaatcataatcatgaacacgaacaccatataagaaagatcaatacaaatgagactctcccaagttccttaagttctccaaaattacgtaatgatgcatccttcaagaatccatcggggataggaaatgacaattctaaggcttccgaaaggaaagctagtcagtcgtctactgagacgcagggaccgagttcggaatccggactaatgacagtgaaggtgtattctggtaaagattttactcttcccttccctatcacctctaactctactattttacaaaaactactaagttccggcatccttacttcatcatccaatgacgcttccgaagttgcagccataatgcggcagctaccacgatacaagagagtggatcaagattcagcaggggaaggcttgatagatagagcttttgccactaaattcattccttcctctatattgttacctgggtcaacaaattcaagcccattactttattttacaattgaatttgataattctattactactattagtccagatatgggaacgatggagcaaccagtgtttaacaaaatatcgacatttgatgtaacaagaaaattacgatttttaaaaatcgatgtctttgcaaggattccatccctacttttaccctctaaaaactggcaacaggagattggcgagcaggacgaagtactgaaggagattttaaaaaaaatcaatacaaatcaggatatccatttggactccttccatttacctttgaatttaaaaatcgattctgcagcccaaataagactatacaatcaccattggatttctttagaaaggggatatggtaaattaaatatcacggtggactacaaaccttctaagaacaagcctctctccattgatgactttgatctattgaaggttatcgggaagggttcgttcggcaaagtgatgcaagtaaggaaaaaagatacccaaaagatttacgctttgaaggctctgagaaaagcatatattgtatcgaaatgtgaagtgacacatactttagcggagaggactgtcctagcaagagttgactgcccctttattgttccgttgaagttctcattccaatctccggagaagttgtacctagtattagctttcattaatggcggtgaactgttctaccatttacaacacgagggacgattcagtctagcacgctcccgtttttatattgcagaactattatgtgctctcgattcattacacaaacttgacgtcatttatcgtgacctaaagcctgaaaacattctattggattaccaaggacatattgcactgtgtgattttgggctttgcaagctgaacatgaaggataatgacaaaacagacactttctgtggtactcccgaatatttggcaccagaaatcttgttggggcagggctatactaaaacagttgactggtggacattaggtatcttactgtatgagatgatgacagggctgccaccatactatgatgagaacgttcctgttatgtacaagaaaattctgcagcaaccgctactatttcctgatggatttgaccctgcggcaaaagacctattaattggcctcttaagcagagacccaagcagaagactcggcgttaacggtacagatgaaattcgtaaccatcctttctttaaagacatctcatggaaaaagctacttttgaagggctatattccgccttacaagccaattgtaaagagtgaaatagatactgcaaattttgatcaagagttcactaaggaaaaaccgatcgatagtgtagtggacgagtacttaagtgcaagtattcaaaagcagtttggtgggtggacgtacattggtgacgaacagttgggtgattctccttcgcaggggagaagcattagttag

SEQ ID NO: 4487 - DNA, 2034 bp, Saccharomyces cerevisiae
atgtccagctctacgactcctgatttactatatccctctgcggacaaagtcgcagagcctagtgacaatatacatggagatgaactacgacttagagaaaggattaaagacaatcccacgaatattttatcatacttccagcttattcaatatttggaaactcaagagtcatacgctaaggtgagagaagtatacgagcaatttcataacacattcccgttttattcacctgcgtggactttgcaactaaagggtgaattggcaagagatgaatttgagactgttgagaagattttggctcaatgtctttctggcaagttggaaaataatgacctatctctttggtcaacatatttggactacatacgcagaaaaaacaacttaattactggtggacaagaggcgagagctgttattgtcaaggcattccaactagttatgcaaaagtgtgcaatttttgaacccaaatcatcttctttttggaacgaatatctcaattttttagagcagtggaagccattcaacaaatgggaggagcaacagcgaattgacatgctcagagaattctacaagaaaatgctatgtgttccttttgataatctagaaaaaatgtggaatagatacactcaatgggaacaagaaataaattccctaacagccagaaaatttattggcgagttatcagccgaatacatgaaagcccgttccttataccaggaatggttgaacgttactaatggattgaaaagggcatctccaattaatctgcgcacagcaaacaagaaaaacataccacaaccaggtacctcagactcaaacattcagcagttacagatttggttgaattggataaaatgggaaagggagaataagttgatgcttagtgaagatatgctatcacaaagaatcagttacgtttataaacaaggtattcaatacatgatattttctgctgaaatgtggtacgattattcaatgtatatatctgaaaattcggatcgacaaaatatcttatatactgcgttattagctaatcccgactcaccttctcttacattcaagttatccgaatgctacgaactggataatgattctgaaagtgtttctaactgttttgacaagtgcactcaaactttactatcgcagtataaaaagatcgcctccgatgtaaattcgggtgaagataataacacagagtatgaacaagagctgctatacaaacagagggaaaaattaacattcgtgttttgcgtgtatatgaatacgatgaaaagaatatcaggactatccgcagcacgtactgtatttggtaaatgtcgtaaactgaagcgtatattaacacatgacgtctacgtggaaaatgcatatttagaatttcaaaatcaaaacgattataagactgcttttaaggttttagaattgggtttaaaatacttccaaaacgatggagtttatatcaacaaatacttagattttttaatatttttaaataaggattcgcagatcaaaaccttatttgaaacatcagtggaaaaagtgcaagatttaacccagctgaaggaaatatacaagaaaatgataagttatgaatcgaaattcggtaacttaaacaacgtttattctctagagaaaagatttttcgaacggttcccccaagaaaatttgattgaagttttcacaagtcgttatcaaattcaaaactccaacttaataaagaaattagagttaacttatatgtataatgaggaagaagacagttacttttcttctggaaacggggatggccatcatggctcttacaatatgagttcgtcagatagaaagagactaatggaggaaactggaaacaatggaaacttctccaataagaaattcaaaagagactcagagcttccaacagaggttcttgatttattgagcgttataccaaaacgtcaatattttaatacaaatttactcgatgcgcagaaattggtgaattttttaaatgatcaagtagagattccaacagttgagagcaccaagtcaggttaa

SEQ ID NO: 4488 - DNA, 2034 bp, Saccharomyces cerevisiae
atgtttaagacttcatataacttgtacgatttgaactatccgaaaaatgattcattaacgccaataagagactacaaaaatgactattttcataaaaatgatgacaaattaccagaaattgttagaaaacctacgagaaagttatcgaaacatgaaaacaaactcaacgataaaaaattcacgaataaacgaccagcaagtctggacttgcattctatagtggagagcctgagcaataaaaaaatttactctcctattaacacagagatatttcaaaatgtcgtgagactgaatttgagccctcagattcccaattctcctcacgagggatgcaaattttataaaatcgtacaggagttttacctctctgaagtggaatattacaataatttgttaaccgcaaataacgtatacagaaaggcattgaatagtgatccaagattcaagaataaacttgtcaagcttgattcaagtgacgagctattgctttttgggaacattgacactattgcgtcaatcagcaaaatactggtaacggcaataaaagacctacttttagccaagcaacgtgggaaaatgttggatgcgaatgaatggcaaaagatattcaccaaaaatgaggtacaacagcagctatattcaacttttgatatttcagaggcgttcgagcaacatttgttaagaatcaaatccacctacacaagctattttgttagccaccaaaaacaaatggaactatttactacattaaggatgaataagaatcatttttttaacaagtggtatgaatattgtttaaaagagagtggatgtataaagttagaggacatattgaaaagcccgatgaaaagactgactcagtggattgatactttggaaactttggaaagctgttacgaagatattctttcgccagaattgggcttgaaactaagcccgacaagaagaaaatattctttattttccaataagttagaaaccgaggtctccgagtataagagtaattccatgtataatttcagtttaaccccatcagagattatacaaagttatgatgaagatcagtttacacaccttttaaaacccccagacaaacaaaataaaaatatatgtaatgcatctcgacaagagagtaatttggataatagtagagttccttctcttctttctggatcatcgagttactactcagatgtatcagggctagaaattgtcactaatacttcaactgcctcagctgagatgataaatctaaaaatggatgaagaaacagaattttttacattggcagatcacatcagtaaattcaagaaagtaatgaaaggtttgttagaattaaaaaagaatttattgaaaaacgatctgtcaggcattattgatatcagtttaagaagaataaatgcatggaaaaaggtgatcgagtgcgaacgcccttctggtgcattttttgcgcacgataacttaatatcgaccatgtgttcttcgtacatagataaactgcatgaacaaaaaaatcaagtaacaattttgaaactcacagagctcgaaacagatgtgatgaacccacttgaaagaatcatagcccattgtactaccgttaaaagcaaactaaaagatttgcaagctttgaagaaagattacatgttatttttacaagaaaaaaaagcaaatgtgcgagatattaaacgtgacttgttgggaatgcatttccaaaacctgcaaaaccagatgaaaagggaattaccggtctttattactttgatccacgatactatcgaatgtatcttgttgaactatatcaaagtcttcttaaaatatttggaaatcattgctggtggaaaaaaatacctgcaaaaagatcttgaaaatatgtctcttaatgactctatagctaccggccaaattaaaaatcttgatattttgcagtgttattctaaatcacgatatatgacaaaacgcatggtaagaaaagattggcctttccctggagaccctagtggaagccgtgttgtcagaaaacttttcgaactttaa

SEQ ID NO: 4489 - DNA, 2037 bp, Saccharomyces cerevisiae
atgcactctcatagacaaaagtggggccgccagacggatatagcgagggtgctcgacgatatagaacacgacctctatctaccgcaacggctatcactcgatggtgcaactggtactgacgaatcacatgtgcaatacggtatagtcaaagactgctctgtgcttacgtgtggctgctgtatatctgaatcgctattcaatgatttatgcagggaaacttcgaacaagcaaactgcgtgtcccatctgtcagcgagaaaatgttcgactactttcagccatcaagccgctgcgagatttggctcgtcagattgacttcttcagaagtactaccggacagggcgaaagcgaaagcgatgagctccccgctatagtaaagacttcaccatcatcatcatcactatcgctaacgccatcgcgctcttcctccactgctgggctagaagctgataacaagacactatcagaccctacagttaaggagaaatcatcactgctcgaactcttccatattgtggcttcgaagatgcataatgcgaatacagaggtagggtcggaccacccactcacgactggcaccacccgtgatcaagaagaacacaccactaaggagaattactcaagcagcttactcgagcccaactatgacgaccacgcgaactggaaaatcctggataatgcctcgaacacaagaactgtgccgatagataacaacttctctttgatgtctacggacgttacaataccttccacagcaaactaccaaacaaatagtgcacatgatctggacgaagaaaaggagtacttttttgccaactgtttccccatgtacagaaaaaaatttcagttcaacacacaccccaaattcctagggacgaaatccaaattattcatcaaccaaagcatttctcccgattgcaccaaatttgctctaattactgaacacaagtgggaaatttattcgattaatccgaaggacaactctcctcaactagtatcatgtggcaagtctagtggagaatatggtcccaacttcaaccaactaacagagcaatcgtcatcttcactctccactacttctcaagcgtcaaaaaagaaaaagaaaaactggagccaacgtttttgcaaactttccaatgatttcttgataatatcgggttcgcaaaacattcttaatgtacacgacatacaccaaaacggcaaactcatctatacctacgtgtcgagattccccatccgatgcatagacatagatccaaggtcgcagataatagcctacggaatcaccggaaaggatagacatacaggcgcggaacaagcattagtcgtgatccaacaaattaccagaaataaagtgactttggagcccgagttccccccaccaatcaccataacacttccatacagagatcccatcaataccatacaactttcgcacgacgccaagtatctgacatgttcgaccgcgctagagtcgcggttcttgatcatatctttgcagaaaataaacgaaccaagactgataatgaaaagtgttcggtccatagacacttccttagaatctgaaggtatcactgacacaaaacttttcccaggaaatccaaatctgatgtgtatcacatcaacagcattcaattcatctccactggtcataaacaccaaaatcacccaaattaacggtgtacggaccgtggcacaaccatccatgcttataagggtagatgagattggatgcaagattcacaagtgcgaaatatcaccaagaaacgacgcaattgccttcctcgaccgcaacggatcagtttacatcatgtgtgcccccaccatgatggacaacaacgaaaaaagaaggacaatcctcgttgaaaccgtggcaaatgcctacagggcttatgaatcagctactttgcggtttaacccagagggcaacaagctttatattctcgacagaaaggggactttctttgtggaagactttgcatatggcttgccccaatctcgcgaaatcaccaaatgtaagcaaatattccacaaataa

SEQ ID NO: 4490 - DNA, 2037 bp, Saccharomyces cerevisiae
atgggactcttagctttgggcacgcctttgcagtggtttgagtctaggacgtacaatgaacacataagggatgaaggtatcgagcagttgttgtatattttccaagctgctggtaaaagagacaatgaccctcttttttggggagacgagcttgagtacatggttgtagattttgatgataaggagagaaattctatgctcgacgtttgccatgacaagatactcactgagcttaatatggaggattcgtccctttgtgaggctaacgatgtgagttttcaccctgagtatggccggtatatgttagaggcaacaccagcttctccatatttgaattacgtgggtagttacgttgaggttaacatgcaaaaaagacgtgccattgcagaatataagctatctgaatatgcgagacaagatagtaaaaataacttgcatgtgggctccaggtctgtccctttgacgctgactgtcttcccgaggatgggatgccccgactttattaacattaaggatccgtggaatcataaaaatgccgcttccaggtctctgtttttacccgatgaagtcattaacagacatgtcaggtttcctaacttgacagcatccatcaggaccaggcgtggtgaaaaagtttgcatgaatgttcccatgtataaagatatagctactccagaaacggatgactccatctacgatcgagattggtttttaccagaagacaaagaggcgaaactggcttccaaaccgggtttcatttatatggattccatgggttttggcatgggctgttcgtgcttacaagtgacctttcaggcacccaatatcaacaaggcacgttacctgtacgatgcattagtgaattttgcacctataatgctagccttctctgccgctgcgcctgcttttaaaggttggctagccgaccaagatgttcgttggaatgtgatatctggtgcggtggacgaccgtactccgaaggaaagaggtgttgcgccattactacccaaatacaacaagaacggatttggaggcattgccaaagacgtacaagataaagtccttgaaataccaaagtcaagatatagttcggttgatcttttcttgggtgggtcgaaatttttcaataggacttataacgacacaaatgtacctattaatgaaaaagtattaggacgactactagagaatgataaggcgccactggactatgatcttgctaaacattttgcgcatctctacataagagatccagtatctacattcgaagaactgttgaatcaggacaacaaaacgtcttcaaatcactttgaaaacatccaaagtacaaattggcagacattacgttttaaaccccccacacaacaagcaaccccggacaaaaaggattctcctggttggagagtggaattcagaccatttgaagtgcaactattagattttgagaacgctgcgtattccgtgctcatatacttgattgtcgatagcattttgaccttttccgataatattaacgcatatattcatatgtccaaagtatgggaaaatatgaagatagcccatcacagagatgctatcctatttgaaaaatttcattggaaaaaatcatttcgcaacgacaccgatgtggaaactgaagattattctataagcgagattttccataatccagagaatggtatatttcctcaatttgttacgccaatcctatgccaaaaagggtttgtaaccaaagattggaaagaattaaagcattcttccaaacacgagagactatactattatttaaagctaatttctgatagagcaagcggtgaattgccaacaacagcaaaattctttagaaattttgtactacaacatccagattacaaacatgattcaaaaatttcaaagtcgatcaattatgatttgctttctacgtgtgatagacttacccatttagacgattcaaaaggtgaattgacatcctttttaggagctgaaattgcagaatatgtaaaaaaaaataagccttcaatagaaagcaaatgttaa

SEQ ID NO: 4491 - DNA, 2037 bp, Saccharomyces cerevisiae
atgggtgtgcattttgatgataatgctaacacaacgtgggaagccacagaccctggcgtttcaagtgattgcgatggacagcaccgtgtgactgagtctatacaactgcagaacttttccaatacagacatggaaagtatgcttgatgaagaagggagagaaaacagtaagtcaaaatggttactattaaaaaggaaacatcctatacaaaagtttattgaaagagtttggaatggccctgttgagccaagtgacgaaccgcctagctttcctaaacgttggggatggctgaagaagatagatgattttccgcagactacattcaaaactaaaataccaagtaagttgatacgactgttgctactgattgtgtactgctgcttttggatgcgcattttttattctctcatatacccctatcttatcaagccgccatacttccatccaaatgatggctcagaaaagattcctatattgtctttaagttgcaattcctacttgaactgggagggtaccaataacgaatgtggtttaaatgctaaaaactgcggtccacttgataataaagaatacatgatcagatgtccagcactgtgtgatagaggtggatggacatactccgccattgccgtagggaataggagagtcaaatatacagggtatgaaattggcggaggtgccctgtttagcgaagaagacccgatggtcgtgtcctacccttatagaagtgactcgtttccatgcgcctctgcagtacatgcaggtgttatctcaccattttacggtggctgtaccaaagtttctatgcaaggggcccaaaattcttttccatcaaaaaaaggaatgtataacactgggttttcagtagcattcaattcattttttcccggttcatattcattcagagatatacaaggcggtatcctgtcgggctgttatgatcctcgagcagctgtggtcgcattgaatatgctttttggactgccaatattttatttgtatgacagtatttacgggtactggataaacacgatagtgggctattggactcttgtattatctctagaccctccattactaacggatgcacatgacccagctagcgtgtatgagcttttcagtgtgggatttcaaagacttttacctttatgctttgttttatacgtcgtttggaagagtgcggtgaaaagaacactagaaaatggatcgcccatagcaaaagtaatactttggtaccccacattttggttgggaatctcaaataatgtcacatttgaccgattacctgttgatagacttacgacgacggatttgaaagagcaggctggagcactgactgctgtgggatctattgcagccactattcttacatgcgcagttatacaggcttattcactctggaaatcaggaagattcaaaaagtattttaaaatatacatttgtttcattggcggattaatagctttgggatctttgccgggactgaacttgaggatacatcactacatcttaggttctatactggttccaggctgtgccacgagaggatcatctgcatatctgttccaaggaattttagtcgggttaattctgtctggtgtagcaagatgggattttgcaagcatagttgagacagatacggccttgttaagaggagaagcaggtgcttctttgaagccacctatactggattttaacgacgatcaaaaccattctctgtcgtggcatctaaatgcaactgatccagtaattgatcaaataggaaacatcgacggtttttcattacttttgaacgatgtggaagtgtacgtaggcaagaatgagactgtgagtatcgatgttcttcggatggagaatccagcacttgctcaaatgatggacgatgctcttgatgcctctaacgggacaatagacttgtatttaagagtggctcgtgcctctgtacggtctccaacgaatagaggtgactatacgaatgcaggagttttacagtggccgaacggaatgtggcaaaagcctgaaccaggcgtatcataa

SEQ ID NO: 4492 - DNA, 2037 bp, Saccharomyces cerevisiae
atgtcattcagcaacggaaatatggcttcctacatgactagtagtaatggagaggagcaaagtataaacaacaaaaacgatatagacgataacagcgcttacagacgtaataatttcaggaatagtagcaattcaggatcacatacgttccaattatcggacttggacttagatgtggatatgaggatggattccgccaattcatcggagaaaatatcaaagaacctttcctctggcatcccggactcatttgattctaacgtgaacagcttgctgtctccgtcaagcggttcttattctgcagatttgaattaccaaagtctatacaaaccagatcttccacagcaacagttacaacagcaacagttacaacagcaacagcaacagcaacagcaacaacaacagcaacagcagaagcaaacaccaactttaaaagtcgaacaatctgatacatttcagtgggacgatatcttaacacctgctgataatcaacatcggccatccctcacaaaccagtttttatctccaagatctaattacgatggtaccactaggagctcgggcattgactccaattatagcgatacagaatcaaactatcatacgccttatttgtatccacaggacttagtttcttcacctgcgatgtctcacttaaccgcgaataacgatgattttgacgatcttttgagcgtcgcatctatgaactcaaattatttactgcccgtaaattcacatggttataaacatatttcaaaccttgatgagttggatgacttgctatctttaacatattcagacaataaccttttatcagcatcaaacaacagtgatttcaacaacagtaataacggaattattaataccgctgacactcaaaacagtaccattgccattaataaaagtaaagtcggtactaaccaaaagatgttattgactattccaacttcttccacaccttctccttccactcatgctgccccggtaacacccatcatttctatacaggaattcaatgagggacacttcccagttaaaaacgaagatgacggaacgttacaactaaaagttcgggataacgaaagttatagcgctactaacaataacaatctacttcgtccagatgataatgattacaacaacgaagctctcagtgatattgaccgctccttcgaagatatcattaacggtcgaaaattgaaacttaaaaaatcaagaagaagatcttctcaaacttccaataatagtttcactagcaggagatcctcgagatcaagaagcatatctcccgatgaaaaagctaaatctataagtgcaaatagggaaaagttattggagatggcagatcttttaccatccagtgaaaatgacaataatcgggagcgctatgacaatgatagcaaaactagctataacaccattaacagtagcaattttaatgaggataataataataacaatttgttaacaagtaaaccaaaaattgaatcgggcattgtcaatattaaaaatgaactagatgacactagcaaagatcttggcatacttctagacatagatagcttgggccaatttgagcagaaagttggtttcaaaaatgatgataatcacgaaaataacgataatggcacattttctgttaagaaaaatgacaatctagaaaaactagacagtgtaacaaataataggaaaaatcctgcgaattttgcttgtgatgtatgtggtaagaagtttacaagaccttataacttaaagtcacacttaagaacgcatacaaatgaaaggccatttatttgttctatttgtggtaaggcgtttgcacgtcaacatgatagaaagagacacgaagatttgcatacaggtaagaaaaggtatgtatgcggtggtaagctgaaggacggtaaaccctggggttgtggcaaaaagtttgcaagaagtgatgctcttggtaggcattttaaaactgaaagtggtagaagatgcatcactcccttgtacgaagaagccagacaggagaaatcgggacaagagagttaa

SEQ ID NO: 4493 - DNA, 2040 bp, Saccharomyces cerevisiae
atgaatattgtcaaattacaagtatgtatgcctttctcgaattcccacactgctgagcacagtgaaaaagttttttctaccttttaggttgtaataaacgtttcatatactaacaaactcttctgcgattagagaaaatttccaattttgactcaagaggatcttttttccacaattgaaaagttcagagccattgacttagatgataaaggatgggttgaaaaacagcaagctctagaagcggtgtccaaagatggtgatgctacttatgacgaagcaagagaaaccctgaagcatgtgggtgtggatgcgtcaggccgtgttgaactggacgattacgtcgggttggttgcaaaattaagagaatctaaaacaggagctgctccacagaccactttcaacgtagcacctaactcaacccctattgtttccactgctgccacaggactacagcacaagggtaagggtactcaagccaagattattgttgctggctcccaaacaggtactacacataccatcaatgaagaagaaagacgtgaatttactaaacatatcaatagcgtcttggcgggagaccaagatataggtgatttgcttccatttcctactgatactttccaattatttgatgaatgtagggatgggttggtgctatctaagttgatcaacgactctgttcctgatactatcgatacaagagttttgaattggcctaagaagggtaaggaattgaataattttcaggctagtgaaaatgctaatattgttattaattctgcaaaagccattggttgtgtcgttgttaatgttcattccgaggacattattgaaggtagagagcatttgatcctgggtttgatttggcaaattattaggagaggtttgttaagtaaaattgatattaagctgcatcctgagttataccgtctattggaggatgatgaaacgttggagcaatttttgaggttgcctccggagcaaattctactacgttggtttaactaccatttgaagcaagcaaactggaacagaagggttaccaatttttcaaaagacgtgtctgatggtgaaaactatactatcttgttgaaccagttggaccccgccttgtgttctaaggcaccattacaaaccacagatttaatggagagagctgagcaagttttacaaaatgctgaaaagctagattgtagaaagtatttaaccccaagttcattagttgcggggaaccctaaattaaacctggctttcgtggcacatctattcaatacacatcctggattagagcctattcaggaagaggaaaagcctgaaattgaagaatttgacgccgaaggtgagagagaggcaagagtctttaccttatggttgaactctcttgacgttgatccacctgtcatttcgctgtttgatgatttgaaggatggtttgatattattgcaagcttacgaaaaggtgatgcccggtgctgttgattttaaacatgtcaacaaaagaccggcctcgggtgcagagatatccagattcaaagccttagaaaacaccaactatgcagtcgacttgggcagagccaaaggattttctttggttggtatcgaaggatctgatattgtagatggtaacaaattactgaccttagggttagtgtggcaattgatgcgtagaaatatttcgataaccatgaagacattatcctcaagtggtagagacatgagtgattctcaaatattaaagtgggcccaagaccaggtaactaaaggtggtaaaaactctaccattagatcatttaaggaccaagctttatcaaacgcccacttcttattggatgttctgaatggtatcgcgccgggctatgttgattatgatctagtcacccctggtaacaccgaggaagaaaggtacgcaaacgcaagattggctatttctattgctagaaagttgggtgctttgatttggttggtgccagaagatatcaacgaagttcgtgcaagattaattattacttttatcgcttcgttaatgactttgaacaaatga

SEQ ID NO: 4494 - DNA, 2040 bp, Saccharomyces cerevisiae
atgcacgacaagaagtcgcccatggcgaattcccactacttgaaaaatctaaaacagcagtttcgcaacaagaaccttatcgaaacgactatccatctagtaaagtgcaatgaccatgactcattggcctttttagcaagaacatacggggttccaccacagttgcgacacgtcgtgtggccgatcctgctgaagtaccacccaatgtgcatttcaccaaacattacctccaataccatttcttgggacccaataaccaatgatttcatacttaatgacccttttctgaaaagtaaggctccaaccgataagcaagacaagagcgacgatgaaaatattctcccgtacgatatcgaatccattatcctgcatgatttgaaaaaatacttccactccaggtctaatcctgctggctcatcgagtaatgctaacaccaccaatatcgccaccccgacacctgtttcgtcgtccgacgcttccactatttcttctatggaggtactgtctccctcattagactatgagttccagatcatcgagactttgaaaaatgccatcgtgaaatttctgctgaagtggtcaaaaatcttcaagtacgaaagcggtcttgcctggattgctctgggattggctgaatggtatcccatctatccctacgaaaccatgtctcctttcaacgagactcattcattttacgaagtggaggattatgtagttctgagcggaagaaagcacgctcttctaagcactaacaacggcaataacggaaatagcaactcctctagcaacaacaccaacaacaataacacgaatataacatcgggcatgcacaacttgagcatcaacacaaataccagcttgcacaattctccgtacatttctcacacgttatcatatctttataaggaatatccgttaccctttgagctgcgatcaaaattgcctacaaaaccaattttctcatttagtgcccttttcgaaagactagctcttgtcattctacattgccctgataccatactggcacacaaacaattgaaaaatgactcgaacgcatcttccagctcaaaggcaaactcaaacttcaacacaaattatttccctattatatctggtggcgatctttcatttcagacccaagtttttttcaaggtattctcttcaattttgccagagctgtaccaacctttgacagaggaatcttccttacaaccttcgtcgtcaagaaactcctggatatattggtggttgaaatgctctggagctaaagctttacaaagacaagatagagggcgtgtatgggatttgctgctcggttggaggcccaaaccaaacatggacacgataaatttctttttgaactataacgataagaaaatggatcacctctatcacgatacaccacaatgtgacaacgagcagtactggatgaaagattggatcgctttgtacaataatgatccgttttggttccccgatctggatagcatggcactaggttcgaaaaaatttccctatgattatagtgtcttcaaagaattaattttaaggaatagatacggaggtactcaaagcaaagctcaaaaggacaacacagtaccatctcctggtagtgattcaaatgataagtcagaattgaaactaccgttttcttccattgatcctcatatgcaattgattttcattttcatcgcgattttgcagtttaacgaatttaagctattagaatttgaagaagcggaaatttctgagtttcttaataacgttcctctgctaacaaaatttgatgactcttcctataggaagttatacgagaatacagaatctagcataaccagtttgccttcttcaccgactacttctacaatggcgtcattacaatccagttccaattcgagtgcccatatctcgaattatcacatgttaatcgaagtcggtaatgatgctaaggcttcccattgttttgatgatcttttaaatatggctggggatatttggaggaaatggctatggagagagttagaggaaagctctctttga

SEQ ID NO: 4495 - DNA, 2040 bp, Saccharomyces cerevisiae
atgccatcggaagttacgccaaaagtacctgagaggccctcaaggaggaagacatctgagctgtttccgttatccggctctgaatcaggagatattaaagctaatagcgagccaccaacaccagcaggaacgcccaatgtaccaacacgtagacccatacttaaagcaaagacgatgacttcgtttgagagtggtatggatcaagagagtttgcccaaggtaccattgcagaggccagttagacgctccactactgaagaactaaataatgtaatgaataacaccagtaaggagttagaggagattgaaagtttgatttcaaagcacaatatacacaatgtttccaggaaaaaaagtccaacttctgtggaagagggaaaggtggccgccattcatcaaaacgggcaaagaagtgcatcagataacaaaacttctacaaatccctccccactcgaaaaaaatgagcacgagggtgctgagggcaatgagtctgctatttcaccttctaatttagttaacaagtctaataatgaagtgacagagcatagtgactccgaagaccttactgaaaagcaaaaggtacatgctgccctagataatgaggcaggggatagaagccattttgaagaaaagctcattcctggagatatgaaagtacaggtagatgttagtaaggacgtagaagaaggcagcctcaatgctctgcctccatctggaatcacagaatcagacgacaaagctgaaaagttcactaaacatcctgaatctagtttagaagagctacagaagcatcaagaacaacaggaagaaaaaattttccaaaatccaaccgatgaagaaagtactacctctttgaatgagaaacaagaaggcaaggacaacatggaagtgaattctcagccgcaaggaccttctgatactgaaacagttatagcagcaactagctcaaacgttccttcacaaattgcaagtgaagaggaaaatgacgttccagtgattccaaggagtaggcctaagaaggattttgaagcacacgtacaaaaagaggagttgcctaacacacaagagaagcgagtatcagaagagtgtgattcgaccctaattagtaccgaagaggaaagtaaaatcccaaaaattccctctgaaagaccaaagagacgtgccccacctccggttcccaaaaaaccttcttcaagaattgcggcctttcaagaaatgttacaaaaacaacagcaacaagatctgcataataatggtaattcttcagctactaccgcttcagcagatattgctaaaaaacacacagattcttctattactagcgataccacgaaggcagattttacgagcaaattgaatggactgtttgcgctacctggtatggtgaaccctggacagcttccaccttccttggagaagaagttgtcctccccggatactgaatctaagctaggaccccaggaccaatcacaggcaaaaacgggacctctgggcggaactagaagaggtagaggacctcgtgggcgtaaattaccttctaaagtagctagcgtagagaagattgaagaagatgacaacactaataaaatagaaatatttaacaattggaatgtttcctcttccttctctaaggaaaaagtcttaatagatactactcctggtgagcaagcagaaagggccttggatgaaaagtcaaagagcattcccgaggaacaacgagaacaatctccaaataagatggaggctgctctttgtccttttgagctggacgaaaaggaaaagttacctgctaatgctgagtcggatcctctttctcagttgccacagacgaacgccgtaggtaatagaaaagccataagtgaggaatctctgtccccatcggaggccatcgccaacagagatcaaaacgatacgacagaaatacaggaacagcagatggaggaccaaatggaggttgatatggaaagagaactctcaggtggctacgaagacgttgattctgccttacattcagaagaagcgtcttttcactccctttag

SEQ ID NO: 4496 - DNA, 2040 bp, Saccharomyces cerevisiae
atggacaaaatcaatcctgattgggcgaaggatattccgtgcagaaatatcactatttatggctactgcaaaaaggagaaagaaggttgccctttcaaacacagcgataacactaccgctactaccataaatgacgttcctcctccaatagatgtgggtgaggctacaactccgaccatgacatcagttcctaagttcaatgctaaagtatccgcaagtttcactccgatgacagtcggtagtgactccttaaccactgtgacgaataccacctccgctgctacaaatgctactggcaatatcgccatggcagctacctctgctactgcttctacagttaatccgatgattaatccgatagttaatagctcgttagtgaataacaataacaataatagtaatataagcatatcaataccaactaccgcttcgagttccaattacgaccccttcaatgcccccattttcactccgtcttcaacctcctcaattcacactaatgcaaatgcacattcttttccatttccctccattgcaaattctggtggcataaatataaacgccactgatgataatagtaacaatatgagtatggctaataatgtgccacctcctatgcaaccgccacccatagagagtagtaatcttaagtacccacgtatttatccgcctcctcacagtcttctacagtatcacctatatgcacctgaacagccatcatcattgaaatcattattaaagcctaatgaaaggtctgcagatcagcttttcattccaaacaatattagagaagatttaaccaagaaaaacttatcgattttgcaggttttcccctcttcaggtaaagttataccaagtattgtacaagattattttaatttggttccattgaacttcaataataacgattttttaaataaaactacgctcttcaaagttttttccaattatgacggtaaagcctacgttttgaagaggcttcctaacatcgataagtcaatgaatccaaacaaaatatccaaaatatatcagatatggtcaaaaattaattgtacaaatttgataaagtttagggacatttttcaaactactaaatttggtgatctgtctatttgtttggtctttgactactacccaaactcgctatctttgtatgattaccactttgttaatttccctaagtttccaataacgaataattatttatggatatatttagttcaactcaccaatgtaataaactctatccattcacaaaacttgagtattggcaatacattaaactggagaaaagttttgattactggggacccagggagaatcaagttatcacactgcaattttatggaccttttgttcaatgatgatactgataccgtagtatcttccggcggaagtaccatagagggacaacaacagctagactacaaatatttaggagagctattatttaacctatccattaatattgaaaactctaataacaacactgcccctaaagaatatcgattggaggaaataacccctcaatcaattgatgacatgagacagatcgatgataagttcaaggatgtactcaagtatctgatatcagacaacggcgattccaaaaagagcattcatgatcttactagtcacttttatgataagatgttcatggtcctggaatcgtcacaaacctatacagaatacatggagtctgtcttatcaagagaactagaaaatggcagattatttaggctggtcaacaagctaaattgcatttttggtagaatcgaatcaagaatagacataaattggtccgaatctgggactaaattccccattatactattttatgactacgtattccatcaagtggattcgaatgggaaaccaataatggatttaactcatgtcctaagatgtttgaacaaattagacgctggtattcaagaaaagttaatgttggtaacgcccgatgagttaaactgtattattatatcctataaggagttgaaggacttgatagaatccacctttcgatccatcacccaataa

SEQ ID NO: 4497 - DNA, 2040 bp, Saccharomyces cerevisiae
atggatacgtcagtatattctcatgcattggatatttgggccaaggcagatttaacgaatcttcaaagagaattggatgctgatgttatagagattaaggataaagaaaccctgtccttgaattcaagaaagtcattagccactgagactaaaaaatttaaaaaactcgaacctgaggaaaaattgaacaatgtgaataaaataattaagcagtaccaacgtgaaattgataatttgacacagagatcaaaattctctgaaaaggttctttttgacgtatacgaaaagctttcagaggctcctgatccacagccgctactacaaagttcgttggaaaaattgggcaaaattgatgactcgaaggaacttaaggaaaaaataagctacctagaagataagctagccaaatatgcagattatgagactttgaaatcaaggttactggacctagagcaaagctctgcaaaaacattggcaaaaagactgactgcgaaaactcaagaaatcaattctacctgggaggaaaaaggaagaaattggaaagagagagaagcagatctattgaaacaattaacaaatgtacaggagcaaaacaaggcactagaggccaaaatatctaaaaatatagatatagaaggtaatggaaacgaagatggtgaccaagaaaacaatcaaaaagaagtatctacaaggattgctgaatataatctagtaacacaggagttggaaactacgcaggctagaatatatcagttagagaaaagaaatgaggaactaagtggtgctcttgcaaaggcaactagtgaagcagaaaaagaaactgagttacatgcaaaggaactaaaacttaaccagctggaaagcgaaaatgcattgttgagtgcatcctatgagcaggaacggaaatcaacatcacatgcaataaatgagttaaaagaacaattaaatagcgttgtggcggaatcggaatcttacaagtcggagctagaaactgttagaagaaaactaaacaattattctgattacaataagataaaagaagaactttctgcattgaaaaaaattgagtttggggtaaacgaagatgattctgataatgacattcgctctgaagacaagaatgataatactttcgaaagttccttactatctgcaaataagaagctccaggctactttggcggaataccgctcaaaaagtacggctcaagaggaagaacgaaacgaattgaaaaaatctgtggaccaattgaagcagcaaatagctactctcaaagaagcaaatgaaaaattagagacggacctagaaaaagtagagaacgtcagtcctcacttcaacgagactgcaagtatgatgtctggtgtaacaagacaaatgaacaatcgtacgtcccataaaatgtccccaacgagttctattattggtattccagaagatggggaactttctggaaaccaatcaaccattttaccaatagttactaaacaaagagacagatttcgttcgagaaatatggatctggaaaagcaactaagacaaggaaactcagaaaagggtaagcttaaactagaaatttcgaagctaaaaggcgacaatacgaagctttatgaacggattaggtatctgcaatcctataataataacaacgctcccgttaatcaaagtacagagcgtattgacgtggaatcccaatactcaagggtgtatgatgaatcgttgcatccaatggcaaattttagacagaacgaattaaaccactacaaaaacaagaaattatcagctttagagaagttattttccagttttgcaaaagtcattttacaaaataaaatgacaaggatggtattcctcttttactgtatcggtttacacggactcgtattcatgatgagcatgtatgtgattaatattagcggctacatgacacctgaggttggtatagtacaatcggcaaagtcttcttcaaatctcaacggaggacttgggggagcagaaaaagtagctgcaggcgttggttcagttcatggcataaatcgatag

SEQ ID NO: 4498 - DNA, 2040 bp, Saccharomyces cerevisiae
atggcatttagaaaatcaaatgtgtatttaagtttagtgaatagttatattattgattcaccacaaccatcatcaattaattattgatgaaatatgggttcattattaggtttatgtttagttattcaaattgtaacaggtatttttatggctatgcattattcatctaatattgaattagctttttcatctgttgaacatattataagagatgtgcataatggttatattttaagatatttacatgcaaatggtgcatcattcttttttatggtaatgtttatgcatatggctaaaggtttatattatggttcatatagatcaccaagagtactattatgaaatgtaggtgttattattttcattttaactattgctacagcttttttaggttattgttgtgtttatggacagagtgagacaagtataagtatattattataatatcataccattaaataaattattttaatgaaatgattatgtttatatataacatatacctaattagacatgcattattagtaataattttgtatgaaactctaataataataattattattaattattaaggtaagattcatatggatagcgtaagtcaatctaatattataaaatatcgtaacataaacaatatttttttctattattaattaataaataataataaataaaaataattatatgagaagtaagatattcaattctgtctagaatacatatatatacgttaatactcatcggtataaaattagaatcctaagtgaattattgaaagtataataatataaacttggtaagcccaattatttccatataatattaatataaatattatatggtagttatatataatattattaaataaataataatagaaattataatatagataagtgggtaaaagactattgaaaaagctaaagattatatgtaatgtataatatagatcaaattatttatatattttaataaaaatatattaataatggttaatattattattaattaattaattaattaattaataataataacgaataaatgattaatgtgaaagcatgctaacttcaatataggatgatttatatagtatataaattgtttgagctgtatactatgaaagtagtacgtacagttctgagtgggggaaaatttgtaaagatctacctatcacaattgtcacattgaggtaatataaatatcgcctcaaatatatttaatataataaaactaatttatataataatgttaatattattaatttatattttttatacgattataataagacaaataataaaaactaaagaatatcttatattaattaagagtatagattatattaataaaaataaatatataattaatttaaatataacaaataagaaagatataaataataatattggtccattaaatataaacattttatcaattatttatggttcaatattaggagatggtcatgctgaaaaaagaaaaggtggtaaaggaacaagaattgtatttcaacaagaatattgtaatattaattatttatattatttacatagtttattagctaatttaggttattgtaatactaatttacctttaattaaaactagattaggtaaaaaaggtaaaattagacaatatttaaaatttaatacatgaacttatgattcatttaatatgatttattcagaatggtatattaaaaatatatctggaaaaggtaatattaaagttattcctaaatctttagacaattatttaactcctttagctttagctatttgaattatagatgatggatgtaaattaggtaaaggtttaaaattcacaactaattgttttagttataaagatgttcaatatttactttatttattacataataaatataatattaaatctactattcttaaaggcaataaagaaaatacacaatttgttatttatgtatgaaaagaatctatacctattttaactaaaattgtatctccttatattattcctagtataaaatataaattaggtaattatttataa

SEQ ID NO: 4499 - DNA, 2043 bp, Saccharomyces cerevisiae
atgactcaattcactgacattgataagctagccgtctccaccataagaattttggctgtggacaccgtatccaaggccaactcaggtcacccaggtgctccattgggtatggcaccagctgcacacgttctatggagtcaaatgcgcatgaacccaaccaacccagactggatcaacagagatagatttgtcttgtctaacggtcacgcggtcgctttgttgtattctatgctacatttgactggttacgatctgtctattgaagacttgaaacagttcagacagttgggttccagaacaccaggtcatcctgaatttgagttgccaggtgttgaagttactaccggtccattaggtcaaggtatctccaacgctgttggtatggccatggctcaagctaacctggctgccacttacaacaagccgggctttaccttgtctgacaactacacctatgttttcttgggtgacggttgtttgcaagaaggtatttcttcagaagcttcctccttggctggtcatttgaaattgggtaacttgattgccatctacgatgacaacaagatcactatcgatggtgctaccagtatctcattcgatgaagatgttgctaagagatacgaagcctacggttgggaagttttgtacgtagaaaatggtaacgaagatctagccggtattgccaaggctattgctcaagctaagttatccaaggacaaaccaactttgatcaaaatgaccacaaccattggttacggttccttgcatgccggctctcactctgtgcacggtgccccattgaaagcagatgatgttaaacaactaaagagcaaattcggtttcaacccagacaagtcctttgttgttccacaagaagtttacgaccactaccaaaagacaattttaaagccaggtgtcgaagccaacaacaagtggaacaagttgttcagcgaataccaaaagaaattcccagaattaggtgctgaattggctagaagattgagcggccaactacccgcaaattgggaatctaagttgccaacttacaccgccaaggactctgccgtggccactagaaaattatcagaaactgttcttgaggatgtttacaatcaattgccagagttgattggtggttctgccgatttaacaccttctaacttgaccagatggaaggaagcccttgacttccaacctccttcttccggttcaggtaactactctggtagatacattaggtacggtattagagaacacgctatgggtgccataatgaacggtatttcagctttcggtgccaactacaaaccatacggtggtactttcttgaacttcgtttcttatgctgctggtgccgttagattgtccgctttgtctggccacccagttatttgggttgctacacatgactctatcggtgtcggtgaagatggtccaacacatcaacctattgaaactttagcacacttcagatccctaccaaacattcaagtttggagaccagctgatggtaacgaagtttctgccgcctacaagaactctttagaatccaagcatactccaagtatcattgctttgtccagacaaaacttgccacaattggaaggtagctctattgaaagcgcttctaagggtggttacgtactacaagatgttgctaacccagatattattttagtggctactggttccgaagtgtctttgagtgttgaagctgctaagactttggccgcaaagaacatcaaggctcgtgttgtttctctaccagatttcttcacttttgacaaacaacccctagaatacagactatcagtcttaccagacaacgttccaatcatgtctgttgaagttttggctaccacatgttggggcaaatacgctcatcaatccttcggtattgacagatttggtgcctccggtaaggcaccagaagtcttcaagttcttcggtttcaccccagaaggtgttgctgaaagagctcaaaagaccattgcattctataagggtgacaagctaatttctcctttgaaaaaagctttctaa

SEQ ID NO: 4500 - DNA, 2043 bp, Saccharomyces cerevisiae
atggcacctctttcgttgaactttaaagatgacaagaaatataagggcctcacaacagtgtggttgctttctgcgttgggaaattccattgtaaaggaaagtaacaattattattcaaacaaaagcaactccactggaaacatatcttcatccaccgttaagaaaaaagacatcgtaaatatttccataccaaaaacatgtgatgaaattcaaaatttcgaaaatgatttttctcttagatacatttctaatcttttatatggagtgacaatttgctataataaaaaaaccgagtatgtgttgaatgacctaaatcacctgcttgtgcagttacaaaaaaatgatgtatacgcttttaaggccaaaaataagtctacgaggattaatggattgaatagtaataacagtattataggaaacaaaaacaataattacacctgggaagaatgcgtttttttcgatgacgatcccttatatgatattactaaagttcccgcactggagtttcttaacactactctccaagataatgtatcttttattgaggaagctaaatcaataaggagacaagactacatcaatgagttaagtaattctaacaggttcgagcttcatggggacatgactaactcagacgcgcaaagtaatctaggatctaacgttagaaattcttttccgctggatgaaattcccgttgatgtggactttaacctggacttagatgatatagtgagccatcaggggacacctttaggctctcactcaagttcacagaaggatggaaacgatttcaagtttaattatcaaggagatgaattggtgttgaattttgagaacgataatgaaaataacagtaatggaggagaagatacatcagttgaaaatgaagggccggtagccaatctcaaagactacgaattggggttagaagcgcaggcttctgaagaagaaaacgatcttcaacagaaacttaacaccagaatgcaaagaggacatcgcgccgatgtaggtgggcaattttctaaggtacaatttgatgccaaaacgagttatccaaatgaagttctcaaattcaaccatggaaattacagtcacttaatggaaaaaaacaggattagaaaactaaccggccaaaattttctcacctctaacataagtagtttggtaaggtcatgtggtgaggaagaatttttttcaacaaattggttaagtatatttaacgacttttccaatataaagactagcgaatgggacttatatccccaaggttttagttcagttgaaagagggagaaaaagagcacattctttagtatcaacccaaagctcaagtagtaccagaagtcacgaatatggtaggaaaagttttcgcaataataagaacgataattattcttccgatatggaaaatgataatttacttttaaaccttgaacaaattaatgaggatttggaagatgggcactatattgaagaaaactctcaaggtaacatcctagattttaatttgaatctacctccttcaagttttggaagaagtcataccagaaactcaaccaggtctagtggtttcaatgaagatatagttggtgctctcagaaggagagtcgggccatctgaacagaattttgccgaggaagacgattccagcaacagttgtttttctgatggctctcagcaaaatttgcagcaggacaaaacaaattttcaagacgtcattctggattatcaaactaaaaaattctacgattacatcaaagaaagatcaattgttgtcggaagaacaacgcgctccaatccgcctttcaagagaaagatgctgttggttgacatcatcccaagccgcatgggcgaagctcaaacgggagctaactttgatgatgtagaaagaggtgtcagcagacagatagccgccagtgccttcctatccttactgaatttggctacgaaagggatggtcaagttgaacgaatatcctgttgcagatgcggtaactaaagatcttaaactgagaagagaggacgaaataattgtatatgcctga

SEQ ID NO: 4501 - DNA, 2043 bp, Saccharomyces cerevisiae
atgtattcttggaagtcaaagtttaagtttggaaaatctaaagaagaaaaagaagccaaacatagtgggttttttcactcctctaaaaaggaagaacagcagaataatcaagcaactgcgggggaacatgatgcttcaattactcgttcatctttagacaggaagggcacgataaatccatcaaattcatcagtggtcccggttcgtgtttcatacgatgcatcctcatcgacctctactgtacgagattcaaatggtggtaattcagaaaacacgaactcatctcaaaatttagatgaaacagcaaatattggttctacagggacacccaatgatgccacctcaagttcaggaatgatgactatcaaagtatataatggtgatgactttattttaccttttccgattacctcaagcgagcaaatattgaataaactattggcctcgggtgttccaccgccacataaggagattagtaaagaagtagatgctttaattgcacaactgtcccgtgttcaaataaagaaccaaggtccagctgatgaagatttgatctctagcgagtcagcagcaaagttcatcccatctactatcatgttaccagggtcttcgaccttaaatcccttactatatttcaccattgaatttgataatacagttgcaactattgaagcagagtatggtacgatcgctaaacctggtttcaataagatatctacctttgatgtgacaaggaaattaccttatttaaagattgatgtatttgcaagaattccgtccattcttttgccctcgaagacatggcaacaggagatgggtttgcaagacgagaagctacagaccatttttgataaaataaattccaatcaagatatacatttagattctttccatttgcccatcaacttaagttttgactctgcagctagtattagactatataatcaccactggatcacattggataatggcttgggtaagatcaatattagtattgattataaaccttccagaaataaacctttgtccatcgatgatttcgatcttttgaaagttatcggtaagggttcgtttggtaaagtgatgcaagtcagaaagaaagatacacaaaaagtatacgctttgaaggcaatcagaaaatcatacattgtctctaaatccgaagtcacgcatactttggcagaaagaaccgttctagcacgtgttgattgtccatttattgtacctttgaagttttctttccaatcaccggaaaaattatactttgttttagcgtttatcaatggtggtgagttgttttatcatctacaaaaggaaggaaggtttgatttatcacgtgccagattttataccgcagaattgttatgtgcgctagacaacttgcataaactagatgttgtctatcgtgatttgaaaccagagaatattttattggattatcaaggccacattgccctttgtgatttcgggctatgcaaattgaatatgaaggatgatgataagacagatactttttgtgggaccccagaatacttggcaccagaactattgctaggtttaggctatacaaaggcagtagattggtggacattgggagtcttgttatacgagatgctcacaggtcttcctccttattatgatgaagatgttccaaaaatgtataagaagattctacaggagccactagttttcccagatggatttgatagagatgcaaaggatctattgattggattattgagccgtgatccgacaagaagattgggctacaatggtgccgacgaaattcggaaccatccttttttcagccaattatcatggaagcgcctgttgatgaagggttatattccaccatataaaccagctgttagtaattccatggatactagtaatttcgatgaggaattcactagggagaagccaattgatagtgtggtagatgaatacttgagtgaaagtgttcaaaagcaatttggtggctggacatacgttggaaatgaacagctaggtagctcaatggtgcaaggtagaagcattagatag

SEQ ID NO: 4502 - DNA, 2046 bp, Saccharomyces cerevisiae
atggcacagttctccgacattgataaacttgcggtttccactttaagattactttccgttgaccaggtggaaagcgcacaatctggccacccaggtgcaccactaggattggcaccagttgcccatgtaattttcaagcaactgcgctgtaaccctaacaatgaacattggatcaatagagacaggtttgttctgtcgaacggtcactcatgcgctcttctgtactcaatgctccatctattaggatacgattactctatcgaggacttgagacaatttagacaagtaaactcaaggacaccgggtcatccagaattccactcagcgggagtggaaatcacttccggtccgctaggccagggtatctcaaatgctgttggtatggcaatagcgcaggccaactttgccgccacttataacgaggatggctttcccatttccgactcatatacgtttgctattgtaggggatggttgcttacaagagggtgtttcttcggagacctcttccttagcgggacatctgcaattgggtaacttgattacgttttatgacagtaatagcatttccattgacggtaaaacctcgtactcgttcgacgaagatgttttgaagcgatacgaggcatatggttgggaagtcatggaagtcgataaaggagacgacgatatggaatccatttctagcgctttggaaaaggcaaaactatcgaaggacaagccaaccataatcaaggtaactactacaattggatttgggtccctacaacagggtactgctggtgttcatgggtccgctttgaaggcagatgatgttaaacagttgaagaagaggtgggggtttgacccaaataaatcatttgtagtacctcaagaggtgtacgattattataagaagactgttgtggaacccggtcaaaaacttaatgaggaatgggataggatgtttgaagaatacaaaaccaaatttcccgagaagggtaaagaattgcaaagaagattgaatggtgagttaccggaaggttgggaaaagcatttaccgaagtttactccggacgacgatgctctggcaacaagaaagacatcccagcaggtgctgacgaacatggtccaagttttgcctgaattgatcggtggttctgccgatttgacaccttcgaatctgacaaggtgggaaggcgcggtagatttccaacctcccattacccaactaggtaactatgcaggaaggtacattagatacggtgtgagggaacacggaatgggtgccattatgaacggtatctctgcctttggtgcaaactacaagccttacggtggtacctttttgaacttcgtctcttatgctgcaggagccgttaggttagccgccttgtctggtaatccagtcatttgggttgcaacacatgactctatcgggcttggtgaggatggtccaacgcaccaacctattgaaactctggctcacttgagggctattccaaacatgcatgtatggagacctgctgatggtaacgaaacttctgctgcgtattattctgctatcaaatctggtcgaacaccatctgttgtggctttatcacgacagaatcttcctcaattggagcattcctcttttgaaaaagccttgaagggtggctatgtgatccatgacgtggagaatcctgatattatcctggtgtcaacaggatcagaagtctccatttctatagatgcagccaaaaaattgtacgatactaaaaaaatcaaagcaagagttgtttccctgccagacttttatacttttgacaggcaaagtgaagaatacagattctctgttctaccagacggtgttccgatcatgtcctttgaagtattggctacttcaagctggggtaagtatgctcatcaatcgttcggactcgacgaatttggtcgttcaggcaaggggcctgaaatttacaaattgttcgatttcacagcggacggtgttgcgtcaagggctgaaaagacaatcaattactacaaaggaaagcagttgctttctcctatgggaagagctttctaa

SEQ ID NO: 4503 - DNA, 2049 bp, Saccharomyces cerevisiae
atgaataactcaaatgagcataggcgggaagaggcaggagcggctaatgaacaaatgccttacaataaggctgtaaagtccgcgtatgcagatgtcctcaaggacaaaatgaatagggaacaggagattagcctacgagccatcaaaaaagggatatacaccgatggcggtgaaactgacaactatgatatggataaagagaatgattccgcgtacgaaatgttcaaaaaaaatcttgattttccgttagaccaacataatgatgacgacgatgatgatccgtacattgaggataatggacaagagaccgacggatatagcgacgaggactatacagatgaggcagacaagagttttatagaagacagcgattccgacagctacgatttggaaagtaattctgactttgaagagaacttggaaagttcaggtgaagctaagaagttgaagtggcggacgtacattttctatggaggccttttcttcgttttttatttttttggatcttttttgatgacaaccgtgaaaaataatgatttagaaagccattcatccggcgctacatcctctccaggcaaatcattcagcaacctacaaaaacaggtgaatcatttatatagtgagttgagtaagcgggacgaaaagcacagttcagaattggataaaacagtaaaaatcattgtctctcaatttgaaaagaatattaaaagacttttaccctcaaatttggttaattttgaaaatgacattaactcgctgacaaaacaggttgagacaatttcaacttccatgagtgagttacagaggcgaaatcacaaatttacggtcgagaatgttactcaatggcaagatcaactggtaaaacagttggatacacacctccctcaagaaatacccgttgtaattaataattcttcgtcgcttttaataatccctgaattgcacaattatttgagtgctttgatttcagacgttattgagtctccaggcattggtactgctggaagcgctgaaagtcgttgggagtatgatttgaatcgctatgtaaaggaaattctttcgaatgagttgcaatatatcgataaggattatttcatccaagaaatgaacagaaggttgcaatctaacaaacaggagatttgggaagagatcacaaataggttagagacacagcagcagcagcagcagcagcaggttcaacaggattattctaacgtgccacagcagtattcgagcatattaatgaaaagattaattcaccaaatttacaattccaatcaacaccaatgggaggacgatttagattttgctacttatgttcaaggtactaaactattgaaccatttaacttcaccaacctggagacagggcagtggggtacagccgatagaattactgaccgactccaaacaaagctcctcaacttactggcaatgtgagaacgaacctgggtgttcatgggccataaggtttaaaactcctttgtatctaaccaaaatttcgtacatgcatggccgttttactaataacctacatataatgaactcagcaccaagactgatctcattatatgtaaaactgtcacagactaaagagatcaaagcattgcagacattggcaaatcaatacggtttcgggcagcatcacaagagagaccgaaattacatcaagatcgcaaaatttgagtacaggttgacagattctagaatacgccaacaaatgtatctgcccccatggttcattcagttaaaaccactcgtacgctcaattgtctttcaagtggacgagaactacgggaacaaaaagttcatatctctgaggaaatttatcatcaacggagtgacaccgcaggatttgcaaataattgaaaataacgagttccctgttttactgggtgacaccccagaatatggtgtcactcagaacaccgacgaaggcaagaggaaagttctcctatcaaagcctccttacgcgtcttcatctactagtaccaagtttcatcccgcttctaacgtcccatcatttggccaagatgagctagatcaataa

SEQ ID NO: 4504 - DNA, 2049 bp, Saccharomyces cerevisiae
atggatagcttcaattatattcatggaaaatataaaaaaaatgggacgggaggcgacagaagtataaatccatcctcacattcatcgtctggcaagaatatcattctttgttttgatggaacaagagaaaattttggacctcagccattcactaatattttaaaattgtacaaccttcttgagaacggtgatagttctgaacaaatttgttattaccaacctggaattggttcagttggatttgacgctgttgttgatgtcagaagacggttaactatttctcacttacaaaatttattagattctatgttcgcattcagtttagacaatcacatatgttctgcatatctttttttgatgaagtattttgaaccaggagatagaatttatatgtttggcttttctagaggagcttttattgcaagagttcttgctggaatgattgaaagagtcggacttttgagtaaaggtttggaagaaatggttaaaatggcatggcaaatctatgaaaaatgggaatacgattcgcagcctaatgaattacagtacacaagtaccttggctgaagaattcaagaaaacattctctagggattacgaggtaaagatacattttcaaggcttattcgattctgtgaactcagttggaatattaagggacaggttgtttccttgcacccagagaagcaatatcgttgagcatgttcgacattgcgtatccttggatgaaagacgtggaaaattcaagcagttatgtttcactccgatgccgtacattccgaaactattttcattgacatattgtaatcatataactgaccagtgttcgccggtgccaacttctaatgcattaatgcgtgatctaaccccggaaaatcctttgataaaatacactttaaaaagtggcgcacattctattagtaatccttctccactcattcctgataaccctggaaggttgttatcgagcaaaagcgaggaaactacagagttgctgttggacctgaactcattcttagaaggtaattcatacgcgagagatacagaatgttcaacaagaggaattgaagccattttccaacttcaatctatccaaggcagcggtacatcaagtagaatgactatgacacccgacttgattgaaaaatggtttccaggtgatcattctgacgttggtggaggttgggcgcctgactgtgagacagaagagaacttgtcaaatttaacgctgcgatggattttagcagaggcaatcaaatttggtgttaaattcaaacctggtgcaatacatgatttcgctaccaaacacacttcgattggatctttattcgcagacacacatgattaccttagtttcaactcaccaaagaaatgttccctactaggagtgagtgataatgaggatggagcccgagaggataaatctggcagaaatgagagaatggaagattgtctaaaaaatataaaagagactagattgagcttgaaagatgaaaaagaaaaagtgaaggatgcttttactcttaaatgtggacatgcaaataaatttatgagattggtgtggtgggtattggaactgctccccattggaatacgaatggaaaataaagaaggaaagtggcaaaattttcatacacctaacctcggaagatctcgttatgtacccgaatatgtcagtttacattggtcagtctattggagaattaagtttgatcgtaggtatagaccggacaatatgccggaatatgtaaggcaattgttccaagatttggaaggtattgatttaaaaagtaataaagtttcaaataaatatgataagcaagataatagcaacgggagtgaaatcaatgggggcttttttgataatgaggaagggcaggaactccacatgggtcaaaaagcaagttattttgcaacgacatacaattcaagattatttgacagtaaatactcccaattaaaaaagaaattcatggactgggatagtaattcctggacagatattccagatgatttaaaaatatacctacagcaagatgaatcgctttag

SEQ ID NO: 4505 - DNA, 2049 bp, Saccharomyces cerevisiae
atgtttttcaacagactaagcgctggcaagctgctggtaccactctccgtggtcctgtacgcccttttcgtggtaatattacctttacagaattctttccactcctccaatgttttagttagaggtgccgatgatgtagaaaactacggaactgttatcggtattgacttaggtactacttattcctgtgttgctgtgatgaaaaatggtaagactgaaattcttgctaatgagcaaggtaacagaatcaccccatcttacgtggcattcaccgatgatgaaagattgattggtgatgctgcaaagaaccaagttgctgccaatcctcaaaacaccatcttcgacattaagagattgatcggtttgaaatataacgacagatctgttcagaaggatatcaagcacttgccatttaatgtggttaataaagatgggaagcccgctgtagaagtaagtgtcaaaggagaaaagaaggtttttactccagaagaaatttctggtatgatcttgggtaagatgaaacaaattgccgaagattatttaggcactaaggttacccatgctgtcgttactgttcctgcttatttcaatgacgcgcaaagacaagccaccaaggatgctggtaccatcgctggtttgaacgttttgagaattgttaatgaaccaaccgcagccgccattgcctacggtttggataaatctgataaggaacatcaaattattgtttatgatttgggtggtggtactttcgatgtctctctattgtctattgaaaacggtgttttcgaagtccaagccacttctggtgatactcatttaggtggtgaagattttgactataagatcgttcgtcaattgataaaagctttcaagaagaagcatggtattgatgtgtctgacaacaacaaggccctagctaaattgaagagagaagctgaaaaggctaaacgtgccttgtccagccaaatgtccacccgtattgaaattgactccttcgttgatggtatcgacttaagtgaaaccttgaccagagctaagtttgaggaattaaacctagatctattcaagaagaccttgaagcctgtcgagaaggttttgcaagattctggtttggaaaagaaggatgttgatgatatcgttttggttggtggttctactagaattccaaaggtccaacaattgttagaatcatactttgatggtaagaaggcctccaagggtattaacccagatgaagctgttgcatacggtgcagccgttcaagctggtgtcttatccggtgaagaaggtgtcgaagatattgttttattggatgtcaacgctttgactcttggtattgaaaccactggtggtgtcatgactccattaattaagagaaatactgctattcctacaaagaaatcccaaattttctctactgccgttgacaaccaaccaaccgttatgatcaaggtatacgagggtgaaagagccatgtctaaggacaacaatctattaggtaagtttgaattaaccggcattccaccagcaccaagaggtgtacctcaaattgaagtcacatttgcacttgacgctaatggtattctgaaggtgtctgccacagataagggaactggtaaatccgaatctatcaccatcactaacgataaaggtagattaacccaagaagagattgatagaatggttgaagaggctgaaaaattcgcttctgaagacgcttctatcaaggccaaggttgaatctagaaacaaattagaaaactacgctcactctttgaaaaaccaagttaatggtgacctaggtgaaaaattggaagaagaagacaaggaaaccttattagatgctgctaacgatgttttagaatggttagatgataactttgaaaccgccattgctgaagactttgatgaaaagttcgaatctttgtccaaggtcgcttatccaattacttctaagttgtacggaggtgctgatggttctggtgccgctgattatgacgacgaagatgaagatgacgatggtgattatttcgaacacgacgaattgtag

SEQ ID NO: 4506 - DNA, 2052 bp, Saccharomyces cerevisiae
atgaacaaagaattggcttctaagtttttatcaagcatcaagcatgaacgtgaacaagacattcaaacaacttctaggctattaacaacgctatctatccaacaattggtgcaaaatggcttggcaataaacaacatacatctagaaaacataagatccggtctcattggcaaattatatatggaactgggacctaacttggcggttaacgacaaaattcaaaggggtgatattaaggttggtgatattgttttggtacgccctgcaaaaaccaaagtaaataccaagactaagcccaaagtcaaaaaggtgtctgaagactccaatggcgagcaagcggaatgctcaggcgttgtctacaaaatgagtgatactcaaatcaccatagctctagaagaatctcaagatgttattgctaccacattttattcttatagcaaactttacattttaaagactaccaatgtcgtcacgtataatagaatggaatccacaatgagaaaactgtctgaaattagttcacccatacaagacaaaattatacaatacttggtaaacgaacgccccttcatccccaatacaaacagctttcaaaacattaaatcttttttaaacccgaatctgaatgactcccagaaaactgccattaattttgccattaacaatgacttgaccattatacatggtcctcctggtacgggtaaaacattcacattaattgaattgatccagcaattgctaattaaaaatcctgaggagagaatcttaatttgtgggccttccaatatttctgtggatacgattctggagaggctaacgcctcttgtgccgaataatttattattaagaatcggtcatcctgctaggctattagactctaataaaagacactctcttgatatacttagtaaaaagaatactattgtgaaggacatttcccaggagattgacaaattaattcaggagaataaaaaactaaaaaactataagcaacgtaaagaaaactggaacgaaattaaactgctgcgcaaagatttaaagaaaagagagttcaaaaccattaaggacttaataatacaatcgagaatagtcgtcaccactttacacggttcatcatcgagagaactatgctccctttatagagatgatccaaatttccagcttttcgataccttgatcatcgatgaagtctcacaggccatggaaccacaatgctggatcccactaattgcacatcaaaatcagttccacaaactagtccttgctggtgacaataaacaattgccacccacaatcaaaacagaagacgacaaaaatgtcattcacaatttggaaaccacactatttgacagaataatcaaaatattcccgaaaagggatatggtaaaatttcttaacgttcaatacaggatgaatcaaaaaattatggaatttccatcgcactcaatgtataatgggaaactattggccgatgcaacggtcgcgaacagacttttgatagacctaccgaccgtcgatgctacgccatctgaggatgatgacgatacaaaaattcctttaatttggtatgatacgcaaggtgatgaatttcaagagactgcagatgaagctactatccttggatctaagtataatgagggcgaaattgccattgtaaaagaacacattgagaatttaaggtcattcaacgtcccggagaactctataggtgttatttctccatacaatgcacaagtttctcatctgaaaaaattgatccatgatgaattaaaattaactgatattgaaatatcaactgtagatgggttccagggccgtgaaaaagatgttatcatattgagtttagttcgtagcaatgaaaaatttgaagttggtttccttaaggaagaacgaagactgaacgtcgccatgacaagacccagaaggcaactagttgttgttggcaatatagaagttctgcaaaggtgcggtaacaagtacctaaaaagttggtcagaatggtgtgaagagaacgctgacgtaaggtaccccaacattgacgattatttgtaa

SEQ ID NO: 4507 - DNA, 2052 bp, Saccharomyces cerevisiae
atgacaatcaaggaacataaagtagtttatgaagctcacaacgtaaaggctcttaaggctcctcaacatttttacaacagccaacccggcaagggttacgttactgatatgcaacattatcaagaaatgtatcaacaatctatcaatgagccagaaaaattctttgataagatggctaaggaatacttgcattgggatgctccatacaccaaagttcaatctggttcattgaacaatggtgatgttgcatggtttttgaacggtaaattgaatgcatcatacaattgtgttgacagacatgcctttgctaatcccgacaagccagctttgatctatgaagctgatgacgaatccgacaacaaaatcatcacatttggtgaattactcagaaaagtttcccaaatcgctggtgtcttaaaaagctggggcgttaagaaaggtgacacagtggctatctatttgccaatgattccagaagcggtcattgctatgttggctgtggctcgtattggtgctattcactctgttgtctttgctgggttctccgctggttcgttgaaagatcgtgtcgttgacgctaattctaaagtggtcatcacttgtgatgaaggtaaaagaggtggtaagaccatcaacactaaaaaaattgttgacgaaggtttgaacggagtcgatttggtttcccgtatcttggttttccaaagaactggtactgaaggtattccaatgaaggccggtagagattactggtggcatgaggaggccgctaagcagagaacttacctacctcctgtttcatgtgacgctgaagatcctctatttttattatacacttccggttccactggttctccaaagggtgtcgttcacactacaggtggttatttattaggtgccgctttaacaactagatacgtttttgatattcacccagaagatgttctcttcactgccggtgacgtcggctggatcacgggtcacacctatgctctatatggtccattaaccttgggtaccgcctcaataattttcgaatccactcctgcctacccagattatggtagatattggagaattatccaacgtcacaaggctacccatttctatgtggctccaactgctttaagattaatcaaacgtgtaggtgaagccgaaattgccaaatatgacacttcctcattacgtgtcttgggttccgtcggtgaaccaatctctccagacttatgggaatggtatcatgaaaaagtgggtaacaaaaactgtgtcatttgtgacactatgtggcaaacagagtctggttctcatttaattgctcctttggcaggtgctgtcccaacaaaacctggttctgctaccgtgccattctttggtattaacgcttgtatcattgaccctgttacaggtgtggaattagaaggtaatgatgtcgaaggtgtccttgccgttaaatcaccatggccatcaatggctagatctgtttggaaccaccacgaccgttacatggatacttacttgaaaccttatcctggtcactatttcacaggtgatggtgctggtagagatcatgatggttactactggatcaggggtagagttgacgacgttgtaaatgtttccggtcatagattatccacatcagaaattgaagcatctatctcaaatcacgaaaacgtctcggaagctgctgttgtcggtattccagatgaattgaccggtcaaaccgtcgttgcatatgtttccctaaaagatggttatctacaaaacaacgctactgaaggtgatgcagaacacatcacaccagataatttacgtagagaattgatcttacaagttaggggtgagattggtcctttcgcctcaccaaaaaccattattctagttagagatctaccaagaacaaggtcaggaaagattatgagaagagttctaagaaaggttgcttctaacgaagccgaacagctaggtgacctaactactttggccaacccagaagttgtacctgccatcatttctgctgtagagaaccaatttttctctcaaaaaaagaaataa

SEQ ID NO: 4508 - DNA, 2052 bp, Saccharomyces cerevisiae
atggattttacaacaatgactatggcaagcaatatggctactagtactactacgacggctacatcggcacatgcatctataaattcgtcatcaaactttaatattgatattgattcgaaccagaatactccttccattttgataaataacaattcggattcttctaatggaaaaaacacagattttaacggcgtcaataatattcaccaaaaaaatatcatgaataatacaaataatgttcatttgtactctccaaatataatggaccaaacgctactaactccacaggacattgccaagttacggagagaatcaatagcccattctcaagggatgggtggtgtttcatggggatccattagtgttggttcttggttaagagatgaaattattagccgtagaaatagtattgtacctgcatcagcaaacggtgctgcctccgctgccgcttctgcaaccactactgccactaatactttgcagattcaacaaccaactaagagaccctctgttagtaatccgccttaccatagagggtattctatttctcctcagatagcctacactgcttatctgccaaatctagaaaagcaatattgtaaagattattcatgctgtggtctttccttaccaggtttgcatgatttgctgagacattacgaagaagctcatatatccacgtctcctaacactaccaatatgtcacaaataccgatgaactctgctggtaacactagttcatcagttcgtatgacaaataatacctcttctgccaactataacctgcagaataacatggccgctaatacaaaaaatgcaggtcataagactaatactatgcaggctcatagcagcaatgcaactaataacacctccattaataatatgcatgccaatcttcagagcaacatggattccaactccacaatacgacaatctcagcatcctcaccatcagcagaatataatacaacaacagttgcaatcgaattctgtaaatcatacatcaggggctgtacccacaccgagtgtaatgggttcagcaactgcgtcgtccacaactgcaaatccaaatgtgatatctataacgggtgcccccaactcgggcttatctatggctaatcactctcaacaactacatctgaatggtaatctagtcgatgccgtttcaacgaatgatgtgtttttaagaacgagcaattctccatcaagacacgttccgcacaataaacaaattaacagtaacaataatagtggtatcaatatcaataataatacctcacacaattctaatattaacatgggtagtaaaaacgccatggtgaatcgtccacatacttttaataactattccttgaacaaaacgtccaggaatcctattcaacatcaatcaagaaaaattgatcctcatcaaaccgatttatcacctctggtacttgtccaagatatagatttaagttttatggatgatgatattttgggccctagtaaccacaattccatgaactctgtcgtaaatccaactacaggttctcacaactacaatacttttcattcttccgtacacgcaaaatcttctcaaaacatggtcgaggatcaagacattgatgacattgatgatgacgatgatgttgatgatgacgatgacgatgacgatgacgatgacacagaaaatggctccagttccaatggaaaatcagttcataacaacaattacaagatgcctcagcaagcttatatagacgatcctgcgagaaggctctatgtaatggatcatgaggaacaaaaaccctttaagtgtccagttattggttgtgaaaagacttataaaaaccaaaacggtttgaagtaccataggttgcacggacatcagaatcaaaaattacatgaaaaccctgacggtacatttagcgtaatagatccagattcgacagattcttttggtgatggaatgggctctgcaaaggataaaccataccgttgtgaagtttgtggtaagagatataagaacttgaacggtttaaaatatcacaggggccactccactcactaa

SEQ ID NO: 4509 - DNA, 2055 bp, Saccharomyces cerevisiae
atggacaccagcaagaaagatactactaggtcgccctcacattccaacagttcttctccttcatcttcttctctctcttcatcttcttccaaagagaaaaaacgtcctaagagactatcctcccagaatgtaaattacgatttgaaaaggagaaagatcatcacttctgaaggtatagaaagatcattcaagaacgagcatagcaatcttgcagttgaagacaatatcccggaagaagaacccaaggaacttcttgaaaaggactccaagggtaatatcatcaaacttaatgagccatccaccatctcggaagattcgaaggtatctgtcactggattgccgttaaataaaggtccttctgagaaaatcaagcgagagtctctttggaattatagaaaaaatttgggaggccaatcgaacaactcagaaatgacgctggtccccagtaaaagatttactcaggtgccgaaaaattttcaggatttgaacagaaatgatttgaaaacgtttttaactgagaacatgactgaagagagcaatatacggtcaactattggttggaatggcgatataataaacagaactcgtgaccgtgaacctgaaagcgaccgcgataataaaaagctatcaaatattagaaccaaaataatactttcaacgaatgctacctatgattcaaaaagtaaactatttggccaaaattccatcaagtcaacatcgaatgcgagtgaaaaaattttcagggacaagaacaattcaaccatagattttgagaatgaagatttttgttcggcttgtaatcagtcaggttcttttttatgctgtgatacatgccccaaatcctttcactttctttgcttagacccaccaattgatccgaacaacctgcctaaaggtgattggcattgtaatgaatgtaagtttaaaatcttcataaataactcaatggcaactttaaaaaaaattgaatccaacttcattaagcaaaataacaacgtcaagatttttgctaaattacttttcaatatcgattcccacaacccaaaacagttccagctaccaaattatataaaagaaacctttcctgctgtgaaaacgggttcgagaggacaatactctgatgagaatgataagattccattaactgatagacaattgtttaacacttcttatggccaaagcataactaaattggactcttacaacccggatacacatatagattcaaattcaggtaagtttttaatttgttacaaatgcaatcaaaccagactaggttcatggtctcatccagaaaattcaagattaataatgacttgtgattattgtcagactccatggcatttggattgtgtaccgagggcttctttcaagaacttaggttcaaaatggaaatgtcctctacattccccaactaaagtttacaaaaagatacaccattgtcaagaagataatagcgtaaattataaggtgtggaaaaaacaacgattgataaacaagaaaaaccaactttattatgaacctttacaaaaaataggctaccaaaataacgggaacattcaaatcataccaacaactagtcatacagattatgatttcaatcaagatttcaaaattacacaaatagatgaaaattccattaaatatgatttttttgataaaatttacaaatcaaaaatggttcaaaaaagaaaactctttcaatttcaagaaagtttaatagataagttagtatcaaatggatcccaaaatggcaatagcgaggataatatggtcaaagacatagcctctttaatatatttccaagttagcaacaacgacaagagtagtaacaataaatcggcttccaaaagcaataacttaagaaaattatgggatttgaaagaactgactaacgtagtcgtgccgaacgaactagattctatacaattcaatgacttttccagcgatgaaataaagcatctgttatatttaaagaagattatcgaatccaaaccaaaggaagaactgttaaaatttttaaacatagaaaatcccgaaaaccaatccgaatag

SEQ ID NO: 4510 - DNA, 2055 bp, Saccharomyces cerevisiae
atggctagaagaaagaatttcaaaaaagggaacaagaagacttttggtgctcgtgatgactcgagagctcaaaaaaactggtctgaactggtaaaggaaaatgaaaaatgggaaaaatactataagactttagctcttttcccagaagatcaatgggaagaatttaaaaagacatgtcaagctccacttcctctaacttttagaattacaggttctagaaagcatgccggtgaggtcctgaatttgtttaaagaaagacatctaccaaacttgactaatgttgagtttgaaggtgagaagattaaggcccctgtagaattaccttggtatccagaccatcttgcttggcaattggacgttcctaagacggttattagaaagaatgaacaattcgcaaaaactcagagatttttagttgttgaaaatgccgttggtaatatctcaagacaagaagccgtttcaatgattcctccaatcgttctagaagtaaaacctcatcacactgttttagatatgtgtgctgctcctggctccaaaactgctcaattaatcgaagccttgcacaaggatacagatgaaccatctggtttcgttgtagctaatgatgccgatgccagaagatctcatatgttggttcaccaattgaagagattgaacagtgccaacttgatggttgtcaaccatgacgcccaattcttcccacgtatcagattacatggcaactcaaataacaagaatgatgttttaaaatttgacagaatcctgtgtgacgttccatgttctggtgatggtaccatgaggaaaaatgttaatgtttggaaagactggaacacacaagcaggtcttggtttgcatgctgttcagctgaatatattaaacaggggtttgcatcttctaaagaacaacggtagattggtttactcaacctgttctttaaatcctattgaaaatgaagcggttgttgccgaagcgttaagaaagtggggtgacaagattagattagttaactgtgatgataagcttcctggcctaataagatccaagggtgtatccaaatggcctgtctatgacagaaatttgactgagaaaaccaaaggagacgaaggtacactagatagtttcttttcaccatctgaagaagaggcatcgaaattcaatttacaaaattgtatgagggtttatcctcaccaacaaaacacaggcggatttttcattactgttttcgaaaaagtcgaagatagcactgaggcggctacagagaaactatcttctgaaaccccagctctagagtctgaaggacctcaaacaaagaaaataaaggtagaagaagtccaaaagaaagaaagactaccacgtgacgcgaacgaagagccttttgttttcgttgatccacagcacgaagctttaaaagtttgttgggatttctacggcatcgataatattttcgacagaaacacttgtttagtgcgtaacgccactggtgaaccaacaagagtggtttacactgtgtgtccagcattgaaggatgttattcaagcgaatgacgataggttgaagattatttattctggtgtaaaattgtttgtctctcaaagaagtgatatcgaatgttcatggagaatccaaagtgaatcattgccaataatgaaacaccatatgaaatctaatagaattgttgaagctaatttagagatgttaaaacacttgttaatcgaatctttccctaactttgacgacattcgttcgaagaacatcgataatgattttgttgaaaagatgacaaaattaagctctggttgcgcctttattgatgtgtcaagaaatgaccctgccaaagaaaacttattcttgcctgtgtggaaaggcaacaagtgtatcaatttgatggtttgtaaagaagatactcatgagctattatataggatctttggtattgatgcgaatgccaaggctactccaagcgctgaagaaaaagaaaaagaaaaagaaacgactgaatctcccgcagaaactactaccggaacctctactgaagctcctagcgctgctaattga

SEQ ID NO: 4511 - DNA, 2055 bp, Saccharomyces cerevisiae
atgttaaaatgtatatgccgtgtctattcccagcctttggctcaaatggtcacttcaccgctgtttaaacatatgggtagcgcagggacatacacaattctacctattacaaatctgcgccatttatctacgaaaaactgtccattgaaaattaaatcaaatcgttcagaacctttgcagtttggcgattttgaacgacaggtgccatgttctaggaagagcggatcttcgaaaaatgttcagaagcgtttatacgagctccgacaattgaaaactgtattaagtgagacttttggagtaactgaatacgcctctttttttgaatctctacgaaatgccctgcatataaataattgctcagaaaatgaaaagaagaaacttttatatgatatcattttgcatcaacacgagttatacccagaggtggcaagaaaaattggattttatctaccaggtgaggtccacagatggttctggtatcatattccaaaatcagaatcttttaatcactatctttttcttttgaaaagtgatgttcttctctttacttctaactactgtacgagatttaccaataggctgataaaaggaactgagatggagaggcagttagccacgttccaaatatttttgcatgatgagacaaacataaaatttataatggaaaaagttctgaagttgcatacatttgacagcttaatcgctctagtaaatggccttgttaaggcgaaaaattttaggttcattaaagtatttattcaagctctactacagaagttggaacagcactgttattctggtaaagatggagcaaagcaaaagaacctgcgttatgtcaagttcaacaataccttactttattaccttttgaaaagtggaaatgttgagttattcatcaaaacctttcaagaggaactgaaattcattgtaagctcaggattgcttaatcacattgatggaaacgaacacatattgaattttcccattcaccactacttgaatctgctccgaatatctaataggcaggaggagcttttcaatgtaatttcctgcttacaaagcagcccactgatgaaatataaattgttcaaggagtttttaatgggtgaattaattgcatcttttcaagcctttcgtgacccgaaattggtgtgtaaatatctcctctcatcatacagctcaaaggcgtctgctaatattctgaatgccctagggatttgggggtggctctatcattcaaaatcaacgactttgacagctcctacgttagcaagagagctgaagaacaaaaataatattctaccgaacacaatgcgaataggatcaccagtgactgttccaattttaactgaactgtatagaagccttttatcttcgagttctgtttcactggaaagtggtcaattcaagaattgtcttcttgatttatattacaagtacaagagttttctttccgaggaagctcataaatacaggtattggagaaatgataccggaatcctcaatgttttcctaaattatattagattccaagctcgtgaaccaaggctggcctacaatgttcttctggatttttattctcaacctttcgccaaaaaagtggttttaactaccacgctatgtcccttttccatagtagcctataaaaatcatacattaacgcaggctgaactatcagaattgctacaggtgatgcataaaaatggggtgcctttaacgtttaaattttgttctgcaatggtaatgcattatgtcaaaatgagagacgaaaaaggagcacgctcctggtacaataagatactcttcgggggctttgaaatcaggcatatggctttgatacagataataaaagaccaaggctggccgtttcccaaaaactttgacgaaactttactgacggaattggtggaaaataataacattaaagaacctactgatagcaccctgtttactgacgaagatatgttcgaagaagatggcaagcctagatttaatgatgatgatgttaataaatgtacaaatattataagagagacgttgaaaagtctaaattaa

SEQ ID NO: 4512 - DNA, 2058 bp, Saccharomyces cerevisiae
atgaagtttatagcattaatatcaggtgggaaggactcgttctacaatatttttcactgcctgaagaacaaccatgaattgattgccctgggaaatatatacccaaaagaatcagaagagcaagaattagactctttcatgttccaaacagtaggacatgacttaatagactattattctaaatgtattggtgttccactatttagacgctcaatattacggaacacttctaacaacgtcgagttgaattatactgctactcaggatgatgaaattgaagaactatttgaacttctaagaactgtcaaagataaaattccagatttagaagctgttagtgtaggtgccatcttatcgtcttaccagaggaccagagtggaaaatgtttgttccagattgggtctagtagtgctaagctatttatggcaaagggatcaagccgaactaatgggtgaaatgtgccttatgtccaaggatgttaacaatgttgaaaacgatactaattcaggaaataaatttgacgccaggataatcaaggtggcagcaattggattgaacgagaaacatttaggaatgtccttgcctatgatgcaaccggtgttacagaaacttaaccaactttatcaagttcatatctgtggagagggtggggagtttgagacaatggtcttggatgccccttttttccaacatggatacttggaattaattgatattgtcaaatgtagcgatggtgaagttcacaatgcaaggttaaaggtaaaatttcaaccgcgtaatttgagcaaaagttttttactcaaccaattagatcaattacctgtaccttcgatttttggtaataattggcaagatttaacccaaaatttgccaaagcaacaagctaaaacaggagaacaaagatttgaaaatcacatgtcgaatgctctaccacaaacgacaatcaataaaaccaatgataagttgtacatctctaacctacaatcacgtaaaagtgagacggtcgagaagcaaagtgaagatatttttactgagctagccgacattctgcattccaaccagattccacggaatcatattttatctgcgtcattattaattagagatatgtctaatttcggaaaaatcaacaaaatatacaatgaatttttagatttgtcaaaatacggacctttgccaccatcaagagcatgcgtaggttcgaagtgcttgccagaagattgtcacgtacagttatcagttgttgttgatgtaaaaaatacaggcaaagaaaaaatcaacaagaataagggcggactacatgttcaaggccgttcatattgggctccatgtaatatcggaccatattcccaaagtacttggttaaacgatgatgcaaaccaagtcagttttatcagtgggcaaatcggactagtaccgcagtcaatggaaatattaggaacacctctcactgaccaaatagttttggcattacaacattttgatactttgtgtgaaacaataggagctcaagaaaagttactcatgacatgctatatttcagacgaatcggttctcgactctgtcatcaaaacatgggcgttttattgttcaaatatgaatcatagatcagatctatggatggacaaatctgatgatgttgaaaaatgcctagttcttgtaaagatttctgaattacctagaggcgctgttgcagaatttggtggtgttacttgtaagagattaatagtggacgataatgattccgacaagaaagaaagggaagagaatgatgatgtttcaaccgtattccagaaattgaatttgaatattgaaggttttcataacactacagttagtgcgtttggatataatagaaactttattacgggatttgtagatagtagagaggagttagaacttatcttggaaaaaaccccaaaatcagcccagattaccctctattataatcccaaagaaatcatcactttccaccatcacattggatactatccggtggagaaactttttgattaccgtggtaaagaacaccgctttgggttgcatattcgttcctaa

SEQ ID NO: 4513 - DNA, 2058 bp, Saccharomyces cerevisiae
atgagtaagtatggtccattgggtattactaactttattactccgtacgatctatgcatattaatcctaatacatgctcactgctcacaagataatggcatatcagtgccaacagcagtatttcttcggttaatatcccctactagaccttcactagaatggaatcctctgctcaaggataatagtaatttaagatcttcatctattgttcctcctcctgtacttcctattctagataatataataaggatactgttagatgacaaggatggtaacaaaatagctctgacattaatgggctatttggaagcaattaatggactggattcaatcaacagactaatgatggatttagaaaagaactgtttggttaataattacaggtcaatgaaaatgcgtacaacatcaacaagaagacaaatgacaagagcgagttttttaggaacatttttgtcaacttgtatacgcaagtatcaaattggtgattttgaaatgagggagacaatctggattaatctacaaaatttcaaaactgtatttaagcatactccgctatggctacgatttaaagataacgttcatattcaaaaggtaaaaaactgtcttctggctaacgacgagatctcggtggaggatcaacagatggtggaatttttccaacacttcaataatggtaatgacgctgattcaaaaacaatgaacgaagaaaattatgggacattgatttccatccaacatttacaatcaatagttaatcgacaaattgtgaattggttagataatacagaatttaatctgatgggtcaagaagaaactagttccacatatgaagaacaaagcggactagtttttgatttgctagatacgctttcattgaacgatgccacaaaattccctttgatttttatattaaagtatctcgaagctataaaagagaacagttatcaaaccgcactagattctctacataactattttgattacaagtccacgggcaattctcaaaattacttccatatctccttgttgtcccttgccaccttccactcaagtttcaatgagtgtgatgcagcgataaattcttttgaggaagccacgagaatcgcaagggaaaataaagatatggaaacgttgaatttgataatgatatggataataaacttcatagaggtgcacccggaatatgcaaacagattttatatcacagtagaacaaataataaaatatctgaaaaatagttcagatgtagaagatgccaatattttcagtaacgcctacaagtttgaaacattgttatctatggtcaaagaatcgaaaactgctgaagtttctagttcacttctgaaattcatggctatcactttgcagaacgtgccttctcaaaactttgatcttttccaaagtcttgttagctatgaagtaaaattttggaaagaactgggatacgaatccatatccgatgtatatgagaaattcctgtctaaaacatcctcttcctctttaaggaactacgactcttctattatcaaccaagatataaaggtagctttcaaggcacttgaagaagacgattttttaaaagtaaaacaataccttttgaaatcagaatcactggaactagactacgaccaaaaaataaatttgaaatatttaagagtgaagtatctcgttaaaataggtgactatgacctaagcatgcgattaatcaaccaatatgtcaaggagtgctgtgaagaagtggcggattcgaactggagattcaaatttgaaattgaaagtatcaatgttttacttttaagtgacgtagggataagaagtttgccgaagataataaaattaatcgacgaatacaaagagataggaaatcctttgcgatgtgtaatattattgcttaaattatgtgaagttttgattcaggtagggaagagtatggaggcagagtgcttgatcagctgtaacctatcaaccattctagaattcccatttgtaaggaagaagacagatgagcttttggaatctcttagtgttgaagaggatagggatgttcagatgacttga

SEQ ID NO: 4514 - DNA, 2058 bp, Saccharomyces cerevisiae
atggaagaaacaatagaaaatgttgaagtgccttctagtaatgtctcaaaacaaaatgacgacggcctagatatgaagactttgtttgtgaggtctataccccaggatgtcacagatgagcagctggcagatttcttttccaattttgctccgatcaagcatgcggtagttgttaaggacacgaataaaaggtccaggggcttcgggttcgttagttttgctgtagaggatgacacaaaagaagccctagctaaggccagaaagaccaaatttaacggacatatcttgagggtagacattgctaaaagaagagatcgttcaaagaaaacatcagaagtggttgaaaagagcacacctgagtcatctgagaaaataacgggccagaacaatgaagatgaggacgatgctgatggtgaagactccatgctaaaaggtaaaccgaaattaattatcagaaatatgccatggagttgtcgtgatccagttaaattgaaaaagatctttggtagatatggtaccgtcgtggaggctaccattccaaggaagcgtgatggtaaattgtgtggatttgcgtttgttactatgaagaaaatcagtaattgtagaattgctttggaaaacaccaaagacttgaaaattgatggtagaaaggtggctgttgattttgctgttcaaaaaaacagatgggaagattacaaaaaagcccagccagaaatgaatgacaaagatgataacgagtcaggaaatgaagatgctgaagaaaaccatgacgacgaagaagatgaaaatgaagaggaagatagacaagtagatcaagcttcaaaaaacaaagaatcgaaacgtaaagcacaaaacaaaagggaagatttttctgtttttgttcgtaacgtcccttatgatgccactgaagaatctttggctccgcacttcagtaaatttggcagcgttaaatacgcattacctgttatcgataagtctacggggttggctaaaggtacggcctttgtagccttcaaagaccaatatacatataacgagtgtatcaaaaatgcgcctgcggctggctctacctctttattgataggtgatgatgtcatgcctgagtatgtgtatgaaggtcgtgttctgtccattactccaacgttagtaagagaggatgctggaagaatggcagaaaagaacgccgccaaaagaaaggaggccctaggtaaagcgccaggcgaaaaagatagacgtaacttatatttgctgaatgaaggtagagttgttgaaggctcaaaaatggctgatttgttaaccaacactgacatggagatcagagaaaaatcttacaaattaagagtggagcaactgaaaaagaacccatctttgcatttgtcgatgactaggttggctatcagaaatcttcctagagcaatgaatgataaagcattaaaggcgttagctcgtaaagctgtcgtggaatttgctacagaagttaaaaataaggaaagacatccattgagtaaagaagagattatcagatctacaaaggaaaaatacaagttcatgggtccagatgagattgaagctcaaaaaaagaaagacaaaaaaagtggtgttgtcaagcaagcaaaagttataatggaagttaaaggatcaactgcgggaagaagtagaggttacggttttgtagaattcagagatcataaaaacgctttgatgggcttaaggtggttgaattgtcatgccgttacctccgatgaaattttagagggtttgaatgatgatgaaaagaaacaagtagacaatgacttaggcaaaggaagacgtctttgtgttgaatttgcgattgagaactctaacgtcgtaaagagaagaagggaacaattgaagcaagcaagaaccaagagaacaagaccagataatgaagatactggagatgtcggagaatccgagaataagaagccaaaaaaagaagaagcaacgacgcccaccaatcccgatgacaaaaagatgggcgatgatataaagagaataatcgggttcaagcgtaagagaaagcacgcaaaaaaatag

SEQ ID NO: 4515 - DNA, 2058 bp, Saccharomyces cerevisiae
atgtcggattcaaaccaaggcaacaatcagcaaaactaccagcaatacagccagaacggtaaccaacaacaaggtaacaacagataccaaggttatcaagcttacaatgctcaagcccaacctgcaggtgggtactaccaaaattaccaaggttattctgggtaccaacaaggtggctatcaacagtacaatcccgacgccggttaccagcaacagtataatcctcaaggaggctatcaacagtacaatcctcaaggcggttatcagcagcaattcaatccacaaggtggccgtggaaattacaaaaacttcaactacaataacaatttgcaaggatatcaagctggtttccaaccacagtctcaaggtatgtctttgaacgactttcaaaagcaacaaaagcaggccgctcccaaaccaaagaagactttgaagcttgtctccagttccggtatcaagttggccaatgctaccaagaaggttggcacaaaacctgccgaatctgataagaaagaggaagagaagtctgctgaaaccaaagaaccaactaaagagccaacaaaggtcgaagaaccagttaaaaaggaggagaaaccagtccagactgaagaaaagacggaggaaaaatcggaacttccaaaggtagaagaccttaaaatctctgaatcaacacataataccaacaatgccaatgttaccagtgctgatgccttgatcaaggaacaggaagaagaagtggatgacgaagttgttaacgatatgtttggtggtaaagatcacgtttctttaattttcatgggtcatgttgatgccggtaaatctactatgggtggtaatctactatacttgactggctctgtggataagagaactattgagaaatatgaaagagaagccaaggatgcaggcagacaaggttggtacttgtcatgggtcatggataccaacaaagaagaaagaaatgatggtaagactatcgaagttggtaaggcctactttgaaactgaaaaaaggcgttataccatattggatgctcctggtcataaaatgtacgtttccgagatgatcggtggtgcttctcaagctgatgttggtgttttggtcatttccgccagaaagggtgagtacgaaaccggttttgagagaggtggtcaaactcgtgaacacgccctattggccaagacccaaggtgttaataagatggttgtcgtcgtaaataagatggatgacccaaccgttaactggtctaaggaacgttacgaccaatgtgtgagtaatgtcagcaatttcttgagagcaattggttacaacattaagacagacgttgtatttatgccagtatccggctacagtggtgcaaatttgaaagatcacgtagatccaaaagaatgcccatggtacaccggcccaactctgttagaatatctggatacaatgaaccacgtcgaccgtcacatcaatgctccattcatgttgcctattgccgctaagatgaaggatctaggtaccatcgttgaaggtaaaattgaatccggtcatatcaaaaagggtcaatccaccctactgatgcctaacaaaaccgctgtggaaattcaaaatatttacaacgaaactgaaaatgaagttgatatggctatgtgtggtgagcaagttaaactaagaatcaaaggtgttgaagaagaagacatttcaccaggttttgtactaacatcgccaaagaaccctatcaagagtgttaccaagtttgtagctcaaattgctattgtagaattaaaatctatcatagcagccggtttttcatgtgttatgcatgttcatacagcaattgaagaggtacatattgttaagttattgcacaaattagaaaagggtaccaaccgtaagtcaaagaaaccacctgcttttgctaagaagggtatgaaggtcatcgctgttttagaaactgaagctccagtttgtgtggaaacttaccaagattaccctcaattaggtagattcactttgagagatcaaggtaccacaatagcaattggtaaaattgttaaaattgccgagtaa

SEQ ID NO: 4516 - DNA, 2058 bp, Saccharomyces cerevisiae
atgtctctgacaccaactaatgaaatattgtttcattacaagtcttcagtgaaggttggtgaacttgagagatatgtaattacttatcatctttatgacggtgaggaaattccaccagatttgaatttaaattccttgtggttaaaggtgagaaatatgaatccgttatcgtatagagctgcgtacctaatgggtccattcatgctttattgcgatgtaaaaactgcccaatatcatcattcccaaaaaatagttgcttcagttgattaccccaaatttgaaccgaatgtgcaaactcaacaagatttcgtggctgaactttcagtacataacatacgacagaaatacgtatggattgctgatgtgatgagtcaaatattgttcactacaaatacgaacgtcacttacgaagtcactattggaactagtaaagagtcagtagaaaatccgcatgatctgccatctcatctaggttcttatagccctaaacttacagtgaacaggttaactaccttggatttgtggaatcttcccgttcagattaccacaccacagaaaaagaaacatcttgtagttttgacacatggtttacattctaatgtgtcgaccgatctagtgtatattatggaacagatatacaaagcacaaaagaattatccccacgaacaaattgttgtgaaaggttataggggaaatgtctgtcaaactgagaagggagttaagtatttaggtactcgtttggccgaatatattatccaggatttgtacgatgaatccatccgcaagatttcttttgtaggtcattcattgggtggcctaatccaggctttcgcaatagcgtacatttatgaagtctacccttggttttttaaaaaggtgaatccaataaattttattactttagcttcaccgcttttaggtatagtcacagataatcccgcctatattaaagtactactttcattcggggttattggaaaaacaggtcaagacttgggtttggaaaatgatgttgaagtaggcaaaccgcttctctacttgctatctggtctgcccttgatagagattttgcgtaggttcaaaaggaggacagtatatgcgaacgctattaatgacggaattgtcccattgtataccgcatcgctattgttcctagactataatgatatcttggagcaattacagaaactaaaggagaacagcaaaaaatcaccgctaataaatgatgcttcaacacctgtgaatcaagatttcttcaataaaactttcatttcgcctctgactaaaatgttgagtatactggcgccacaaaagtttcctacggagaatggttccgaaattcctaaagtatcatttttcgagtcagcaagctcaattctccttcctcctttacctgaaagagcgtacataatggatccagattcaagagatcctgtaattattcatgataagatatacaatgaggatgacattccacaatccgaatttgatatcgaagacggtttttttggtaaaaagaatatactccttcaggctttttttgcaggaaagaaagaacgtgcgaagtatcgaaatttggaagaaacgattgctcgaaggtggcatgaaggaatggcatggagaaaggttgtcgttgctttaaaacctgacgctcacaacaacattatagtccgaagaaagtttgccaacgcatacggttggcccgttatcgatcatctgatagatgtccacttcaatggtgatgacgatgacgataacgatgaaaatgacgatatcaattccacacaagttgttgaacctattcagagcgtaaccgaaggaaagaaaaagtataggaaagctgaaaacattcctcaagaatatggatggttgaataaggttgaaacaaacggagtctttgacgaaggtcctacgggaatgatatcaactgttggtgaaatagtcgaggcgttagctaaaagaggatttagcgccgtaatcgacaggagaaatgcctcggaagatccgaatgatgaggtccttcggtttgaagaaatgaatagtgatttggtacaatga

SEQ ID NO: 4517 - DNA, 2061 bp, Saccharomyces cerevisiae
atgaatttaaagtccatcgttagctggttcaaggaacatcttcccagttttgatgtcgacgtggacaagcattttagaactttaagagtccgcaaatattctcagatatgtcttttaatttctttcattataatatgtgttattatacccttaatgaattatttgttgctaactgacaaattcttcaaaatatgtcaccatttaaagcatcatgttttcaacagaagatcatgggttcacaaaacacatatgtatcacaaacagtcactacaactatgtttaatatgctttgttttcacctcgttttttgttatacaaggcgctaacggagatctgttagaaattactaagcgaatggggagaatttccgttgctttgatgccacctttactatttctaacgttgaggccatcaccgttacctcacacgttatacttagcattgttacctctccacaaatggatttccagaattgttgtgcttgaatctattctacacacgtggttctatctctattacatgtacattaatgatacgttatacgtgaaaatgagaaaactacccaacatttatggggttattgccctcggccttttcctactgattgccatcacctctgtgagatatgccagacgatggagctacagagttttttactatgttcactatgtaagcacatggcttattttggtgtttctacattatcacgctcgcccaggaatttcatattataccactttaaatgtgctcatattaacgggacaaatcgtctataggctccatatcaccaatgttacgagagttacgatagtacccatttcttcatcattgtctcttttggagttcccattaaccgatttacccaaaaagcccatcctaccaggagggcatctaaggatcaacatttaccatagaaattttttaaggaggtttttctcccatttgatacccttccaacatccttttactattgctagtattccaagtgataatttggtcaggttaattattagaaacgggcattttccattgcgtacaaatgaaaagtattacattacaggggcttttgaacctgagttgagtttcatttctaaacctactgttccttttaatattaccacgaaatcttccaagaatccatttcgaaacaattcttctgcactaataaattcgcctttaaattttctaattaaagcgcaaagagtgtttatgtgtgttggaggttcaggaatttcctttggcttaccactacttcgtattctaaacttcaacggtgtaaacgttaggctcctttgggtttctagagattataaggatctggaagtattgaaccacttcaaaaacaattttgaaggtatggagatatatattagtggcaccgaaggcaacgaacaggacatagaaattgattatattgactatcatgactgcgctgctgatattaatgatgaagtcaggagtatttcttcgagcggccgagtttcagaactgggagataattccatgttatcagatggaaatccccaacctacggagcccaatgagaacacagcccttctaagtaagaaatctaccttgagaaaccatcacccaccaaaaacaagtgatatacctgacatcaatgctgatgacgagatagattttacatatgcttttagcagatccaaatcaaggaaaaatactgcacaaggaactctaactacacattcttcgtttaacggatcgagcgttttcagacaaccaaagatcattgagccacctgcccaagatccttgtttagaggcggcgcctaaaaagatcagaattcccgcaggtgttaaagtgttctttggcaggcctacacttggagataaggattatgaatggtgtctgcaaaccgaatgtgatgcagagacggattctattcaatgttgcaggtgggcgaatcaaggcagagaccatgctgaatatttgtcacaagtatgggttctcgctgcaggccctagaggcttaattgaaagcaccaaaagatgggcgacagatggtggtttacactttcacggagaaagttttgcattataa

SEQ ID NO: 4518 - DNA, 2061 bp, Saccharomyces cerevisiae
atgaccgatatcacacccgtacagaacgatgtggatgtcaatggtaataatgtcaatgacgacgtttccagtaatctaaagaggcctatagatcaaggggatccttcgaatggactcgcagaagaagaaaaccccgccaataaccagttgcatctcaaaaaggctagactggatggagatgctctaacatcatcgcctgctggacttgcagagaacggtattgaaggcgccaccctggcggctaacggggaaaatgggtataacgccaccggaagtggcgcagaagacgaacagcaggggttgaagaaggaagaaggaggacaaggtaccaaacaagaggatttagatgaaaactcaaaacaagaacttccgatggaggttccaaaggaacctgcccctgctcctcctccagagcccgatatgaataatctccctcagaatccaataccaaagcaccagcagaaacatgcattgcttgcgattaaagctgtcaaacgcttgaaggatgcgagaccctttctacaacctgttgacccagtgaaattggatattcccttttactttaactacataaagaggccaatggacttgtctactatagagaggaagttgaacgtaggcgcttatgaagttccggagcaaatcacggaggatttcaatctcatggttaacaacagtattaaattcaacggtccaaatgcgggcatatcacaaatggcaagaaacatacaagcttctttcgagaaacatatgctaaatatgcctgctaaggatgctccacctgtaatagccaagggacggcggtctagtgcccaagaggatgccccaattgtaattagacgagcccaaactcataatgggaggccgaaaaggactatacatccgccgaaatcaaaggatatttatccttatgaatcgaagaaaccgaaatccaaaagactacaacaagcaatgaaattttgtcagagtgtgctaaaggaattgatggccaagaagcacgcctcttataactacccatttttggaaccagtagacccagtttctatgaatttgccgacttatttcgattatgttaaagagccaatggatttaggcacaatcgccaagaaattaaatgactggcagtatcaaacaatggaggattttgagagagacgtgaggttggtctttaaaaactgctacacgttcaatccggatggcacgatcgttaatatgatgggtcatcgtctagaggaagttttcaattccaaatgggcggataggcctaatttggatgactacgattccgatgaagattcgaggacccaaggcgactacgacgattatgaatctgagtattcagagtctgacatcgatgaaactataattacaaatccagccatccagtatttggaagaacaacttgctcggatgaaagtggagttgcaacaattaaaaaagcaagaactggaaaaaataagaaaagagaggcgcttagcacgtggatcaaagaaacgcggcaaaagatcgaagggaaggagtgggtctaagaacgcttcttcgaaaggaaggcgagataaaaagaataaattgaaaacagtagtgacatatgatatgaaacgtatcattacagagaggatcaatgatttaccaacttccaaattagaaagagcaatcgacataataaaaaaatccatgcccaatatttctgaagacgatgaagtagaacttgacctcgacactttagataatcacaccatcttaacattgtacaacactttctttagacaatatgaaagctcatccggtgcttctaacggtttggacggtacttcaggtgttacgcgagatgcttcgtccttgtcgcctacaagtgcgggaagcagaaagagaagatctaaggcattaagccaagaggagcagagtaggcagatagaaaagataaaaaataaactagctatcttagacagtgcttcacctctgagccaaaacggctccccaggccaaattcaaagcgctgcacacaacgggttttcctcatcttcagatgacgatgttagcagcgaaagtgaagaagagtga

SEQ ID NO: 4519 - DNA, 2061 bp, Saccharomyces cerevisiae
atgatacgtccattatgttcaaaaattattatcagttacatattcgcaatttctcagtttctactggccgctaatgcgtggtcgcccacagatagttatgttcctggcaccgtgtcgtgtcccgatgacataaatctggtaagagaggctacgtctatatctcagaatgagagcgcatggttggaaaagaggaataaagtcactagtgtagctttaaaagatttcttgactagggctactgcaaatttttcagatagctcagaagttttgtcgaagctatttaatgatggcaacagcgaaaacctgccgaaaattgctgtcgccgtttcaggtgggggctatcggtccatgctaacaggtgcgggtgttctagcagcaatggataacagaactgaaggtgcttatgagcatgggctgggtggacttttacaaagcacaacatatttatctggtgcctcgggcggcaactggctagttggtacattagccttgaacaattggacatccgtgcaagacattcttaataatatgcagaacgacgattctatttgggatttgtcagattctattgttacccccggcggcattaatatattcaaaacagccaaaaggtgggatcatatctctaatgctgtcgaatctaagcagaacgccgattacaatacttctttggccgatatttggggcagagccttggcgtataattttttcccttctctaaatagagggggtataggcctgacttggtcttccattagggatttcccagtgtttcaaaatgctgaaatgccttttccaatttctgttgcggacggtaggtatcctggaacaaaagtcatcaatttgaacgcaacggtttttgaatttaatccctttgaaatgggatcctgggatccctctttgaactcttttgccaacgttaagtaccttggaacgaatgtctccaatggtgtaccattggaaaggggaaaatgtaccgcaggctttgataatgcaggttttatcatgggtacttcctccaccttatttaaccagtttcttttgagaataaactccactcacttacctagtttcatcacaagattagcaagacattttctaaaggatttatctcaagattttaatgatatcgctgtttacagtcctaatccatttaaagacacgaagtttttggatagtgactatacgacaagtattgttgattcagacagcctattcttagttgacggcggtgaagacgacgaaaatgttcctgtgttaccgcttatacaaaaggaacgtgatgtggacattatttttgcggtagataattctgccgatatgagattggcttggcctgacggttcttctttagtccatacctatgagcgtcaattcgttaagcaaggtcaaggtatgtccttcccatatgttccagatacgaatacattcgttaatttgggtttgaacaagaaaccaaccttcttcggttgcgatgctaataatttgaccgatcttcaatatattccacctctagttgtttatctgccaaatgcagaatactctttcaatagtaatcagagcgcgttcaagctatcatattccgaatcccaaagaagaagtatgattcaaaacgggtttgaaattgcaactaggaacaacttcactgatgatcctgaattcatgggctgcgtcggctgcgccatcattagacgtaagcaacaagctttgaatattactttgcctccggaatgtgaaacctgttttaaaaattattgctggaatggtaccctggatactaccccattaccagatgttgaaaaggatgttcaccactcctttatcaacgtcaatagcttcaacagctccataggacaagaagaaagtctttacgccggatcttcagcttcccagtcatcgtcttcatcatcgtcttcatcttcgtcttcggaaattccttcggctactgcaacccttgagaaaaaggcagctactaattctggatcacatttatctggcataagtgtaaagttctctgctatgattatgcttactttattgatgtttaccggagcagtataa

SEQ ID NO: 4520 - DNA, 2061 bp, Saccharomyces cerevisiae
atggttagaacccgtgtattattctgcttatttatatctttttttgctacggttcaatcgagtgctacacttattagcacttcatgtatttcccaagctgcgctataccaatttggatgttctagtaaatctaaaagttgctactgtaaaaacatcaattggctgggttcagtgacagcatgtgcctatgagaattccaaatctaacaaaacactagacagcgccttaatgaagttagcatcccaatgttcaagcatcaaagtttatactttagaggacatgaagaatatttatttaaatgcgtcaaattatttgagagcacctgagaaaagtgataaaaaaaccgtggttagtcaaccgctcatggcgaacgagacagcgtatcattattattatgaggaaaattatggtatccatcttaacctaatgcgctctcaatggtgcgcttggggtctcgtcttcttctgggtggctgtgcttactgcagccactatcttgaacattctgaaaagggtgtttggtaagaacatcatggcaaactccgtcaaaaaatcacttatttatccttctgtttacaaagattataatgaacgaactttttatttatggaagcgtctaccatttaattttacaactcgaggcaagggtctcgtcgtattaatttttgttattttgactatattatctctcagttttggtcataatattaaacttccacacccatatgataggcccagatggagaagaagtatggcctttgtgagtcgtagagcagacttgatggccattgcacttttcccagtagtctatctattcggaataagaaataatcccttcatccctataacagggctttccttttctacatttaatttctatcataaatggtctgcctacgtttgtttcatgttggccgttgtacactcaattgtcatgaccgcctcgggagtgaaaagaggtgtgtttcaaagtctggttaggaaattttactttaggtggggtatagtggcaacgatattaatgtctattattattttccaaagtgaaaaagtatttagaaatagagggtatgagatattccttcttattcataaagcgatgaatattatgttcattattgccatgtactaccattgtcacaccctgggctggatgggttggatttggtcaatggctggtattttatgctttgatagattctgcaggattgttagaataatcatgaatggtggcttgaaaactgctactttgagtaccactgatgattctaatgttattaaaatttcagtaaaaaaaccaaagtttttcaagtaccaagtaggagctttcgcatacatgtatttcttatcaccaaaaagtgcatggttctatagtttccaatcacatccatttacagtattatcggaacgacaccgtgatccaaacaatccagatcaattgacgatgtacgtaaaggcaaataaaggtatcactcgagttttgttatcgaaagttctaagtgctccaaatcatactgttgattgtaaaatattccttgaaggcccatatggtgtaacggttccacatatcgctaagctaaaaagaaatctggtaggtgtagccgctggtttgggtgttgcggctatttatccgcactttgtcgaatgtttacggttaccatctactgatcaacttcagcataaattttactggattgttaatgacctatcccatttgaaatggtttgaaaatgaattgcaatggttaaaggagaaaagttgtgaagtctcagtcatatatactggttccagtgttgaggacacaaattcagatgagagtacaaaaggttttgatgataaagaagaaagcgaaatcactgttgaatgtctcaataaaagacctgatttgaaagaactagtgcgctcggaaataaaactctcagaactagagaataataatattaccttttattcctgcgggccagcaacgtttaacgacgattttagaaatgcagtggtccaaggtatagactcttccttgaagattgacgttgaactagaagaagaaagttttacatggtaa

SEQ ID NO: 4521 - DNA, 2061 bp, Saccharomyces cerevisiae
atgtcgaaaaacaacacaatgacctctgcggtctctgatatgctgtcacagcaacagctaaatcttcagcacctgcataacttgcagcagcatacgagaagtatgacttcagcagatcatgccaacgttttacaacaacagcaacaacaacaacaacaacaacagcagcagcagcagcaacagcagcagagcgcaagctttcaaaatggcagtttgacatccgatataaaccaacaaagctatttgaatggacaaccagttccttccactagtaattcaacgtttcaaaacaataggacgctgacgatgaattctggagggttgcaaggtatcataagcaatggttctcctaatatcgactcgaacaccaatgtaaccattgctgtcccagatcccaataataacaacgggaaacagctccaagggaaaaactctttaaccaacacttcaatactgtcgagggctaggtcttccttacaacgtcaaagacttgctcagcaacagcaacaacaacaagatcctagatctccattagtaatactggtccctacagctgcgcaaccaacagatattcttgcagcgaggttttcagcttggagaaatgtcatcaagtcggtgatcgtttacttaacagaaatcgcttctattcaggatgaaattgttagacagcaactaagattatcacatgctgtacaattcccattcttttcgatcgagaatcaataccaaccaagctcgcaggaggataaatcagtacaaaagttttttttgccattgggtaatggctcgatacaggacttaccaacaattttgaaccagtatcatgaatccctagcatccagcgcgtctaaggcatcaagggaattgaccaatgatgttattcctcgtttggaagacttgaggagagatctaatagtcaagataaaggaaataaaatcactgcagtcggatttcaaaaattcttgttccaaagagttacaacaaacaaaacaggccatgaagcaatttcaggagtctttaaaggatgcgcgctattcagtgccaaaacaagatccattcttaaccaagctggcgcttgatagacaaattaaaaagcaacttcaggaggaaaactttctgcatgaagcttttgataatttagagacttcaggcgctgaattagaaaaaattgtagttatggaaattcaaaactctttaacaatatatgccagattactgggacaagaagcacaattggttttcgatatattgatatccaaattagattctggatttttcaacgttgacccacaatttgaatgggataacttcatttcaagggatcccaactttttattgcctaatctaccgatgaggacattcaaagaaatcgtttacaaataccaattcgatcctttgacttatgaaatcaaatcagggtttttagaaagaagatcaaaatttctaaaatcctattcaaaagggtattatgtgctgacaccgaactttttacatgaattcaagaccgcggacagaaaaaaagatttagtaccagtgatgtcgttagcattaagtgaatgtactgtgacggaacattcccggaaaaacagtacatcatcaccaaattcgactggttcggatgctaagtttgtgttgcatgctaagcaaaacggcataattcgtcgtggtcacaattgggtttttaaagccgattcttatgaatcaatgatgtcttggtttgataatttgaagatcttaacatctacttcgaatatacaagacaagtataaattcataacacaaaaattaaacttgaattcagatgggaaacccaagctaaccaataaccataccagcattaataagtatcagctgagtaatgccaatagcacaatggtagaaaatgatgaaaacgatgatataaatagtaattatgtggggtccacggtaacaccaaaattggacaatcaaacaaatacgaatacatccatgtcttcattacctgatactaatgattctgaattacaagatcaagttcccaatatttatattcaaactccaataaacgatttcaaatcataa

SEQ ID NO: 4522 - DNA, 2064 bp, Saccharomyces cerevisiae
atgaaacctccgttaaacatgtcacgttcaaataaaccacttactcaggaagctaatagttcggcgcatattgatagggcacatcagctagcacaggattttaacagtaaacaggatgataccgcactaacttcactgccccacaagaaccccgacatattcagatttgagaacaacatcacagctcatagctcgcgtcgtggttctctatatagagacagcgatgctactgtggttttgccgctttctgaacatacccctagattatcaatggatgatccataccgccaattactacaacaggctgaaatctcacaactacgaagtaagaaaaaaaggcattccagtcgagttttgcgtacttcgtttatatcttttgtggtgctagtttcctcgctgtcagggttggaccaaggcctcatatctggtaacgttatgactttgtcgttccagaagtattttcattacccacttacttctccgctgggcaatatagtgagcattgttaatctgggtgcgttcatggcgtcgttatttgtctattctggcatcctggagccttgtagcaggaaaaaaatgctccaaataagcacaatgatatactctttgggtgccattgttcaggtcttggctctaaaccaatggtgtttactactgggtagattcttactcggagtaggtatgggctttgccttttctatggtaataatttatcaattcgagtttccccttccctgtataagaaaacggacattaatttccattcaatgcgtctctagtgtcattgcgtattcattcggaatatggattaattgtgctttcagatatttgggctttgcatggagataccctttgtcaacacatgtggcacttggaataatactaaacctaatgtcgttctatcttattttagagtccccttcgtggctgttgaagcaaaagaacgacgtagaggcattggttttaatatcgaatgttttcgatgatggaaatttcgaagaaaaccaaactcagttgaaatttagggtcctgaaacgagacatattattaaagtcacaccttcaaaaaaactcctatccatatgcgtatatcttaaaggatttttcttcaataataaaattgttgataggtttccaacttctcacacgaacaaatggagtggatgctttcttgtattactcaccgttaatattacaacaaatggggagaggagaaagaaaatctatctatttaacggggcttaatgctttaatttacagcatcgtaatattagcatatgttcccttggtgttacggaaacgtaaagagaaaacgaatgtactcttaggttcgattgtgatgtgtgcattgctatttaccatatcttttacagactggtttcccaagagcacaacgaggtatatatcaatactatttgctgtttttctttttacgcacttcatcagttgggattctataggatgggttatgaccattgagcttctacctcacttgtcacaggccccagtgatactactagtctcaaacttttattggatttttaagtggttcgtcagcttaataacccctatacttattgaccgtctgtcttggaagttttatcttattccatctttatcttcctttatttccattatatttgtgctgaagatttttcctatagaaacccgtgacgaaaggttagattctgatgatgattctaccggaaacggtagcggtaaccatgatgatgtttttgacgataccggttctgaattctcctcctcaccatctttttccgcgtatcagataaacactctaggaagtagtatcaaacaaaataatcaagcctattcatctattcaaaatgagcagattctacccaaaaacggaaacttatcgaaccagacacacggttctgcacaaaatgtttatttcattacatctgattcaggaccatcaaggactggagaatttttcagttttcataacagaaccgatccaaatatcagcgacaacattgctgcgaataaacccagttcaggtggaggccagaattcgcctggagacatggcagttgcctag

SEQ ID NO: 4523 - DNA, 2064 bp, Saccharomyces cerevisiae
atgacaacggaagatccagattcaaatcacttaagttccgaaactggcattaaattggcattggacccgaacttaattacattggcactaagttctaatccaaactctagccttcattcaccaacgtctgatgaacccgtacctgaatctgcaggaaaagcagatactagtattcgactagaaggtgatgagttagagaataaaactaagaaagacaatgataagaacttaaaatttttgaagaataaagattctctagtcagtaatccacacgaaatttatggctccatgccgttggagcaattgatcccaatcatcttaagacagcgtggtccaggctttaaattcgttgatttaaatgaaaaagaattgcaaaatgagattaagcagcttggtagtgatagtagtgacggtcataacagcgagaagaaggacactgatggcgctgatgagaatgtacaaattggagaagatttcatggaagtggattatgaagataaagataatccagtggattcacgaaatgaaacagaccacaaaacgaatgaaaatggcgagaccgatgataatattgaaacggtaatgacacaggaacagtttgttaaaagaaggagggatatgctagagcatataaatctggccatgaacgaatcgtctttggctttggaattcgtttctttgctactgtcgagtgttaaagagtctacaggtatgtcatcaatgtcaccatttcttaggaaagttgttaaaccttctagtttaaacagtgataaaattccatatgttgcacctacaaaaaaagaatatatcgagttggatatattgaataagggatggaagttacaaagtttaaacgaatctaaagatctcctacgcgcaagttttaataaactgagttccatattacagaacgaacatgactattggaataagataatgcagagtattagcaacaaggatgttatttttaagattagggacaggactagtggtcaaaagctgttggcaattaagtatggttacgaagactctggatctacctataagcatgacagaggtattgctaatataaggaataatatagaatcacaaaatttggatttgataccccacagtagttcagtgttcaaaggcactgatttcgtacattcagtaaagaaattcttaagggttcgtatcttcacaaaaatcgaatcagaagatgattacatattgagtggcgaaagtgtgatggatagggatagtgaaagtgaagaagctgaaacgaaagatatcagaaagcaaatccaacttttgaaaaagatcatttttgaaaaagaactgatgtaccaaataaagaaagaatgcgctttgttgatttcctatggtgtcagtattgaaaacgaaaacaaggtaataattgaactacctaacgaaaaatttgaaatcgagttgttgtcccttgacgatgactccattgtcaatcatgaacaagacttaccaaaaatcaacgacaagagagcaaatttaatgcttgttatgttgagactattattagtcgttatattcaagaaaacattacgatcgagaataagctcaccccacggactgatcaatttgaatgttgacgatgatatcttaataatacgtcccattcttggtaaagttcggtttgctaattacaaactgttactaaaaaaaatcataaaggattacgtgctcgatatagttcctggctcaagtataacagaaacggaagttgagagagaacaacctcaagaaaataaaaacattgatgatgaaaatataactaaattaaataaagagatccgtgccttcgataaactattgaatatacctagacgtgaactcaaaataaatctaccattaactgagcacaaaagccctaatctaagtttaatgctcgaaagtcctaactattgtaacgcactcattcacatcaagttttcagctggtacggaagccaacgcagtgtcctttgacacaacattttctgattttaaagaagtagaggacttcctacattttattgtcgctgagtacatccagcaaaagaaggtgtaa

SEQ ID NO: 4524 - DNA, 2064 bp, Saccharomyces cerevisiae
atgactttgaaaccttcaaagagacgtaagggcaggtctcgccattccaggaagaagcaaataacgtcagcgatactgactgaggaaggaataatgatcaaggcaaaaccatcaagtccttacacatacgcaaatagaatggcagataaacgaagtcgcagcagcattgacaacatcagtagaactagctttcaaagcaacatcagtagaactagctttcaaagcaacagtgataacaacagtatatttgaaacggcttcactaattagctgtgttacctgtttaagcgatactgatacaatagacagatcggaaacatcgacaacggatacaagtaaagatgatctttctgctaatccaaaacttcattatccttcggtgaatggtcaattgccagcaaacaccgttatcccctatggacgaattctggatgccagatacattgaaaaggaacctctgcattattatgatgccaattcatcacccagttcacctttaagcagctcaatgagtaacattagtgaaaagtgtgatcttgatgaattagagtcttcccaaaaaaaagaaaggaagggcaactcgctatcgcgaggaagtaacagtagtagtagcctcctgacttccagatctccttttacgaaactagtagaggttatatttgctaggccaagacggcatgacgttgtacccaaaagggtttcattgtatattgactataaaccccattcatcttctcacttaaaagaagaagatgacttggttgaggagattttaaagagaagctacaaaaacactagaaggaacaaatccatatttgtgatcattaatccgtttggtggtaaaggtaaggcgaaaaaactgtttatgacaaaggcaaagccgttactattagcaagtcggtgttccatagaagtggtttatacaaaataccctggtcatgctatagagatcgcgcgggaaatggatattgacaaatatgacactattgcttgcgcttcgggagatggcattcctcatgaggtgatcaatgggttataccaaaggcctgatcatgtcaaagcattcaacaatatcgccattacagaaattccatgcggatcaggtaacgcaatgagcgtatcctgccactggacaaacaatccttcgtactcaactttatgcttaattaaatcgatagagactagaattgatttgatgtgttgttcgcagccttcttatgcaagagagcacccaaagttatcatttttaagtcaaacatatggtctcattgcagaaactgacataaacactgaatttattagatggatgggacctgcaaggtttgaattgggtgtagccttcaatatcatacaaaaaaaaaaatatccttgtgagatatatgtaaagtatgctgccaaatcaaaaaacgagttaaaaaatcattacctggaacacaaaaataaagggtcgttagaattccagcatattactatgaacaaagataacgaggattgtgataattacaattacgaaaatgaatacgaaaccgaaaacgaagatgaagatgaagatgcggatgcggatgacgaagactcccacttgatatctcgtgatctggcagattctagtgctgatcaaattaaagaggaagatttcaaaataaaatatccattagatgaaggtatccctagtgactgggaaagattggatcctaatatttcgaacaacctaggtatcttctatacgggtaaaatgccatatgtggctgctgacactaaattctttccggcagcgcttccttcagatggtacaatggatatggttatcaccgatgcaagaacctcgttgacgaggatggcaccaatcctgctgggactagataagggttcccatgttttacaaccggaagtcttacactctaaaattttggcatacaagataataccaaagctagggaacggcttgttctctgtcgatggcgagaaatttcctctagagccccttcaagtcgaaattatgccacgcttatgcaagacgttactgagaaatggccgttatgtggacacagatttcgattctatgtga

SEQ ID NO: 4525 - DNA, 2064 bp, Saccharomyces cerevisiae
atgatcagacaatctacgctaaaaaacttcgctattaagcgttgctttcaacatatagcataccgcaacacacctgccatgagatcagtagctctcgcgcagcgcttttatagttcgtcttcccgttattacagtgcgtctccattaccagcctctaaaaggccagagcctgctccaagtttcaatgttgatccattagaacagcccgctgaaccttcaaaattggctaagaaactacgcgctgagcctgacatggatacctctttcgtcggtttaactggtggtcaaatatttaacgaaatgatgtccagacaaaacgttgatactgtatttggttatccaggtggtgctatcctacctgtttacgatgccattcataacagtgataaattcaacttcgttcttccaaaacacgaacaaggtgccggtcacatggcagaaggctacgccagagcttctggtaaaccaggtgttgtcttggttacttctgggccaggtgccaccaatgtcgttactccaatggcagatgcctttgcagacgggattccaatggttgtctttacagggcaagtcccaactagtgctatcggtactgatgctttccaagaggctgacgtcgttggtatttctagatcttgtacgaaatggaatgtcatggtcaagtccgtggaagaattgccattgcgtattaacgaggcttttgaaattgccacgagcggtagaccgggaccagtcttggtcgatttaccaaaggatgttacagcagctatcttaagaaatccaattccaacaaaaacaactcttccatcaaacgcactaaaccaattaaccagtcgcgcacaagatgaatttgtcatgcaaagtatcaataaagcagcagatttgatcaacttggcaaagaaacctgtcttatacgtcggtgctggtattttaaaccatgcagatggtccaagattactaaaagaattaagtgaccgtgctcaaatacctgtcaccactactttacaaggtttaggttcattcgaccaagaagatccaaaatcattggatatgcttggtatgcacggttgtgctactgccaacctggcagtgcaaaatgccgacttgataattgcagttggtgctagattcgacgaccgtgtcactggtaatatttctaaattcgctccagaagctcgtcgtgcagctgccgagggtagaggtggtattattcatttcgaggttagtccaaaaaacataaacaaggttgttcaaactcaaatagcagtggaaggtgatgctacgaccaatctgggcaaaatgatgtcaaagattttcccagttaaggagaggtctgaatggtttgctcaaataaataaatggaagaaggaatacccatacgcttatatggaggagactccaggatctaaaattaaaccacagacggttataaagaaactatccaaggttgccaacgacacaggaagacatgtcattgttacaacgggtgtggggcaacatcaaatgtgggctgctcaacactggacatggagaaatccacatactttcatcacatcaggtggtttaggtacgatgggttacggtctccctgccgccatcggtgctcaagttgcaaagccagaatctttggttattgacattgatggtgacgcatcctttaacatgactctaacggaattgagttctgccgttcaagctggtactccagtgaagattttgattttgaacaatgaagagcaaggtatggttactcaatggcaatccctgttctacgaacatcgttattcccacacacatcaattgaaccctgatttcataaaactagcggaggctatgggtttaaaaggtttaagagtcaagaagcaagaggaattggacgctaagttgaaagaattcgtttctaccaagggcccagttttgcttgaagtggaagttgataaaaaagttcctgttttgccaatggtggcaggtggtagcggtctagacgagttcataaattttgacccagaagttgaaagacaacagactgaattacgtcataagcgtacaggcggtaagcactga

SEQ ID NO: 4526 - DNA, 2064 bp, Saccharomyces cerevisiae
atgccaaacttaaagagactacccatcccgccactgcaggacacgctcaaccgctacctggcacgcgtggaacccctgcaggacgagcgccaaaaccgccgtacgcgccgcactgtgctctccgcagaaaacctggacgcattgaacacgctgcacgagcggctgctagaatacgacgcacggctcgcggaaagcaacccagagtcctcatacatcgagcagttctggtatgacgcgtacttgctatatgatgcaactgtcgttctcaacgtcaacccgtacttccaactgcaggacgacccaaccatcaaagacacaccagagacggcggcacagggcccctatggcgcacacacggtgcaggttcgtcgtgccgcacgactcaccacctctattctcaagttcatccgccagattcgccacggcacactccgcacagacactgtgcgcggcaaaacgccgctgtcgatggaccagtatgagcggctattcggctccagtagaatccctccgggtcccggcgagccctcttgccacttgcaaacagacgccacgtcgcatcacgtggtggcgatgtatcgtggccagttctactggttcgacgtgctggacacacgcaacgagcccatcttcgccaccccagaacaactggagtggaacctctactcgatcatcatggacgcggaatccgccggaagcggatccgcgccctttggcgtgttcaccacagagtcgcgccgggtgtggtccaacatcagggactatctgttccatgcggacgactgcaccaactggcgcaatctcaagctgatcgactccgcgctgttcgtggtctgtctcgacgacgtggcgtttgccgccgatcagcaggacgagctcacgcgttcgatgctgtgcgggacttctaccatcaatctcgacccgcaccaacaccagccgccattgaacgtgcagacaggcacctgtctcaaccgctggtacgacaagttacaactgatcgtgaccaagaacggtaaggcgggcatcaacttcgaacacaccggtgtggacggccacactgtgctgcggctcgccacagacatctacacagactcgatcctgagcttcgcacgcggtgtcaccaagaacgtcgtcgacatctttagcgacgacgatggaaaaccatcgtcgtcgtcgttggcctcggcggctcactccgccaacttgatcaccatccctcgtaaactggaatggcgcactgacaatttcctgcaatcgtcgctgcactttgccgagacgcgcatctcggacttgatctcgcaatacgagtttgttaatcttgacttctccaactacggcgcgtcccatatcaagacagtgttcaagtgctcgccagacgccttcgtgcagcaggtgttccaggtcgcatacttcgcgttgtacggtcgcttcgagaccgtgtacgagcctgccatgaccaaggcgttccaaaacggccgcacagaggccatccgctccgtcacgggccaatcgaagctctttgtcaagtcactactggaccaggatgcctcggacgccaccaaaattcagctcttgcacgacgcctgtacggcgcactcgcaaatcacaagggaatgctcccaggggctcggccaggaccgtcacttgtatgcgctctactgcctctggaaccaatggtacaaggacaagttggagctcccacccatcttccgcgacaagtcctggactaccatgcagaacaacgtcttgagcacctccaactgcggtaacccctgcctcaagagcttcgggttcgggcctgtcaccgccaacggcttcggcatcggctacatcatcagagaccactccgtctctgtggtggtgtcctcaaggcatcgccagactgctcggtttgcgtcgctcatggaaaagtcgctgctggagatcgaccgcatcttcaaacggcagcaagctcgcgcagcaaaacccgctgccaggaccactgctagcgccaacaccaaatcagaagacatgaaatacctgttgtccggctacgattacttcgacgtgagcgtgtccggttga

SEQ ID NO: 4527 - DNA, 2064 bp, Saccharomyces cerevisiae
atgccttacaaaatcaaccgaatgaaaaattcgctcgagataaatgaaaccggaggtaccttattggttgatgagcggaagagattaagaataggtgagttatatcgctacaagttttccgtgaacaaagatgtaattaaggaacaagggctagatgtatcgcatctattcttgaggatcaagaacgaggaaagcgcgcttctgcgaccgctttatttgacggggccatattctttttacatcgatgttaggccgcataactataatgagaatcgcaagtttccagggaaggaaattattccatttgttgaaaatctaaagccggacgaaagatttaaagtaaaaatattattgaatgagaattctagagttggcgacacttctctttattcatggacaatagatataatttcgcagttggcggtaaccacaattccgaagctggaattttcgtttaggatagggactacaaggaaggtggtcaagaaatcgaatgggctctttaagagtattgaaggtgtctctttagagatgtgggatactgaaaccctttgggatttaccaccaaaatttccagaaaagcctgtacatctcgttattatgacacatggtatattttctaatatcgggtgtgatatgctatatatgaaagataaaattgaagaaatgacgtttcctatggatgagtctattaatccgaatataattgttcgaggttttatgggcaacgtcgggaaatcaggtcacggtatacattgcttgggcgttagagttggaaagtatgtgcttgagactgttgataagttgaataaaaagtacaaagtagacaggatatcattcattggccattccctaggagggccaactcaatccatggcggtgcgttacataagtattaaaagaccagatttttttgatgcagttaaaggtgttaaacccgttaattttattacgttagctagtcctttcatcggtgttattggcgacttccccttttatttgtctgttccactggatatgggcgcgcttggtttgacaggaagggacttgaatttaaaatatacaccgttaacgtccaaagatgggttgtatgcagacgatgaagtgtacccagaacattccaagtacatattagaaattcttccacaggcgccggctaaaaaagtatttgagtcttttaagaggagaacgatatatgccaatgtcatggatgatggtattgttccattacgaactgctgcacttttgtatctggattggcgaagcatacacaaagtccagaaaattaggaaaaaaaataagaactctccaacttcaagcgagtttgtgtcctccgatagcccagagagtagtggagcatcatcaccttcaaacgaaaatggtaacaacgtcggggagattcctgcagaaagtccaaacaaaaaagcgacgttgcagtggactttacctcaggccgttatccacggaagtaaaataaataaatataagagaggacaaactaatgaagccaactcagattcggataatgaacaaggagtatttcttgatggtcaaaagttcgaacctccaaaagaagccaatactgtattgtctgcattatcggtattgacagctgccataccagatcaggagtatatcaaaaacccggctgtaaggaaagatgaagtcattcatgataaactttatcacccggaagaattacctccgccgcattatgagaataggcctatcgttaagaagcttatatatcctaatgagagtgtcaacaggattcaagagcgcattgctagagaatggcaagaaacgatgacttggagaaaagtattagtgcagatccagcctgattcccataacaatatcgtagtaagaagaagatttgttaatttatacggctatgttgctgtggaacacatggttgagcaccatttcggatccaaggtttgtagcgagctggctgaagatgcaaatgagccaaaagatgagccaaaccagtcatcgcaagcggaccggtcgaatgagtataacgagggggaaatatcaaagggcgcggagaatgccacatga

SEQ ID NO: 4528 - DNA, 2064 bp, Saccharomyces cerevisiae
atggacactttagagccaacagccgttgatacgcatgtttctgcggagcagattctgcgggatgtgtacaagaaggggcaaaaagcaagaggatcgactaatattgatatattagacttggaggaacttcgagagtatcaacgaaggaagagaacagaatatgagggttatttgaagagaaaccgactggatatgggacaatggattcgttatgcgcaattcgaaatcgaacaacacgacatgaggcgcgccagatctatctttgaaagagcattattagtagatagttcattcatccccctttggatacgatacattgatgctgagctgaaagtcaaatgtattaaccatgctaggaatcttatgaacagagctattagtacgttgcccagagtagacaagttatggtacaagtatctcattgtcgaagagtcgttaaacaacgttgaaattgtacgatcactgtacaccaaatggtgctccttggagccaggggttaatgcatggaattctttcgtggattttgaaataagacagaaaaactggaacggtgtaagagagatttactcaaaatacgtcatggctcacccgcaaatgcagacatggctaaagtgggtgaggtttgaaaatagacatggtaatactgaatttacgagaagtgtgtattctttagcgatagacacagtagctaacctccaaaatttacagatttggtctgatatggaggttgcaaaattagtaaattcatttgctcattgggaagctgcgcagcaagaatacgaaagatctagtgctctttatcaaattgctatagaaaaatggccctccaatcaattgctcaaggcaggactgttggattttgaaaagcagtttggtgacataaactcaatagaagaaactattagctataaaaggaaaatggagtatgaaacaatattgagtaataacgcctatgattatgacacctggtggctgtacttggatctcatttcagaaagtttccccaaacaaataatgcaaactttcgagaaagctattgtggacagccgaccaaaagaactatcaaaaaatgttcagtggaaaaggtatatttatctgtggatgagatatatatgctatgttgagttagaattggaaaattcgcttttagaagaagaactttttcagaggttaattgacgacatcatccctcataaacatttcactttttccaaaatatggctaatgtatgctaaatttctgatacgacatgatgatgtaccgaaggcgagaaaaattttgggtaaagcaatcggtttatgtcctaaggctaaaactttcaaaggatatatcgagttggaagtgaagttgaaggaatttgatcgtgtgagaaaaatatatgagaaatttattgaatttcagccctctgatctacaaatttggtcacaatatggagaactagaagaaaatttaggagattgggatagagtaagaggtatatatacaattgcactagatgaaaattctgatttcttaacaaaggaggctaaaattgtattacttcaaaaatacataacatttgagacagaatcacaagaatttgaaaaggcaaggaagctttatagaagatatttggagctcaaccaatattccccccaaagctggatcgaattcgccatgtatcaaacttcaaccccgacggagcaacaactattagatttagcaaaactgcaaagcgaaaatgtggatgaagacatagagtttgaaattaccgatgagaataaattggaggcaagaaaagtttttgaagaggcgatagtttttttcaaggagaaggatgataaacaagggagactgtctattttggaagcgctaaaagactatgaagaaacttacggtactgaactcgatcaagaaaccgtcaagaaaagattccctaaagtaatcaaaaaagtgaggttacagaacggtgtggaagaagaattcgtggattacatttttcctgatgatatcgatgatgacaagccaaaaccatcaaagttcttggaactagccaaaaaatggaaacaggaacaggcactttga

SEQ ID NO: 4529 - DNA, 2064 bp, Saccharomyces cerevisiae
atgtgcgccagtttaaacgaggtaaaaaagaatgacacctatggggtctcacaaaagggctacaatgacaatttcagtgaaagtgagggcgtccttcatggtagtaagtcgatgcccactagcatgaaaaatatgctacagtctcccacgatggtcaacatgtgtgatattttacaaaacaaggaagctgctaatgacgaaaaacctgtgatacctactacggataccgccactgcggggactggtactgaagatattagctccactcaatccgaggaaactgatcagaatagtcatcttattgcctcagagatcttggaaggcactttcaaagatgtatcttacaaggaatatgcaaatttcttgggaaacgataacaataatcaagtcttgactgagtttgtaaagttattgagtcctttgccgtcgtcactattagaaacgcttttcaatttatcgaaaagtatatatttcattgcagaagcgcaaaatatcgaccggatactagagtgcttgagcatagaatggatagcttgccacccgaacacacattggaagtcaggctataagtcatgtcatatagtcttattttccctgttgatccttaattcggatttgcacaacaactttcaagttgaccataaaaagattaagttttccatggttgcatttatcaacaatacactgagggcactaagagaggaaaatgaatacgaagaattgaaaatatactcccgcgaacatttgatcatcgaagaactttccgaatactataaaacgttaaatgaaacgcctttaccgttatgcacagaatctagaacatcaataaatatatcagataaccaatcttccttgaaaaggttctctactctaggatcacgggaatttagtacatcaaatttacgtagtgttaactctaattctactacactatattcaagagatggtcaagtatctgtacgagaaatgagcgcaaaatcaaataaaaactttcacaataatcaccccatggatgcactctaccttaaagagtcttttgatgacggtttaattaccgaaaacggctccagttggttcatggacgatttaattcttataagcaagaaatctttaccacgtaaatattctaaaagagacaaagatcaagtggcggcaccaaaaatgacctctaagagaaacaaatcgttcttcggatggctaaaaccatctaaaacgactacacttattgagcacacatctagaaggacttctttatcgtatttgaataaggattctgaatgggagagggtgaaaatacaggtcaaggagggcagaatttttattttcaaaattaaaccagatgttaaggatatcatccaatcaagtgaaacagacagtgctaccatcgactatttcaaagatatcagtagctcttattttgcttactcactgcttgaagctgaagcacatgtcgtgcaagataatataattataggtagtggagcaatgaaatcaaatgtgtgtaacaaaaacaccaagaggaaaagtggcaactttaccgttagttttccagagaatatcaacggaccaaagcttgttctggagttccagacgagaagtgttgaagaagcccacaagtttatggactgtatcaacttctgggcaggtaggatttctccagttcctttaacacaattcgaagccgtatctaacgcagaatatggatggagtgacaagatcttgacagagcacgcttccctcaatcttaaaaatattgttgtaagtgaatggaagccactattggggctagagctactatacgaagatgcgaaagatgtagagatggtcgaactaaaagaaaggctaaaggaattgatgaacttcaccagacagcttggtatatggatagataaacataacgaaataaaggataagctggtcgaaatttggagctttgacgataactattttgaagcagtcatgaataattggaattcgagatatttgtatatgaataatcaatataagaaacgactgagctacttgaaagctttgcaaaaagccatgggttctgttcagttctaa

SEQ ID NO: 4530 - DNA, 2067 bp, Saccharomyces cerevisiae
atgaaagtccaaataaccaatagtagaacagaggaaatcttaaaagttcaagctaataatgaaaacgatgaagtcagtaaagctactccgggcgaagttgaagaatcgctaaggttaatcggcgatctaaaattctttttagccacagcgccggtaaattggcaagaaaaccaaattataaggcgatactatctgaatagtggacaaggctttgtctcttgtgtattttggaacaatctatactatattacaggtactgatattgtcaaatgttgtctttacagaatgcaaaagtttgggagagaagtagttcaaaagaaaaaatttgaagagggtattttttcagatttaagaaatctcaaatgtggtatagatgcaactttagaacaaccaaagtccgaatttttgtcgtttctattcagaaatatgtgtctgaaaacccaaaaaaagcagaaagtatttttttggttcagtgtagcacatgataagttgtttgcggatgcgttggaaagagatttaaaaagagaaagtttgaatcagccttcaacgactaagcccgttaatgagcccgccttatctttttcatatgattcctcatctgataagcctctctacgatcagttacttcaacatttagattctagaagaccatctagtacaacaaaatcagataattcgcctccaaaattagaaagcgagaattttaaggataatgagttggtaacagtaactaatcagccgcttttaggcgttggcctcatggatgacgatgcgccagaatccccctctcaaattaatgattttattcctcagaaattgattatagaacccaatactctcgaattgaatggtctcacagaagaaacgcctcatgacttacccaagaataccgctaagggcagagacgaagaagattttcctctcgactattttcctgtatctgttgaataccctacggaggaaaatgcgtttgatccgttccctccacaggcttttacgccagctgccccttccatgcctatttcctatgataacgtgaatgaaagggattctatgcccgttaattctcttcttaatagatacccctatcagttatcagtggcacccactttcccagtgccaccatcatcatcgaggcaacattttatgacaaatcgggatttttattcatctaacaataacaaggaaaaattggtatctcctagcgaccctaccagctacatgaagtatgacgaaccagttatggattttgatgaatctcggccaaatgaaaactgtacaaatgcaaaatctcacaactctggccagcaaactaaacaacaccaattatattctaacaacttccagcaatcttacccaaacggaatggttccaggatactacccaaaaatgccgtataatcccatggggggggatcctctactcgatcaagccttttatggcgcggacgattttttctttccaccagaaggatgtgataacaatatgctgtatccacaaactgcaacttcatggaatgttttgccccctcaagctatgcaaccagctccaacctatgttgggagaccatacacaccgaattatagatcgacaccaggttccgcgatgttcccatacatgcaaagttcaaattccatgcagtggaacactgctgtttcaccttatagttcgagagcaccatctacaactgctaaaaactatcctcctagcacattttattctcaaaatataaatcaatacccacggcgaagaactgtgggaatgaagtcttcacaaggaaatgttccaacaggtaataaacaatctgtgggcaagtctgcaaaaatttcaaagcctctacatattaagacaagtgcttatcagaagcaatacaaaatcaacttggaaacgaaagccaggccaagtgctggtgacgaagattctgctcatcctgataagaacaaagaaatttcgatgcctactccggattccaatactttggtggtccagtcagaagaaggtggagctcattcacttgaggtagataccaatcgaaggtccgataaaaaccttccagatgcaacctga

SEQ ID NO: 4531 - DNA, 2067 bp, Saccharomyces cerevisiae
atgcctgtttcggaagcgtttgccaagttgtgtgtgaatgagaagcctcctgctgaatctgccgttgcggtgaagtctttggtcttcaaaccaaagactccaaagtccgccacccctgttcctatcgttgtggtggctttgcaatctactactactccttctgcgttgattgccaacgctacgtccagtaaggatccaagattggctcgcgatgatttggtcaagcaagcgttccaatctgaatccgctagagcttttatcttgggggatttggctaacgccacgtccaattttcacttgctaattgatcacgagttgggtactgttgacggtgacactatcttgcagttaaacgacagtacttatatgaagaaatctgacatgatgaaatttctaaacaattttgaggatagtcaaaaagtggttgatttctcccaagaggtgtctaaggaaaccgctacagaaggcaagaaacaacagaaaaagcagcaaccttctaaggcaggcactgcagcagcagcagcagcagcagctttggaagacgccaaacttattggtatcaccgtagacaaagcgttggatttcccaggctggtaccaacaaatcttgaccaagggtgaaatgttggactactacgatgtttctggctgttacatcttaagacctccttcttatgcgatctgggaaaacattcagaaatggttcgacgacaagatcaaggccattggtgtacaaaatgcctatttcccaatgtttgtttcctcacgtgtgttggaaaaggaaaaggaccatgttgaaggctttgctccagaagttgcctgggtcaccagagctggctcctctgaattggaagaaccaatcgccattagaccaacttctgaaactgtcatgtatccttactacgcaaaatgggtccagtcttacagagatttaccattgaaactaaaccaatggaattctgtggttagatgggaattcaagcatcctcagccctttttaagaaccagagaattcttgtggcaagaaggtcatactgctcacttgactgctaaggatgccgaagaggaggttttgcaaatcttagatttctacgctggggtttacgaagagttattagctgttccagtggttaagggtagaaagaccgaaaaggaaaaatttgctggtggtgacttcaccacaacttgtgaaggctatattccacaaaccggtcgtggtattcaaggtgccacctctcaccatttgggccaaaacttttctaagatgttcaatttgtctgtggagaacccactaggttctgatcatccaaagatctttgcgtaccaaaattcatggggtttatccactcgtgtcattggtgtcatggtcatgatccactctgacaacaagggtttggttatcccaccaagagtgtcccaattccaatccgttgtcattccagtgggcatcacaaagaagacctctgaggaacagcgtaaacacattcatgaaacagccagaagtgtggaatcccgtttgaaaaaggttggcattagagcctttggtgactataacgataattacacaccaggttggaaattttcccaatacgagctaaagggtattccaatccgtattgaattaggtcctaaggatattgaaaaaaaccaagtcgttgtcgttcgtagaaatgactccaagaaatacgtcgtttctttcgacgaattggaagcccgtatcccagaaatcttagaagaaatgcaaggagatttgttcaaaaaagccaaggagctattcgacacccacagagttatcgttaatgaatggagtggttttgttccagcattgaacaagaagaacgttatcttagcaccatggtgtggtgtgatggaatgtgaagaagatatcaaggaatcttctgcaaagaaagacgatggtgaagaattcgaggaagatgacaaggcaccaagtatgggtgccaaatctttatgtatcccattcgaccaacctgtattgaatgaaggtcaaaaatgtatcaagtgtgaacgtattgctgtcaattactgtatgttcggtcgttcttattag

SEQ ID NO: 4532 - DNA, 2067 bp, Saccharomyces cerevisiae
atggagtacatcaagattgccaaagtatctaatgtagtgctgcatagaagaggtacggccacacaaggtactttacatttgactactcaccatttgatctttgagtcaccacaattgtcgacggaattttggtttccatatcctttgatctatggagtgcataaaaacccgggtagtacattactgtccaagttgacttccactaatcaaatccaattggagggaacggattcacagaattacaagctttaccagggtaaggatctatggtcttttgtaaatatcaaggtaattgggaaagattatgcggtattctcattggatttcggtggtgatttacatctacaggcaagaaaggtgtatgattccatcttaaatttgacggtcctgtccaatatcacgcaactatatgcatttatttacatatccaacaatctggaaaggaaactaccttcacccgatagctgggatatatatgacccaattaaggaatttcgaaggcagggcctcgacagtaaagatgaaacatgtccttggaggctatccacggtaaacgaacactatgaattttgtccaacgtatccctcaaaactttttgtaccaagatccacgtcagatatattattgaagcatgcttcgaagtttagatcacagaaaagaattcctgttttaacttatcatcacaaggcaacagattgcaacattcttaggtcatctcaaccattaccggggttgatcaatcagaggtccattcaagatgaaaaattagtttgggaaagcttcaactcattttgtaataaagatattagaagaacgaaacatgtaatagtagatgccagacccagaacaaatgcattagcacagatggcgttgggtggcgggacagaaaatatggataattataatttttttttagctgataacaatatgggtgtcgataaaagtctaaaactgcccacagttacacggttatttcttggtatagataacattcatattgtttccaacacagctgcatacatgacggaagttatctgccaaggtggcgatttgaatttaccactggaacagaatttaattaggagtcaaaaattttccaattggttgaagttgaacactcttattttaaaatccgttgatatgcttttaaagtccatcattttcaatcattccaacgttttggttcattgttctgacggttgggacagaaccagtcaagttgtatcactattagaaatttgtttggatcctttctatagaacttttgaaggttttatgatcctagtggaaaaagattggtgctcttttggtcaccggtttttggaaagaagtggtcatttaaactctgatattagatttcatgataacactatgcattccaacttcaacgatgtggataccaatggcgatgatcttgacataggtgttaacactcaagacgattatgctgaagatgatgaaggaggtgaagatgagacgaatttaattaatttgagtagaatttccaaaaaatttaacgaaaactttaaattgaacaagaaaagtctaaagttcgtctccccagttttccaacaatttttagactgtgtataccaacttttgacgcaaaacccagatctatttgaattcaacgaaagatttttaagaagactagtttaccacttgtattcatgccaatatggaacattcctttccaatagcgagaaggagaaatttcaacagaatttgccaaacaagactaaaagtgtctgggactacttcagatctagaagaaagcagttcataaatccaaatttcatacagagaaaaagaagcggcatgaatgagcacgatcaaaaccttgaagaggaagaaaaagtggagtggatttcgccggatctgaagaaagtccaatggtggtggcagttatatggaagaaaagattcagaaatgaatgatgaattacgccataaacgagactcagtacccatatcggtggataaaaagagtaaagagcatagtaattccgatggcggtaagggtttaaatttgtcaatttttggatttgatatgtttaatagaaagtga

SEQ ID NO: 4533 - DNA, 2067 bp, Saccharomyces cerevisiae
atgggggaaaaaaggacaataatcaaagcgctgaaaaactctgcagcgtcccacttcatcaagaagttgaccgcagatacttccctgtcgtccatacaagaggcaataaacgtcgtgcagcagtacaatgcaacggatcccgtgagattaaagcttttccatacgcctcggatggtttcgcagggggctcattttgcattttgtttgcccactaagaaaccacattacaagccattactgctttcgcaaaacgcacttgatgagtttaatttggtgcaggatcaggacttggagaaaatactatccggtgagaaagtatattattccgatagtatctttccctatagtacagtgtactccggatttcaattcggctcatttgctgcacagctgggagacggacgtgtggtaaacttgtttgatcttaaggacaagtgtagcggacaatggcaaacgtttcagttgaaaggtgccggtatgacgccattttctcggtttgcagatgggaaagctgtgttaagatcaagcatacgtgaattcataatgagcgaggcgttgcacagtattggaattccatccacaagagctatgcaattaactctgttaccggggacgaaggcgcaaaggcgcaatcaagaaccgtgcgctgttgtatgccgttttgcgcccagctggatccgcttgggtaacttcaacctattcagatggcggcacgacttgaaagggttgatccaactatcagattattgcattgaggaattgtttgctggggggacccaatttgaggggaaacccgactttaatatattcaaaagggatttttttcctgacactgagacgaagattgatgagcaggtggaaaaggatgaaactgaggtgagtaccatgaccggagataacatttccacattgagcaaatatgatgagtttttcagacatgtagttagcttgaatgcaaacacagtggcccattggcaagcgtatgggtttgctaacggtgttttgaatacggataacacctccattatgggcctgacaattgattatggcccctttgccttcctggacaagtttgaaccaagctttaccccgaaccatgatgacacagcgaagagatattcgtttgccaaccagccaagcattatatggtggaacttgcaacagtttgccaaggatctcgcatgtctgctgggtcctgaggcccgtgaccttgaattgttacttaagggcgaactgaattctgttgatgacgccctagagaaaaccatgattgaaagggtccagaagttggtagagctcagtgctaatgagtacaagtatgtgtttacgacaaggtacgcgcagataatgtctcaaagactcggtgtagatctggatctggaaaagtgcatgtcttctacaaacctcaaagatatcgaacatgcagccgagaaggctaaagagttctgcgatgttatcgtcgaaccattgctagatattctgcaggccacaaaagtcgactataacaatttttttatccatctacaaaattacaaggggcccttcttcatcaaagataaaagtgacaccgcaacactttttggagcattcgatgaagagtacttgggtatgttcttcaactccaagcaactgcagcaaatggcagaaactgaagaggccttcgcggctggtgagaaggtctttgacgctaacggcgaattgcgtttgctcaacgaaaaattgcaagaaatacgcaattggacccaagactatttgaccttggtcccacccacggaaactgctgcaagagcgtcgcttgccaagaaagccaacccgttgtttgtccccagaagttgggtactggaggaagtagtcgacgatttaatgtacagtcaaagggatggcctacaagatcccagttcggagctagatacatctgcgttgaagaagctatacctaatgagcgtaaacccatacgaccgcacgaaatgggatgtcactctgcggccagaactggagacaaaatgggctgacctttcccaccaagatgacgctaagtttatgatgcaagcttcctgcagtagctaa

SEQ ID NO: 4534 - DNA, 2067 bp, Saccharomyces cerevisiae
atgggtctaaaaattacaaaaggacagctgagaaccaaggatctgaatcaatcatcctcaaagtcatcgcagtcttcaagaataggtgtagacacttgtatatttactagaatgctaccccgaataaacactgcaattaatctcacagagcatctgctgagaagatcttttcattcactgacaaatctacagaaaactcaagtaaaagaaagactacatgagctagaacgtcacggtttcatattaaataaaacatccaaacaattggaaaggataaattctaagaaaagaagacaattgaaaaaactgcaaaagacagcataccccaaggatcaagcttttcatattcttcgaaaatttcataaaataaataatgaggcattagcagatacaaaactggggccaactagccaaagcgacttgaagttcctatccttaaccaaagataagagactcttttataccatactaggcgtcaatggagaacagttacgtgattccaaattaatcgccaatgatgttcaaaaatttttgaaaagaggacaactggaaaaagctgtctttttggctaggctagctaaaaagaaaggcgtcgttgggatgaatttgattatgaaatattatatcgaagttgtgcagtcccaacaaagtgctgtagatatcttcaattggcgaaaaaaatggggagtccctattgatcaacattccatcacaatcctctttaatgggctctcaaaacaagaaaatttggtctcaaaaaaatacggagaacttgttttgaagactatagatagtttgtgtgacaaaaatgagctcacggaaatagaatataataccgctttggcggcactgataaattgtaccgatgaaacactagtgttcaaacttcttaataaaaagtgcccaggtttgaaaaaggatagtattacatataccttaatgataagatcttgtaccaggattgccgatgagaaacgttttatggtggtactcaatgatttgatgaataaaataccagactattgtgtcgattctaaattgttatttgagtactgtgaagtaatatgtagccagaagtcaccaaagattgagaagcaaggaatgggactatgggccctctgtgaatattttcaatttgataagaccattttcaagaagtatttgacacaaagcgattttcctacgttagttccactaagtcattggaacatcaataagccatttcctctcaacaaacatgttgtgggattgtttatgaattactgtttgaaaaacaaggaatatgatcttgctatggaaatatttaagacattagaggcacagaacaaccaaatgttagatcagagcatataccacaaatacatggaaactgtcataacaacgaggcccatcacttgcggcgacgagtgtctggacatttatgaacgggtagcctcgtcggcacaaatctcaataaccaggaggacgttaattttggtgtacaacgcattccaaagacaaagtctcaaggccgttataaacaaagatgcatcaaatgctgaagctactttgcacaagattcgggggtttatagatagcgtagaggccacatactcatcaaagttgaacggcaaagtttacaggtttaattcatggaagttcctgtttcctatcgttaaaaatctgaacatgaatgataaagtgtctacagtggaactgaaaagtatactagatgaatacttgaaatctttattgaatggtgagttcgggaaggaatttaaagcgagcatagaagacaagcggtttgttacgttggagggaattcgtttagtcaaggttttaaccgagagaatcaagcttccgtcactggacagtgaggaaatagccagtttaaaaggcacggaaagaaagaagtttcttgccagaaggcaccttttgaggctgaagcaaatattactggaagatttagcggacattgaaggcaactcaagaaggaagggtgatagcgaaaatacaagtaccagtgaagagcgcatcatggaggacttggccgagctgatacttgaaaccagctatgacaagttttaa

SEQ ID NO: 4535 - DNA, 2067 bp, Saccharomyces cerevisiae
atggttttagaaacgctgaaacaagggcttgacagcagtcaaatacatgaagctttaatacaactagattcctatcctcgcgaaccggtggatctagatgcctcgatggttctcataaaattcgtaattccagtttatccatcactaccagaaagatcgaaggtgatattgagacggctagcttctaaatcgtttacatttttatgccaaattgtcaccttctcaaggacaataagtggccgcgatggactgcaagagatacgcatataccaagaaattttagaagacatcatcagttttgaaccgggatgtttgactttttatttaaaggcaagcactactagcaaagcagaccgtgatagcattaaggcccttttctttgggagcaagttatttaatgtgttggccaaccgaattgatatggcgaaatatttgggataccttcggcttcagtggaaatttctacttgagagtaatgaaacagatccacctgggtttttaggggaatggttagtttcatcatttttgcttaacccagtgctagcggcagatatgttattaggcgaattatttttattgaaagagtcgtatttcttttcttttcagaaaatcatatctgctagtagtctgatagatcaaaagaggctgattgctaagtttttattaccatatattcaagttatcgtgactttagaaaatttgaacgatgttaggaaaattctgcggcggtttgatctcgataaaatcataagtctgtccgtattatttgaaatacagtcgctgccattgaaggaagtgatagtacgtctgatgagcaaccactcttccacgaagtttgttagcgctttggtaagtaaatttgctgattttacagatgaggaagtagacacaaagacatgtgaattgcttgtactctttgcagtgcacaatctcaatcattcccagagagaggaaatagcacacgatgagcggtttttgaatggcgtgaccaaacatttaggtagcaatgaacgtgaggcaagggagcgtgcgatgtttattgccaagcttttatcaggcggtcatctgaagtacgaaagtgattttaaaatcaatataccgaatgtcaaattcgaaagcaatagcgatgataaaatcattgatttccaatctttaaaaaatccatccatatgcaatacccaaactgatgtgggtaaggataagattactgaggtctcgggtcatgttcaaagccttacattggactgcagtgatagcgatgatgaagatgagaacgatgagcgggagattgttaaacgaattgtatttttaaaagatttaatgaaagaatacgaaaaaactggggaatctcgaaaagctccattgataccacttctgaagcaaacagtgaaattgatacggcaaaaggcggattttcagttagaggttggctattatgcacaaggtattctgtcaagcattgtgtgcttgaataatgaatttgatgaaccgcttttcgagcagtggagaataaacgctctaacaagcatactggtcgtccttccagagaaggtgaatggcgctataaatattctattcaattcagaactgtcgttacagcaaaggatgtcactattgtcggctctgggtctttctgcaagagagttgagagggcttgatgatcctactattgtcaagcccaagtttgattttccaacaaatcgtttaccgtgggatgatcaaagccatcataatagtaggcttgttgaagttcaagagtcaacaagtatgataaagaagacgaaaacagtatggaaatctagaaaactaggcaaggatcgagaaaaaggaacgcaaaaccgctttagaaaatatgctggtctattcttctatccgctagcacacggttggcttaatggaattgacgtaggcacatacaatcagctttttaagtcgcattatttaacaacactgcgtatcatatactcttgcgctaacccggtccacgattttgaatccatgacggagttgatgaatcatataattagttcagccatagaggaaggaatttctctcaataaaggttag

SEQ ID NO: 4536 - DNA, 2067 bp, Saccharomyces cerevisiae
atgtccattgacgaggctgttgccagatatagagatgttataggcaatctagcaactggcaatttaaggcggattgttatacagtcagaaaaactggcccagatcattgcatcttcaaaaggtaccgttcgtttccaccataaaactcgcagcggtaaaacagtaatatacaaatgcatcaaaaaggcgctgctttccagtgtcgcgtctctatcgtcagagttttcctcagaaacagatgttcagcaattcctccatttaaattacatatatcaatctcacttccaagctttgagtggacaaataaacaaatattgcggcatgaagaaatactacgagttaaagtttgcagcaatcgactacttagaaaccgaagtccaaactaccgggcttacactctcaagattctgggtggcatctttagatgagttcattaaaaaagagcgatggccagataatggatctaactttcaaatcttttacaaactaatggctgagtattcgtcttggaaatgggattctgatgataaaaggcaactccagttcatgtacgaatttcgaatgaaactcaaagaatgtttggtgaaattttacgagaattttgatcttcaaaaatctagcgatcctctgaaagaactcattataccttgggaaaagattgtttatgtcgccaactgtatcgatgcattcactggagagcaagttaggatcgacggtgctgaattaatctggacatccaaaaatcttgtgttctcttcgatttcttctgccgttcttagattaaatgaccttcaaaatatgttcagcgcattccggccttatggggaagaagcattagttcaagactttgcgcatatacgatctttaaagtgggatagtaatgataaagttgaaagcttaattcgtgcccttatttttaatgatatgtttccttatttcaataaggaacaggtagatacgaaggcagatggtatattctttttgcgcttactgagaaaaaacttcaaagaacacattaatgacgttaaagattttcatattcaagtgataaagtacttgaattcccaatttaaaaataattacagcacattgatgacgtcatcgaaaactcaggatagaaggaaaagtcataatatgccttcttctatcttagacgatggtaacaaaattggaatgcatgtttcgcctatcgatgaatactcacattttattgataatgatgaaccgttgtggcgagacaaagtatatccaaagatttacacaaatgagcaaacacctacacctgacgcatcagcaatatttgattctcacaagatatatgcaattatatcgctgctgcgatattacttacctgagaagagaaagttttttcggatttattatctgcccagtatttttaaaaggatattatattacggtgcaaagtttgctcaactatatttcatggaaggttgcttggaacggctagtaatagaatctctccaaattctagaaccctctttggtacatgcgataaataatttgatcaagtctagcatagaatcactcaaaaatgtaacagtgacaagtgatgacaaaacttcatctggtgtcattattttgtcctacaaagaatttaagtcactatctgaagttaacaaagatttcaatgaaccattttggcctaaccaatcaattgcgaatagttggccagatttcgcgaataagcaattaaagaggggtcaaattttgcaagacgcatttgcattccacctttttgaaattgaactaccaattattatcgatactacaagaaatacgcatttgaaactcgtttccaacatgtgtactacgagcatattgtacttatataatgaagttgattccttatcattaactagcatacaggaaaaattagctgttttaccgacaagtaaacggaatgaaatcttattgtacaatttgaacaggctaacaaaattgaaactattgttgttgaaagagaacgaaaaaggacaaaagttttacgcatttaattttaagtacaaaagggatggacagaaaacatcattaataaggttaatttaa

SEQ ID NO: 4537 - DNA, 2070 bp, Saccharomyces cerevisiae
atgacctcaacactagccactagactctcgacatattctatttcattaatactgcagcgcatcaaaattataaaacgttgttactcagctcccgtactcagagattaccaacaagatgctatagatgcatgtgtgaattctattcgacagggcaccaagagaattggtgtatcattagccactggtggtggtaagacagtgatattctcaaatcttatcaatcaattgcgccaaaactattttaaagaacgtcaaggaaattttaaatcgttgatcctggttcacaggagggagctggccttacaagcgacggccactcttaaaaaaatattccccgacttaaaggttcacatagaaatgggaaaatatgattgcgatattgaagattctgacgtgattgttgcatctgttcagacgttgattagaagactccataaatatgatactaattcagtgaatctcatcatcattgatgaagcacatcattctgtggctaattcttatagaagtatcttagatcatttcaaagcttcaactgcagaaaccaaaatccctgttattggctttagtgcgactttcgaaagagcagataaaagagctttgtcaatggtaatggataaaattgtgtaccaccggggaatactggaaatgatcgatgacaagtggctatgtgaggcaaaattcacgtcagtcaaaattgaagcagacttatcagatgtaaaaagcactgcagatgacttccagctggcaccgttatcgtctctaatgaatacgaaagaaattaatgaagtaattctgaaaacttaccttcataaaaagcaagagaaatcactaaaatcaacattactgtttggcgttgataaagcccatgtacaaagtttgcataaattatttaaagacaacggtattaatacggactatgtcacctcggatacaaaacagatagaacgagataatataattcaaaaattcaaaaatggggaaactgaagtactcatgaactgtggaatattcacagaaggaacggacatgccaaatattgattgtatactactgtgtaggcccacaaaatcgcgttcacttttgattcaaatgattggaagaggtttacggttacaccattcgaaagaccactgtcatatcatcgacttcattggagcttctagtgttggagtggtttcagcgcccactctactgggtataaggagtgatgatatcgaatttgatgatgctacagttgaagatttaaaagcaatccaaggagagataatagctaaacaacaaaaaatcgacgaaaggttaagggctttatttcagactgatgaagcagcaatggaaaatgtaactgaaagaaatagcgttgccgattggattcacagtgcaaattcggttgatttaaccttgtgctcctttgatagttttaggaattttacacagagcaataactcatatccatctggcaaggagtttgatgaagcttctgaagctgtaaaagaaatggagctgttgatgaactcacaatatccgtgggtgaaatttgcctcaaatgcgtggggcctccctttaaaaggtaagaatcatttgagaatatacaaagaaaaatccgaagacaaattgtcgatggtatatcatctaaaaatgtatcgacaattaccgtgttttataacaaataaatacgcggactatgttccaaaaagtataataaaagacgctaatctttggaatgtaatgtcaaaggtggaaaaaatcataaatactctaaattcggacttggaaggacaaacaatgcaataccaggcaatatctagtaaatactcgaaatggagacaaacagttcctacgtcaaaacaaagagactttgttttcagaaagctaaagaaagtatatggtgagtcctcaaaagattttattagattatctttggatgatgttactacttatgtaaatactaagatgacgaaaggagatgcttccaacttaatctttgccagcagtttggcacctgtctacccgttgaaatcattgttacgaatattagaatatcaaaaaagaagatcttttataaagtga

SEQ ID NO: 4538 - DNA, 2070 bp, Saccharomyces cerevisiae
atgcaagcccaaggttcacaatcgaatgtagggtctttgaggagtaattgctctgacaattcactaccgaacaatcatgttatgatgcactgcgatgaaagcagcggcagcccgcacagcgagcacaacgattatagttacgaaaagaccaatctggaaagtacggcatcaaatagtcgtgaacacagagacaaccagctaagtaggttgaagagtgaggaatacgttgttccaaagaatcaacgtaggggactattgcctcaactcgccattataccggagttcaaggatgccagagattatccaccgatgatgaaaaagatgattgtcttcttgattgcgttttcctccatgatgggccccatgggcacatctatcatttttccagcgatcaactcaatcacaacagaatttaaaacatcagtgattatggtaaacgtttcaattggtgtgtaccttttaagtcttggtgttttcccattgtggtggtcttctctatccgagctagagggcagaagaactacttacataacttcatttgcattattgtttgcatttaatatcgggtctgctctagctcctgatatcaactcatttattgccttgagaatgctctgtggggctgcttctgccagtgttcaaagtgtaggtgctggaacagtggctgatttatatattagcgaagatagaggtaaaaatttgagttattactatttgggtccactactggcgccgctactatctccaatttttggatctttgttagtgaatcgctggccctggagatccactcaatggtttatggttattttatccggatgtaatgtcattcttttgacggtgttactacctgaaacattaagaaaacaagattctaaaggcgctatcgctcaaattttggctgaaagacgtattcaagtagacaataacgaacgtggagagatacaagaagattatcagaggggagaagatgagacagatcgaattgaaaaccaagttgccacattatctactgagaagcataactacgttggagaggtaagggatcaagactcgctagatttagaaagtcactctagccccaatacttatgatggtcgagctggagaaacccaattgcaacggatttatacagaggcgagtagaagtctgtatgaatatcagctagatgatagcggtatcgatgcaacaacagcacaagttacgagaataagatcaacagatccaaagttagcgagatcgattcgagaaaatagtctgagaaaattacaaaccaacctggaagagcaagtcaaaaaagtgctatccagtaatggaggtgaaatcgctcctaaacaggtatcagcggtgaggaaggtctgggacaccttttttgtttattttatcaagcctttaaaatcattgcacttcctagaatatccacccgtggcacttgcaataacattttccgcaatttccttttccacagtatactttgttaatatgacagttgaatataaatattcaaggcctccttacaactttaaaccattatacattggtctactgtatattccgaattctgtaacatactttttcgcctcaatttacggtggacgttgggtggacatgcttttaaaaagatacaaagagaaatatggaattcttgctcctgaagctcgtatatcgtggaatgttgttacatctgtaatatctttccccattgcgctattgatatttggctggtgcctagataaaaaatgccactgggtaacgccactaattggaacagccctctttggatatgcagctatgatgacaattggtgctaccctttcctatttagtcgattcattgccgggaaagggtgccaccggtgttgctttgaataatttaataaggcaaatcttggctgcaaccgcagtctttgtcaccacacccatgttaaacggtatgggaactgggtgggctttcacaatgctggcctttatcgtcttgggtgctagcagtgtacttataatactgaaaaagcacggtgattactggagagagaactacgatttacaaaaattgtacgacaaaattgattaa

SEQ ID NO: 4539 - DNA, 2070 bp, Saccharomyces cerevisiae
atgtttggctctgggaatgttctgcctgttaaaattcagcctccgctgcttaggccactggcgtatagagttttatcaagaaaatatggtttatcaattaaatctgatggactgtctgctcttgcagaattcgttggcactaatataggtgctaactggagacaagggcctgctacaataaaatttctcgagcaatttgctgcagtatggaaacaacaagaaagaggccttttcatcgaccagagcggggttaaagaagttatacaggagatgaaagaacgtgagaaagtcgaatggagtcatgaacaccctattcaacatgaggagaatatcttgggacggacagatgacgatgagaacaacagtgacgatgaaatgccgatcgctgctgattcatccttacaaaatgtttcattatcttcacccatgcgacagcccaccgaaagagatgaatataaacagcctttcaagccagaaagctccaaggcgttggactggagggactacttcaaagttatcaatgcttctcagcaacaaagattctcatacaatccgcacaaaatgcaatttattttcgtccccaataaaaagcagaatgggctaggaggcattgcgggttttctaccagatatagaggacaaagttcaaatgttcttgacaagatattacctcacgaacgacagagtcatgagaaatgaaaacttccaaaacagtgacatgtttaatccattatcatctatggtgtctttacaaaatgaactgtccaatactaaccgacagcagcaatccagcagtatgagtatcaccccaataaaaaacctactaggtagggatgctcaaaactttctactattggggctcttaaataagaactttaagggcaattggtcactggaagatccgtctggatctgtcgaaattgacatttcccaaactatccctacacaaggccattactacgtgccaggttgcatggttcttgtggaaggaatatactattctgtaggaaataaattccatgttacctccatgactttaccccctggtgagagaagagaaattacattagaaacgataggtaatctcgatctcttaggaatacatggcatttctaataacaatttcattgctcgtttggataaagatttgaagattagattacaccttttggagaaagaattaacagatcataaatttgtaattctcggcgcaaatttgttcctagatgatttgaaaattatgactgcactcagcaaaattttgcaaaaattaaatgatgacccaccgaccctattaatttggcaaggttctttcacttcagttcccgttttcgcatcaatgagtagccggaatataagtagttccactcaatttaagaataatttcgatgccttggcgacgcttctgtcaagatttgacaatttgaccgaaaataccacaatgatatttattccaggtcctaacgatttatgggggtcgatggtgtcattgggggcaagtgggacattaccgcaagatccaattcctagtgcgtttaccaaaaaaatcaacaaggtctgtaaaaacgttgtatggagctcaaatccaactagaatagcatacttatcccaagaaatagtcattttcagggacgatttatccggaagattcaaaagacaccgtttggaattcccattcaacgagagcgaagatgtttatactgaaaacgataacatgatgtctaaagacaccgatattgtaccaatcgatgaattagttaaagaaccagaccagttaccacaaaaggttcaagaaacaagaaaactcgttaaaacaatactagaccagggtcatttatcgccatttcttgattccttgcgcccaatttcatgggatttggaccacactttgacactttgcccaataccatcgacaatggttctttgcgacactacttctgcacaatttgatttgacatacaacggttgtaaagtaattaaccctggaagtttcattcataatagacgtgctaggtatatggagtacgttccatcctcaaagaaaactatacaagaagagatatatatctaa

SEQ ID NO: 4540 - DNA, 2073 bp, Saccharomyces cerevisiae
atgaatgtattagtctataatggcccagggactacgccaggatcagttaagcatgctgttgaaagtttacgtgactttttggaaccctattacgccgtcagtactgtcaatgttaaggtattacagacagaaccatggatgtcaaagacctccgctgtagtttttcctggtggtgccgatcttccttacgttcaagcttgtcaacccattatttctcgattgaaacattttgttagcaaacaaggtggtgtctttatcggattttgtgcaggaggttactttggcaccagccgtgtagaatttgctcaaggtgaccctacaatggaagtatcaggaagcagggatttgcgattctttccgggaacaagcagaggacctgcgtacaatggatttcagtataacagcgaggccggtgcacgtgcagttaaattgaatcttccagatggctcacagttctcaacttatttcaatggaggagccgtttttgttgatgcagataaatttgataatgtcgagatcttggccacgtacgcagaacacccggatgtgccttcttctgactcaggaaaaggtcaaagtgaaaacccagctgctgtagtgctatgtacggtcggaagaggaaaggttttactcactggaccacaccctgaattcaacgtccgttttatgaggaaatccacagataagcattttcttgaaaccgttgtggaaaacctgaaagcacaggaaatcatgaggttgaaatttatgagaacggttcttaccaaaactgggttgaattgtaataatgacttcaattatgtaagagctccaaatttgacaccactgtttatggctagtgcacctaataagcggaattacttgcaagaaatggaaaacaacttagctcatcatggaatgcatgcaaataatgttgaactctgctcagaattaaacgccgaaactgactctttccaattttatagaggctatagagcctcttacgatgcagcaagttcgtccttgcttcataaagagccagatgaggttcctaagaccgtaatatttcctggcgtagatgaagatattccaccatttcaatatacgcccaattttgacatgaaagaatacttcaagtatctgaatgttcaaaacaccataggttctttacttctatatggtgaagttgttacatcaacgagtaccatattgaataataataaatccttattaagttcgatccctgaaagcactttacttcacgtgggtactattcaggtttctgggcgtgggagaggtggtaacacttggattaatcctaaaggtgtttgcgcatcaacggccgtcgtaacaatgccgcttcaatcgcctgtgactaatcgaaatatatcagttgtttttgtccagtatctttctatgcttgcttactgtaaggcgatactttcgtacgctcctggattttcagatattcctgttaggatcaaatggcccaatgacctttatgctttgagccccacctactataagcgtaaaaacttgaaattggttaacaccggttttgagcatacaaagttgcccttaggtgatatcgagcccgcttatcttaagatctctggtttattagttaatacccacttcataaacaataaatattgtttgctacttggctgtggtataaatttgactagtgatggtcctacaacttcattacaaacttggattgatatcctgaatgaagaacgccaacaattacaccttgatttattgccagcaataaaggcagaaaagctgcaggcactctatatgaataaccttgaggtcatattaaaacagtttattaactacggagctgcggaaatattgccaagttattatgagttgtggttacatagtaaccaaatagtaacattaccagatcacggaaatacgcaagccatgattactggtatcacggaagactacggtttactgattgcaaaagaattggtaagcggtagttccactcaatttacaggaaacgtttataatttacagccggacggtaacacttttgatatcttcaagagcttaattgctaaaaaggttcagagttaa

SEQ ID NO: 4541 - DNA, 2073 bp, Saccharomyces cerevisiae
atgctgcttcttccaagatgtcctgtaattgggcgaattgtaagatcaaaatttagatctggtctaatccggaaccattcgcccgttatatttactgtgtctaagttatcaacccagcggcctctgttattcaattcagctgtgaatttatggaatcaagcacaaaaggatattacgcacaaaaaatccgtcgagcaattctcgtcggctccaaaagtgaagactcaggtaaaaaagaccagcaaggccccaaccctctcggaactgaaaatcttgaaagatctatttcgctatatttggcccaaaggcaacaataaagtgaggataagggtactgattgcccttggactgttgatatccgccaaaattttaaatgttcaagtacctttttttttcaagcaaactattgattcaatgaatatagcatgggatgatcctacagtcgcccttccggcagcgattggattaaccattctttgctatggtgttgcaaggttcggctctgttttattcggcgaactgaggaacgccgtatttgccaaagtggcacagaatgccattagaactgtgtcgctacaaactttccagcaccttatgaagttagatttgggatggcacttgagtagacaaacgggtggtctgacgagggccatggatagaggtacaaagggtatatctcaagtgttaacggccatggtattccacattatccctataagttttgaaatatctgtcgtttgtgggattttgacgtatcaattcggtgcgtcatttgccgcaataacattcagtacaatgcttttatactccattttcactataaagacgaccgcatggaggacacattttagaagggatgctaacaaggccgataacaaagctgccagtgtggctttagattctttaattaattttgaggcggtaaaatacttcaacaatgaaaaatatcttgcagataagtataatggctccttgatgaactatcgtgactctcaaattaaagtatcgcaatctctagcatttttgaactccggccaaaatctaatttttactactgccctaactgcaatgatgtatatgggttgcaccggcgttattggtggcaacttgacagttggtgacttggttctaattaatcagttggtttttcaactatcagtaccgctaaattttcttggtagtgtttacagagatttaaagcagtctctgattgatatggaaacgctatttaagttaagaaaaaatgaagtcaagattaaaaatgccgaacgtcccttaatgcttccagaaaatgttccctacgatattacttttgagaacgtcacgtttggatatcatcccgataggaaaattttaaagaatgccagctttaccatcccagcaggctggaaaaccgcaatagttgggtcttcgggcagtgggaagtccaccattttaaaattagtctttagattttatgatcctgaaagcggaaggatcctcataaacggtagagatattaaagaatatgacatcgatgccttgaggaaggtgattggtgtggtaccacaggacacaccacttttcaatgacactatctgggaaaatgtaaagttcggtcgtattgacgcaaccgacgaggaagtgataactgtagttgaaaaagcccagctagcacccttaatcaagaaattaccacaaggttttgacaccatcgtcggggagcgagggttgatgatcagcggtggtgaaaagcaaaggctggcaattgcaagggtactattgaagaatgcaaggatcatgttttttgacgaggccacaagcgccttggacacacacacagaacaagctctcttacgaaccattagagataactttacttcgggttcgagaacgagtgtatacatcgcacatagactgaggacaattgcagatgcagacaagatcatagtccttgacaacggaagagtaagagaggaaggtaagcatcttgaactgttggctatgccagggtcattgtaccgcgaactttggaccatacaagaagatctggatcatttagagaatgaactaaaagaccagcaagaactatga

SEQ ID NO: 4542 - DNA, 2073 bp, Saccharomyces cerevisiae
atggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 4543 - DNA, 2076 bp, Saccharomyces cerevisiae
atgaatagattttggaatactaagaaattttcattaacaaatgccgatggactatgtgctaccttaaatgagatatctcaaaatgatgaagttcttgtggttcaaccaagtgtattgccagtactcaatagtttgctaactttccaagatttgactcaatcaactcctgtaaggaaaattacgttactcgatgatcagctaagtgacgatttaccgagtgccttaggcagcgttccgcaaatggatcttatttttcttattgatgtcagaacatctctccgactccctccacaactgcttgatgctgctcaaaagcacaatttatcatctttgcatataatatactgtcgatggaaaccgtctttccaaaatactttggaggatacagagcaatggcaaaaggatggtttcgatttgaattcaaaaaaaacacatttccctaacgtcattgaatctcagttaaaggagctatcgaacgaatataccctttacccttgggatctcttgcccttcccacagattgatgaaaatgttctattgactcattccctttataacatggaaaatgtaaacatgtattatcccaacttacgttctttgcagagtgccacagagtcaatactggttgatgatatggtcaattcgttgcagagcttgatttttgaaactaatagtatcataacaaatgttgtgtcgataggtaatctgtctaagagatgtagccatcttttgaagaaacgaatcgatgagcatcaaacagagaatgatttattcatcaagggtacgctttatggtgaacgaaccaactgtggactagaaatggacttgattatcttggaaaggaataccgatcctataacgccattgttgacacaacttacgtatgcaggaatactagatgatctatatgaattcaattctggcataaagataaaggagaaagacatgaacttcaattataaggaagataaaatatggaatgatttgaaatttttaaattttgggtcgattgggccgcagttaaataaattggcaaaggaactacaaacgcaatatgatacaaggcataaagccgagagcgtacatgaaatcaaagaattcgttgattccttaggttctttgcaacaaaggcaagcttttttgaaaaatcacacaaccttatcatccgacgttttgaaagtggtagagactgaagagtacggatctttcaataaaatcttagagttagagctggaaattttgatgggaaatacacttaataacgacattgaagatattatactcgagttgcagtaccagtacgaggttgatcaaaagaagattctcagattaatctgtttattgtctctttgtaaaaattcacttcgagaaaaggattatgaatatctaagaacctttatgatcgactcttggggcattgaaaaatgctttcaacttgaatcattggctgagttaggatttttcactagcaaaacgggaaaaactgatttgcatattacaacaagtaagtcaacaagattacagaaagaataccgttatatttcacaatggttcaatacagtacccatagaagacgagcatgctgccgataaaatcacaaatgagaacgatgacttctcggaagccacttttgcttacagtggtgtagtgcccttgacaatgagactggttcagatgttatatgataggtctatcttgttccataattattcctcgcagcagccttttatactgtcaagagaacctagagtttctcaaacggaggatttaattgaacagttatatggagactcacatgcgatcgaagagagtatatgggtcccgggaaccattacaaaaaagatcaatgcaagcatcaagagcaataatagacggtccatagacggatctaatgggacatttcatgctgcagaggatattgcactcgtagtattcctcggaggtgtaacaatgggtgaaatagctataatgaagcatttgcaaaaaatactaggtaaaaaaggtatcaataaaaggtttatcatcatcgccgatggcttgatcaatggcacaaggatcatgaactctatatcttaa

SEQ ID NO: 4544 - DNA, 2076 bp, Saccharomyces cerevisiae
atgacaaggttcatgaacagctttgccaaacaaacgctgggatatggcaatatggcgacagtggagcaagagagctcagctcaggctgttgattctcattcaaacaacacaccgaagcaagctaagggtgttcttgcagaggaactaaaggatgcattgcggttccgggacgaaagagttagtattattaatgcagagccttcttcaacactgttcgtcttttggtttgtggtttcatgctatttccctgtgattactgcctgcttgggtcccgtagctaacactatctcgatagcctgtgtagttgaaaaatggagatccttaaagaacaactccgtggtgacaaatccacgaagcaatgacaccgatgttttgatgaatcaagtaaagacagtttttgatcctcctggtatttttgccgttaatatcatctctttggtactgggttttacgtcaaatattatactaatgctacatttcagtaagaagttgacgtatcttaaatctcagttaataaatataacaggatggacaatagctggagggatgcttttggtggacgtgattgtatgctccttgaatgacatgcccagcatctacagtaagactatcggattttggtttgcctgtatcagttctggtctatatttggtatgcaccattattttaacaatacattttattggatataaattaggaaaatatcctccaacgttcaaccttttgcccaatgaaagaagtatcatggcatacactgtactattgtctttatggttgatttggggtgcgggtatgtttagcggtttattgcacatcacttacggaaatgcattatatttctgcacggtatcattattaaccgtgggactaggtgacatcctgcccaagtcggttggcgccaaaatcatggttttaatcttttcgctatctggtgttgtcttgatgggtttaatagtgtttatgacaagatccatcattcaaaagtcctctggcccaattttctttttccacagagttgaaaaaggcaggtccaaatcgtggaaacattatatggatagtagtaaaaatttatctgaaagggaagcgttcgacttaatgaagtgtatccgacaaacggcctcaaggaagcagcattggttttctttgtcggtgactattgcaattttcatggctttttggttattgggagctcttgtattcaaattcgcagaaaattggtcgtacttcaattgtatttacttttgtttcttgtgcttattaaccattggatacggagactatgctccaaggactggtgcaggccgtgctttttttgtgatttgggcgttgggagccgtgccattaatgggggctatcctatctacagtcggtgatctgttgtttgacatttccacttctctggatattaagatcggtgaatcattcaataataaagtcaagtccatcgtttttaatgggcgtcaaagagcactttcctttatggtgaacactggagaaattttcgaagaatctgacacagctgatggtgatctggaagaaaatacaacgagctcacaatccagtcaaatttctgaattcaacgataataattcagaagagaatgattctggagtgacatcccctcctgcaagcctgcaagaatcattttcttcattatcaaaagcatctagcccagagggaatacttcctctagaatatgtttcttctgctgaatatgcactacaggactcggggacctgtaatttaaggaacttgcaagagctacttaaagccgtcaaaaaactacatcggatatgtctggcggataaagattacacacttagtttttccgactggtcgtacattcataaactacatttgaggaacattacagatattgaggagtacacacgcggacccgaattttggatatcacctgatacgcccctcaagttcccgttaaatgaacctcattttgcttttatgatgcttttcaagaacatagaagaattagttggtaatctagtagaagacgaagagctttataaagttataagcaaaagaaaatttttgggtgagcatagaaagacactttga

SEQ ID NO: 4545 - DNA, 2076 bp, Saccharomyces cerevisiae
atgagccagatcgttgattttgttgaggacaaagattcaagaaacgatgccagtattcagatcatcgatggaccctcaaatgttgaaattatcgctctctcggaatcaatggatcaagatgagtgcaaaagggcacatgtaagctctgcagagatgattccatcatcaccgcaaagaaaatctgtttcgaatgatgttgagaatgttgacctaaacaaatctatcgaactttctgcgccgttcttccaagatatcagtataagcaagctagatgacttttctacaacagtaaattccatcatagattcgtctctcagaaatgagaataatgcaaaaggaaacgcgaaaaaacttttggatgatctaataagtgatgaatggtcagctgatcttgagtcgagtggaaagaagcacaacaaatcacaatacaatttgagggacatcgcagagaaatggggagtacagtctttaaaaaatccagagcctattgctgttgactgcgaatataagacacaaggaatcggaaaaaccaatagtgacattagtgatagtccgaaatcacagataggagcagctgatatactgttcgattttccactgtctccagtaaaacatgagaacccaactgaagaaaagcacaattcgattgctaatgaaaattcttcaccagataatagcctgaaaccagcaggaaaacaaaatcatggtgaagatgggacatccatggcaaaaagggtatacaataaaggtgaagacgagcaagaacaccttccgaaaggaaagaagagaaccatagcgttatcaagaacactaatcaacagcaccaaactacctgatacagtagaactaaatctttctaaatttctcgattcctcagatagtattactactgatgtactttcaacccctgcaaaggggtctaacatagtaaggacaggtagtcaaccaatctttagcaacgctaattgttttcaggaagcaaaacgctcgaaaacattaacggctgaggatcccaaatgtactaaaaatactgccagagaggtatcacaactagagaattatattgcctatgggcaatactatactagagaagactcaaaaaacaaaatacgacacttgttaaaagaaaacaaaaatgcttttaagcgagttaaccagatatatcgagataatataaaagcacgctctcaaatgattatagagttttcgcctagccttctccagttatttaaaaaaggagacagtgatctgcaacaacaattggcaccagcagttgtgcaatcaagctataacgattctatgccgcttttaagatttcttcgaaaatgtgacagtatttacgactttagtaacgatttctattacccctgtgatcccaaaatagttgaagaaaacgttttgattctatattatgatgcgcaagaattttttgaacaatacacttcacaaaagaaagaattatataggaagatacgatttttctcaaagaatggaaaacatgtgattcttatactaagcgatataaataaactcaaaagagctattttccaattagaaaatgaaaagtacaaagctagggtagaacaacgattgtcaggaacagaagaagctttaagaccgagaagtaaaaaatcaagccaagttggaaaattagggataaaaaaatttgatttagagcaacgattgcgcttcattgatagagaatggcatgtcaaaatacatactgtaaattcacatatggagtttattaattctctgccgaacctagtgtcattaattggaaaacagcgcatggatcccgcaattcggtatatgaaatatgctcatttgaatgtaaaatccgctcaggatagtacagaaacgctaaagaaaacctttcatcagatagggagaatgcctgaaatgaaggcgaataatgtcgtgagcctataccccagttttcaatcattacttgaagatattgaaaagggaagactgcaatcagacaacgaaggtaaatacttgatgactgaggcagtagaaaaaagattgtacaaactgtttacttgtactgatccaaatgatactattgaatga

SEQ ID NO: 4546 - DNA, 2076 bp, Saccharomyces cerevisiae
atgcaaagctcaacaagtactgatcaacatgtgctacatcacatggaccctcatcggtttacgtcccaaataccaactgcaacatcgtcacaattgaggagaagaaacagcacgaatcaaggtctaaccgacatgatcaataagagtattgccaggaatacaataagcgggactggcattcccacaggaggcataaataaaaataagaggacaagaagcacggttgcaggaggtacaaatggtacagcattggctctaaatgacaaatccaacagtagaaacagcgtcagcagattatcaataaatcaacttggcagcctgcagcaacatctgagcaatagagatccaaggccactaagagacaaaaacttccaaagcgctattcaagaggagatttatgactatttgaaaaagaataaatttgatattgaaacaaatcatcccatttcaataaaatttctaaaacaacccactcaaaaggggtttattatcattttcaagtggttatatttaagactcgatccaggttacggctttactaagtctatcgagaatgagatctatcaaattttaaaaaatctgcgttatccgtttttagagtcaataaataaatcacaaatttcggctgtaggtggctctaattggcacaaatttcttggcatgttgcattggatggtacgaacaaatattaaactggatatgtgcttgaataaagtagatcgttcattaattaatcaaaatacacaagaaataacaattctgagccagcctttaaagactttggacgaacaggaccaaagacaagaaagatatgagctaatggtggagaaactgttaattgattattttacagagtcttacaaaagctttttgaaacttgaggataattatgagccttcgatgcaagaactaaagttaggttttgaaaaattcgttcacataattaatactgatatagctaatctacaaacccaaaatgacaatctttatgagaaatatcaagaagtaatgaaaataagccaaaagatcaaaaccaccagggaaaaatggaaggctttgaaaagcgattctaataagtatgaaaattatgtcaacgcgatgaagcaaaagagtcaagaatggccaggtaaactggaaaagatgaaatccgagtgtgaactgaaagaagaagaaattaaagccttacaaagtaatatttccgaattgcacaaaattttaagaaaaaagggaatttcaactgagcagttcgaattacaaaaccaagaaagagaaaagctgactagggaacttgataaaataaatatccagtctgataaattgacaagctcaattaaatccagaaagctggaagccgagggaatattcaaaagcttactggatacgttgaggcaatacgattcgtcgatacaaaatttaaccagatcgcgtagtcaattgggtcataatgttaatgattcatctctaaaaattaacatttcagagaacttattagacagagattttcatgaaggtatctcctacgagcaattgtttccaaagggatctggaattaacgagtctattaaaaaatctatcttaaaattaaacgatgaaattcaagaaagaataaaaaccattgagaaagacaacataacattagaaaaagatatcaaaaacttaaagcatgacataaatgagaaaactcaaattaatgaaaaacttgaattggaattgtccgaagcgaattccaaatttgagctctctaagcaggagaacgaacgattattagtagcgcaaagaattgagattgaaaaaatggaaaaaaaaattaatgattcaaatctcttgatgaaaactaaaatttcagatgctgaggaattggtaacttcaacggaactaaaattggaagaattgaaagttgacttaaacaggaaacgatacaaactacaccaacaagtgatacatgttattgatataacaagtaaatttaaaattaatattcaatcgtcattggaaaactctgaaaacgaattaggaaacgtcattgaagagttacgaaatttggagtttgaaactgaacataacgtaacaaattaa

SEQ ID NO: 4547 - DNA, 2076 bp, Saccharomyces cerevisiae
atgccgtttggaatagacaacaccgacttcactgtcctggcggggctagtgcttgccgtgctactgtacgtaaagagaaactccatcaaggaactgctgatgtccgatgacggagatatcacagctgtcagctcgggcaacagagacattgctcaggtggtgaccgaaaacaacaagaactacttggtgttgtatgcgtcgcagactgggactgccgaggattacgccaaaaagttttccaaggagctggtggccaagttcaacctaaacgtgatgtgcgcagatgttgagaactacgactttgagtcgctaaacgatgtgcccgtcatagtctcgatttttatctctacatatggtgaaggagacttccccgacggggcggtcaactttgaagactttatttgtaatgcggaagcgggtgcactatcgaacctgaggtataatatgtttggtctgggaaattctacttatgaattctttaatggtgccgccaagaaggccgagaagcatctctccgccgcgggcgctatcagactaggcaagctcggtgaagctgatgatggtgcaggaactacagacgaagattacatggcctggaaggactccatcctggaggttttgaaagacgaactgcatttggacgaacaggaagccaagttcacctctcaattccagtacactgtgttgaacgaaatcactgactccatgtcgcttggtgaaccctctgctcactatttgccctcgcatcagttgaaccgcaacgcagacggcatccaattgggtcccttcgatttgtctcaaccgtatattgcacccatcgtgaaatctcgcgaactgttctcttccaatgaccgtaattgcatccactctgaatttgacttgtccggctctaacatcaagtactccactggtgaccatcttgctgtttggccttccaacccattggaaaaggtcgaacagttcttatccatattcaacctggaccctgaaaccatttttgacttgaagcccctggatcccaccgtcaaagtgcccttcccaacgccaactactattggcgctgctattaaacactatttggaaattacaggacctgtctccagacaattgttttcatctttgattcagttcgcccccaacgctgacgtcaaggaaaaattgactctgctttcgaaagacaaggaccaattcgccgtcgagataacctccaaatatttcaacatcgcagatgctctgaaatatttgtctgatggcgccaaatgggacaccgtacccatgcaattcttggtcgaatcagttccccaaatgactcctcgttactactctatctcttcctcttctctgtctgaaaagcaaaccgtccatgtcacctccattgtggaaaactttcctaacccagaattgcctgatgctcctccagttgttggtgttacgactaacttgttaagaaacattcaattggctcaaaacaatgttaacattgccgaaactaacctacctgttcactacgatttaaatggcccacgtaaacttttcgccaattacaaattgcccgtccacgttcgtcgttctaacttcagattgccttccaacccttccaccccagttatcatgatcggtccaggtaccggtgttgccccattccgtgggtttatcagagagcgtgtcgcgttcctcgaatcacaaaagaagggcggtaacaacgtttcgctaggtaagcatatactgttttatggatcccgtaacactgatgatttcttgtaccaggacgaatggccagaatacgccaaaaaattggatggttcgttcgaaatggtcgtggcccattccaggttgccaaacaccaaaaaagtttatgttcaagataaattaaaggattacgaagaccaagtatttgaaatgattaacaacggtgcatttatctacgtctgtggtgatgcaaagggtatggccaagggtgtgtcaaccgcattggttggcatcttatcccgtggtaaatccattaccactgatgaagcaacagagctaatcaagatgctcaagacttcaggtagataccaagaagatgtctggtaa

SEQ ID NO: 4548 - DNA, 2079 bp, Saccharomyces cerevisiae
atgaatggaaaagaggtttcaagtggctctggaagaacgcagagcaacaacaacaaaaaaaataacaacggaggcagtacaggaatctcgcatgcgtctggctcacctttaacggacggcaacggtggcaatagcaacggtaatagtagaagtagaagcagaagtagaaaatctagtggaactacaggtggtttgctaaaaaagccgccgctgcttgtgaacaatgaagcggtgcatgctagcgtacccgacgcgtcgcacacttcctgtaacaatggcacgcttgaagtgagcataaataaccctgagccacatgtggtagatgccgtggcacgccacttgataagaaacccgagtaacagcctacaattgcaaggcggagacattacaagagatctgtataagtggacaaacgaccatccttcatcaccatcgcagtatcagtacccaagtcaacctgcactttccacctcaataccttcacaagcgccctcattctcgaatcgtaaaaggtctatgagcttttctgccgcttctatagcatcttcctctcaccttaacaacaactcggaggcgaatgggaatcctctagcggcaataggcctggcgcccgcaccgatgacgcacgaagaaatcagggctcctggtggattcagaagatcttttataatacagaagcgcaggaaacataacgttgatgcgcccataccgaattttttcaccaggaactttattgaatttttgaccttgtatggccacttcgctggtgaagatttatcggaagaagaggaggaggaggaagaaactgaagaggagccagaggaggaagctttggaaacggaaagcacccagctagtttctcgtgaacacgggcgccatcctcacaaatcatctacggtaaaggcggtgctgctcttgttaaagtcatttgttgggacaggtgtgcttttcctaccaaaggctttccataacggtggttggggatttagcgccctttgtctactctcgtgtgccctcatttcttatggatgtttcgtatcattgattaccaccaaggacaaagtaggcgtagatgggtacggtgacatgggtcgtatactatatgggcccaaaatgaaatttgccattctttcgtctatcgccttgtcacaaatcgggttttctgctgcatacactgttttcactgcaactaatttgcaggtcttttctgaaaatttcttccatttgaaaccgggcagcatcagtctagccacctatatctttgcacaagtactcatctttgtcccactatctttgacaagaaacatagccaagttaagtgggaccgcgttaatagcagatctatttattctactgggattggtttatgtttacgtttactccatttattatattgctgttaatggtgtcgcatccgatacaatgcttatgttcaataaagcggactggtcgttgttcatcggtaccgccatattcacctttgaaggtataggcctacttatccccattcaggagtcaatgaaacacccgaagcatttccggccatcgttgtccgcggtgatgtgtatcgtggcagtgattttcatatcatgtggtctcttatgctatgccgcttttggatctgacgtgaaaactgttgttttattgaattttccgcaggacacttcctatactctcactgttcaattactgtatgcattagccattttgttatccacgccgttgcagctatttcccgcgatacgtattttggaaaactggacttttccctcaaatgcatctggtaaatacaacccgaaagtcaaatggttgaaaaactatttccgttgcgctattgtcgtcctgacatctatcctcgcttgggtaggcgccaacgatttggacaaatttgtatcactggtaggctccttcgcgtgtatcccattgatctacatatacccgccattgttgcactataaggcgtccatcttatctggaacctcgagagccaggcttcttttagatttaatcgtcatagtatttggagttgctgtcatggcctacacgtcatggcagacgattaaaatgtggagccagtaa

SEQ ID NO: 4549 - DNA, 2079 bp, Saccharomyces cerevisiae
atgctttcccataatgctttaagggcctttgattgttcaaaggtgattatttcacgaagatgtctaacctcttcaacatcgatataccaacaaagcagcgttcacttacaagaaacagatgatggacattcaggaaatagagaaaagcacgtctcaccgtttgaaagggtacaaaatttggctgctgatttgaagaacgagttgaaagctccagattcagatatcaatgaagtttttaatgactttaaagataagattgaatcgttgaaacagaaattaaggaacccttcacctatggaaagatcacacttgttagcgaatttttcttcggatctcctacaggaattaagttacagaagcaaaaatatgacgctagatccttatcaagtattaaacacattgtgccaatacaaattggcacgctcacaacatttcacgattgttttaaagtaccttctatataatcaatcaccacaggacgttattgccttatgggtgaagtacttggaaaccatttccgaaaacccagtgatcttacttcaaaatagttcttctcgtgcacatatgcaaaatattgcaattaccaccattgcttacttatctttaccagagaatactgtggatatcaatattctgtataagattttacagatcgatcgtaaaatgggccaggttttaccttttaacatgattagaagaatgttaagtacagaatttagctctcttgaaagaagagacgtgattatcaaaaatctaaacactttgtactatcaatacacagtacaggatagtgatcatttcttaagtcaaattgaaaatgctcctagatggatagatttaagggatctttatggccaatacaataaacttgaaggtgagaaaaatgtagagatcataagcaagttcatggacaagtttattgatttggataaacccgaccaagttgttactatttataaccagtatagcaaggttttcccaaatagtacgtcgctgaaagattgtcttttaagagctgtgtcgcacttacgagctaaatcgagtaaagagaagttggacagaattctagcagtctggaacagtgttatcaaaccaggagataatattaaaaacacatcttatgcgacgctagttaacgcactaactgattctggaaatttcaaccatttaaaggaattttgggaagaagaacttcctaaaaagttcaagaaagatcccatcgtgaaggaagcatttctcctggccttatgtcaaacttcgcctctaaagtatgaccaagtcaaaggggagttagcagagactgttaaaaccaagaagttgttcaataaagttttattgctaatgttagatgatgaaaaagtgagcgaagaacaattcaacacattttactataaccattatccatcagatggtgtgttaccccctactttggatactctaagcattaaaatgtacgctaattataaatttcaggcagaagatacacgcccacaattcgatctattgcaaagtgtttccattaatcccaccgattatgaaaaggttgaaaagattacgaaagcctttatttcagtgtgccccactgtcgagccgattcgtcaactttacaaacaattgggaactcacttaaatgctaggaattatgcagactttatttccgcagagtttaataagcctgacggcacagtggccgaggcaaagaatttgttttctgattttctctcatatcaaaagactagaaagagaaacgtggataatacgcctctaaatgctttattattggggttctgtgataaactttacaagagtaaacatagcgagtacgttccctacatcgaaaagtactacaatctagctaaggattcaagtatcagggtgtcgaacttggccgtttcgaaaattctattcaacttggccacatttgcacgcaatactcagcagttatctgacaaagaggttgcttttattaaccagtttatgcgagatttaggcactaatgagggttttcgtcccaaccctaaggatattcaaattttaaaagaatgtgatggaattactgttccagaaaagttgacttaa

SEQ ID NO: 4550 - DNA, 2079 bp, Saccharomyces cerevisiae
atggactatcctgatccagacacaataaggattttaattactacagataatcatgtgggttacaacgaaaatgatcccattactggcgatgattcttggaaaactttccatgaagtcatgatgctggccaaaaataacaacgtagacatggttgtacagtccggtgatctttttcacgtgaataagccttccaagaagtcactctaccaagtactgaagactttgagattatgttgcatgggtgacaagccttgcgagttagaattattgagcgatccctcacaagtttttcactacgatgaatttaccaacgttaactatgaggaccccaactttaatatttctattcccgtattcggcatatcaggtaatcatgatgatgcgtcgggggactcactgttgtgtcctatggatatacttcatgcgactggtctaataaatcatttcgggaaagtcatcgaatctgataaaataaaagtcgtgccattattatttcagaaagggtccactaagttagcattgtacggattagccgctgttcgtgatgaaaggttatttagaacttttaaggatggtggtgtcacttttgaagtaccgactatgcgagaaggtgaatggtttaatttaatgtgcgtccatcaaaatcatacaggtcacacgaatactgcatttttacctgaacagttcttgccagatttcctggatatggtgatatggggtcatgaacatgagtgtattccgaatctcgtacacaatccaattaaaaattttgatgtattacaaccaggttcatctgtagctacttcactttgtgaggctgaggcacaacccaagtatgtctttatccttgacataaagtatggagaagcaccaaaaatgacacctattcctcttgagactatacggacattcaaaatgaaatccatttcgttacaagatgttccccatttgaggcctcacgataaagatgctacgtctaagtatcttattgaacaagttgaagaaatgatccgcgacgctaatgaggaaactaaacaaaaattagcggacgatggtgaaggtgacatggttgcggaattaccgaaaccattgatcagattacgtgttgattatagtgcaccctccaatacacaatccccaatagattaccaagttgaaaacccgcgtagatttagcaatcgatttgtgggacgtgttgctaacggtaataacgttgtgcagttttataaaaaaaggtcacctgtaactagatcaaaaaaatccggtataaatggaacaagcatcagtgatagagatgttgagaaacttttcagcgaaagtggcggtgaactagaagttcaaactttggttaatgatctcttgaacaaaatgcaactatctttattaccagaagttggtttgaatgaagcagtaaagaagtttgtagataaagatgagaaaacagctcttaaagaatttattagccatgaaatatcgaacgaagttggaatattatctacgaatgaagaatttctgagaacagatgatgcagaggaaatgaaagcgcttataaaacaggttaagcgtgctaacagtgttaggccgactccccctaaagaaaatgatgagacaaatttcgcattcaatggtaatgggctagattccttccggtctagtaatagagaagtaagaactggatctccagacattacccaatcacatgttgataatgaatcaagaataacccatattagtcaagcggaaagcagtaagccaacgagcaaacccaaacgagtgcgaactgcaacgaaaaagaaaattcctgctttttcagactcaactgtcatatccgatgcagaaaatgaactcggtgataataacgatgctcaagatgatgttgatattgatgagaatgacataattatggtcagtactgacgaagaggacgctagttatggtttacttaatggtcgaaaaacaaaaacaaagactcgtcctgctgcgagcaccaaaaccgcttccagaaggggaaaaggaagagcatcaaggacgccaaagacggatattcttggaagtctccttgctaagaaaagaaaatag

SEQ ID NO: 4551 - DNA, 2079 bp, Saccharomyces cerevisiae
atggccaagagactgttagaatcaagccaaaatgatcaggccaatcgaaaaaactcaaagattgagaagaaagaagtatcgttttatgaggaggaagaaacagatgattcttttgatagtttttaccaggatgaagaagatgatttaagtgatattgattgggaagaagtttctttagatggaagcttaactgtcacatttggcaatatacgcagagacagggagaaagtcagcaagtacaaaagaaagcataataaaaaagcattcaattatcagcgacttaaatatggactccatttgataatgattccatttatgttatttttgttaaaatctaggatgaaatggatagacgatgaaagactaaataggcgactaagaaggtctgtaccaaaattaattggcaaaaaattcaaagattgggatgtaagggatccagcttttaaaatggattctttaagaacccttttgcttggtttggtcttatggttccgttccaattacaaaatgaatagcaatggcattagacagaatttcaacaggctgcaataccttatcaagtatgccgataaccaaaacgaaaattcaatctctgaatctacatataaaaaagttcttgaaaatcaacaagaattttatggaaataggccgttgataaatcatggtgttgaagatattcgcaagatggctaaaaggaaaatggccaacagagatattctaacgttgttcttctttattatcttagaaaatgtgctaccggggcctaagaagctttacttatgctttgccttgcccttgcacgattacgatattaggtgcaataaggtgaagtggcaaatcgaacatggtattggcaaagttcccaacagatttgactctgacctaatacaaccttatttttggattgaattagaagttcctactttgagcgatggtgaattatacatcattgaccctatagcccatctgggtgaacgtgaaatggtcttgaaaacacgcgaagatcagtttgtccctacttatcaaccttcggtagacatgaagtacaacctaaaccaaaagtttcattatgtagtccgtatcaatcatgctgaaaaggtactacaagatgtttcaccaagatatgtgccaaatgtttgttacaggtactttgaattatctgagtcttctcctattttgaaatcgaagcattacactagctaccaatatctatctaagtggttgaaagtcttgaacaagaaaaaagcatctgttcatcattacgcaataatgaaaaagattgctttaactaattttacattaccaaagagtgtgacagagattaaaagaacagataatttcgtgattccctctctgttaaagtctaatgaagtattaaaagcatgtgcaaaacaagccgcaacatttactaagggagacaattcacaagagcccatattttggagaagagacgtcattcaattaaagagtaaacagcactgggcaatattagggcgttccattctacctaatgctcaaccattaaaacgtaaaaagtatctaccgatgagggaaaggatggtaagaaacctagacaagtacgttatcaaagaattgttttcgtatgagcaaacaatgaagtctcctaaataccccagcacgtattgcgatcatttaggacaggaacatgtgataacagatttgtcgcattataaaaataaatttggcaacatcgaaatttactcgaaagaaactaagcctgatggatttgaattaataccgcttagcaaagaagttgatattaaatgcctgataaaggagtataacaaaggtaaaagaaagatgcaaaaaatcaagtatttggatgtggtaagtggatttgattttaaacagaaaaaaggccatgccattccgaaaattgaaagcattctagtcaaagagacagactataaagcagtccagcttttgaagcagcaaactaaagtactactgggactctcgttctgggacattctattaagaaagctacgagttaacgatcgattaaatgctgagtacggtaatgttggaaataatgaagaaacgttggacgaccattga

SEQ ID NO: 4552 - DNA, 2079 bp, Saccharomyces cerevisiae
atggggaagagagtatacgatccaattcatgatactttccaactacgagaagacaattctgacgaaacaaaagcagattctccaatgcaatctgtaaaatcgggatcacaagaagaagcatccccaagctccattcaatcagagaccgagactgtgactacaaaaagcattccagttatacacgagattgaaatcgacgataaaaatgatgatgactccacgcaaagtgaagaagaaaataccaacatcttgctcaacttcgaaccttctacagtgcctgaagcaacaggagcaagtacggcaacggggccagtgacaactaacactgttagaaggaaacccaaagaaagcaatgccagtaaatacaatcgtcatttgaagaaacctgacggcgagccattcaatagaaaggacattcagttcagtttcatgcaagaactgttgatggacaagaggcaaatcttcactaatgttctaaaacccctatacaagaactctattgtacccattaatatcgatggcgataaattatcaatcaacgtgaccgacaaagagtacgatgcaaggacatttgtatttaacgataaattgacgttcgcacaattgtatgtgttgacaatagccacttctatcaaatgttccaaaattctcagagataaactattattagaccaacaagtagcattttctacttgtgttttagcgttattggtcaacattggtaggttgaacaccactataaatttttatttagaaatgacatcgcaattgagaacttttcactccgtgccagttttacaattacatgccaatgatccgaaacttttgcaggatacacctagactgaaatctattctgaaaaatctgccgtggggcaatgagcaactctcattgatggagacttacaaaaaggtcgaccaaaatgatggtgaagtggacaccgttaacaaatttaacattattaatatgttgtttagcatatgtgataattccggcctaattgacaagaggtttctttccaagtatgtggaagtcgaatcgaaagctcaggagcaagatatggtagatgaacagaatgaagtaaaagaaacggaagcggaaaatgaaaaacaagaatcaaaagcagcttatgcaacaacattatttgatatactggactattcgaaatacgagccaaaggatagatcaaacatattgatttggctgctatatattcatttggagacaaacttaagccaggaggaggtcgaagaatcagtaagatttttcaatggattggaagatggtgcacctgctggaaagttcattttaaggtgtacggaacgcagttacgacacggatcctgaagatgaattagagttcggagccaaccaacgcatcaagagaagagaattcatgagtaagatggaggagggtaggaagcgcgagcgtaccaatgttacagaggtgaaaaagcccagtatcggtggtgacaagagtgaagaggacggtgaaggggaagatgacaagagcgaggagactgtagaggagactagatcacttttgacgcctacgcccatactggaatcttcttcacccatgacattgaacaggaaaaaagtcacaccacaactgcccaaagtaacgccagcagcaccaacagaaacagaagaagaaatcacctccgctgctatcattgacaaaaacgatttaaatctaacaccattgaaaaaatacaatagttcggctacggtaaacaaggtcgacaagctaatatcgctagatctgaacaagcatgtgtcagaaaatggtaagacacaagaggagtttctcgccgatttgaaaaaatcccaggtgccaaacaggttgaaaagacgcgatattgggttaatcaagatattcaatgaatttgaagacatccccgtagcgtcagtgcttgggattcgcggtaaaaagagaaagaaattcaaagataatttgcttggatttgagacggatttcatgaaaaatctcggcgcttcaaagaaagtacttttaaataaaatcgaacgcgcggaaattgatgacgaagaagcaaccgccatgtttaagctggagtga

SEQ ID NO: 4553 - DNA, 2079 bp, Saccharomyces cerevisiae
atgggtaattcaagttcaaaatcttcgaaaaaggattcacattcgaattcctcctcgagaaatcctcgtcctcaagtgtcgagaaccgagacttcccattctgtgaagtctgcaaaatcaaataaatcttcaagatcaaggcgatctcttccttcttcgtccactacgaatactaattcaaacgtccctgatccctccactccatcaaagcccaatcttgaggttaatcaccaacgacatagctctcacacgaatcgttaccatttcccatctagctcacactcgcattcaaattctcaaaacgaattgttaactactccttcatcatcctctactaagaggccttctacttctagaagatcaagttataatactaaggctgctgctgatttaccaccttcaatgatccaaatggaacccaagtcacccattttaaaaacaaacaatagtagcacacacgtatccaagcataaatcttcatactcatctacctattatgagaacgccttaaccgatgatgacaatgatgataaagacaacgacatctcgcacactaaaaggttttctagatcttcgaattctcgtccgtccagtataagaagcggatcagtgtcaagaaggaaatcagatgtgacccatgaagagcctaacaatggatcatactcctctaacaatcaggagaattatctcgttcaggcattaacccggtcaaattctcatgcatcttcgctacacagtaggaaatcttcgtttggatcagatggtaataccgcatacagcaccccattaaactctccaggcttgtccaagctaacagatcactctggtgaatactttacctctaattcaacctcctcattgaatcaccattcaagtcgcgatatttacccgagcaaacacatcagcaatgatgatgacattgaaaattcatctcaattgagtaatatccatgcatcaatggaaaatgttaatgataaaaataataatataacagatagcaaaaaagatccgaatgaggaatttaatgatataatgcaatcttccggaaacaaaaacgctccaaaaaaattcaaaaagcctatcgatattgatgaaactatccaaaaattactggatgcgggctacgctgctaagagaacaaaaaatgtttgtttgaagaacaatgaaattttacagatttgcatcaaggctcgtgaaatctttctttctcaaccttccttattagaattatcacctcctgtaaaaattgtaggcgacgttcatggccaatatggggatctcttaaggctttttaccaaatgtgggttcccaccatcctcgaactatttattcctaggtgattatgtggaccgtggtaaacagtcactggagactattttactattgttttgttacaaaataaaataccctgaaaatttctttttattgagaggcaaccatgaatgtgctaacgtcacaagggtttatggattttatgatgaatgtaaacgtcgttgtaacatcaagatctggaagacattcatcgatacttttaatacattaccattagctgctatcgtagccggaaagattttttgtgttcatggtggattgtcgccagttttaaattctatggatgaaatcagacatgtagttaggcctactgatgtaccagattttggcttaattaatgatcttttgtggtccgatcccacagattcacccaacgaatgggaggataacgaacgtggtgtaagttactgttataataaggtggcaattaacaaattcttgaacaagtttgggtttgatttggtttgtagagctcacatggttgtggaagacggttatgaatttttcaatgatagaagtctcgttacggtgttttccgcgccaaattattgtggtgaatttgataattggggggctgtaatgagcgtcagcgaaggtttattgtgctcttttgaattgttagatccactagatagtgcagctttgaagcaagttatgaagaaaggtagacaggaaagaaaactggctaatcaacaacagcaaatgatggaaacaagcatcacaaatgataacgaatctcaacagtaa

SEQ ID NO: 4554 - DNA, 2082 bp, Saccharomyces cerevisiae
atgagcactccatttggcttagatttaggtaacaataactcagtactagcagttgccagaaataggggtattgatgtcgttgtcaatgaagtttctaataggtctacaccatccttggtcggctttggccccagaaataggtacttaggtgaatctggtaaaactaagcaaacatcgaatgttaaaaacactgtggaaaacttgaaaagaatcattggactaaagttcaaagaccctgaatttgatatcgagaataagttcttcacttcgaaattggtacagctaaaaaatggtaaagttggtgtggaagtggagttcggcggtaaaacacacgtattttcagctactcaactgactgctatgttcattgataaggtgaagcacaccgttcaagaggaaacgaagtcatcaattaccgatgtctgcctcgcagttcctgtatggtattcggaagaacaacgttataacatagccgatgctgccagaattgcaggattaaatcctgtaaggattgtcaacgatgtgactgcagccgccgtttcgtacggcgtcttcaagaatgatctgccaggtcctgaagaaaagccaagaatcattggcttagtggacattgggcattctacctacacctgttctattatggctttccgcaaaggcgaaatgaaagtattaggtactgcttatgacaagcactttggtggtagagatttcgatcgcgcaatcacagaacattttgctgatcagtttaaggacaagtacaagattgacattaggaaaaatccgaaagcttataacagaattttaatcgctgctgaaaaattaaaaaaagtgctttctgcgaacactactgcccccttctccgttgaatctgttatggatgatatcgacgtttcctctcaattgagccgtgaagagctggaagaattagtagagcccttgttgaagcgtgtgacgtatccaatcaccaatgcattggctcaagctaaattaactgtcaatgatattgacttcgtagaaataattggtggtacaacccgtatcccagttttaaagaagtcaatttctgatgtttttggaaaacctttgtcatctactttaaatcaagacgaagctgtggccaagggggccgctttcatatgtgccattcactctccaactttaagggtcaggccgtttaaatttgaagatattgatccgtattcagtgtcatacacttgggataagcaggtcgatgacgaagaccgtttggaagtattccctgctaattcatcatatccatcaactaaactaattactttacatcgtactggagatttcagcatgaaagcggtgtacactcatccttcgaaactgccaaaaggtacttccaccactattgcaaaatggagcttcactggggtcaaggttcctaaagatcaagattttattcctgtaaaggtcaagttaagatgcgatccttccggcttgcatattatcgagaacgcttacacaacggaagatattacggttcaagagccagtgcctttaccggaagacgcaccagaagatgccgagccccagtttaaagaagttactaaaacaattaagaaagatgtgctaggtatgactgcaaaaacattcgcgctaaacccggttgagttgaacgatctaattgaaaaagagaatgaattaagaaaccaggataagttagttgccgaaaccgaggatcgcaaaaatgcccttgaagagtatatttatacccttcgtgccaaactcgatgatgaatactccgattttgcgtctgacgcagaaaaagaaaagctaaaaaacatgttagccactactgaaaattggttatatggtgatggtgacgattctaccaaggcaaaatacattgctaaatatgaggagctggcatcgttggggaatattattagaggtagatatttagcaaaggaggaagaaaaaagacaagcactcagagcgaatcaagaaacttctaaaatgaatgatattgctgaaaaattggctgagcaaagaagggcacgcgctgcaagtgatgatagcgatgacaacaatgatgaaaacatggaccttgattaa

SEQ ID NO: 4555 - DNA, 2082 bp, Saccharomyces cerevisiae
atgagtactccatttggtttagatttaggtaacaataactctgtccttgccgttgctagaaacagaggtatcgacattgtcgttaatgaagtctctaaccgttccaccccatctgttgttggttttggtccaaagaacagatacttgggtgaaactggtaagaacaagcagacttccaacatcaagaacactgtcgccaacttgaaaagaattattggtttggattaccaccatccagatttcgagcaagaatctaagcacttcacctctaagttggttgaattggatgacaagaagactggtgccgaagttagattcgctggtgagaaacatgttttttcagctactcaactagctgccatgttcatcgacaaagtcaaggacaccgtcaagcaggacacaaaggcaaatattaccgatgtttgtattgctgtcccaccttggtacaccgaagaacaacgttacaacattgctgatgctgctagaattgctggtttgaaccctgttagaattgtcaacgacgttactgctgccggtgtttcttacggtatcttcaagactgatttgcctgaaggcgaagaaaagccaagaattgttgcctttgttgatattggtcactcttcctacacctgttctatcatggccttcaagaagggtcaattgaaagtcttaggaactgcctgcgacaagcattttggtggtagggacttcgatttggctataacagaacatttcgccgatgagttcaaaactaaatacaagattgacatcagagaaaatccaaaggcttacaacagaattctaactgctgctgaaaagttgaagaaagttttgtctgctaatactaatgccccattctctgttgaatccgtcatgaacgacgttgatgtttcctctcaattatctcgtgaagaattagaagaattggtcaagccattgttggaacgtgttactgaaccagttaccaaagctttagctcaagccaaattatctgctgaagaagttgattttgttgaaattattggtggtactactcgtatcccaacattgaaacaatccatttctgaagccttcggcaagccattgtccaccactttgaaccaagatgaagccatcgccaagggtgccgcctttatttgcgccattcactctccaactctaagagttagaccattcaagtttgaggatatccatccttactctgtctcttactcttgggacaagcaagttgaggacgaagaccacatggaagttttcccagctggttcatccttcccatctactaaattgatcactttgaaccgtacgggtgacttttcaatggctgctagctacactgacatcacacagttaccaccaaacactccagaacaaatcgctaactgggagatcactggtgttcaattaccagaaggtcaagactctgttcctgttaagttaaagttgagatgcgacccctctggtttacacacaattgaagaggcttacactattgaagatattgaagttgaagaacctattccattaccagaagatgctccagaagatgctgagcaagaatttaagaaggttactaaaactgtaaagaaggatgacttaaccatcgttgcacacacctttggcctagacgctaaaaagttgaatgaattaattgaaaaagaaaatgaaatgcttgctcaagataagctagttgctgagacagaagaccgtaagaacactcttgaagagtacatctacacattgcgtggtaagttggaagaagagtatgctccatttgcttccgatgctgaaaagacgaagttacaaggtatgttaaacaaggccgaagagtggttatacgatgaaggtttcgattccatcaaagctaagtacattgccaaatacgaagaattggcttctctaggtaacattattagaggtagatacttggctaaagaagaagaaaagaagcaagctataagatctaagcaagaagcatcccaaatggctgctatggctgaaaagttggctgctcaaagaaaggcagaagctgaaaagaaggaagaaaagaaggacactgaaggtgatgttgacatggactaa

SEQ ID NO: 4556 - DNA, 2082 bp, Saccharomyces cerevisiae
atgctacgatcaaccacatttactcgttcgttccacagttctagggcctggttgaaaggtcagaacctaactgaaaaaattgttcagtcgtatgcggtcaaccttcccgagggtaaagttgtgcattctggtgactatgtatcgatcaagccggcacactgtatgtcccacgataattcgtggcctgtagctttgaaattcatggggcttggcgctaccaagatcaagaatccttcacagattgtgaccactctggaccacgatattcagaacaaatcagagaaaaatttgaccaagtacaagaacatcgaaaattttgctaagaaacaccatatagaccactaccctgccggtagaggtattggtcatcaaattatgattgaggagggctatgctttccccttgaacatgactgtcgcatctgactcgcattcaaacacctacggtggtctggggtcgctgggcactccaatagtgagaacagacgctgcagccatatgggccacgggacagacgtggtggcagatcccaccagtggctcaggttgagttgaaaggtcaattgcctcagggtgtttccggaaaagatatcattgtcgcattatgtgggcttttcaacaatgatcaagttctaaatcacgccattgaattcacgggtgactctttgaatgcattgcctatcgatcacagactcactattgctaacatgaccaccgagtggggggctctttctggtttgttccccgtggacaaaactttgatcgactggtataaaaaccgtttgcaaaagctgggcaccaataatcatccaaggattaatccaaagactatccgcgcactagaagaaaaggcgaagattccgaaagcagacaaggatgcacattatgccaagaaactgatcatcgatctagccacgctaactcactacgtctcaggtccaaatagtgttaaggtctccaacaccgtgcaagatctatctcaacaagacatcaagataaataaagcttatctagtgtcatgtacaaactcccgtctatctgatttgcaatctgcagcggatgtggtttgtcctactggagacttaaacaaagtcaacaaggtggctccaggtgtggagttctatgtcgctgctgcctcttcagaaattgaggctgatgcccgtaaatcaggcgcttgggaaaagctgctaaaggctggctgtatcccactgccttctggttgtggtccatgcatcggtctaggtgcgggattactggaaccaggtgaagttggtatcagtgccacaaacagaaacttcaaaggtagaatgggttccaaggatgcattggcttacttagcttcccctgctgtagtcgccgcttctgccgtgctgggtaagattagttctcctgctgaggtattgtccacaagcgaaattccattcagcggcgttaagactgagataattgagaatcccgtggttgaagaggaagttaacgctcaaacagaggctccaaaacaatccgttgagatattagaaggtttcccaagagagttttctggtgaattagttttatgtgatgccgataacatcaataccgatggtatatatcctggtaagtacacttatcaggatgatgtgcctaaagaaaagatggcgcaagtttgtatggaaaattatgatgccgagttcagaaccaaggttcatccaggtgatatagtggtcagtgggttcaatttcggtaccggttcctccagggaacaagcggccaccgccttattggctaaaggtatcaacttagttgtttcaggatcttttggtaatattttttcaagaaactccattaacaatgctcttctgaccttggaaatcccagcattaatcaaaaaattacgtgagaaatatcaaggtgctccaaaagaacttacaagaagaactggttggtttttgaaatgggatgtagctgatgctaaagtggtcgttaccgaaggttctttggacggccctgtgatcttggagcaaaaagtgggtgagctaggtaagaacctacaagaaattattgtaaaaggaggcttggaaggttgggtcaaatcccaactataa

SEQ ID NO: 4557 - DNA, 2082 bp, Saccharomyces cerevisiae
atgtggggggatagtatgcgcgagcttggtgacgctatggataatgagttgaatgcagtgaagccggtggtggaagaaggtggcatggatggtgccagaaaatttattaagggtaagagctttcagaagtcttctaccgaacatatgttgatttcgcccggtagggatggttcagtgccattgaatgggttgaaatcgtcgccggcagacccgcacttgtctgatgttaattctatcttggacaatcatcgtggcggtggcgagacagctttgacgtctgtaaataatattatcatggccacttcgacgaatggggacagtgatggggttgatggagatgccaagaggccgtctatttctaactgttcgtcgagatcatcattttttgacaccgtactgagcacgttttccctaaaatcaaattcacaagatacggttactaatgaagtcaaaaatattgaggtccagtttgcatccgaggaggctaataaaaaattccgccaaatgttcaagccattagctcctaatacgagacttattacggactacttctgctacttccacagagaattcccctatcagggcagaatctatctctccaacacacatttatgtttcaactcaaccgtgttgaactggatggcaaagttacagattcccttgaatgaaattaaatatttagataaggtcaccacaaattcaagtgctatttcggtggaaaccgtgactaacaggtacactttttccggattcatagcgagagacgaggttttccaattgattacaagagtttggtcaaaggaaaacttaaccaatatcaatgacgttttggaggttgatgagagggtctccaagaaaaagggaatatcatcgaccccttcttccatattcaacaatgtttctaccaatgcatataacgatttcatatcgacaaccactactgaaccaacaagcagggcttcctacatgagcgagaacgacatgctcatcgaggaggccataaggtccgtggacgattacatgggcacaccaagagcatcgccatcttcttcatcttcgtcgtcatcgtcgtcatcgtctttaggctcttcaacaacttattattgtaggcccgtatataggttaaagccaaacgcaccatttcaatatgaggggccattccatgtacaagaaaccatggactttccttataaacctgaggctaataatgaatacgtgcttctggaacgtcaattcagcgttccacccggcctacttttcattatgatgttcaatgaagataatccagtttttgagttaagctttttgaaaactcaagattcgtccaacatctcacacatagggacttttgaaaaagtcaataaagatggacaacattacagagaattccaatacaccaaacagctgcatttccctgtggggcccaaatccacaaactgtgaggtagcggaaattcttttacactgcgactgggaaaggtacataaatgttttaagtataacaagaacaccaaatgttcctagtggtaccagtttcagcaccagaacgaggtacatgttccgatgggatgaccaggggcaaggttgcatattaaaaataagtttttgggtggactggaacgcatccagttggatcaagccaatggtagagagcaattgtaaaaatggacaaattagcgccactaaggacttggtaaagttagtcgaagaatttgtagagaaatacgtggaattgagcaaagaaaaagcagatacactcaagccgttgcccagtgttacatcttttggatcacctaggaaagtggcagcaccggagctgacgatggtacagccggagtcgaaaccagaagctgaggcggaaatctcagaaataggcagcgacagatggaggtttaactgggtgaacataataatcttggtgctcttggtgttaaatctgctgtatttaatgaagttgaacaagaagatggataagctgacgaacctcatgacccacaaggacgaagttgtagcgcacgcgactctattggacataccagccaaagtacaatggtcaagaccaagaaggggagacgtgttgtaa

SEQ ID NO: 4558 - DNA, 2085 bp, Saccharomyces cerevisiae
atgaccgaacaatattccgttgcagttggcgaagccgccaatgagcatgaaaccgctccaagaagaaatatcagggttaaagaccagcctttgattagacccataaactcctcagcatctacactgtacgaattcgccctggaatgttttaccaagggtggtaagagagacggtatggcatggagagatattatagatatacatgagacgaaaaaaaccatagtcaagagggtggatggtaaggataagcccatcgaaaaaacatggttgtactacgaactgactccctacataaccatgacatacgaggagatgatctgcgtaatgcacgacattggacgtgggctgataaagattggtgttaaacctaacggtgagaacaagttccacatctttgcctctacttctcacaagtggatgaaaacttttcttggttgcatgtcacaaggtattcctgtggtcaccgcgtacgacactttgggtgagagcggtttgattcactccatggtggaaacagattccgtcgccattttcacggacaaccagctgttgtccaaattagcagttcctttgaaaaccgccaagaacgtaaaattcgtcattcacaacgaacccatcgatccaagtgacaaaagacaaaatggtaagctttacaaggctgccaaggatgctgttgacaaaatcaaggaagttagaccggacataaaaatctacagtttcgatgaaattattgagataggtaaaaaggccaaggacgaggttgaattgcatttccccaagcctgaagatccagcttgtatcatgtacacttctggttccactggtacaccaaagggtgtggtattgacacattacaacattgtagctggtattggtggtgtgggccataacgttatcggatggattggcccaacagaccgtattatcgcattcttgccattggctcatatttttgaattaacctttgaattcgaagcgttctactggaatggtatcctagggtacgccaatgtcaagactttaaccccaacttctacacgtaattgccaaggtgacctgatggagtttaaacctaccgtaatggtgggtgtcgccgcagtttgggaaacagtgagaaaaggtatcctggccaagatcaacgaattgcccggttggtctcaaacgcttttctggactgtctatgctttgaaagagagaaatataccatgtagcggcttgctgagtgggttgatcttcaagagaatcagagaagcaaccggtggaaacttaaggtttattctgaacggtgggtctgcaatcagcatagacgcccaaaaattcctctccaaccttctatgtcctatgctcattggatatgggctaactgagggtgtggctaatgcctgtgtcctggagcctgaacattttgattacggtattgctggtgaccttgtcggaactattacagctaaattggtggatgtcgaagatttgggctattttgccaagaataatcaaggtgaattgctgtttaagggtgcacccatctgttctgaatactataagaatcctgaagaaactgctgcggcctttaccgatgatggctggttccgtaccggtgatatcgctgaatggacccccaagggacaagttaagatcattgatagaaagaaaaatttggttaagaccttaaatggtgagtacattgcattggaaaaattagaatccatttacagatcaaatccttacgtccaaaacatctgtgtctacgctgatgaaaacaaagttaagcctgtcggtattgtggtccctaacttaggacacttgtctaagctggctatcgaattaggtataatggtaccaggtgaagatgtcgaaagctatatccatgaaaagaagctacaggatgccgtttgcaaagatatgctgtcaactgccaaatctcaaggcttgaatggtattgaattattatgtggcattgttttctttgaagaagaatggactccagaaaatggccttgttacatccgcccaaaaattaaagagaagagatattctagcggctgtcaagccagatgtggaaagagtttataaagaaaacacttaa

SEQ ID NO: 4559 - DNA, 2085 bp, Saccharomyces cerevisiae
atgactcatacaaatgagcacgaccataaggctgaacaacaacaaaatggaaggggcgatacaacaacagagactgtaaaccctcagaagatgaaattggttaccaaacttctcattgataataaatttggactaatggacgacttgaattttagtataccattaaccgcttcttctgagggtgtaccaatatcagcaaagacatcagaattgggtacggagtacctcaagaatcaacaagagaattcagtaagcccaatacttccaatatcaagaagtacaagaataaaagcagacagggtgagaatatatttagactattattataatatattagagcgttgcatttcaattgatagctcccagaatcatcatgagggtgttgaaggggtgtacaacccattacaagttattaggaatcgtaaattaaaaaagaagcatcatgaattacctaccagagagttttatactacaaaacaccctattattgccattaagcagttttcgaaaaaacccaacaaaaaaatgccgtggtttgtagatataaacgagaagtatatggatttgacttggagaacttcgcattgggaagaattagtggatcctcaaggtaagctttggttccagtcttatagtccttccaacgaatcgagcggatcatcatcatcccgccggcatcatggacaccacattcatcccagaagacatttacaacatcactccagggtccgtacagctaattcagtgcactcaaacactcaatcactgacaccgaaacgagtcatgaccaatgaagaagacaataataatcataacaataataacatgataacgaagatcgcaactactccagaagctcagatttcaaggaacaaaaaatctgatctcaatttaagtcacattcatttagaggtaccaataaccaatacagttacaaacacctcatcagatcaggggtcattgatcatcgaagcaaagggcagtagctatggaggtgatcgtcgtggaagtagtaataccagtggaagtggtgggaaaagaaattctaaacattatcgttcaaaatcagcaggccccccggaaaacgagaaatcaagaatgaatgggctcgaaaaaatcattagtaaaacgtcgaaaggatggtctagatcaccaaaaaaaaatacgcctgggcttgaaaaacaggtgcttctgaatcccactattagtaatggaggcaccagcagaaggagcagtaataatggagagagtattagtaccaacagtagcaaaagtagcatgggaattacttttggaaacactgaaacttacaagacgccggttgataatgggaaagatgctataatacggcaaagtttgttgagcgaagtgccagttcataccttgagaggtaaaaccagcaacagatcgttgcgagcagaaggtgaacaagctcttgaaagtgacaaagaattaccaaatggtgctgggagtatttacgaaggtgcgcctagggagaagactactagtcaaggtagcgaaccagtgggattagtaagcgattccttacaggttgacgaacagttacagagatactggcatgatacaaggtatattatgagtaccgtagctatgatgcaacacaggagagagacacatgatatagtgaagaggagagaaattgcacgaagaaacgaaattgaaattacacaagatgcagatacaaacattaggaagactgcagatgctttgactcagtatgataatgaattgaataaagttttaaagctaggtaatgactggacatcaaaacttctgaacgactattcaattcgtgtagaaactttgatatcatctagtgacagaattcttagtgatataaatacaacattgacattgaagttgaaaatgtttcaagagaatacagaaaggtatgttacggtgaaagttatgagagcccaaaagatgaccaaaaccatatatcggttgctggaatttggcattgttttagttctttggacaatttggtttttgttcagcgtcctgagaagcattcggttcacaatttttttagttctaaaaatcattaaggcattgctgtggtaa

SEQ ID NO: 4560 - DNA, 2085 bp, Saccharomyces cerevisiae
atgcttttcgctagattagtgctgctgttggtgtatttggcaccaggttctttagcaaaaccagcatcaactaagaaaagaacgcaatgggaccagatagcaattgatgcttgtgctaaagaattggaatcacacaaatttgacacggatgtgaagggtcggcacgctactctttgcacttatgaaccagcactagggtcttggttacattgcgcgaaggatgttctcgacagtaggaagaaaagtaaaaaaatattcgaaaaaacgtttagcaaaattaatcagtattgccacgattatcacaaagatgaggtcgtcagcaatgaggagtattatcgaatttttgccaatgcatcccttttcatccggcctcttgatgaggtaaaggaaaacatacgatatcccgtcactcccaataaagcctctctagataggtgggtatgggcttattttgggcccctggataatatagacaaaggaaatgtttatggagtgacgatttgcttatactggataggagttctgtttattgcagctgtatatcacttcttgaacttttctcgacttaaacaaacggtgttcaaaaacaaggtgtctgctttcttaagaggccactatgttcttccagcgcttgttcataaccatgctatgtcagtgggaaggtggtttttcatcggtctggtccctaccaggttagagacccttgtcctattcggttacgttttgttgcacgggttcttgttgagtagttacaattttgaccataatgagttgctcagtgatcgcagaagccaagtgcttatcttcctttccgacagggcagggatcctggcattcgcacattttcctttgatagttctctttggcggtaaaaacagcacaatgacttggctcacaggtataagatataccgcattcattacttaccacaaatggttaggaagattcatgttagtagactgtacgatccatgcaataggatacacctaccatgcatacatagaaaattactggaaatacgtgaagtatagtgatctatggacatccggaagacatgccatgatcattgttggaatacttgtgtttttttcgttcttcttctttagacgacattattacgaattgtttgttattacgcacattatcttagcaataggatttttccatgcgtgctggaaacattgctataaacttggatggggtgaatggataatggcgtgtgcactgttttggattgctgaccgtattctgcggctaataaagattgcaatttttggaatgccatgggctaaattgaaactgtgtggcgagtccatgatagaagtgagaatctcaaaaagctccaaatggtggaaagcagaacctggccaatatatatatctgtacttcttaagaccaaaaatattctggcaatcacatccattcacggtcatggattctttggttgaggatggtgagttggtagttgtgataacagtgaaaaatgggctaaccaaaaaattacaggaataccttttagagagcgaagggtacacggaaatgcgagtactagcagaaggaccttatggacaaagcacgcgaacacatttgttcgaaagcctcctgtttattgccggaggggcgggtgttcctggacctctgtcgatggcaataaaggcaggtcgccaggtcaaaagcaacgattctcatcaaatgatcaaatttgtgtggagtgtacgtaaccttgatctcttagaagtgtatcgcaaagagataatggtgctaaaagagttgaacatagacacaaaaatttacttcacaggagagcgaaaagatgaatcgaacacggaggagggagcaattgctaatatgagcacggaaggcagactgctgacgacatcgaaatcagcggaaatgattactgattttggacgaccaaatatcgatgagataattgaagaagcagtaagtggtgcaaaatctttgttggtcacttgttgcgggtcagagggctttgtagacaagacacgagagttgacggcaaaaagagttcttgaacacggtgacaaatggatagaatacgtggaggaattccagaattggtag

SEQ ID NO: 4561 - DNA, 2085 bp, Saccharomyces cerevisiae
atggtcttgataaatggcataaagtatgcctgtgagaggtgcataagaggccatagagtaacaacatgcaatcatacagatcaaccgcttatgatgatcaaacccaaaggtagaccttccactacatgcgactattgtaaacaacttcgaaaaaacaagaatgcaaatcctgaaggtgtttgcacgtgtggccggctagagaagaaaaaactggcacagaaagccaaagaagaagcaagagctaaagccaaagaaaaacaaagaaaacagtgtacctgcgggactgatgaggtttgcaaatatcatgctcaaaagagacatctaagaaagtccccttcaagttctcaaaagaaaggaagatccatttctcgttctcaaccaatgtttgaaagggtattgtcttctacttcacttgacagcaatatgttatccggccacggagcactatcagatacctctagcatactgacgagcacatttttagacagtgagccgggtgttggtaaaatttcaaaagattaccatcatgtcccttcattggcctccatttcatccttacaatcctcgcaatcgttagatcaaaatttcagtataccacaaagcccgccgttatcttcaatgtcatttaattttctcacgggaaatatcaatgaaaccaaccaaaatcacagtaatcatcagcattcaaaatcaggcaataactggcaagatagttcggtaagcttgccagcgaaagctgattcacgtcttaacatgatggataaaaacaactctgtgggtcttgacctattaggccattcaaaacgaatatcgccgatatcaaactctcgtgtgggcgaagttagcgttccgctagaagaatatattccttctgacattgatggggttggaagagttactgataaaagctctttggtctacgattggccatttgatgaaagtattgagagaaatttcagtacaaccgcaaccgctgcaactggtgaaagtaagttcgacattaacgacaactgtaatagaattaatagcaaaagttatagtaagactaatagtatgaatggaaacggtatgaacaatagcaataataataatatcaacagtaatggcaacgacaagaacaataacaactcttctagacaagaacatcaaggaaatggactatttgacatgtttacagattcatcgtcgatttcaacgctttcccgtgcaaacttattattgcaagaaaaaattggttcgcaagaaaactctgtcaaacaagaaaactattcgaaaaatcctcaacttcgtcatcaattaacttccagaagtagatcatttattcatcatccggcaaacgagtatttgaagaatacttttggaaattcacatagtaatgacatcggaaagggagttgaagtgctatctttgacaccgagttttatggatattcccgaaaaagaaagagaaacggaaagatcgccatcatccaattacattactgacagacctttcactcgaaaacctagatcttctagcattgacgtaaaccataggtatccacctatggcaccaacaaccgtagcgacatctcccggtgcattgaacaatgccgtagcaagcaatctcgacgatcaactgagtttaacatcactaaactctcagccatcatcgatagcaaatatgatgatggacccttcaaacctagctgagcaaagttctattcattcagttcctcagtcaataaactctccgagaatgcctaaaactggaagtcgccaagacaagaacattcacactaagaaggaagaaagaaatccgctaaataacatacacgatctgtcacaattggaaaatgtaccagacgagatgaaccaaatgttctccccaccattaaaaagtatgaatagaccggatgccataagggaaaattcatctagtagtaatttcataatccaaggaaatagcatgatctctacgccttccggaaggaatgaccttccagatacctctccaatgagtagtattcaaacagcgtcaccaccaagtcaattactgaccgatcaaggatttgcggatttggataatttcatgtcttcgttatga

SEQ ID NO: 4562 - DNA, 2085 bp, Saccharomyces cerevisiae
atgtccgaacaacactctgtcgcagtcggtaaagctgctaatgagcacgagactgcccctaggagaaatgttagagtcaagaagcggcccttaattagaccattgaactcgtcagcatctacgctgtatgaatttgccctagagtgtttcaacaagggtggaaaacgagatggtatggcttggagagatgtcatcgagattcatgagacaaagaaaaccattgtgagaaaggtagacggcaaggataaatctatagaaaagacatggctgtattatgaaatgtcaccatataaaatgatgacctaccaggaactgatctgggtgatgcacgatatgggccgtgggctggcaaaaataggcatcaagcccaatggagaacacaaattccacatcttcgcatctacttcccataaatggatgaagattttccttggttgcatatcccagggtatccccgtagtaaccgcgtatgatactttgggtgagagcggtttgattcactccatggttgaaaccgagtctgctgctattttcactgataatcaattattggctaaaatgatagtgcctttgcaatctgctaaagatatcaaatttcttatccataacgaacctatcgaccccaatgacagaagacaaaacggcaaactttacaaggctgctaaggatgccattaataagatcagagaagttaggccagacataaaaatttatagttttgaagaagttgtcaagataggtaaaaaaagtaaagatgaggtcaaacttcatccacctgagccaaaagatttggcttgtatcatgtacacctcgggctcgatcagtgcaccaaaaggtgtagtattgactcattataatattgtttcgggtatcgctggtgtaggtcacaacgtctttggatggatcggctctacagaccgtgttttgtcgttcttgccattggctcatatttttgaactggtctttgaattcgaagccttttactggaacggtattcttgggtacggtagtgttaagactttgactaatacttcgactcgtaattgtaagggtgacctggttgagtttaagcctactattatgatcggtgtggctgccgtttgggaaactgtgagaaaagctattttggaaaagatcagcgatttaactcccgtactccaaaagattttttggtctgcctatagtatgaaagaaaagagtgtaccatgcaccgggtttttaagtcgtatggtcttcaagaaagtcagacaagccaccggtggtcatcttaagtatattatgaacggtgggtctgcgatcagtattgatgctcagaaattcttttctatcgtcctgtgtcctatgattatcggttacggccttactgaaacagttgcgaatgcttgtgttttggagcctgatcatttcgaatatggtatagttggtgatcttgttggatcggtcactgccaaattggtggatgttaaggacctaggttattatgcaaaaaacaatcaaggtgaattgcttctaaagggtgcgccggtctgttctgaatattataagaatccaatagaaacggcggtctctttcacttacgatggatggtttcgtactggtgatattgttgaatggactcccaagggacaacttaaaattattgatagaagaaagaatttggttaaaaccctaaatggtgaatatattgcattagaaaagttagaatctgtttacaggtcaaactcctatgtgaaaaatatctgtgtttatgccgatgaaagtagggttaaaccggtgggtattgtggtacccaacccaggacccctatctaaatttgctgtcaaattgcgtattatgaaaaagggtgaagacatcgaaaactatatccatgacaaagcattacgaaatgctgttttcaaagagatgatcgcaacagccaaatctcaaggtttggttggtattgaactattatgtggtattgttttctttgatgaagaatggacacctgaaaatggctttgtcacatctgctcaaaaattaaagagaagagaaatcttagccgctgttaaatcagaagtcgaaagggtttacaaagaaaattcttag

SEQ ID NO: 4563 - DNA, 2088 bp, Saccharomyces cerevisiae
atgaagaatctgaccactataaagcaaacgaacaagaatgtcaaacaagaaagacgtaaaaagtacgctgatttggcgattcaaggcacaaataactcctcaattgcttctaaaagatcggtagagttattgtatttgccaaaactgagttcggctaataatttccaaatggataagaataataaactgttggaatattttaaattctttgttcctaagaaaattaaaagatctccctgtattaacagaggttattggttgaggttatttgccatcaggtcaagattgaactccatcattgaacaaacgccacaggataaaaagatagttgttgttaaccttggttgtgggtacgatccattaccatttcaactattagacaccaataacatacaaagtcaacaatatcatgaccgagtttcctttattgatattgattactctgatttattgaaaattaaaattgagttgatcaaaactatacccgagctttcgaaaattattggtctttctgaagataaagattatgttgatgatagtaatgttgattttttgactactccaaagtatctcgcccgaccatgcgacttgaacgattctaagatgttcagcacattgctaaatgagtgtcaattatacgatccaaacgttgtcaaagtatttgttgctgaagtatcactggcgtatatgaagccggagcgttctgatagtataatcgaggcaacttctaagatggagaatagtcattttattattcttgagcagttgattccaaagggaccttttgaacccttttctaagcagatgctagctcatttcaagagaaatgattctccgttacagtctgtattaaagtataatactatcgagtcacaggttcaacgattcaataagttaggtttcgcttacgttaacgtgggtgatatgtttcaactgtgggaaagcgcagatgaggcaaccaagaaggaacttttaaaggtagagccttttgatgaactagaggagttccatttattttgtcatcattatgttttatgccacgctacgaactataaagaattcgcatttactcaagggtttttgtttgacagatcaatatctgagataaacctaactgtggatgaagactatcagcttctagaatgcgagtgccccatcaatagaaaatttggcgatgtagatgtcgctggaaatgatgtgttttacatgggaggtagtaacccatacagagtaaacgaaatattacagttgagtatacactacgacaaaatagacatgaagaatattgaagtaagcagcagcgaggttcctgtagcaagaatgtgtcacacttttacaactatttctagaaataaccagctactgcttattggaggtagaaaggcaccacaccaaggtctctctgataattggatatttgatatgaaaacaagagagtggtcgatgatcaagagtttatcacacacgagattcagacatagtgcatgtagcttaccggatggaaacgtcctgatccttggtggggttacagaaggacctgccatgctgctatacaatgtcaccgaagaaatcttcaaagacgtaactccaaaagatgaattcttccaaaattcgctagtatcagcgggtctagaatttgatccggtttccaaacaaggcataatattgggtggtggatttatggatcaaacaactgtctcggacaaggcaattattttcaaatatgatgcggaaaatgctactgaaccaattacggtgattaagaagctccagcaccccttatttcaacgttatggatcccagataaaatacattactccaagaaagctattaatagtcggtggaacaagtccttccgggctatttgaccggaccaactctataatcagccttgatccgctgagtgagacgctaacatcaattcccatatcaagacgcatatgggaagatcactcactaatgcttgctggatttagtttggtgtccacttctatgggcaccatacatatcattggaggcggtgccacttgctacggctttggatcagtgactaatgtaggtcttaagctcatagcaatcgcgaaataa

SEQ ID NO: 4564 - DNA, 2088 bp, Saccharomyces cerevisiae
atgactatacatcagttatctccagaatcccaatggaagattgtttctagttcctttatttacggtccggtagctgctgtaagggaattattagataatagcatcgattcgggtgctaaaaaagtattcatcgatgtagattccactacgggaggatgtgaatatatatcagtcaaggacgatggatcaggtgtggatattatcgacagaccttctatgtgcttggaatacaccacatcaaagatgagtagtctcggagatatttcgattctgactactcttggattcagaggtgaagcattgtttcttttgtcaaacttgtgtaaccagaaaggctcaatgcaggttgaaacaaaaactgcagatgatgtcattggagaaaaatggttagttgatagtaagggtggtattaccaatggaaaaaggtacaaggtatcttgtcccgtggggactacagtaatattaaggaaacttctgggagggttacgagcaaggtatctcgaaatttcttcgaggccaagaaaaacattcgatgaactaatctatttaataaaccattattctctaattcatagaaatattcggttttatttttcgttggtgtcattacaaaaaaatggtgccatagagcgtaaacaaatgcaagaaacgttagaccctaagatttctagagctagaagtttgtccctactagctagactaaaaaagcctgtgccgctgaactttattgtagaagaaaactttgttatcgacgaaaaaataaatttagatttgatcttaccgaggatggtgccagaatctgacgttattaatataaagagacgatttaaatttttatctgttaatgagagagcgctatctttgaacttggagacggggaagactatttctaagttactatcgtcaatctatagagatttctctttactagatcctatggtttggtttattaatttaaattgcgatacaaagcttcttgacgtaaatatcgaaccagagaaaaatgacgtgatgatcaaaagttttgaagtgatatttaagaagatagagaataagttaaagttgttattggaggagagaattggcatcgaaacaaatatgctgggagataaacatgttcagccttctatcaacgaaaaaacttctcccgcactggtgatacctacacccgacgcagagaatgaaatatcaaagggctgtggtgctgttagtggtaaagacaagactgacatcccacaaaaaaactcagatttgatagtaccaactttttacgatgaagcaaacttagagaatacgaccattgtcgctgctactccttcacctacaaaatttagcgaggataaagctcttgacgaacaaactcagctgaccatttcaagttatagaagctcgagttccgggtctatggcttccgaggacagtactaattggcgacataatttccaacaagaactaagcgaaaatagtgaagtagcaggagctggatcctcaacattaccctcgtcattaacttataactatatagaaactattccagagaacgaggatttagaactttctaaggacgcttctatttctaatccttttatgatcacaaaaataagaaacgtcaacaagaaactgagcgaaaacttacttgaggccaaacgtactagctgtggagatgccaataaaaggggaatgcccaacgaaagacagctttcaaatacagaaaaaaaggaactaataaagcttcagcaaacctacggtaaaagaaacaataccgtggacatgaccattccacgaaattcgaaaaaaaaagtaactgataattatataaagaaagcatcctgcatgcacaaaacaaggccgaaactcatgcatttttccgagtataccaacaactacgtctataccctgaagaatgaaaaaattgttaagcatgacagcgataactttgccaaagaaactctgtggttacgatcgagggacgatgccacaagcccttcttccagtcttttgcaagccttgcgagcgcatgtgaagaaaccgggacacattgaagccacgacaaatgaatggtgcctcttcacgccagacagcccctga

SEQ ID NO: 4565 - DNA, 2088 bp, Saccharomyces cerevisiae
atgattgtaagaatgatacgtctttgtaaaggtccaaagttgttgcgaagtcaattcgcatcagcaagtgcactatattcaaccaagtcattgttcaaacctcccatgtaccaaaaagcggaaattaatttgattattccacatagaaagcactttttgttgcggtcgattcgattacaatcagacattgcgcaaggaaagaagtccaccaagcccactttaaagttgtccaatgcaaattcaaaatcctcggggtttaaagacattaaacggctattcgtcttatctaaaccggaatccaagtacattggtcttgccctccttttaatcctcatttcaagttcagttagtatggctgtaccttccgttatcggtaaattattagacttggcttccgaaagtgacggcgaagatgaagagggctcaaaaagcaataagttatatggttttacgaagaagcaatttttcacagcattaggagcagtatttataattggagcagttgctaatgcaagcagaatcatcattttaaaggtcaccggtgagagactggtcgcaagattaagaacgagaacaatgaaagctgcattagatcaagatgccacatttttagatactaatcgtgtcggtgatttgatctcaagattatcatctgatgcatctatagtggccaaatcggtcacacaaaacgtctctgatggaacaagggcaattattcaagggtttgtcggttttggcatgatgagcttcctctcgtggaaattgacttgcgtaatgatgattttagcccctcctttaggtgctatggcactgatatatggtaggaaaatacgaaacctatcaagacagttacaaacctcagtaggtgggttaacaaaagtggcagaagagcaattaaatgctactaggacaattcaagcatatggtggtgaaaaaaacgaggttcgccgctatgcaaaagaggttagaaatgtatttcatattggtctgaaggaagcggttacttccggtttattcttcggaagtactgggctagttggcaacactgcaatgctgtcgttattattggttggaacaagcatgattcaaagtggttcaatgactgtcggtgaattatctagtttcatgatgtatgccgtgtataccggaagttcattatttggtttatcgagcttctattcagaacttatgaaaggtgctggtgcggctgccagggtttttgaattaaatgaccgtaagccattgattcgtccgactattggaaaggatcctgtgtcattagcccaaaaacccatcgttttcaaaaacgtgtcattcacttatcccactcggcccaaacaccagattttcaaggatttgaatattactatcaagcctggtgaacacgtttgcgctgtcggtccatcaggaagcggcaaatcaacaattgcgtctttgttgctcaggtactacgatgtgaactcaggatcgatcgaatttggtgatgaagacatcagaaatttcaacttgaggaagtatcgaagactaataggatacgtgcaacaagaaccactacttttcaatgggactattctggacaatatcctctactgcattccgcctgaaattgcggagcaggatgatcgtattagacgtgctattggaaaagctaattgcacaaaatttttggccaattttccagatggattgcagactatggttggtgctagaggcgcgcaattgtccggtggtcaaaagcaaagaattgcattagctagagcgtttttactagatcctgccgtccttattttagatgaagcaaccagtgcccttgactctcaaagtgaagaaatagttgccaaaaatcttcagagacgtgtggaaagggggttcactactatatcaattgcacataggctttcgacgatcaaacacagtactagggtgattgtgttaggaaaacatggctcagtggttgaaaccggttcattccgagatctaatcgccattcctaatagtgaactaaatgcgctgcttgccgaacagcaggacgaggaaggaaaagggggagtgatagatttggacaatagtgttgcccgggaagtataa

SEQ ID NO: 4566 - DNA, 2088 bp, Saccharomyces cerevisiae
atggctggaattttgtcaaagactctttcagaagtgcatccttccctccgaacaaatggtatgggtatcggtaacactcacaggaggatatcgctaggcttcctacctcccaacaagaagaatcctctggtacgaaaatttcgtgcaagaacgagaaatattgatcagaggagtttcagatctttaacagatgattttggaagtaacgtccatgaaccaaatccgtacttaggtaatattgatgaggaacctgacctttactatcatgatgaagaagatggcgaactgagcagaacgatttctctaccatcaagggtatcagaaactcctgagctttcgccacaagatgttgattggattctacatgaacatgaacgacgatactcatcggtatgcaactctgataatgaggaagcaagtcaaagcaacacaccagatagaatacaagaatattctggaagagaactagaatatgacgaatttatgaatagactccaagctcagaaacagaaattaactcgaagtgcggtaacagacgctaaaggcacctcacatcacagaagaccatcattcgtatctgtgactagccgaggctcagttcccacaatttaccaagagatcgacgagaacgattctgaggcactagcagaattggctcacagccacgtcaccttcaaatcagaagcaagagttttggcatcttattccttccctctaattttcacattcttattggaacagattttccctatggtatgttcattaactgtgggccacttaggcaaaaatgaactagcagctgtgtccttagcatccatgacttctaatataacactagcgatattcgagggtattgccactagtctagatactctatgccctcaagcgtatggctctgggagattctacagtgtaggagttcaccttcaacgttgcattgctttttcattggtcatatatataccttttgctgtcatgtggtggtattctgaacctcttctttcttatatcatccctgagaaagaattaatcaacctaacgtcacgatttttaagagtactaatattgggagcgccagcgtatattttttttgaaaatttaaaacgatttttacaagcccaaggtattttcgatgcaggcatctacgttttgacaatatgtgctcccttaaacgtattagtcagttacactctcgtttggaacaagtacattggtgttggatttattggggctgcaattgccgttgtgcttaacttctggctaatgtttttcttactattgttttatgcattgtatattgatggaagaaaatgctggggtggattctcaaggaaggctttcacccattggaatgatttagggcatttagccttctcaggtattattatgttggaggcggaagagctgtcatatgaactattgacgttatttagtgcatattacggtgtcagttatctagcagctcagtcggcagtatctactatggctgcattgctctatatgatcccatttgcaataggtatatctacctctacgagaattgcgaacttcattggtgcaaaaagaaccgatttcgcgcacatctcttctcaagttgggttgtcattttcgtttattgcggggttcatcaattgctgcatactagtatttggacgtaatctaatcgccaacatttactcaaaagatcccgaagtcatcaaattaattgcgcaagtattgcccttggtgggtattgtgcaaaatttcgactcgcttaatgccgttgctgggtcttgcctcaggggtcaaggcatgcaatctctaggaagtatagtaaatttaatggcttactatctatttggaattcccctggctctcatcctaagttggttctttgacatgaaattgtatggtctttggattggtattggaagtgccatgcttttaattgggctagttgaggcttattacgtattatttcccgattgggacaaaattatgacctatgctgagattttgaaagaaaccgaagatgatgaagtagatagcgatgagtatttaacagactcagacgatcctgatgaaaacacagccctcttaggggcttaa

SEQ ID NO: 4567 - DNA, 2091 bp, Saccharomyces cerevisiae
atggcaagttcaccgcaggtacatccatataagaagcatttaatgcaatcacagcatataaattttgataacaggggcctacagtttcaaaacagttcgttgaaggtaggtcaagatttttcagataataaagagaatagggaaaacagggacaatgaagacttcagtaccgcagaccttcctaagcggtcggcaaaccaaccgcttatcaatgagcatcttagagctgcgtcagtacctctactatcaaacgatataggcaatagtcaagaggaagatttcgttccagtcccacccccacagcttcatcttaataattcaaataatacttccttaagttctttgggaagtactcctacaaattctccgtcaccgggagcattaagacagacaaattcgagtacatctcttacgaaggagcaaataaagaaaagaactcgttctgtagatttgtctcacatgtacctgttgaatggtagcagtgatacccaattaacggctactaatgaatctgtagcagatttgtcacatcagatgatcagtcgatatttgggtggtaaaaataatacttccttagttccaaggctaaaaacaatagaaatgtatagacaaaacgttaaaaaatctaaagatcctgaagtgttattccagtatgcgcaatatatgttacaaaccgcactgactattgaatcttccaatgctcttgttcaagatagtgacaaggaaggaaatgtcagccaatctgacttaaaacttcagtttttgaaagaagcgcaaagttatttgaagaaactgagcataaagggttattcagatgcccaatacttattagcggacggctactcatccggagcatttgggaagattgaaaataaagaagcatttgtcttatttcaagcagctgcaaagcatggtcatatagaaagtgcttacagagcatcgcattgcttagaagaaggactaggaacaacaagagattctcgtaagtcagtcaattttttaaagtttgcggctagcaggaatcatccctcagcaatgtataaattgggactttattcattctacggcagaatgggtcttccaaccgacgttaatactaaattaaatggggtaaaatggttatcaagggctgcagcaagagctaatgagttgacggccgcagcaccatacgaattggctaagatttatcatgaagggttcttagatgttgtcattccggatgaaaagtatgcaatggaactatatattcaagcagcaagtttagggcatgttccttcagcaactttgttggcacagatttatgaaacaggtaatgatacagtagggcaggatacatcactttctgtacactattatacgcaggcagcgttaaaaggcgattctgtggcaatgttaggtttatgtgcatggtacttactgggagcagaacctgcttttgaaaaagatgaaaatgaggcttttcaatgggccttgcgtgcagctaatgctggtttgccaaaggcccaattcactctgggctacttctatgagcatggcaagggctgtgatcgtaacatggaatacgcatggaaatggtacgagaaagctgcagggaacgaggacaagagggcgattaataagctacgctcaagggacggtggactagccagcattggtaaaaaacagcataaaaaaaataaaagtatcagtactttgaatttattctctactgtggacagtcaaacaagtaacgtagggtcaaattcaagagtttcttcaaaatctgaaacattctttactggaaatccaaaacgtgatcgtgagccacaaggtttgcaaattaacatgaattcaaacacgaatagaaatggtattaaaacgggttctgatacaagcatcaggaaaagttcttcctcagcaaagggaatgtcaagggaagttgctgagcagtcgatggcagcaaagcaagaagttagtttatcaaatatgggcagttcaaacatgattcgtaaagattttcctgcagtaaaaactgagtcaaaaaaacctacaagcttgaagaacaagaaggataaacaaggtaaaaaaaaaaaagactgtgtaattatgtaa

SEQ ID NO: 4568 - DNA, 2091 bp, Saccharomyces cerevisiae
atggtaggctcgaaggatattgatctattcaacctgagagagaacgagcaaatcgtttctccttgtcttatcgtgcacggaaaatgcaataagcaaaatggtgcgaagaccgttcaagtgcagcatccacaattgcctccaattacttaccccatacataatcagttcttcaaggccactgtgatattgactcctggtgagaacaagttgacctttgttacagacactaacaccgctaggacaatcgtatgttactacacaccactgacgcagaaccctcccgtacacctgtgtctgatcttggccaaggattcgcctttacagtttgactctcctcgagaacagaaggacagagagggcgggaatggcctcgaattggcaatcaagaagctaagacttggggccagactcatgcaagcgtacacgaacgagcaaatgctgagaaacagtatgggaaataggacgtttccctttgttgaagaatttacctgggacacgctgttcgaacggcctgctatgagaaacaccatcaaaatacatgtagttcgttcggaaaagacggtgaaggaaatccaggaccctgacatagctcaacagaattccaaagggaaaaacaccggcgccctttttgggatagccatggacgcccttaaaagttacggcggacccttcaccaataacgaaaagcctgttcaggcagcttgtatgtttctagacacccactgggatggtaagttgattagaggccacgccgcattgggtgggggtgacgacagcattaagctcgccatttttgggtcgcacgggctttactcatggcctacttgtctcgagcaattggtgccttattttactgatgagacaagatcctccaccagtgaagtcgccaacgactgtaatgagtgtggtacttactgggaatgtttgactatcacgttgggagcatttatgcatgagattggtcacttactgggttgtcctcatcaggaaagcggtgttatgctaagaggctataccactttgaataggtctttcttgactaaagaggcttattctgtaagaactaattcaactggtgctagtcctcccatcttccccaaggaagaatgtacctggaaccgtctcgatacggtaagatttttgtaccacccctctttcactttaccacaggattattacgatccatcgttcatgagacctacaaaattgggcggataccccaatataaaacactctgtatatcctttgggtaacggcagttgccgcatattatcgcccacaggaatctatttgattgaaattatatgtgatgatttggccaggggccatattgaatacttgccggtttccctaggtggacaggggcctcaacgggaagttatagtaacattagatgatttacgtgccaggttgcccaagaatgaactcgccaagtttggcaataccttcaaattgaaaattctttctgttaatgcaccggaaaccgagttcgacaagttcccatctttgttagatgttcagccattagacatgtcgaaatatgggttttctaaaaatgttcaaggtatcaaatcaccactttatggtcgcagcgacggtggtaatgctgtcggcgtcgtcgcttttgatgttagattagtcactgctgtgagaatataccatggctatgcattagatggtgtgaggttttattacaaggaaaaaccaactggaacaaaggatgctcccgcatccaagccctctgtaccaccaagaaattatttctcaaaaattacacatagtatcaaaaatcatgcttcaataaacgaagaaaatctaaaaagtgtactctttggacatgaaacacaaaattttacggatgctacactagaaccgggtgaaataatcattgggtttaatctgaggtgcggagcttgggttgatgctatccaaattataacgagtcatgggagaatgaccgacatgtttggtaacaaagacggaggtgggttcgctgaattgcagccacctaatggccaatatatcctaggtgtgactggcagagtcggtcaatgggtcgacgccttcggaattatttacggagctttatag

SEQ ID NO: 4569 - DNA, 2094 bp, Saccharomyces cerevisiae
atgtcttccaagcattcagatccattggagagattttataagcaatttcaagcatttgttcaaaataaccctaatgtcatatcggcagctcgagctgccgcacaaataccggaatctgcaaaagctgttgtagtactatccccatattctttacagcatgtgttcccgagagaatgggtaacaaaatcgtataggaaaactatagtcgaacgaccagaaagattattagcaagctcgatgggtatatcagctgcgattacaatgtatccatcccttttcaccttgaaatcctcgcatcaaaggaaaggttcattgatggcacctcatgtgcttaaagttcatggcagtagctggccggctgagttaattgaactttgccaaatggcagatgctaaattgctaaaaggcgaaatcgaagtcccagatacttggaactcaggtgatatatacttgagctcaaagacaattaaagctctacagggaacaattggggccattgaaactggtgttgactcaattttcaaaggaccatctgcagaacatattagtaacagagcttttgttgctatacggcctcctggtcatcattgccactatggtacaccatccggcttttgtctgttaaacaatgcacatgtagccatagaatatgcgtatgatacttacaacgtcacgcatgttgtcgtgcttgatttcgatctacaccacggtgatgggacccaagacatttgctggaaacgtgcgggtttcaaacctgaggaggaacctgaagattcatcttatgatgattttggtaagaaatttgccgaatttcccaaagtcggttatttttctatgcatgatataaattcatttccaacagagtcgggatttgccacaaaggagaacattaaaaatgcatctacctgtatcatgaactctcatgacctaaacatctggaatattcacttatccaaatggacaaccgaagaagaattcaatgtattatacaggacaaaatatagaactttatttgctaaagcagatgaatttttcaggagcgcaaaactagaaatgaatcaacaagggagaccattcaaaggtttggttgtcataagcgcaggtttcgatgcatcagaatttgagcaaacttcaatgcaaaggcatagtgtcaacgttcctacaagtttttatacaacgttcaccaaagatgcattgaaattagcacaaatgcactgtcatggcaaagttttgtctctaatggagggtggatattctgataaagctatatgttctggtgttttcgcacatttgatcggtttacaaaaccaagattgggttaaagaatgggggtctgaacaagtcgttaaagagattgttcgtggttgcaaaccggcttggaaaccctataagacaaaaagagcaaaagatgtcataagaatatgggcagaagaagttatcaggctgggacgagcaatgataccggaattcgatgatatcatttttaaagacgcagttaacagcgcaccttctaattctctactaaaggctactgtcgaaccagcatccacgtcgacaattgctcaaagaataatcagatctcatagaagcaacgcttccccagaaaaagaacttcatgaaaacaagccgagaagcacggaaaaacaggaacaaagggaaattagaagcgataccaaggtcaagcagctctcgtcaaataatagagcagctgaaacccaaattccgtttttgcaacaagaattttccagtgaggatgaagatgaagaatacgtttacgatgaagaattgaacaaaactttcaatcgcacggtggaggatattaccattgatgatatttctagacatttggagaccttagaaattgaaaaaaaaggtgatgaagattcagaccatgagctaaaagaaaaaaattggaaaaactcgcaccaacgccgtctacaaggtaatggaatgtataaaattccctccaatacgaaaccgcatcgcataagacagcctcaaaacgcaaatacaccaacttatgacgatagtgatatatcaatgatttctcatgtttcaagaaaacatacaacaagaagtggtggaagatggtga

SEQ ID NO: 4570 - DNA, 2097 bp, Saccharomyces cerevisiae
atggactgggcaatcaaagcagctaggaagaaaactcaaaggaagccaggctctacccgttcaatcatagaaaccctcgatgatctaaataatctaacaacagatgcacattcagaaataaatcaacgattgtacgaaagtagtgaatggttaagaaataatgtttatatgaatacactcaagtatgaagacaaaaagatggaagagtctttaattagccccgaaaatacgcataacaaaatggatgtcgaatttcctaaaatgaaaggagaatatgaactttctaactcccagaatgatgccgcaaaagacgttactaagacacccagaaatggattacataacgataaaagtatcacgcctaaatcactccgcaggaaggaagtcaccgaaggaatgaatagatttagtatacatgataccaataaaagcccggttgagccattgaatagcgttaaagtcgacgccaatgaaagcgaaaaatcctcaccatggtcaccttacaaagttgaaaaggttctaagagaatcctccaagacttcggagtctccgattaatacaaaacgcttcgataatcaaacatgggcggctaaggaagaaatggagaatgaacctatacttcaagctttaaagaaagctgaatcagtaaaggtgaaaccaccaccgaattctgggatagcgagatctcaaagaaggtcgaatatgtttgttccactgccgaataaagatcctcttattattcaacacattccaccaacaaaatcttcaggatcaataccaaaagtacgaacagtaaaggaatcaccaatcgcatttaaaaaaaaatctacgataaatagtcctgctataagagctgtggaaaacagtgataccgcgggatctacaaaagcatccagtgttttcgataggctatcatctattccaacaaaatcatttgaaaacaaaatttcccgtggaaacgttggtcacaaatactcctcttcatcaatcgatttaacaggctcccccatgaaaaaagtttctcaaaagtttaagtcaataaactccacggatactgatatgcaagaagcgttaagagatatattctcagtaaaaaataaaataaccaaaaataattcacccaaaggaaaaaactctcgaaaatcctctattccgaggtttgataagacttctttgaagctaacgacacacaaaaagctagcaatcattgcagaacagaaaaagaagtccaaacactctagtgatgttcataaaactggttcaagaccgcacagtatttctccaacaaaaataagtgtcgattcaagctcgccatctaaagaagttaaaaattattaccaaagccctgtaagaggttatttgagaccaacaaaagcgtctatttcgcctaataaaaataaaaatttaacaacgtcgcaaacgccacatcgtttgaaaattaaagagaaaacattaagaaaactttctccgaatattgctgacatctccaagccagagtctcgtaaatccaaaaattatcggcttacaaaccttcaattacttccaccagcagaggcagaacgagatgacttaaaaaaaaagtttgataaaaggttatcaggaattatgaggtctcaacaggaacatcatcggcgtaaacaagagaaacaaaaaaggatgtcgcatttggaacaagatctaaaaaagcaaacaagctttagtaatgactacaaggacatacgtctaaaagaatctttggctcctttcgataatcatgtgcgagataccatcaacaaaaatactgcatttagtaccgacaatatattggccacaataaatacagttgaccatcgagaaataatcggaaatgtgaccccaaagatagcctctgtcaatgattctttaccagagataaatactgattctgaagatgaggctagcgtaactttagcggcatgggctaaatccccgtatttgcaagagcaattgataagacagcaagatataaatccacaaactatctttggaccaattccgcctttgcacaccgatgaaattttcccaaatcctaggctaaacaggttgaaaccgcgtcaaattgtgcccaaaaggtcttga

SEQ ID NO: 4571 - DNA, 2097 bp, Saccharomyces cerevisiae
atggtggataaaaataggacgttgcatgaattatcttccaaaaatttcagcagaacgccgaatggactgatctttaccaatgatttaaagacagtatattccatttttctaatttgtttggatttgaaagagaaaaaacatagtagtgacactaagtctttcttattaactgcattcactaaacatttccacttcacttttacatatcaggaagctattaaagcaatgggacaattggaactaaaagtggatatgaacacaacttgtattaacgtttcatataatattaaacctagtttggcgcgccaccttcttacattatttatgtcttctaagctactacatacaccgcaggacagaactcgtggcgagccaaaagagaaagttcttttccaaccaacacctaagggagttgctgttttacaaaagtatgttagagatattgggttgaaaacaatgcctgatattcttttgtcatcgtttaactccatgaaacttttcacttttgagagaagctctgtcacggattcaatcatccatagtgattatttgatccatattcttttcattaaaatgatgggcgctaagccaaatgtttggtctccaacaaacgcagatgacccattaccttgcctatcttcgttgttggaatacactaataatgatgatacatttacttttgagaaatctaagccagaacaaggatggcaagctcagattggaaacatcgatataaatgacttagaaagggtatcgccattagctcatcgattctttacaaatccagattctgagtcgcacacgcaatactacgtttcgaatgcaggtattaggttgtttgaaaataagacgtttggcacttccaaaaaaatcgtgattaagtacacctttacaacaaaggctatatggcagtggataatggactgtactgatattatgcatgttaaagaagcggtctcgttggcagcgttatttttaaaaacggggttgattgtaccagttcttttacaaccatcacgcactgacaagaaaaagtttcaaattagcaggtcctctttttttaccttgtccaagcgtggttgggatttggtttcttggacaggttgtaagagcaataatattagagcaccaaatggtagcaccatagacctagatttcacattaaggggtcatatgactgttcgtgatgaaaaaaagacattggatgatagtgaaggtttttctcaagacatgcttatctcttcgagtaatttaaataaactggactatgtgctaactgatccaggtatgagatatttattcaggcgccatttagaaaaggaactttgtgtagaaaatttggatgtcttcattgagattaagaggtttttgaagaaaatgacaattctgaaaaaattgatagattctaagcattgtgataaaaaatctaataccagtacttcaaaaaacaatatcgtaaaaacgattgattcagctttaatgaaacaggccaatgagtgccttgaaatggcatatcacatttattcgtcctatatcatgataggatcaccatatcaattaaatatccatcataacttgcgtcagaatatttctgacatcatgttgcaccctcattctccattatcggaacactttcctactaatctatacgatccatcacctgcatccgcggaatcagcagcttcatcaattagctcaacggaggctgacacgttaggtgaaccacctgaagtgagtctaaaaccttcaaaaaatctttcaaatgaaaactgttcatttaagaagcaaggattcaaacatcagttaaaggaatataaacctgccccgttaactctggcagaaacgcattcgcctaatgcatcagtagaaaattcacatacaattgttcgttatggcatggacaacacccaaaatgataccaaatcggttgaatcatttccagcaactttgaaggtcctcaggaaattatatcccctcttcgagatcgttagcaatgaaatgtatagactgatgaataacgattcctttcaaaaatttacccagtcagacgtatacaaagatgctagcgctttaatagaaatccaagaaaagtgctaa

SEQ ID NO: 4572 - DNA, 2097 bp, Saccharomyces cerevisiae
atggttttttcttatgagcactatatgaatctccttttccatttggataacagtaaagaaacggtgcctccagagattgcaaaaagaataatttcaaatgctatagctcctgtaataacagttacttcaactcctctcttcgacaaacatattcaagaaacgtacaaagtagattctctctatatgctgctgcgattctttggcggttgtgtctctgatagagatcaagccaatgaagcgaaggttggacagcatgagcatgaggtttgtgatgcaagtgactcgacggattcaattcccaaaaataaaaatttggaagtgcccaatttatcaaagaaaggtagtcgcagtaggtcgaatagtcttttccagagggattcaacgcaatctcaatatatcaggtttacaaggccattaggtgacttgatcgaaacaagagatgcaaatgatatgttattcaattaccattctttagaggtattcttagataattatttgaaattggttgcagcaaatactgatgaaatggttcctcataatcttcttaagaaatccatttatcatagtttcttttcactagcaatttcatccacaaataacttatcgccctatgaaacttttaatcaccctattctttccttgattgctttagatatatcaaatggcgaagtttatgaggatgcaagagatcttttagtcaatttcaagaatcttaatcataatactgaaaactttcctatcttcatgaatacaaatgaaatgcttccagttttcttactctgctacaatgacgattcccaagaagaattcgaaaaatgccaggcgttagctaagaaactaaagaagcagttgtttgttgagagtatcttactagcactctggaaggattcttttatttacgacgaaaattcagtcatacagttacaccaaccagtaatgtcatcgcttgaagaaattctcttcttccttcaagctccaactcaaacaacactctctctggctttgataaactcgatctatgatatgcttgattatttggtttatgatttaatgataccattcatgaaaagaaaagtgtcattctgggaagagacaattttacagccaagaaagtcgctatttaatggtgcaaagtttttcaaaaaatttatgaataaaaatcctgtcaatggtaatcaccaacataattctctaacgagagacagccagggaaatgaatacttcgcatcgtcatcttctgagtttttgatgagaaagttagcagattggtctatgatgctatccgacttcaaaactgcttattccacatacgaatcgcttatggatgacctagatgcatttccaaagtacctggcatcatgcatcgaatggtgcgcggtatcactattgatgggtgcgcagagcatagtcaccgtgaaaatgatcaaaaacgatataaatcctcttatcgaaagggcattagccacatacgaaaactgctcacgaatacaacgtggtaaaggcaaagaatcaaactctttggatgttacagagccagtgcgttcgtatgagacacgttgtatgattttggcatctgaattgtttttatctttaagcaatacgtggacatctaccccatacgctatccaatatttagaaacaattctagacgagtgcaagttgggaccttgttcacagataatggtttgggaaaggcttagtgactgctataatttgagagttgaccctagaatcaaacatagagttggagcaatgaagaaggacgctaaagacaccgaagatctccgaggtgagcataagtatagcacagatcatttcacagacgaggacatattatcggaagggttaacaagaagacgcaaggcagctttttttaggttaatagcagctaagaagtgggcagagcaaaaacaatggagacaggtttcttggtgcttaaaagatattgaaagtacctattcagagatcaaatttttgcatggtaacggtttaattttaagcaaactaaaaaatcaactcaatttaaaggacgtggattctgcaccacggccctccgaaaagaatcttacaagaacaagtgttagctttattggatga

SEQ ID NO: 4573 - DNA, 2097 bp, Saccharomyces cerevisiae
atgtatcgtacaagaagctctgacgaggtaaccacatcaacagatctaactagctcaagtgacgttgctacttcagttgacccaactacttctgttatcagttcaacttcagcagacccaactacttcagctgactcaactacctcgaccgttcaaaccacttcagctggtccaagtaacaacatcggcaattccactttggccaattccactacttttgcagttagttccacttcaattgacccaactagctcgagcgatgtgattacttcaaccgttcaaaccacttcaattgaaccaactacttctctcgtcagttcaaacgatattactacttcaacaagtctaaatatctctgtcgtgatttccacttccacggactctacatctttaattgagtctactacaacagttggtccacatgcctcatcaagtgttgctggtatgtatcgtacaagaagctctgacgaggtaaccacatcaacagatccaactagctcaagtgacgtggctacttcagcagatccaactagttcaagcgctgtgactactttagttgacccaactacttctgtagtcatttcaacctcagttgatcaaactagctcaagtgacgttgctacttcagttgacccaaccacttctgttatcagttcaacttcagcagacccaactacttcagctgactcaactacctcgaccgttcaaactacttcagttgatccaactagttctgtagtcagttccgctccagttgatccggctagttctgttgtcagtttaacttcatcttacccaactagctcaagcactgtgactatttctgctaattcaaacggttcagctactttagcggctcaaactacttcaattgatccagttagctccatcgttagttcaagcggtgcaactactatcatcagtagcgcctcaattgatccagctagttctgtagttagttcaacttcatctgaaccaaccagttttattgtcagttcaacctcagtttattcaaccagaccaagtggtccaactacttcaacagatctagctactttctctgacacaatcattctaagggtttcaaccacttcaaccagccaagatacccaaacagtatcatctagtctaactgatatggtttcctcaactggttcagctgatttgagcgtctcatccattcaaagatctcaagtagacccaagcactttcgctgtctcgaatagcccagtatatccaacagcttcgaccggatcaacttccacgggcattccaattgcgtcggaaagtctaagcctttctagacagcaaggaatttcggccacttcaagttcttcgattgtaactttaaccccagttgattcggcttcctcgagtaggtcaagcgcaacaagtataatcaagcctaatatgccagttagcagcaatgattcgaagacccaaagttctgtttctgtagttgacgcattccaatcaactaaatcttcatatcctagcataacttcagcagacccaacgactctagccagtgaaaatggtttagtcggctcatcttcctcagctcatccaatcacattagatagaacttatgcatcagctcacgcaagcgtcaccgatattgtcagtagagttactgactcgactcgccatacaacactagtaacttcaaacattaacattcagtctgaggttgggaacccaaattactcgggtcccaaagacactaccatcaccaaacaatctgcatttatgacttctcctgcatcaacgtctactataagtaacgttcaatcaactgcttccgtaatgaatcacagtattgaggacaatatttctgcagctgcctctctagaaagtgtttctggtacctcaactaaagattattctagtcaatccagtgccattcattatacaaattccttcacgaccaccactactaacgcatttatcacatcaaagcattccattgctgctgtatcaacaggagccattacatcatctgccagcatttcattaatcatggaaggcagcgcaaacattgaagcagtaggaaaattggtgtggctcgctgccgctcttcctctagctttcatttag

SEQ ID NO: 4574 - DNA, 2100 bp, Saccharomyces cerevisiae
atgacagctcagttacaaagtgaaagtacttctaaaattgttttggttacaggtggtgctggatacattggttcacacactgtggtagagctaattgagaatggatatgactgtgttgttgctgataacctgtcgaattcaacttatgattctgtagccaggttagaggtcttgaccaagcatcacattcccttctatgaggttgatttgtgtgaccgaaaaggtctggaaaaggttttcaaagaatataaaattgattcggtaattcactttgctggtttaaaggctgtaggtgaatctacacaaatcccgctgagatactatcacaataacattttgggaactgtcgttttattagagttaatgcaacaatacaacgtttccaaatttgttttttcatcttctgctactgtctatggtgatgctacgagattcccaaatatgattcctatcccagaagaatgtcccttagggcctactaatccgtatggtcatacgaaatacgccattgagaatatcttgaatgatctttacaatagcgacaaaaaaagttggaagtttgctatcttgcgttattttaacccaattggcgcacatccctctggattaatcggagaagatccgctaggtataccaaacaatttgttgccatatatggctcaagtagctgttggtaggcgcgagaagctttacatcttcggagacgattatgattccagagatggtaccccgatcagggattatatccacgtagttgatctagcaaaaggtcatattgcagccctgcaatacctagaggcctacaatgaaaatgaaggtttgtgtcgtgagtggaacttgggttccggtaaaggttctacagtttttgaagtttatcatgcattctgcaaagcttctggtattgatcttccatacaaagttacgggcagaagagcaggtgatgttttgaacttgacggctaaaccagatagggccaaacgcgaactgaaatggcagaccgagttgcaggttgaagactcctgcaaggatttatggaaatggactactgagaatccttttggttaccagttaaggggtgtcgaggccagattttccgctgaagatatgcgttatgacgcaagatttgtgactattggtgccggcaccagatttcaagccacgtttgccaatttgggcgccagcattgttgacctgaaagtgaacggacaatcagttgttcttggctatgaaaatgaggaagggtatttgaatcctgatagtgcttatataggcgccacgatcggcaggtatgctaatcgtatttcgaagggtaagtttagtttatgcaacaaagactatcagttaaccgttaataacggcgttaatgcgaatcatagtagtatcggttctttccacagaaaaagatttttgggacccatcattcaaaatccttcaaaggatgtttttaccgccgagtacatgctgatagataatgagaaggacaccgaatttccaggtgatctattggtaaccatacagtatactgtgaacgttgcccaaaaaagtttggaaatggtatataaaggtaaattgactgctggtgaagcgacgccaataaatttaacaaatcatagttatttcaatctgaacaagccatatggagacactattgagggtacggagattatggtgcgttcaaaaaaatctgttgatgtcgacaaaaacatgattcctacgggtaatatcgtcgatagagaaattgctacctttaactctacaaagccaacggtcttaggccccaaaaatccccagtttgattgttgttttgtggtggatgaaaatgctaagccaagtcaaatcaatactctaaacaatgaattgacgcttattgtcaaggcttttcatcccgattccaatattacattagaagttttaagtacagagccaacttatcaattttataccggtgatttcttgtctgctggttacgaagcaagacaaggttttgcaattgagcctggtagatacattgatgctatcaatcaagagaactggaaagattgtgtaaccttgaaaaacggtgaaacttacgggtccaagattgtctacagattttcctga

SEQ ID NO: 4575 - DNA, 2100 bp, Saccharomyces cerevisiae
atggataatgaagaagttaacgaagaatgtatgagattatttttcaagaacgctcgtgcgcatctggataaacatctaacatcaaggttgacatgcgatgaaaatgcatatatcacgttcagatgcttcctggatggaatacatcgcaaatctactaggtttctcgaagagctacttttgaaacaagaaaatatgtaccataataacaattacgaacgcataaatgattccgtgataccattggttctgaaacttttatggcttcaaattcacgaacctacactccaatggtttgagcactggttccatgatatcatgcgactaagtaacagaagaaagttcagagtttttagaatttttcaaaaaaaaatgattcaatttttcaaaattacacacaggtattactatgacatcatcgaacacctatgcgcaaagtacgatatgaattccgttatttcaaatgctctcttcgcgaagttgaatttaatgcaatacacagatggactttcaactcatgagaaaattatcttaaacacgagtaatccactgacgttttccattgtaatctcactacaaagatgcgtgattaatctaggttccacacatttttataaaacactactaaacaagccgtctaacaaacccaagagtgtggaaggttttgagaagtctattaggtacttgaatattgcctcactctatctcccagccgttggagatacttattttcaacgagcgaaaatttacttgatcactgggaaattctcactgtatttctttgaattagtaagaggagcattggtaaggattccgtctaaatgtgcgttaaacaatttgaaagatttcattttgactcctgattttccggaaagaagacgtctgatgaaaaaattggcaattcttgtgtcaaaagatctcaaaggtgagaaatcattctttgaaggtcaaattgttttgcaatttctatcgatagtagaacacactttggttccacagtcatggaacgcatcacgtgcttctaattgttggttattgaaagagcatttacaaatggctgcattaaagtatcattcaggtaatattaatgttatacttgaaaacttggctgccacaatgggaagtttcgatcttatgtttacaactcgaaaaagtaaggaacaaaagaacaaactcaaatatgcagatttgagtgagcgccaggttttttttttagacttgagctttgattttattgctaatatcatagacgtcgtcatcaaaccctcctggcaaaaaaacatggaagactttcgatatctagccattattcgtttgcttatgtgctggattaagtcatatagatctattttgcagtacactcacagacacaggaagttttgcacttcattcgccttgttgctgaacgacttgataaatagtccactgaattgttcaggaaatatatatagccacaggccgaaaagaagctatctttttagagaagatattattttcagggaattttcttgcattaactttgcactaacagattttaatgacgattatgtgtatgattctcccgacatgattaataatataattggatgccctacattgactaaagtgctttctccaaaagaagaatgtgttctgcgaattagatcaataatattttctggcatgaaatttttagagaaaaatgacaccggcgtcatatggaatgccagcaaatataagtttgatttaataagcccaaatattaaaataaaacgccaaatagcattatcggaaatttcctccaaaataaatgtaaaaacacaacaggaaagagtagtctcttcgagaaaagttgaggccaaaagagatgaacaacagcgcaaaagagccgggaaaatagctgtgacagaactggaaaaacaatttgcaaatgtccggagaacaaaaaaattgtctccgctcccagaaaaagatggcgtttcttctgagttggtaaaacatgctgcttcacgagggagaaaaactatcactggcccactatcctctgattttctctcatatccagacgaagcaattgatgctgatgaggacatcaccgtccaagtgccagatactcctacttga

SEQ ID NO: 4576 - DNA, 2100 bp, Saccharomyces cerevisiae
atggtcagattttttggtttaaacaagaaaaagaacgaagaaaaggaaaatacagacttgcctgcagacaatgaacaaaacgcagcagaaacgtcgtctagcaacgtatctggaaatgaagaaagaatagacccaaacagtcatgatacgaaccctgaaaatgcaaacaatgatgatgcgtctacgacttttggttcgtccatacaatcgtcatccatattttctagaggaagaatgacttacggaacgggagcctcttctagtatggccacatcagaaatgcgtagtcacagtagcggacatagtggatctaagaatagtaaaaatttacagggtttcaaagatgttgggaaaccattaagagcggtgagcttcttgagtcctgttaaggaggaggaatctcaggatacgcagaatactttagacgtcagctcttcaacgtcctcaacattagccacttcagaaaatgcgagagaaaacagtttcacttccagaagaagtatcactttggagtacattcacaaaagtttgtctgagctagaggaaaatttggttgatataatggatgatattcatcaggatgtcatcagtatttcaaaagcggttattgaagccatcgaatattttaaagaattcttaccgacaacacgagacaggataccgtacaggataagtttagaaaaatcgtcttcattacgaaaaattaataaaattgtattacattttctggataatttattggtttccgacgcattttcgaattctaggtcgatactgttacgaagattttacttcttcctgaagaaactaaaccttattacggatgacgatttgatatcagaatcgggcgttttaccatgcttatcagtcttttgtattggcagccattgcaacttaccaagtatggataaattaggcatgattctagatgagttgaccaaaatggattcttcaataatctctgaccaggaaggtgcttttatagcacctatacttagaggtataaccccaaagagttcaattcttacaataatgtttggcttacccaacttgcaacatgaacactatgaaatgataaaggttctttattcgttgttcccagatgtacacatgtattgtgtgaaagattacattaaaaaagctgcatcagcagtaggcagtattccgtctcataccgcagcaactatcgatacaatagccccaactaaatttcagttttcccccccatatgcagtttcagagaatccacttgaattgccaatttctatgtctttatccactgagacaagcgctaaaattacaggtactttagggggttatctattccctcagactggtagtgataaaaaattttctcaatttgcaagctgctcatttgccattacttgcgcccacgttgtattatctgagaagcaagattatccaaacgtcatggtaccttctaatgttttacagacttcttacaagaaagttttaacgaaagaatcagataggtatcctgatggttcggtggagaaaacagcatttttggaggaagtgcaaagaatagatcaaaacttgaactggcagaaatcaaacaaatttggtcaagtagtttggggcgagagagcaatcgtagatcacagattatcagattttgctattatcaaagttaattcatcattcaaatgtcagaataccctaggtaatggcttaaaatcattcccagatccaacattaagatttcaaaatttacatgtgaaacgaaaaatttttaaaatgaagcctgggatgaaagtatttaaaataggggcttctacgggatacacttcaggcgagttaaattctacaaaattagtttattgggccgacggaaagttacaaagtagcgagtttgtcgttgcatctccaactcctttatttgctagtgcgggggattcaggcgcatggatcttgaccaagttagaagatcgtctaggtttggggcttgttggtatgttgcattcatacgatggtgaacagaggcagtttggtttgttcacacctataggtgatatcctggagagactacatgctgtaactaaaattcaatgggacattgatccacaactagatggatga

SEQ ID NO: 4577 - DNA, 2100 bp, Saccharomyces cerevisiae
atgtcgttgtctagaatcctgcgatataatcagagaaataacaaaactacagcttccttgactgcagaacacgcctattccgataattgggcatattccgtctcgttaggcgatcccactagtgttggtgtgaatatggctgctaagacgggtgaggcgctaaataaatcatatgattccgttttttcttctctccctgttgcagatagtgtacctcggacagactttactgcatcttcccgggatgatgaaaacacggacgtgcaaaagctgaccacttcctggatggagaaaattgacacgaagatgcccgaaaacatatctaaaatcgactctaatattatttcctctcccatggtcagtaaggttgaagcaagatttattgttcctaaaggaagattgaggaaaaattctaccgattttacgtcatctttctcaaactcgttaagtttacccaaaagttatggcaaattaattttctttacatcaaagaaaaacagcagtagtaccaaaaaaaatctagcgaatgatatcagtgataacaagcataacaacaattcttctaatactatcggtcacaatattccagtcacgacagccacggcgacatgtgatgagattgcatgcacctccacagaacatgaatataatgtttatgaggaagagaggatgttcactactcgtgtatattctctagaagattcggtctcttcactgtccacgaatcctctcgacgacacgtattcagaagcagtgcaagtaaatacaagacatatcgaggacactgaaagcacggcccatataagaaaacactcctatactacgtcattgtcaagtatcaaaaggctcttcaaaataacgtcttttagcaataacaacagtaactcatgcgatcaccaggaaagcacagttgcagatgattgcgctatatcatcatcattgaaggaaacaacttcttcgccagtctcaactggatcattctctctcatgatcgagaatgaagacagcgatagagatcagattattcaggctttatatagtaatattgaagcatccactgacttggtttccaggaaatatagagatctcgacgttgttctcggcgaaggttctggtggtaaagtgaaactggtccaaagggtcctggataataaagtttttgcattaaaggaatacaggtcaaagaaaaaaagggaatctgagagaaaatacatcaagaacataatttctgaatattgtattgcctccacattgaagaacccaaatatttgtgaaacattggaaatactgtatgagaaaggtaaaattttccaaattctcgagtattgcgaatatgatttattttctttggttatgagtgaaaagatgcattacgaggaaatatgctgtctttttaaacagctgatcaacggcgtaaaatatttgcacgacatcggtctctctcatcgtgatttgaagctagacaactgcgttgtaacacgaaggggaatcttgaaattgattgattttggcgcttccagtgtcttccactatccattgtcttcacagatgattgaagcaaatggaattgttggtagcgacccctacttgtcacccgaagtcttttatttcaatgagtacgatccaagagcacttgacgtttggtccgtggggataatattcttttgtatgataacgagaagatttccttggaaatatcccaaagtgaaagatgttcaattcaaggcattttgttccggaagaggtgtgtcatcttttaaagatcttgtgacacggcctgctaccgatgacagcaataattatgataatgatggctacgaagaaggagtcattgatatgggtcccaatttcattctgcacagactaccagaagaaactcacaaaataatgaggcgtatactggaagtttcacctttcagaagaattaccataaacggaatattacaagatggctggatcaaagaaatagaaacgtgtcaagttgtgggcgcggcaagcccaaatgaggcatcgcttcgaataataaacaaaggtaatcacatacatacaaacatcgatcaacgatacgcccacattggcggcctgcatcagcgaacgtaa

SEQ ID NO: 4578 - DNA, 2103 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggtctaatcaaagtggtaaaattcagaactggtgcaatggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgttacgaaatagcgagtgccaggccgaacgacagctctacgatgcgtactttcactgactttgtttctggcacacctattgtaaggagtcttcagaaaagcaccataaggaaatatggatacaatttggcaccctacatgttcttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatgttttgcatgtgtgctgcccaagttgagaagagatactaacaaaatgaccgcggctctcaaaaataattgacgagcttacggtgatacgcttaccgttatccagagctacagcgcaacgtatacgtcgacgatacaacaagaacggttcatcggagcctcgactaaagacgcttgacggactcacttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccggaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcatctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgttgctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagcttgggtgctgcagaaaaggtgtctcgcacaaaggagtttgtcactga

SEQ ID NO: 4579 - DNA, 2103 bp, Saccharomyces cerevisiae
atgacggccgagcctgctactaagaagatcaagctagaattaagcgatcctagtgaaccgcttactcaatctgatgtgatagcgtttcaaaaagaagctttgtttagatgtataaatcgtcgaagagtcgactttgaagccttgcgaaagcaatatgaactttcaagaagggagtgcatagatgtttcccgcaagttggcaaatattatggcgctgatagtaactttagctaggtttatcgaaacattctgcacagacgccaacgagaagcaactatgtagggaaatagcccaaggcgatgagacgttgatagttcagcgcagtgattctttcatgaagctactgactaaatatgggaagccaaacacgacagatagtaatactaatagtaatgcttcggatcatattcaagaattaacaacggagttaaaaaacttgcggaaaagtaaagaggagctcttttatgaaaattcgcaattgacagaggagatttctgctttgaaggaatattatacaaatataattcgcaagtatgatagagatgaatcctttactataaaacgtgtttttaaggaagataagactgatgctgtaaaggaattacgggaagatgaaaaagaatctaatgaaaacaatataaaatctggaaataaagactcctctgcaattaatggtgataatacatccaaaaaatccgagaaaggtgatgaacttgtgcaggcggaggatgaacgaaaagaagatgctgagaatgaaaaattagaattggatctgaaattttctgatttacgggcagagataaactccttgagttccactataaaagaccttgaaaatatcagaagggaaaacgaggaagagctcatcaaaacacgttctgaggtatccaatttaaaaaagcaacagatagcagcagcagaccaagacccagatttcaagtcatatgaccatgagtccctgttagcaaaaattcaacatttgactgaacaaaacgcagaattatctgagatcaatagttcctttttatcaaaatttcaagttttagccaaagagaaagaaatatatacgaagaaggtccgagaagaattccagaaaagtctcgactccctagtagaaatgaacagttcattggaaaaggacgttgtaagaataagaacggctcgtgatgatttactaagcaaaatcgccattttggaagctgaaaaatccaagactgaagtgttgagcgatttacaacatgcaattgatattttgaaggagcaatggacaaaaattgatcaaagatcaaacgatacaaaatcctcgtcgactcaagatgcattaataaaggaaattcaagacttagagaagggttttagagagttatccgacttaactcataaaaagtactctgagattattaatcacgaatctgttatatccaagcttaccgtagaaaaaactaaggctgatcagaaatattttgccgcgatgaggtccaaagattcaattttaattgaaatcaaaactctttctaaaagcctcagtaaatcaaatgagcttattctacagttaaaggactctgatagattgctacagcaaaaaataggaaatttacataaacaactggatctttctcaaaataatgaacgcaggttaattgattccagtaaaacagagacactaaaaataattgatttaaataatacatccactaaactgaaaaggtcattagaaaagctacaagaagaaagtaacaaaagcattgcagatatgacgcatctagaaactaaattaaatgatacagaaatagaattgaagcacttcaagcagaaggcatctcatctagaatccaagtgtgaaaaactacatgatacattgttccgtggtaacaacaaaaataagggctcgagcgatgaagcactcgtagaagaactagcaaatttccgtacacttgtttattgttccctgtgttctaaaaattggaaaaacatggctattaaaacctgtggccatgtcttttgtgagaattgctgtaaggaacgattggcagcgagaatgagaaaatgccctacatgcaacaaagcattcagttccaatgatttattgacagtgcacttgtaa

SEQ ID NO: 4580 - DNA, 2103 bp, Saccharomyces cerevisiae
atggttgctcaatataccgttccagttgggaaagccgccaatgagcatgaaactgctccaagaagaaattatcaatgccgcgagaagccgctcgtcagaccgcctaacacaaagtgttccactgtttatgagtttgttctagagtgctttcagaagaacaaaaattcaaatgctatgggttggagggatgttaaggaaattcatgaagaatccaaatcggttatgaaaaaagttgatggcaaggagacttcagtggaaaagaaatggatgtattatgaactatcgcattatcattataattcatttgaccaattgaccgatatcatgcatgaaattggtcgtgggttggtgaaaataggattaaagcctaatgatgatgacaaattacatctttacgcagccacttctcacaagtggatgaagatgttcttaggagcgcagtctcaaggtattcctgtcgtcactgcctacgatactttgggagagaaagggctaattcattctttggtgcaaacggggtctaaggccatttttaccgataactctttattaccatccttgatcaaaccagtgcaagccgctcaagacgtaaaatacataattcatttcgattccatcagttctgaggacaggaggcaaagtggtaagatctatcaatctgctcatgatgccatcaacagaattaaagaagttagacctgatatcaagacctttagctttgacgacatcttgaagctaggtaaagaatcctgtaacgaaatcgatgttcatccacctggcaaggatgatctttgttgcatcatgtatacgtctggttctacaggtgagccaaagggtgttgtcttgaaacattcaaatgttgtcgcaggtgttggtggtgcaagtttgaatgttttgaagtttgtgggcaataccgaccgtgttatctgttttttgccactagctcatatttttgaattggttttcgaactattgtccttttattggggggcctgcattggttatgccaccgtaaaaactttaactagcagctctgtgagaaattgtcaaggtgatttgcaagaattcaagcccacaatcatggttggtgtcgccgctgtttgggaaacagtgagaaaagggatcttaaaccaaattgataatttgcccttcctcaccaagaaaatcttctggaccgcgtataataccaagttgaacatgcaacgtctccacatccctggtggcggcgccttaggaaacttggttttcaaaaaaatcagaactgccacaggtggccaattaagatatttgttaaacggtggttctccaatcagtcgggatgctcaggaattcatcacaaatttaatctgccctatgcttattggttacggtttaaccgagacatgcgctagtaccaccatcttggatcctgctaattttgaactcggcgtcgctggtgacctaacaggttgtgttaccgtcaaactagttgatgttgaagaattaggttattttgctaaaaacaaccaaggtgaagtttggatcacaggtgccaatgtcacgcctgaatattataagaatgaggaagaaacttctcaagctttaacaagcgatggttggttcaagaccggtgacatcggtgaatgggaagcaaatggccatttgaaaataattgacaggaagaaaaacttggtcaaaacaatgaacggtgaatatatcgcactcgagaaattagagtccgtttacagatctaacgaatatgttgctaacatttgtgtttatgccgaccaatctaagactaagccagttggtattattgtaccaaatcatgctccattaacgaagcttgctaaaaagttgggaattatggaacaaaaagacagttcaattaatatcgaaaattatttggaggatgcaaaattgattaaagctgtttattctgatcttttgaagacaggtaaagaccaaggtttggttggcattgaattactagcaggcatagtgttctttgacggcgaatggactccacaaaacggttttgttacgtccgctcagaaattgaaaagaaaagacattttgaatgctgtcaaagataaagttgacgccgtttatagttcgtcttaa

SEQ ID NO: 4581 - DNA, 2103 bp, Saccharomyces cerevisiae
atgtccgatcaaaaagtttttgccagatataaagcaaatgaaatcgtcacagatctgcaacattttggagtaaaaaagtttaaatcgaatataacaagaaggaaaaatgctctgagaaaaattatcgccaatttggttctaggaaactatggcgaaatgtccgttctgttttctgagctcttgaaattttggcaaattgaagatgatctagaagtgaaaagaatttgccatgagtatattagggtgatcggcgcattaaaacctcagcaggccagagaggctttgccatttataatggacgatttcaaaagcagagatgaaaagttacaaataatggcactaagaactctggtattagtcccggtgaaagagctatctgatcaggccttcgactgtatcatttcattggtaaatcacaagtctccacctgaacaagtgacgaggacagcaatttacgcactgttggatttagatgaaattgatcatgaaagggtattggggttatcaagcattctacatgacattgtaaaagcacagtcgagctctccagaagtcattgtagctgcattacatactttatattccattcacgaaaaaaacgctaacatggaacccttcaggattcccttggaactcgcttttgacatgctagagcttttacccgaattaaatgagtggaataaggctactgttttggaagttttgacgacttcggttgtgccgcagcattatttggatacccatgaaatgatcgaactagctttaccgtacctgcaacaagtaaacacatacgtagtgttgaactctttaaaattcatcatgtacttgttgaattatgttgacgtcatcaaagaaactctagccgaaaagctatctaactctgtaatagctttgttagataagccgcctgaattacaatttttagtattaagaaacgttattcttcttttattgagtagggagtcatctctactcaggctagacatttcgtattttttcatcgagtacaatgaccccatatacatcaaagacacgaaattagagtgtttatatcttttagctaacaaggaaacattaccaagaattctagaagagttggaacaatatgctacagatattgatattcaaatgtcaaggaaatcagtcagagccattggtaatctggctgttaagctagatgaagactctgtacacgattgtgtcgctgttctactagatttgttagaattcggtgttgattatgtcgtccaggagattatttcggttttcagaaatattttgaggaaatatcccaataattttaaagcaaacgtaacagaactagtcaaacacactgaagttgtacaggaacctgaatcaaaaaacgctatgatctggataataacgcaatattcggatgtaattccaaactacctggagttatttagagttttttcctcaaacatgtttagtgagacgctagaagtgcaattttccattctgaactcagcaataaaattcttcatcagaagtcctacaaaggaaactgaagaactttgtatggatttattaaaaggatgcatcgatcacgaaaataatcctgacttaagagataaaacactgatgtattggagattgctgtcattaacgaaaacgtctcgtatatcaaacgcgataacttttgaatctttaaaatcagtactggacggagagttgccactaatagaaatgaacacgaaattagatcccaccgttttggaggaattggagctaaacattggtacaatagtatcgatttacttaaaacctgtttctcatatctttagattgaataaaaccaaactgctaccacaaagtcctattttgaatccaaacaaagacctcttgccagttgtaggtaactcatttcctccaactggagctaatagggaccgtcaaaattcagaaagccagtcctcgacgaagtccagaaagactgctatgatggatgattatgataagcccgctgaaaaaattaatcagttgaaaggtaagcgtaaatctagttcaaacaacccctcaaaactatcacggaaaccctcaactttattaagaaaactctctatgaaacggcccttttcgtga

SEQ ID NO: 4582 - DNA, 2106 bp, Saccharomyces cerevisiae
atgaaaatgaatctgaaaaggctcgtagttaccttcttctcatgcatcacctttctgctgaaattcactatagccgccgctgaaccaccagagggctttccagagcccttaaatccaacaaacttcaaagaagagctatctaaggggctgcatattattgacttctatagtccatactgtccgcactgcaaacatttagcacctgtttggatggaaacatgggaggagtttaaagaggagagcaaaacactgaacataacattttcacaggttaactgcatcgagagcgccgatttgtgtggagatgaaaatattgaatacttccctgaaattagactttataacccctcaggatacatcaaatcgttcactgaaacaccgaggaccaaagaatcattaattgcatttgcacgcagggagtctatggacccaaataacctcgatactgatctggattctgctaaaagtgagagccagtatctcgaaggctttgattttctcgagctgatcgctggtaaggcgactaggccacatttggtttccttctggccaacaaaagatatgaaaaatagcgatgattcactagaattcaaaaactgtgacaaatgccatgaattccaaaggacttggaagatcatttcaagacagttagccgtggatgatatcaacacgggccacgttaattgcgaatctaatccaacaatctgtgaagaactgggctttggcgacttggtgaaaataaccaaccacagagccgatagagaacccaaggtagcattagtcctacccaataaaacctcaaataatttgttcgactatcccaatggctactcagcgaagtcagatggctatgtagattttgccaggaggacttttacaaacagtaaatttcccaatataacagaaggggagctcgaaaaaaaagcaaacagagacattgattttctgcaagaaaggggacgagtaactaataatgatatccatttagttttttcatatgaccccgaaactgttgttattgaagattttgacattttggagtatttaatcgagcctttgtcaaaaattccaaacatatatttgcaccaaattgacaagaatctaataaatttgtcacgtaatctttttggaagaatgtatgaaaagatcaactacgacgccagccaaactcaaaaggtttttaacaaagaatactttactatgaatacggttacgcaactcccaacttttttcatgtttaaagatggtgatcccatatcctatgttttccccggatactccacaacagaaatgagaaatattgatgccattatggattgggtaaaaaagtattctaatcccttagttaccgaagttgactcttctaatttgaaaaaattaatttccttccaaaccaagagctacagtgatttagcaattcagttaataagtagcactgaccacaaacatatcaaaggaagcaacaagcttattaaaaacttgctcctcgcaagttgggagtatgaacatattcggatggaaaataacttcgaagaaattaatgagagaagggcaaggaaagcagacgggatcaagaaaataaaggaaaaaaaggctccggctaacaaaattgttgataaaatgcgtgaagagattccccatatggatcaaaaaaaattgttattaggatatttagatatttcaaaggagaagaatttttttagaaaatatggtattactggagaatataaaattggtgatgtgattatcattgataaatcaaataattactactacaataaagataattttggcaactccttgacttctaacaaccctcaattgctgagagaagcattcgtgtccttaaatattccatcaaaagctctatacagctctaagttgaaggggagattgataaattctccattccataatgtcctcagtttcctagacataatccacgggaacggcatgcccggttacttaattgttattgttttgtttatcgcaatactcaaaggtccatctatttacagaagatacaaagtaaggaaacactatagggcgaaaaggaacgctgtcggtatcctaggaaatatggagaaaaaaaaaaatcaagattaa

SEQ ID NO: 4583 - DNA, 2106 bp, Saccharomyces cerevisiae
atgaacggtattgatgatctcctaaatattaacgacagaattaagcaagtgcaaaatgagagaaacgaactggcatcaaaactgcaaaatctaaagcaatcattggccagcaatgacacagaagtagcattatcagaggtgatagcacaagatattattgaagtaggggctagtgttgaggggcttgaacaattaagggcaaaatatggtgatctgcaaatcttgaataaattggaaaaggtagctgtacaacaaacacaaatgcaagctggcgtagacaaactagatagttttgaacgtcagttagatgagttagctgaacaaccgccggatcaattcactctagatgacgtaaaggcgctacactcaaagttgacgagtgtcttcgctacagttcctcaaatcaataatatagattctcagtatgctgcttataacaaacttaaatcaaaggttaccggcaaatataatgacgttattatacagaggttagctactaactggagtaatacgtttgatcagaaattgttagaagcgcaatgggatacgcaaaaatttgcatccacatcagttggtttggttaaatgtctgagagaaaattccaccaaactttatcaattaagtctgctctacttacctttggaggaggaaacacagaatggagatagcgaacgcccactttcacgctcaaacaataaccaagaacctgtgctatggaattttaaatcactagcaaacaatttcaacgttaggtttacgtaccattttcacgccacatcgtcatcctctaagattgagacgtattttcagtttctaaacgattatctagcggaaaacctatacaagtgcatcaacatttttcatgatgactgtaatgggttgacgaagccagttattcatgaacaatttattaattacgtcttacaacccattagggataaagtaagatccaccctatttcaaaacgatttgaaaactttgatcgtcctaatttcccaaatcctggctacagacaaaaatttattgaattcttttcattaccatgggctaggtttggtgtcgttaatttccgatgaagtatgggagaaatggatcaactatgaagttgaaatggccaataggcaattcatcaatataactaaaaatccggaagatttcccaaaatcttctcagaattttgtcaaattaatcaataaaatttacgattatttggaaccgttctacgatttggattttgatctattagtaagatacaaactaatgacttgttcattaatttttatgaacttgacttcatcctacttggattacattttaactgtcgattcattgaatgaaacaagaactaaagagcaggaattgtatcaaactatggcaaaactgcaacatgtcaactttgtgtacagaaaaatcaaatctttgtcttcaaacttcatttttattcaactgaccgatattgttaacagcacagaatctaaaaaatacaattcactgtttcaaaatgtggagaatgactatgaaaaagctatgagtacggatatgcaaaactccattgtacacaggattcaaaaactgttgaaggaaaccctacgaaattacttcaagatttcaacttggtcaacattagagatgtctgtcgacgaaaatatcgggccgtcgtccgtaccaagcgctgagttggtcaattcaattaatgttttgagaagattgatcaacaaattggattcaatggatatcccactagctatttcattaaaggttaagaacgaattgttaaatgttattgttaactattttacggagtcaattctaaagttgaacaaatttaatcaaaacggtttaaatcagtttttacatgattttaaatctttaagcagcattttgagcttaccgtcacatgctaccaattataaatgtatgagtttacacgaactagtaaaaatattaaagctaaagtatgatccaaacaatcagcagtttttaaacccagaatacattaaaacaggtaatttcacatcattgaaagaagcttattccattaagtacttgaaggacacgaagattcaagatgcactctataggattatatatggtaacatattatag

SEQ ID NO: 4584 - DNA, 2106 bp, Saccharomyces cerevisiae
atgcatgctacaaactggttcgacgattggaacccagaagctctttatagagacgatgtcactggctgcgatgactgttccgaaacttcgccaattccaaagtctggtattatatgtggaccgatattaagactcatcaacatggattttaaggaaaaaacctacgaggggtctattatggtggtagttagaggcgaggaaaactttccgaaaattacctatcagctagggccctctttgccctctgaggatgaagacatcgaagttaacgaggcattcttcgaaggtaaactttttcataaggacattttaaaagatgataatatatggttttacaggtatgagattaagttgcccatgtccaactatgagcagatggtaaaatatgctgttgacggtactatggaaccacattataggttcttcgttccctctttcactcaaaattcgaacgttatctcctattcatgcaacggattttcactgagcgtagatacatcgaaattcaaaggttctctatggtatgatgtccttaaaaagcatcgatacgttcattatcatgccattctcggcggcggagatcaaatttactccgataatattaaactgcatgcgccaaatcttaaagcttggctggagacaaaggacccaattaagaagtataatactcagaccactgaagaaacaaaagagcagattaggcagttttatttagaacactatttaaactggtacggttacggtcactggtatggttctaccccaaaatccaagaccacccaaaaatgctttgtcaagtcactagcttgtattcctgccattaatgtctgggatgaccacgatattattgatggctatggatcgtacaacgattccttcatgaagactgaaaatttcctcacagtgggaagaatggcttaccgatactatatgcttttccagcagcatgtcagtgcttctaaacaagatggcgatgagtatgcttatctcaagagcaaacaatggattctaggtaatgaaaaagggagttcttatatcggtgaaaggtctcactcaatattctcttggttgggtccgaaaatggccatgttagggttggactgtagaactgagaggaaattacacgagattttctcagaaagaagttattccttaatttgggaacgtgtcgaaagggaaataaaaaatttaaaaggtggccacttattgctgatgctcggtatcccgattgcatatccaaggttagtatggttagaatggctttttacctcaaaactactggctccaattaaatatttatctaaaaaagggatatttgctagtggcttcgttaacgaatttaatggagatgtagaactgttggatgatttaaatgatcattggtgcgcgagacatcataaaaaagaaagaaactacttgataatgaaattgcaagacataggtgctaaatatggcgtcagaataaccatattatcaggcgatgtacatttggcatctgttgggagatttagggcaaaaattcatagacaccatctcatcatgtctgaggagaaggaaaaggaaaacaccagaattattgaagaaccaacgaaagacgtaaggctgatttttaatatcattgctagcgccatagtaaataccccaccgccagatgcaatggccacgctattgcaaaaaagatgtcgcttgcatcatttcgatttggaaacggatgaagatgccgtaccaatttttgccaaggaagtggatggagtacataaacgtaaagaatcatgtttcatgaacaagagaaactggtcagatattatacctatagaaaacctgttgaataatccccaattgagtaaagaattaggcgtaaaggttggtgatatagtcattcctggtatcatcacagaacagcaaaagctacagaaattggaaaacgatgaccaaattaactcttatccagtaacttctggtggcttgtttaccaccattcatgttgaaagagatgcaaatcaaacaaactcacaaactgtgagctactgtttacccattccagagttaacagttacctgcgaacggttgtctcacaagggtatcaaacatctgaatatcacatag

SEQ ID NO: 4585 - DNA, 2106 bp, Saccharomyces cerevisiae
atggatggatcccattttcctatgaaatctactaccggagagcccgtttcaagtggtaagaagggcaagaggaggaaggtcatcaagtcatgtgcattttgtagaaaaagaaaactgaaatgcagtcaggccaggcctatgtgtcagcaatgtgtaattagaaaactaccgcaatgcgtttacacagaagagttcaactatcccttgtctaatacggaactgttcgagcaagtgcccaatgtagcgttggttcagaagattgagaatttgcagactctactgaaggaaaacgataacaataatgcgaaaccggtgtattgcaggagttcagaaaatccattacggtcactgagaacttcggttttaggtgataatggctcgaggtatgtgtttggccccacttcctggaaaactttatctttgtttgaacaaaataagtttcaaactgagtttcaaaatttatggaaagtcttgaaaccacttcctgaatgcactaaatcgcaattaaatgaaaatgatgttgtagcagatttgcctagttttcctcaaatggaaagctgtattaaatctttttttgctggaccgctgttcggcatattgcatatcttcaaccaagacgatattctgtccctcttggacagactttttattagagataccacggacaagaacctagtcatcctcctcgatttgcaaggtaatgcaaaagataagtataatcttggcattgtacttcaaattctttgcttgggctattataaccaagatatcccttcttccgtgagtcatttccttcacactttaagtgcagcgtccttgtcatcatcgagctcaaatttcgtggaaaaactacaatttttcttattgtcctatattagtgtaatgataaattgcacggacggtgtatgggatgcgactcaaggcgttgacttaatcaacgagctatgccaggggtgcataagtttgggtttaaatgatattgataaatggtatttgaacgaaagtgaggaaaccaaacaaaacttgaggtgtatttggttttgggctttattccttgatgtatccacctcatatgatataggtaatcctccgtctatttcagatgatcttttggacttaagtatatttactgcgcagaatttccaatcaccgagtattgactttaggagagttaagctaatgcacgattttttagatgtttcccgattcactactcgtgaaattcacaagagagagatgaacgaaaaattgaccactttttcattgagattgattgaatttatacaatctaacttttcacctatcgaacattatacaaattcagtttactactctgatattgatccctttgatatattgattttatcaagatctctaagtatagttgctagtatatacaatattgagatgatcatcgctcaacaaagcagaatcatagataagaacagaatggttcagttcttgttgatatccatatcagtctgtgttaatacaatggtatttcattttaaagagcctatcaacgaccaggagaacgtgttaactgaagggctaaaactgtctattattctaatcaatccacttttaatacgaatagtatcgcaagtgtacagtttagcatttaataggttaatcttcagggagaaggcattccttttccttattgaccttgacactgggaaaaaaatacaattcattaaatatgaagaagaaaactttgatgaacttttgacaggattcgatgttaggactgataaatttctgtcattttcaggaacaataataagattttacgaaattattgatagcatatttgctgttaatgaaagaaataagcgattgttaaaagcagtttccaatttttatcagttaacttcaactttggcgtttgaacgcgtaagtagggttttattcgataaagcgtcccaagcaagaatagagactgaaaaaatttggctgaaaaagggcattaatatggagcacttcagtgatctcatgattgaagattttattaatgatgtttggaaaacgttcaaagagatttccaaagacctttggtccattgacaaaaagaaattttataaacaatatcatttcgatttataa

SEQ ID NO: 4586 - DNA, 2109 bp, Saccharomyces cerevisiae
atgcctagacatggaagaagaggaaaactgccaaaaggcgagaaacttcctaaaaaggagggaggcgacaatactccgtcaaagcttttatcgtcaatgcttaaaactttagatttgaccttcgagcgtgatattggaatgctcaatggcaaaagtgttaggtccatacccaataaaaaaactttacttgaattgcaaagtcaattggatagtctcaatgaaatactgggtacaattgcccgaggtgatcaagagaccattgaagcgcttcggaaaataagagacagtaaaaatgagaagcaagcaaacgatgaaaagcaggaaacttcaaatgcagacgggcagcacgaaagttctactgctactgaagaaacgaatataattgataaaggggtacaaagcccaccaaaacctcctccttctaatgaaatctccggcacaattgagaacgatgtagaaagcatcaaacaagcggctgataatatggctaaagaagaaattaatgaagacaaagatttacaagttcatagagatcaacccagagaaaagaggccgttcgattctgaaactgaaaatagggccactgaaaatgaaaacacacagaggccagacaataagaagcaaaaaattgacgttgacaaaatggaaaacgatccaactgttaaaaatccaaaatcagaatttgtagtatcgcaaacgttacctcgagcagcagcagcactcggcttattcaatgaagagggactagaaagtacaggagaagacttcctaaaaaaaaaatacaatgtagctagttatccaacaaatgatttgaaagatctgttaccaggtgaattaccggatatggacttttcgcatcctaaaccaaccaaccaaattcaattcaatacctttctagcatttgtggaaaattttttcaaagatcttagtgatgacaacttaaagtttttgaagatgaaatatattatacccgatagcttgcaatttgacaaaacttatgaccctgaggtaaacccgtttattataccgaaactaggccctttatacacagatgtttggttcaaagatgaaaacgacaaaaattctgcctataaaaaaccttcaccatattcaaacgatgcatctactatactaccaaaaaaaagtgccaacgaacttgatgataatgctttggaatcgggcagtatatcgtgtgggcccttattatctaggctgttgagtgctgtattaaaagatgacaatgacaaatcagaattgcaatcttctaaaataatacgggatggcggactaccgagaaccggaggggaagacgatatacaatcgtttagaaacaacaacaatgatactgtagacatgacattatctcaggagaacgggcccagtgttcaaacacctgacaatgacattgatgaggaagcatctttccaagcaaaactggcagaaaataaaggcagtaatggcggtactacaagtacgttaccccaacaaattgggtggataacaaatggaattaacctggactatccaacattcgaagaacgattgaaaagagaactaaagtatgtagggatatacatgaatttgcctaaggatgagaacaaccctaactcagatgaccccgattgggtcaccggtagagaagacgacgaaataagcgcagagttaagagaattgcaaggcactttaaaacaagtgaccaagaaaaaccaaaagaggaaagcccaattgattccactagtggaaagacaactagcatggcaggaatactcatctattttagaagatttagacaaacaaatcgaccaggcttatgtcaaacgtattcgcgtacccaagaaaagaaagaagcatcatacagcagcttcaaataatgtgaacacaggaaccacgtctcaaatagcacaacaaaaggctgcaaactcaagtttaaaatcccttctggataaaaggcaaaggtggattaataagattggtccattgtttgataaacctgaaattatgaagagaatccccaatgaaagcgtattcaaggacatggaccaagaagaagatgaggatgaagccgatgtatttgcacaaaacactaataaggacgtggaactaaattaa

SEQ ID NO: 4587 - DNA, 2109 bp, Saccharomyces cerevisiae
atgggtatccaaggtcttcttcctcagttaaagcccatacagaatccagtatcactacgtaggtatgaaggagaagtgttagccattgatggctatgcatggctacatagagcagcctgctcttgtgcttatgaacttgcaatgggaaaaccaactgataagtacctgcagtttttcataaaaagatttagtttattgaaaacctttaaagttgaaccgtatttggtcttcgatggtgatgccattccagttaaaaagtctactgaatctaaaagaagggataagagaaaagaaaacaaagccatagctgaaagactgtgggcctgtggcgaaaagaaaaatgctatggactattttcaaaaatgtgtcgacataacgcctgaaatggcaaaatgtatcatatgctactgtaagctaaacggtattcggtacatagtggctccgtttgaggctgactctcaaatggtatatttagaacagaaaaacattgtgcaaggaataatatccgaagattctgacctcctcgtcttcggatgtcgacgtctcattacgaagctgaatgattatggagaatgtttagaaatatgtcgcgataattttattaaactgcctaaaaagtttccgttgggatccttaactaatgaagaaatcataacaatggtttgtttatccggttgtgactatacaaatggaattcccaaggttggcctgattaccgcaatgaaattagttagaagattcaatactattgaaaggataattctgagtatacagcgggagggaaaactgatgataccagacacatacattaatgaatatgaagctgcagttttagcatttcaattccaaagggtattttgccctattcggaagaaaatagtgagcttgaatgaaattccgctgtacttgaaagataccgaaagtaaaagaaaaagactctacgcgtgcattggttttgtcatacacagagaaactcagaaaaagcaaattgttcatttcgacgacgatatagatcaccacttgcatttaaaaattgctcaaggtgacttgaatccatatgattttcaccaacctctagccaacagagagcacaaattacagctggcatccaagtcaaatatagagttcgggaaaactaatactactaattctgaagccaaagtcaaaccaatagaatcgttcttccaaaaaatgacaaaattggatcataacccaaaagttgcaaataacatccatagtctaagacaagcggaagacaaactgacaatggcaattaagcgtaggaaattaagtaatgccaatgtagtccaagaaacgttgaaggatacaagaagcaaattttttaataaaccctccatgactgttgtggaaaacttcaaagaaaaaggcgacagcatacaggattttaaagaggacacaaactcacaatctttggaagagcctgtttccgagtctcaactatctacacaaatacctagttcttttattacaaccaatttagaggatgacgacaacctgagtgaagaggtttctgaagttgtcagtgacattgaagaggaccgaaagaattctgaaggaaagactatcggtaacgaaatctataatacagatgatgacggtgatggcgatactagcgaggattatagcgaaactgcggaatcaagagttcccacgagcagcaccacctcatttcccgggtcatcccagaggagtatatcggggtgcacaaaagttttacaaaagtttagatattcatcttcattcagcggagttaatgcaaatagacaaccactatttcctcggcacgttaatcaaaaaagtagaggaatggtatacgtcaatcaaaatagagatgatgattgcgacgataacgatggtaaaaatcaaatcacgcaaaggccatcactgcgaaaaagccttattggtgccaggtcacagagaattgtgattgacatgaaaagcgtagatgaacgaaaatcattcaattcatcaccaattttgcatgaggaaagtaagaaaagggacatcgaaactactaagtcaagccaagctcggccggcagtcagatctatctccttgctttcccaatttgtttataaaggtaaataa

SEQ ID NO: 4588 - DNA, 2109 bp, Saccharomyces cerevisiae
atggtgagcatgttctcattatttctgctattaattgagcaatcgccgcttgtagcgtcattgcaacaaagtcaacggcatatagtgggtgttccctgggaaaagcagcacttgtatgactcgaatgaaccagatttgactaaatggcactgtttgaaccacgaagatatcgtattggatataagccagattaatgatggggtttgtgattgtcctgatggttcagatgagcccggcagcgccgcctgcgtggaagatatattcaaaagcgttgcagagggaggtggtaaagtgaataagtatttttattgtgataacaaggggtttattccaagatatatacgaaaatcggaagtcgcagatggtatttgtgactgctgtgactgttctgacgagctactttctggatatgagctctttgatgctggatctaattgttctcagttaaaaaacgaatttgacattatggcctctaaagagttatcaagttaccgggaaggtaaagaggccctagaagaactggaaagaaaatacggtacaaaggaagaggctatcacccgtggtaattgcttagaagaagataaggaaaaagcttctgccgagataaaagtactctccaacaggctctcagaaaatcgagccaaattagagcagttgagaggcgagtactttaaccaattaagccatgatcccattttgtatcaatttgaacaattaaacagtactcgtttgggatcggacatccttacatcgttcactatggtttcaagagtaagtaaaggttaccaggacatattcaagattttaagtgatttatcagaggcctatactccctcgctaaatgataaagttgtcaatgataatattaaaaaattcagaaaagttagaagacgggctgaaaaggctaaaattaatgcagatagcaaaattgatgatgagcaggcagataatctttacttgtactttacagaagaagtacctcaaatttttttgaaaagagaatctgagaacacgttgaggtacgtcataggaaaatccaattttgttcaagcgctagtggagggtaaaattaactataccaacgatatcttggagtatatcagagaattccgtttgattatggatgatatttctcagaattacaatgttaactttcaagatgcaggggtcaaaagtgctgtcgattcgtataaaaactacctaggtgaatacggcgaactggctgaattagaaccagctcacccgtcagagagccttttgagatcgttgagcgaagtaacatcatttgtgaacgagaatgcaccaaaggtattgccaccagacgctgttgagtcagaacaagatacgaacagcgatcatatcggtacttctggagatttgcgcaataaactcaaagagattctatctaagctgaatattttttcatctagaaaagatttggtctcattagagaagagattccgctcttgtgaaagtcaagtcagtctcctggagaatgaattaaagcaaaaaatggactataagaaattattagatgaaactgaagatgaaggaactaattctactgcaggaaatctgactgagcttttagaactaatgggatcacaatcctattgtcttgacgacatactggacaactatgtgtacactatatgctttcaacgtccaatgaccgaaggtgtcatatatcaagctgaggataaggttgacggtaaaaaagttttgatcggtcgttttaagacatcaggttttaatgttgacttaaacatggaaaaatacgcagaacatttaaaggccacatatgatgagaagagtgatttgatttcaaacttagcagctatacaggacgatgacggtaacatgcaacattacgtattcgggaacttaaacgaactgaataatggtctggtactagaatacgaaaatggagaccagtgctggaatggtccgcgcagatcggctactgtatttgttcggtgcagcgacaaattcaagattcggagtgtacatgaagcgactaagtgcaactacatcttcgatgtcgttggtcctctaggctgcaacaagactttcgaatacgagccccctaagttcaatttaagtgaatga

SEQ ID NO: 4589 - DNA, 2112 bp, Saccharomyces cerevisiae
atgcttcccattaaagtcttctctttatctcggatttttgttttgctagcaatcttccgacaaatacacgctatttccattaacagctctactttccaggtttctaactcttttacactactgaacaacgcatcgactctattcccagtaccatttgatgcatatactaaagaatatctaaggacttcggctctgttgacttgtgctaaagactcacagttttctgcatcgtatttcgaagctgcttttttcccgagaaataatactctattctttaatgttgaagcacaaacaattatgagcgaaaacataaccatcaaggcagaattgattgcatatggtctcaatgtttataccaaagtttttgatctatgtggaatccaagataatttattatgtccgttgaagccgggaaatatagaactcatgggaagttattatgttgaggccgcggtagctagccaaataccaagcataacatataatatacctgacttagacgcatatattgtggtgacagcatactccactattgataaagaatttaccaaacctctagcatgtgtacaagtgatgttatcaaatggtagaacagtccaaacagagtatttatcgtggaatctagtgatattgacaatttccggaattatgttttcagtggtttattctttgcaaggttatacggttacttcaacaagactggcgtcttattcaatatcgctacttttatatttccaaaatttggctattttagctatgattagtgtatcatttttaccgcctattgtcgccgcttggactcaaaatttccaatggtcaatgggaataataaggataaattttatgcagcggttatttgactggtatgttgtcgcaacatctgggtcccccaccgttgtataccgcaataaagaagttttatcgatcagtgttcaaaaaagatccttgaacagtaaaatcatatcagcgtcaagtaatttaaatggtattgaaagttcccaaaaaaatgatttattatacacttcaaatttgagaaattcaaatgactatctgtcaaaaattttagtattaagaggtattaaaagggtgtcttacaaagctggaattgagatatcaaatttctttttaacgggattttccttctttatcatattcatttgtatgataatattggcgtttattatcttcaaaacatttttgaaagtacttcagaagtttaaagttaagacaattagatatttacacttccacacacattggagtgcacttttacaggggacactatatcgagcggtgttcataatttattctgagatatctcttttagcactttgggagttcactcaaacagactcagcagctaccttagtggaggcaatcgttgttttcattttgattacagtcttgttatcatccgcaagcgtaagaatatggaggaagatgatcaagtctaagaaaatatttggccagccaagctatttactcttcagtagctcgaaattcttaaacaagttcggctttctttcctctcaatttaagtctacaaaagtctggtggttaatggcgacctctgcacacatgcttattaggtctatactagtgggttctctacaagcgcacggaaaatctcaatctattggtatctttttgaatgaagctatctatctcatccttttgtgctggatgcaaccttacatggataaaacaaccaacttcttcaatattagtatccattcactgaatttagtgaacgcattttttttcttatttttcagtaacttatttcagcagcccatagctgtgtcttcttttatgggactaattttcttttttctaaatgcagcgttttctttgtatctcttcattttcatattgatatgctttacgatggcaatatactacaaacaccctgatacaagatacaaacctattgatgatcaaagacgatcctttttgaagggtgaaatggatgatgatgcggtttacgaatcggtcccggaactgcacgaaatgaagaaagccgttcttgaatgcaacggtattcaaaagccgcagatcaataagattgacctttgtaaacaaaattcgaactgtgaatatctgtatatgtga

SEQ ID NO: 4590 - DNA, 2115 bp, Saccharomyces cerevisiae
atgacggtcgaccatgatttcaatagcgaagatattttattccccatagaaagcatgagtagtatacaatacgtggagaataataacccaaataatattaacaacgatgttatcccgtattctctagatatcaaaaacactgtcttagatagtgcggatctcaatgacattcaaaatcaagaaacttcactgaatttggggcttcctccactatctttcgactctccactgcccgtaacggaaacgataccatccactaccgataacagcttgcatttgaaagctgatagcaacaaaaatcgcgatgcaagaactattgaaaatgatagtgaaattaagagtactaataatgctagtggctctggggcaaatcaatacacaactcttacttcaccttatcctatgaacgacattttgtacaacatgaacaatccgttacaatcaccgtcaccttcatcggtacctcaaaatccgactataaatcctcccataaatacagcaagtaacgaaactaatttatcgcctcaaacttcaaatggtaatgaaactcttatatctcctcgagcccaacaacatacgtccattaaagataatcgtctgtccttacctaatggtgctaattcgaatcttttcattgacactaacccaaacaatttgaacgaaaaactaagaaatcaattgaactcagatacaaattcatattctaactccatttctaattcaaactccaattctacgggtaatttaaattccagttattttaattcactgaacatagactccatgctagatgattacgtttctagtgatctcttattgaatgatgatgatgatgacactaatttatcacgccgaagatttagcgacgttataacaaaccaatttccgtcaatgacaaattcgaggaattctatttctcactctttggacctttggaaccatccgaaaattaatccaagcaatagaaatacaaatctcaatatcactactaattctacctcaagttccaatgcaagtccgaataccactactatgaacgcaaatgcagactcaaatattgctggcaacccgaaaaacaatgacgctaccatagacaatgagttgacacagattcttaacgaatataatatgaacttcaacgataatttgggcacatccacttctggcaagaacaaatctgcttgcccaagttcttttgatgccaatgctatgacaaagataaatccaagtcagcaattacagcaacagctaaaccgagttcaacacaagcagctcacctcgtcacataataacagtagcactaacatgaaatccttcaacagcgatctttattcaagaaggcaaagagcttctttacccataatcgatgattcactaagctacgacctggttaataagcaggatgaagaccccaagaacgatatgctgccgaattcaaatttgagttcatctcaacaatttatcaaaccgtctatgattctttcagacaatgcgtccgttattgcgaaagtggcgactacaggcttgagtaatgatatgccatttttgacagaggaaggtgaacaaaatgctaattctactccaaatttcgatctttccatcactcaaatgaatatggctccattatcgcctgcatcatcatcctccacgtctcttgcaacaaatcatttctatcaccatttcccacagcagggtcaccataccatgaactctaaaatcggttcttcccttcggaggcggaagtctgctgtgcctttgatgggtacggtgccgcttacaaatcaacaaaataatataagcagtagtagtgtcaactcaactggcaatggtgctggggttacgaaggaaagaaggccaagttacaggagaaaatcaatgacaccgtccagaagatcaagtgtcgtaatagaatcaacaaaggaactcgaggagaaaccgttccactgtcacatttgtcccaagagctttaagcgcagcgaacatttgaaaaggcatgtgagatctgttcactctaacgaacgaccatttgcttgtcacatatgcgataagaaatttagtagaagcgataatttgtcgcaacacatcaagactcataaaaaacatggagacatttaa

SEQ ID NO: 4591 - DNA, 2115 bp, Saccharomyces cerevisiae
atgagactacactatattacggtttttgatccatcaagatctaccaacgaaaatgacactttcaagcagttgctgctgttccattattttggcactactgattcaataccctctttaaacgaaaaactgtccatcataggagtaatacagggcatttggtcacttacgagttcatgcgtaaacaaggacggcgaagatttagagaaaattattgagctgaacaatgatattattttttgtattaaggtggaatcaagatttttcatcagtctagcaatttcgaatatcagcgacgatcagagtgccatacctttacagtatctcagtgcttacttatggcttagttacaggttcttcaagctactcaatgggtcattcagcggatttaacaaggacttccgcaaactcacggatttgttgaacgaattcgttattccgttctggaatgatatttatttgaatctagaaactgtaacgaatagatcatttactgtaatgtggcctggtttttataaaagggcaaattttcaacattcctcttataatcctggagaaaaaaataatgtcgaagagtcatgggacgctataatcttgcagaatattcttttagataaaaagagttatctaggactaaaggacattttggtttaccacctaccaaagcgcaccaaagcggctaatagggagtctatgggaacaaaaacttatggactagtaaggaactttaccagtgacctgaacacattaccagatatctcaaattggctatatcatttgcactgcacctatggtgaaatatcaagtcatatattaacaggaaatgtccattttaaagaggagctacaagtagaagaagaacaagagcgaagtcgtgatacaaacggaagagacgaagaggaatcacaggagcaacagcgacgggagcaccaagagactacgcaaaacaatacaagcgaactctctctatcggaaagagtgatacacaacgtaacactccccatttcttttgcatacgacgctatacatgaagtgagtaccacgactggtgtttcgggtagcttatccatgataatggactatgtaccgaagccccattggccgttcatttcatcctctaacaaaagtgccgacaaaaataattactcaaatagcaatgataacgcaaattcgaatgccccactgatggcgcaatcagaggctgttggagggacgataggcaactcgagatttggtttcctaatttccccattgaattcagacctgttgccatcatcataccaagccctgaaactgaatttgaactttgaaaactccaaagacaaggaggatttttataattgcctattttggtactttgatgattttttaattgtaattgtctgtgatccggacttcaacaagatttgtgaaagagactatctaaaggacttgagcttccaattgtgtcagagtatggaatgcctaaacaatgagattttaaactctcaaaattgcgataacgtggaatcctttgcttatgtgatcagagataacgtcaccaaagaaatcgactcgtccgttccatttgggtctccaaaatttacttcggatgaaagcatttcaactttacaactagcaattaacggtatagatcagttcattaacgataattcaaattccctatcgcttgctaattggaatccaataactattatgggtggctcaaatgctatcagcaaaaaaaatactacagaaggatttggaaacggggtaaacgataagactcaaaaattcaaaagaaaatatctgaatttcttgaatttaatgagcgcagaaaagttatgggacttacaggttgacgtcttacagttcttgactagtttacagaactcaaagagagacccagattattttcaggaggagaggttattaaaattgaacaatggtgttttatgctatatcaaagaaaacaattcaaacttaattattattattaaaaactggtttcaaaataacggcacgtcaaaggctgcaaaacaaaggaaccgttttagttcagattcctctaagggaagttcattgtttcaaagtttaggtcgtgacgtgactgactggtgggaatccagggaaatttaa

SEQ ID NO: 4592 - DNA, 2115 bp, Saccharomyces cerevisiae
atgattattgaacgttgggaagtaaagttatctaaatgtaaccaaaatgtgggcggctattctgttctgtcaggaaacttaaaagaaaacatcaaactgggaagacgagcacaaaaatatttgaaagagctaagaaatttgcaacttaaaccactgaaaatcggagggtatgaaaactgcggcacgatcaatggtgaagagtattttttggaggtaattcacatcacctctggaagacaaaaaatagatgtagccgttggcaaaacatggaatgtgactaacattgagaatgacaacaaagaagaactacagtatgagttattcaaggaaaagttaaaagtcgggaaacaggacatgttattttttagctggatgaaaagtctttcagttcaattaaatgctcctcttcaccaaaaaatgacggaacacggtttggcagacgataacacgaggttagagtggttcaacatcccacttctcagaagaagtcaatacaggaaaaaggtaccatatccgagtttaagacaaatgtcctctgtactggaagtgcaatgcagcacactaacggaggaaaagttgaacttctgcgttggattttctgataaacctttgtcagaatggaagccccaaatttttgagcaaacctacaatagataccgtttacaacggatctcacctgagaaatctttcaaatataagagtaggtgcagtaagtacaatttcaagaccagttcgcaaagctgggttgtgaaagtcccagaacatgatcaacagcttaatacgtttgaaaaacgttatgatgaactctttgatgctcaatttaataaactagaattttttaaaataagaatgaaaaaattgaaaaagaataagccaattgagaaaaagaactataaaatatggtgtctagaaaaagaagacctaaaggatttggtatgggatcctctgaaaagaatttgcaatcattctaggtatgcaatatttgagcatgttaccataaatagggaggcctattcgatcaaaccattaaggttaacttttcaaaaattagattccggctcccttgacctgatcgataatcaaaaaaagacgtttggtagtataaagcttgcaatgagtatgccagatgtaaaaaaaactgaaaatcagtcaattgaagaaagtgaaagacacgatgaaactgctattgaaacccaagaatttgatgaaaatgattgtctttcatctaaggcggatattaatacatcattagctcctcaaaagagatctttcatcgataatgaactaatgtccatgttagtcaccaaaaaaaaaataaagaaggacaaggatgttagtgacaccggtatatcttccacttcatacttgataaattctgggacatatgcaaattctcatattgaaattcctacctctaattcagtttacaatggaaaggaagattgctcatttaataactactcagtaaagcattcaatattggaagaagatattgagaataaatgcatagccgtaaatgaaaacaaggtgattgagaaccaaaaggtaattcagtcattatgtaaaaattcccatctagaccttatcgaacaatcttactttggcgaatgcgatttcattataaaccattcaacatgtgtatataaaattcaggcgagccgatttatgcaactcagaaataacggctcattgcattacgataaagcggtaaacgatcttttaactgaatttcagagagtcattataattgtggagttttctgaaataatacaagacgttgatcctgatcttttctggaaaatcaaactttatttattgaattcacgtgttgatgtttttttcattcatgagactactgacttttttattgattggatgaaatatttcattgcaagatgggccttttcatataacgatgagaaagaaaaaaatattgcaaatgccgatattcttctagatttgggatttaacatcctcttagtacggaaaattttccagacatatagtctcgaagaattttttatggcaataataaaggaagaaagcaaagctgttaaaatgcttacggtttcacaaatgactcgcctgaagaagttattaaccttagaatggtaa

SEQ ID NO: 4593 - DNA, 2115 bp, Saccharomyces cerevisiae
atggatgagcatttaatttctactattaacaagcttcaggacgctttggcgcccttaggaggaggatctcaatctcctattgatttaccacagatcactgttgtcggttcccagtcgtcaggaaagtcgtccgttttggagaacattgttggtagggatttcttgccaagaggtactggtattgtcaccaggagacctttagtgttacaattgattaataggagaccaaaaaagtcagaacatgctaaagtaaaccaaactgctaatgaattgattgacttgaacatcaacgatgatgacaagaaaaaggatgaatcaggaaagcaccagaacgagggacaatctgaagacaataaagaggaatggggtgaatttttgcatttacctggtaagaagttttataattttgacgaaattagaaaggaaatcgtcaaagaaactgacaaagtgacaggtgccaattcaggtatttcttctgtgcccattaacttgagaatttattctccgcatgttcttactttgacgttagtggatttgcctgggttgacgaaggttcccgtaggtgaccaacctcctgatattgaaagacaaattaaggacatgttgttaaagtatatttcgaaaccaaacgctatcatattatctgttaatgccgctaacaccgatttagccaacagcgatggtttgaagctggctagagaggtcgatccagaaggaacgagaactattggtgtcttgacaaaagtcgatttgatggatcaaggtacagatgtcatagatattttggctggaagagtcattcctttgagatatggttatatcccagttatcaatagaggtcaaaaggatattgaacacaaaaaaacaatcagagaagcccttgaaaacgaaagaaaattttttgagaaccatccctcttacagttctaaagctcattactgtggtacaccatatttggctaaaaagttaaactcaatcttattacaccacattaggcaaactctgccagaaatcaaagcgaaaatcgaagccacattgaaaaaatatcaaaacgaacttataaacttgggcccagaaactatggattcagctagttcggttgttttgagcatgattactgatttttccaatgaatatgccggtatcttggacggtgaggcgaaggagctttccagtcaggaactttctggtggtgctagaatttcttacgtattccatgaaactttcaaaaatggtgtagactctttggatccattcgaccagatcaaagattctgatatcagaaccattatgtacaatagttcaggttctgccccatctttgtttgtcggtaccgaagcttttgaagttttagttaaacagcaaattagaagatttgaagaaccatctctacgtttagttactctggtgtttgatgaacttgttcgtatgctaaaacagattatttcacaaccaaagtactcaaggtatcctgctctaagagaagcgatttctaatcagttcattcagttcttaaaggatgctactattcctacgaatgagtttgttgtcgatatcatcaaagctgaacaaacttacatcaatacagcccatcccgaccttttgaagggttctcaagcaatggttatggtggaagaaaaattacatcctcgccaagtcgctgttgacccaaagacgggtaaaccattaccaacccaaccatcgtctagtaaggcgccagttatggaagagaaatcaggattttttggtgggttcttctccactaaaaacaagaagaaattggcagctttggaatccccacctcctgttttaaaagctactggccaaatgacagagagggaaacaatggaaacagaagtaatcaagttgttgattagtagttatttctctattgtcaaaagaaccattgccgatattataccaaaggctttgatgcttaaattgattgtgaaaagtaaaactgatattcagaaagttttactcgaaaaactttacggaaagcaagatattgaagaattaacgaaagaaaacgacataaccattcaaagaagaaaagaatgtaagaagatggtcgagatattgagaaacgctagtcaaatcgtctcctctgtttag

SEQ ID NO: 4594 - DNA, 2115 bp, Saccharomyces cerevisiae
atggtttctccaacgaaaatgataataaggtctccgttaaaggaaacagataccaacttgaaacataataatggaattgccgcatcaacaacagcagcgggccacttgaatgtgttttctaacgacaataattgcaacaataacaataccactgaatcctttccgaagaaaagatctcttgagcgcctcgagctccaacagcagcagcatttgcatgaaaagaaaagggccagaatagaaagggccaggtctattgaaggcgctgtccaagtcagcaaaggtacgggtctgaaaaatgtcgagccaagggttacgcctaaggaattgctggaatggcaaacaaattggaaaaagataatgaaaagagattctcgcatttactttgacattactgatgatgtagagatgaatacatataataagtccaagatggacaaacgcagagatttattgaaaagagggtttcttacattgggtgcgcaaataactcaattttttgacactactgtcacaatagttatcacaagaaggtctgttgagaacatatatttactaaaagataccgacattttatcgagagctaaaaaaaactacatgaaagtttggagttacgaaaaggctgccagatttctgaaaaatcttgatgttgatttggatcatttgagcaagactaaatctgcttctttagctgcgcccacattgtccaatcttctacacaatgaaaaattatatggaccaacggatagagaccccagaactaaaagagacgatattcactactttaaatatcctcatgtatacctttatgacctatggcaaacttgggcccccataataactttggaatggaaacctcaagaactaacaaacttagacgaactaccttacccaatattgaaaataggttcattcggaagatgcccttttataggggataggaattatgacgaaagttcttataagcgcgtagtaaagagatactcgagagacaaagcaaacaaaaaatatgcactgcaacttcgtgctctatttcaatatcatgccgacaccttactgaatacgtcatcagttaatgatcaaacgaaaaacctaatattcatacctcacacatgcaacgattctaccaagagcttcaaaaaatggatgcaagaaaaggcaaaaaattttgagaagaccgagttaaagaagacggatgatagcgcagttcaagatgttcgtaatgaacatgctgaccaaaccgatgaaaaaaatagtatattattaaatgaaactgaaaccaaagagcctccgttgaaagaagaaaaagaaaataaacaatctatagcagaagaatcgaataagtacccacagcgaaaagagctggctgccacaccaaaactaaaccatccagtattagctacttttgcaaggcaagaaactgaagaagtgccggatgatttgtgcactttgaaaacaaagtcacgtcaggcatttgaaatcaaagcaagtggtgcacatcaatctaatgatgtggcaacctcttttggcaatggtttgggcccaacaagagcaagcgtcatgagtaagaacatgaagtcattaagtagactaatggttgatagaaagctgggagtaaagcagacaaatggaaataacaaaaattatacagccactatagcaactactgctgaaacatcaaaggaaaatagacacagattagattttaatgctttgaaaaaagacgaagccccttcgaaagagacgggcaaagatagtgctgtacacttagaaactaatagaaagccccagaatttccctaaggtagctaccaaatcagtctccgcagactccaaagttcataatgacatcaagataacaaccacagaatctccaacagcatcgaagaaatcaacttccacaaacgtcaccttacattttaacgcacagacagcacagacagcacagccggtgaagaaagaaacggtaaaaaattccggatactgtgaaaattgtcgtgtaaaatacgaatctttagaacaacacatagtttctgagaagcatttgtctttcgctgaaaacgatttaaattttgaggctattgactcgttaattgaaaatctcagatttcaaatatag

SEQ ID NO: 4595 - DNA, 2115 bp, Saccharomyces cerevisiae
atgtacaacattccagataatgtcaaaggggctgtagaatttgatccatggttgaaaccgtttgccgatgtactttctgaaagaagatacctagctgacaagtggttgtacgacataactcatgctacgcctgatggttcgtatcagtcactcagtaagtttgctagagattcatacaagtcatatgggttgcatgccaatccggaaaccaaagaaatcacttacaaagagtgggcacccaatgcggaacgtgcatttctagtgggagatttcaataactgggataccacatctcatgagctcaagaacaaggacgaatttggaaattttacaatcacacttcatcctttacctaacggcgatttcgccatccctcatgattcgaagattaaagtcatgtttattttgccagatggttccaagatctttcgtttacctgcgtggatcacaagggctacacagccttctaaggaaacttctaaacagttcgggcccgcatatgaaggtaggttttggaatccagagaacccctacaaatttgtacatccaaggccaaagtttagtgaatctgtagattccttaaggatttatgaagcccacgtcggtatttcgagtccagaaccaaagataaccacatataaagaatttactgagaaggtcttacccagaatcaaatatcttggctacgatgcaattcaattaatggctattatggaacatgcttattatgcatcatttggctaccaagtgaccaatttttttgcggcgagctcccgtttcggcacccctgaggaattaaaggagctgattgatactgcacattctatgggcatcctagttttattggatgtagttcatagccatgcttctaaaaacgtcgaggatgggttgaacatgtttgacggttctgatcatcagtatttccattctataagctccggtaggggtgagcatccgctgtgggattcccgtctttttaattacggaaaatttgaagtgcagcgattcttattagcaaacctggcattttatgttgacgtttatcagtttgatgggtttagattcgatggtgtcacatcaatgttatacgttcatcatggtgttggtgccggtgggtcttttagcggtgactataacgaatatctttctcgtgacaggtccttcgtcgatcatgaagccttagcttatttaatgttagccaatgatttggttcacgaaatgttgccaaatctggctgtaactgttgcagaagatgtctctggttatccaactttatgtttaccccgctccataggtggtactggtttcgactacagattagcaatggctttgcctgatatgtggatcaaactaatcaaggagaagaaagatgatgaatgggagatgggaagtattgtatacactttaactaatagacgatatggtgaaaaagtggttgcttattgtgagtcgcacgaccaagctttagttggtgataagacattagcgttttggttgatggatgccgctatgtacaccgatatgactgtattgaaggaaccatccatcgttattgaccgtggtattgctctacacaagatgattaggctgatcactcactcgctgggaggcgaggcttatttgaacttcgaaggtaatgagttcggtcatccagaatggttggatttccctaatgttaacaatggcgatagctacaagtatgctcgtaggcagtttaatttggctgatgatcccttactgcgttaccagaatttaaatgagtttgatagatcaatgcaattatgtgagaaaaggcataagtggctgaacacgaaacaggcttatgtttcattaaaacatgaaggtgacaaaatgattgtgtttgaaagaaataatctgttgtttattttcaacttccatcctacaaacagctacagcgattatagagttggtgtcgaaaaagctggtacttatcacatcgtgttgaactcagatcgtgctgaatttggtggacataacagaatcaacgaaagttccgaattctttaccaccgatttggaatggaacaacaggaagaacttcctccaagtttatattcctagtagagtcgctttggtgcttgccttaaaagaatga

SEQ ID NO: 4596 - DNA, 2118 bp, Saccharomyces cerevisiae
atgaagaatacggaacttagtcaaaaaaaaaaattagataggcagagtagaagaaagcctgcaaagtcgtgccacttttgtagagtaagaaagctcaagtgcgatcgagtaagaccgttctgtggaagttgctcttctcgaaatcgaaagcaatgtgaatataaagaaaacacttccgccatggaggaccaactcaggaaaaaatacaggagatgttcaaaattagagatggctcgtcgtattgaagagcttgaatctcagctaacaaaacaatcccagcctaacattcacgaaggacaaaaccctctttccaacatgagatatttatcttcaaagcacaataggcacattctttatggaccaacgtcgtatcgagcaatattagcaactcaaacagatacttttgccaaatacagagaggagatatggcaagtcctaaaactcagccgtaacaactggaaaagagagcatcattactcaacactctcggagattagttccattgagactgccccaccgcactcaggctcaccaagtgttattgaatacttatgtgaatcgcttccaaattatgaagttttgtgtgagtatttaactgatttttttgctagcgatttttacgatagttaccaaattgttcataaagaaaaagtattaagggatctgcaagattgttttgttaaaggcccaagaagtcataaaactggtcagcacacaataatttcccttaatctggacagtaaaaaaaattattataaagtgggtgttatgacagccattatgtgcttagcatcccatccaaaagaagtgccagaggctattgaagtcttccataaagttttaacgtcttttgtttcggctaaagttttttatactgagcgtgtgcaatttttatttttacgttacctgtacataaatgtggcgggtcttgacgggggcgatcagtcacattgcatatttattcatggtctgacaattgacacagctatccatatgggccttaatgaagatcttcgtcgtttatatctgagtaaaaatcatccaatagaggaaataccttacttggagagattgtggttatggatcctattcacggacgttaaaatttcactctctacaggaattccggtccgaatcaacgacgattttgtaaacaaggtacgtctagaaaactattcttcatcaggggacatccttctgtataaaacaacattaagactgagaaatattatgaaacaaattcatgctcgtgagaaaccgcctgacattccactcatcatcgaggacttaaaaaagttcaccattaaaatgtttaagccgttggatttttacttaaatgcatctaatttaaatggtaatgagttcaccgaacttcaattatggcatgcaactctccatatgataggaagtttatccaatctttataccttaacacatcaagattttgatgcgagaatattcaattttagcgtcctggctccactaaattcattacatttgtgctttaatgtccttgagacctattttgaattagacaacagcaaattatcttctaagtcattatgcctctccaaaaaatggccccatttaaacaatgcgttgtttcttatttatgtgaacgctttcagagcattaattcaaatttataccatttttctacagtatatggaaaataaagatatccaattattcattcagagaaattcgtccgcactaacttattctatatgtcctggagactttgagggtccacacaataagtgtatttcactgaaaattgcatttaaagaaatggaaaacatatttgatcatattcaccaagaaaagttgaaacctcttactcaaatttggcaaaactcctattacttttctattattatatcaatggaaaaaataggaagaagagcttttaacaaaggaatgaaaaatatcgatgaagggcctgaaaccgaaaatgatgcaactgaaaacagtttaacaactatactaaatgatttagagggacctttagaagatttctcggaaaatttcatcgatgatatattaggttctccaagtgccttctttgatacagctatttccgggtggagtaattttgaggacttcttttccagatag

SEQ ID NO: 4597 - DNA, 2118 bp, Saccharomyces cerevisiae
atgacaacaaactcacgtccatccgccttgcaggctcccggtttacagattttttccatgctgaaatcaagcgaagaggatggattcatgagttctagtctaacccttgatagtgataacataataggtgtcaccgagaacaatcgtcaagaattttactctacgtggcgaaaaccgtccctattaagcagccgcagcgtattacatgaatactcccctacaattgtgggatctaatgactgtactttttcacctataaccgtaggaaaaacaacgaagttttttaattgggatgatattatttcaagaattttcatgcaacagccattcggtgtaacacaccaattctttgaagaatttcggtattcaatcattacttctcattttttgaatgatatgaatcattacaggttatcactacatcttgatcaatctattatgaactttcataaaagctcaactttgttaaagaatgtacctcccaaatctgtaccatttatggcgacaaaatatggtaaattggcggtagcagaggacaaaaaattatatttcagacaaaatttcaactacctttcgatgattataacctcttatcgagtacttacacagttgaaaaaatactgtagaaaaaaaaatagtccaggtctgaagagagttgtaattttaatactcgtagcagtgtatttatcaattcagcaagaatactttcgaagacatttgatttgctataaaaccttattaaaggtacggaaagtgctcgaatcattacaacaagtggatgtaatgattcataaatatcatcttcgatttaaagaaataaaaaatcatagttttatatcaagagtgtctcttatttcaattgctgacgagcactcatctgtgataaaagagctcctagtattctcaagtgatgcactgttttataaactcaaatcaatcattccagatattgtcatctttagcgatacaagtgagctatcgaaatactgtgaattatacggtatcgatgtaccaaatctttactataataatactaccacagtaaaagaccttgatggtaagctttatcgtctcaaactgctaaagaaatttatgctctgttgtttgctgtctttagatatgacaggaaacgaaaatctttcaaatgtaaacatgagaaacgcactaaacaaaatctttccagattacatggcaagggtgcaactcaaaaaaaaatataatccaataggtacattccaaaatatagttagtctattaagaggattacattcactactctccactgtcctggtgtctttgaatgaccataagcaaatattgtatgcatttcctgaagaaacatcaactaatactggttgtgaaagagcaaatgtatgttcattttcaaagaatgataaattgtttcaggcacttaattacttaaaaatgatcgagaacaatctattagctattgacattcgaaatggcataacagagaatgataggaacatcattgaggataagttggaggagctcattactttctggaaaacctcgaaaatttgtggcaatatttctaggatacaaaaggtatccccaaccaatacaatcaaccatggtttccatctggatatcctcaaaggcagaaagtcaccccgttcttcgtcagtacaaggtcttagcttagagaggaaagttgacttcattgatgttgctgaatcggtgaatgactcttttgaaaacgacaccgaactagaggaatatgaagactacgactgtcaggaggaatgttctgccggttcacgccaaaatcaccgcgtagattttatcggaaaggatagttgtaggaaaccagatttcaagcaactttctgacaacgaattacgacgcaagttagatgaaagaattttgaaattggctcaagaaaaccgtgaaggcagggaaaggctaagaactgcaaagtcctttgaattgctaagaaaagctcaggcttccatgtccgtaaagtttggctttcaaaaaccattaagagacgatgcctttcttgagagcaggcctctcagcaaatgcaaagtatcttcggaagaaactatcccatttttgtatgaattaaaaggattactaggaaatgattcatga

SEQ ID NO: 4598 - DNA, 2118 bp, Saccharomyces cerevisiae
atgagcggatctatcgatgtcatcactcattttgggcctgatgcagacaagccggaaatcatcactgcattagagaatttaactaaactgcatgcattgtccgtcgaggatctatacattaaatgggagcagttctccaatcaaaggcgtcaaactcacacagatctgacttccaagaacatagatgagtttaaacaatttttacaattacaaatggaaaagcgtgctaaccaaatttcatcgtcctctaaggtaaacacatccacaaaaaaaccagtgattaaaaaaagtttgaattcaagtcccttgtttggccttagtattccaaagactccgactttaaaaaaaagaaagttacatggtcccttttcactcagtgattccaagcaaacatataatgtaggctctgaggcagaaacaaatgaaaaaggaaatagttctttaaaattggagtttactccaggcatggcagaagatgctgtgggtgacagtgctccattgtcccacgctaaaagctcggatgccaagactcccggctcgtcgacattccaaactccaacaacaaacactcctaccacatcgaggcaaaatgttcctgctggtgaaattttggattctttgaaccctgaaaatattgaaatatcatctggtaatccaaatgtaggccttctttcgactgaagaaccatcatataaccaggtcaaagtagaaccattttatgatgctaaaaagtataaattcagaacaatgaggcaaaacttacaggaagcgtctgatgtcctcgatgatcaaattgaatcgtttactaagattattcaaaatcactataagttatctccaaacgacttcgctgatccaactattcaatctcagtccgaaatttatgctgttggaaggatagttccagattcgccgacctacgacaagtttttgaatccagaatcgctttccctagagacctcaagaatgggcggcgttggaagaagggtaaggttagatctatcgcaggtcaacgagctttcgtttttcttaggccaaattgtggcattcaaaggtaaaaatgctaatggggattacttcaccgttaactctattttgccgctaccttatccaaactccccagtgtccacatcgcaggaactgcaggagtttcaagcaaatttggaaggttcttctttgaaggttatcgtgacctgtggcccatactttgcaaatgataacttctccctcgaattgttgcaagaatttatcgatagtataaataatgaggtaaaacctcacgtcttgataatgtttggcccatttatagatatcacccatcctctgatagcgagtggtaaattgccaaattttccccagttcaagacacagcccaaaacattggacgagctttttttgaagttatttactcctattctaaaaaccatatcaccacatatccaaaccgtattgataccctccacaaaagatgcaatttctaatcacgccgcatatccacaagcttctttaattagaaaggctttacagctgcctaaaaggaacttcaaatgcatggctaatccttcatcttttcaaataaatgagatatacttcggttgctcaaacgttgatacattcaaagatctaaaggaagtcataaaaggcggtactacctcatcaagatatagattagatcgtgtttctgagcatattttacaacagcgcaggtattaccccatatttccaggtagtattcgtacaagaataaaaccaaaagacgtatctacgaagaaggaaaccaatgatatggaaagcaaagaagaaaaagtttatgaacatatatctggtgcagatttagacgtgagttatctgggactaacagagtttgttggtgggttctcgcctgacataatgattatacccagtgaattacaacactttgcaagagttgtccaaaacgtagttgttataaatcccggaagatttattagagcaacaggtaacaggggatcctatgcacaaattactgtccaatgccctgatcttgaagacgggaaattgacgcttgttgaaggtgaagagccagtttatctacacaacgtgtggaagcgcgctagagttgacttgattgctagttga

SEQ ID NO: 4599 - DNA, 2118 bp, Saccharomyces cerevisiae
atggctggtgaaacttttgaatttcaagctgaaatcactcagttgatgagtttgatcatcaacactgtctattctaacaaggaaattttcttgagagaactgatctctaacgcctccgatgctttagacaaaattagataccaagctttgtctgatccaaagcaattggaaaccgaaccagatttgttcattagaatcaccccaaaaccagaagaaaaagttttggaaatcagagattctggtattggtatgaccaaggctgaattgattaacaatttgggtaccattgctaagtctggtactaaagctttcatggaagctctatctgctggtgccgatgtatccatgattggtcaattcggtgttggtttttactctttattcttagtcgccgacagagttcaagttatttccaagaacaatgaggacgaacaatatatttgggaatctaatgccggtggttctttcaccgttactttggacgaagttaacgaaagaattggtagaggtaccgtcttgagattattcttgaaagatgaccaattggagtacttggaagaaaagagaattaaagaagtcatcaagagacattctgaattcgttgcttaccctatccaacttctagtcaccaaggaagtcgaaaaggaagttccaattccagaagaagaaaagaaagacgaggaaaagaaggatgaagatgacaagaaaccaaaattggaagaagtcgatgaagaagaagaagaaaagaagccaaaaaccaaaaaagttaaagaagaggttcaagaattagaagagttgaacaagactaagccattatggactagaaacccatctgatatcactcaagaggaatacaatgctttctataagtctatttctaacgactgggaagacccattgtacgttaagcatttctctgttgaaggtcaattggaatttagagctatcttgttcattccaaagagagcaccattcgacttatttgagagtaagaagaagaagaacaatatcaagttgtacgttcgtcgtgtcttcatcactgatgaagctgaagacttgattccagagtggttatctttcgtcaagggtgttgttgactctgaagatttaccattgaatttgtccagagaaatgttacaacaaaataagattatgaaggttattagaaagaatattgtcaagaaattgattgaagccttcaacgaaatcgctgaagactccgagcaatttgacaaattttactctgccttcgctaagaacattaagctgggtgtacatgaggacactcaaaacagagctgctttagctaagttgctacgttacaattctactaaatctgtcgatgaattgacttccttgactgattacgttactagaatgccagaacaccaaaagaacatctattacatcaccggtgaatctctaaaggcagtcgaaaagtctccattcttggacgccttgaaggctaagaactttgaagttttgttcttgaccgacccaattgatgaatacgctttcactcaattgaaggaattcgagggtaaaactttggttgacattactaaagatttcgaattggaagaaacagacgaagaaaaagctgaaagagagaaggagatcaaagaatacgaaccattgaccaaggccttgaaggatatcttgggtgaccaagtggagaaggttgttgtttcttacaaattgctagatgctccagctgccatcagaactggtcaattcggctggtctgctaacatggaaagaatcatgaaggctcaagccttgagagactcttccatgtcctcctacatgtcttccaagaagactttcgaaatttctccaaaatctccaattattaaggaattgaaaaagagagttgatgagggtggtgcacaagataagaccgtcaaagatttgactaacttattattcgagaccgctttgttgacttctggtttcagtttggaagaaccaacttcttttgcatcaagaataaatagattgatttctttaggtttgaacattgatgaggatgaagaaacagaaaccgctccagaagcttctaccgaagctccagttgaagaggttccagctgacaccgagatggaagaagttgattaa

SEQ ID NO: 4600 - DNA, 2118 bp, Saccharomyces cerevisiae
atgtcccgtgacctacaaaaccatttgttattcgagactgcgactgaggttgctaatagggttggtggtatttactccgtgctaaaatcgaaggctcccattacggttgcccagtataaagaccattaccacttgatagggcccttaaataaagccacttatcaaaatgaagttgatatactagattggaagaagcctgaagccttttccgatgaaatgaggccagtgcagcatgccctgcaaacaatggaatctagaggagttcattttgtttatgggaggtggctgattgaaggtgctccaaaagtaatactttttgacttggattctgtgagaggttattcgaatgaatggaagggtgatttatggtcattagtaggaattccctctcctgagaatgatttcgagacgaatgatgctatcctattggggtatacagtcgcttggtttctaggcgaagtggctcatctcgattcacaacacgcaattgttgcgcactttcacgaatggttggccggtgttgcgttaccattatgccgtaaaaggcgtatcgatgtagttaccattttcaccactcatgctactttattgggacggtatttatgcgcctccggcagtttcgatttttacaattgtttagaatctgttgatgttgatcacgaagctggcagatttggcatataccatcgttattgtatagagagagcggcggctcattctgcagacgtgttcactacggtgtcacaaataactgcttttgaagcggaacatcttttgaaaagaaaaccagatgggattttgcctaatggactgaacgtcatcaaatttcaagcatttcatgagttccaaaatttgcatgctttgaaaaaagaaaaaatcaatgactttgtaagaggccattttcatggttgcttcgatttcgatctagacaacaccttgtacttttttattgctggtagatatgagtataaaaataagggtgctgacatgtttattgaggctctagcgcgtttgaactacagattaaaagtatccggatccaaaaaaactgtggtagcgtttattgtcatgcccgccaaaaataattccttcactgttgaagcattgaagggccaggctgaggtgagggcgttagaaaatactgtacatgaagtgactacttcaattggtaaaagaatattcgatcatgctatcaggtacccccacaatggactgacgacggaattaccaaccgatttgggtgaattactaaagagttcggataaagttatgttaaagagacgtattttggctttgagaaggccggagggacagttacccccaatagttacacacaatatggtcgatgacgctaatgacctgattttaaataaaatcagacaagttcaattgttcaatagcccaagtgatcgtgttaaaatgatcttccatccagaatttttgaacgctaataatccgatccttggtttagattatgatgagttcgttcgtggttgccatttgggtgttttcccttcatactacgagccttggggttacacacctgcagaatgtacagtaatgggtgttccctccatcacgacaaatgtctctggtttcggtgcctatatggaagacttgatcgaaaccaaccaagcgaaagattacggtatttatattgtggatcgtcgtttcaaggcacctgatgaatctgtggaacaattagttgactacatggaagaatttgtaaaaaagacaagaaggcaaagaattaatcaaagaaatagaactgaaagactctccgacttactggactggaagagaatgggtctcgaatacgtcaaggcaaggcagttagcattaagaagaggctatcctgatcagttcagagagctcgttggtgaagaactaaatgattccaacatggatgctttagcaggcggaaagaaattgaaagttgcaagaccgcttagtgtacctggctcaccaagagatttgagatcaaacagcacagtctacatgacccctggtgatttgggtactctgcaggaggttaataacgcggacgattatttttcattgggagtgaatcctgcagctgacgatgacgacgatggcccatatgctgatgacagttaa

SEQ ID NO: 4601 - DNA, 2118 bp, Saccharomyces cerevisiae
atgtcgttgggtcctcttaaagctatcaatgataagcaattgaatacccgttccaagttagttcacaccccaataaagggaaataccgcagacctcgtaggaaaagaaaatcactttaaacaaacaaagagactagatccgaataatgatcatcaccaccagccagctcaaaaaaagaaaagggaaaagttatcagctttgtgtaaaacaccaccttcattaatcaaaacaagaggaaaagactatcaccgaggtcattttttaggtgaaggtggatttgctcgctgtttccaaattaaggacgattcaggcgaaatttttgctgccaaaacagttgctaaagcctcaattaaatcagagaagacaagaaaaaagttgttgtcggagattcaaattcataaaagtatgtcccatccaaatatcgttcagtttattgattgttttgaggatgatagcaatgtctatatcttattggagatatgccccaacggttcattaatggaattactaaaaagaagaaaagttttaacagaaccagaagttagatttttcaccactcaaatatgtggtgcaattaagtatatgcattcaagaagagttatacatagagatttaaaacttggtaacatcttcttcgattcaaactataacttaaagattggtgacttcggtctggcagctgtgttggcgaatgaaagtgaacgtaaatacaccatatgcggaacacctaattacatcgcacctgaagtgttgatgggtaagcattctggacattcatttgaagtagatatttggtcattaggtgttatgctttatgctttgttgattggtaagccacccttccaagcaagagatgtaaacactatttatgaaagaatcaaatgtcgtgatttttcgtttccaagagataaaccaatctcagatgaaggtaagattttaataagagacattctatccttagatccaatagaaaggccctctttgactgaaattatggattatgtatggtttaggggaactttcccaccatctattccttcgacggtcatgtcagaagcaccaaattttgaggatattcctgaagagcagtcactggttaacttcaaagattgcatggaaaaatctctactattagaaagcatgagcagcgataaaattcagcgtcaaaagagggattatatttcttcaattaaatctagtatcgataaactagaagagtaccaccaaaacagaccatttttaccacattctttatcccctggcgggacgaaacagaaatataaggaggttgttgatatagaggcacaaagaagattaaacgatttggctcgtgaagcaaggatacgtagagcacaacaggccgttttgagaaaagaattaatagctacatcgaccaatgtcattaaatcagaaatctccttgagaatattagccagtgagtgtcatcttactttgaatggcattgtagaagcagaagctcagtataaaatgggaggtcttccgaaatcaagattgcctaaaattaaacacccaatgatagttaccaagtgggtcgactactccaacaaacacggattctcctatcagttatcaacagaggatattggtgtcttatttaataatggcaccacagttctccgattggcagatgcagaagagttttggtatattagttatgacgatcgggaaggttgggtagcaagtcattatttattgagcgaaaaaccacgagagctaagtagacatttagaagtagttgatttttttgccaagtacatgaaggcaaatttgagccgagtatctacgtttggcagagaagaatatcataaagatgatgtatttttgagaagatacacaaggtataaaccatttgttatgtttgaactaagtgatggtactttccagttcaatttcaaagatcatcataaaatggcaatatccgacggaggtaaattggtgacctacatttctccctcccatgaaagcaccacatatcccttagttgaagtactaaaatatggcgagatcccaggatatccagaaagtaactttagagagaaactaactttgataaaggaaggtttgaagcagaagtccacaattgttaccgtagattaa

SEQ ID NO: 4602 - DNA, 2121 bp, Saccharomyces cerevisiae
atgagagtaagaccaaagaggtcggtcataacactcatggcgatagtagtcgtgatgctcatcctcagaaaccagttctactcatcacgaacgcgagggcatgggcaggaaccagtcatctcctccagccaaaagaatctttatgacgggtggataacacccaatttctatagaaagggtgatcccttggaattgattgtgaataaggtagaatctgacttaacgcaattgccatacgcatattatgacttgcccttcacttgtcctcctactatgcataaaaaaccgcttcatttatctctaaacgaaataataagaggggataggaaatgggaaagcgactataaactcaaatttggcgaagacaatccatgtgaaacgttgtgtgcccggaaaactaccaaagagggcatgcagaccttagacaagttagtcagggagggatacgtcgtacaatggctaattgatgatgaattgccggctgccactacctttatttccaccactgatcataaaaaatattatgcatctgggtttcctttaggtttcatagatcctgatacagataaaacctatctgcataatcacgtaatgctggtaatacgttttcatgccagtgataatgataaaaataccatagtcggctttgaagtatatccaagatctgtgtcagattatcattgtcctggggcatcgaagaactacgaacaatacgaaatagtcattcctgaggatgaaaatgagttgacatatttgccatttacttactccgtatattggagggaagaatttgaagtagactggaatcatagatgggattatttcttgaacgcaggtgagttatctgacgaacagagcattcagtttcattggatgagcttagccaattcagtgggaattgtattgtccatctcatttatcacgcttattatttacgtacgagtcatgtacacggataaaagtaattcaaagtcccccaaatacatgataaatatagaaggaattgaaacagaggatgacctggacgatgacaagtatggtaaatactccgtttacacggtggcgaaagactggatacaaaatggtagaccaaatttatttggtttaaaagttttaatccttctggtctcatttggggtgcaatttttatttaccataattggatccttaacgatatcatgttcaatgaacaaattgcataatgtaagaaacagtgtgctaactatggccattttatttttcgtacttggagcattcatggcatcattcgtagggacaagactcagtatggtaacgaaaacgaaaagaaccaaggccaattaccttgacgataacagatacctcaaagactacaagaagtttagtcccatttttacgatactttgtgggtccagcttacctggcattgtaatggtgagcacatttttattaaatagtattgtttgggcacatgattctacaagtgcattaccattcaagactattgtgtttttcatgagcatttatttcatcgtctgtataccactcagcttgtttggtggtattgtagctaataatatacctttgcctcaatattggttgagtggaattactaaagatgaaagcaatagcgatggcaatggattatttgtacctaaatcacgagccaagttcaacccgttggtttactgcggcatttatttatgtggtattttccccttgttagtaatttacgtggaaatgcaatacgtttacaaatctctctggttggagaaaactacattttattatttttacggattcctttttttgagtatcatactattatgcgtgttaactatggagatatcaattattggaagttatttattaatgagattttgcttcgaagataaggtggttcgcaacaattggagatggaagtgctttgaaatgggatttagcggtggtgtatatatggaattgtattcgctatattacattttcgcagtgctaaacatccatgggttttcatctatcttaatttccatttgttatagtttaatcttcaacgtaatgtgcagtttagggcttggcgcattaagttacttaacggcttcatggtttataaataaaatataccaccagaaagtcaacctgtaa

SEQ ID NO: 4603 - DNA, 2121 bp, Saccharomyces cerevisiae
atgattcaaaaaatgagcccaagcttaaggaggccatcaacgaggtctagttctggttcaagtaatatcccacaatcgccctctgtacgatcaacttcatcgttttctaatctgacaagaaactccatacggagcacctctaattcgggttctcagtcgatttctgcatcttccactagaagtaactccccactaagatccgtatcagccaaatccgatcccttccttcacccaggtaggataaggatcaggcggagcgacagtattaacaacaactcgagaaaaaacgatacatatactgggtcaatcactgtgaccatccggccgaaaccacggagcgttggaacttcccgtgaccatgtggggctaaaatcgcccaggtactctcaaccaagatccaactcacatcacggtagcaatacatttgttagagacccctggtttattactaatgacaaaacaatagtgcatgaagaaattggagagttcaagttcgatcatgtttttgcttcccattgcactaatttggaagtttatgaaagaaccagtaaaccaatgattgataagttattgatggggtttaatgccaccatatttgcgtacggtatgaccgggtcaggtaaaacgtttacaatgagcggaaatgaacaagagctaggcctaattcctttatctgtgtcgtatttatttaccaatatcatggaacaatcaatgaatggcgataaaaagttcgacgttataatatcgtacctcgaaatttacaatgaaaggatttacgacctgttagaaagcggattagaagaatccggtagtagaatcagtactccttcaaggttatatatgagcaagagcaacagcaatggattgggcgtagaattaaaaatcagagatgactctcagtatggggtcaaagttatcggtctcaccgaaagaagatgtgaaagtagtgaagaattattgaggtggattgcagttggtgacaaaagtaggaaaattggcgaaactgactacaatgcaagaagctcacgatctcatgccattgtactgattcgtttaacaagtactaacgtaaagaacggcacctcaagatcgagtacattgtcgttgtgtgacctagcaggttcggaaagggctacggggcaacaagagaggagaaaggaaggttcattcatcaacaaatccttacttgctttggggactgtgatatccaaactcagtgccgacaagatgaactcagtaggctcaaacattccctcgccatctgcaagtggcagtagcagcagtagtggaaatgctaccaataacggcactagcccaagcaaccacattccatatcgtgattctaaattgactagattattgcagccggcactaagcggtgacagcatagtgacaacgatatgtacagtcgacaccagaaatgatgcggcagcggaaactatgaatacgctgaggtttgcatcaagagcgaaaaacgtcgcacttcatgtatccaaaaaatccatcatcagtaacgggaataacgatggagataaagatcgcaccattgagctactgagacgccaattggaagaacaacgtaggatgatctctgaattgaagaaccgttcaaacattggcgagcccttaaccaaatcttccaatgaaagtacttataaagacattaaagccaccggcaatgatggtgatccgaatttggctctaatgagagcggagaatcgagtattaaaatataaactagagaattgtgaaaaactactagataaagatgtggttgatttgcaagattctgagattatggaaattgtagaaatgcttccctttgaggtcggcacccttttggaaacaaagttccaaggtttggaatcacaaataaggcaatataggaaatacactcaaaaacttgaagacaagatcatggcgctagaaaaaagtggtcatactgcaatgtcgctaactgggtgtgacggcactgaagtgatcgaattacagaagatgctcgagaggaaggataaaatgattgaggccctgcagagtgccaaacgactgcgggatagggctttgaaaccactcattaatacacagcaatcaccgcaccctgtcgtggataacgataaatga

SEQ ID NO: 4604 - DNA, 2121 bp, Saccharomyces cerevisiae
atgcaattacggaacatattacaggctagctcgctaatttctggactttcgctcgctgcagattcgtcgtccactactggtgatggttatgctccatcaataattccttgtcccagtgatgatacctctttagttagaaacgcgtctggcttatctaccgctgaaactgattggttaaagaaaagagatgcgtacactaaagaagctttacattccttcttaagcagagctacttctaacttcagtgacacttctttgctatccactcttttcagtagtaactcttccaatgtacccaaaattggtattgcatgctctggtggtggttatcgtgccatgttgggtggtgctggtatgattgctgctatggacaatcgtactgatggtgctaacgagcatggtcttggtggtttactacaaagttccacgtatctatcgggtttgtccggtggtaactggttgactggtactttggcatggaacaattggacctctgtacaggaaattgtagaccatatgagtgagagcgattccatctggaatatcacgaaatccattgtgaaccctggtggctctaatttgacctacacaattgaaagatgggagtccattgtacaagaagtgcaggctaagtctgatgcaggcttcaatatatctttgtcggatttgtgggcccgtgcactttcttacaacttctttccaagcttgccagatgctggctccgctttgacttggtcctctttgagagatgttgatgtgttcaaaaacggtgaaatgcctttaccaattactgttgcagatggtagatacccaggtaccaccgtgataaacttgaatgccactcttttcgagttcactccatttgaaatgggttcttgggatccttctttgaacgcttttacggatgtgaaatatctaggtaccaacgttacaaatggtaaaccggtcaacaaggatcaatgcgtttctggttacgataatgctggatttgtaattgccacatccgccagtttattcaacgaattttccctggaagcttccacttcgacctattataaaatgattaatagttttgccaacaagtacgttaacaacctatcccaagatgacgatgatattgcaatttacgctgcaaatccattcaaggatacagaatttgttgaccgcaattacacttccagtattgttgatgccgatgatttgtttttagttgatggtggtgaggacggccaaaatttgccgttggttccactaatcaagaaggaacgtgacttggatgtggtgttcgcattggatatatccgacaatactgatgaatcatggccaagtggtgtgtgcatgacgaacacttatgagcgccagtattctaagcaaggtaaaggaatggctttcccatatgttccagacgttaacaccttccttaacttgggcttaactaataagccaacgttttttggttgtgatgcaaaaaatttgacggacttggagtatattccacctttagttgtatatatcccaaacacaaaacattcattcaatggtaaccaaagtactttgaagatgaactacaatgttacagaacgtcttggaatgatcagaaatggttttgaagctgctacaatgggcaactttacggatgactctaactttttaggttgcataggttgtgccatcattagacgtaagcaagaaagcctaaatgccaccttgccccctgaatgtaccaaatgttttgcggattactgctggaacggcacactaagtacctcagctaatcctgaactatcgggaaatagtacgtatcaaagcggtgctattgcctctgcaatctctgaggctactgacggtattccaataacggctctcttaggttcatcaacctccggaaatactacatcaaactcaacaacctcgacttcatcaaatgtcacttctaactcaaactcttcgtcaaatacaactttaaactcaaattcttcatcctcttcaatttcttcctctacagctcgttcttcttcctctacggcaaacaaagcgaatgctgcggctatttcctatgcgaacactaatactctaatgagtttgttaggtgccataacagcattatttggactaatttag

SEQ ID NO: 4605 - DNA, 2121 bp, Saccharomyces cerevisiae
atggacaagctaactccatctcaatggaaggtaataaataagtcatatgaaccagcgtctacgataaaagtcattgcgggcccaggctcaggaaaaacgctaacgctactatataaagtactacatttaattactgtggagaatattaagcctgaagaaatacttatattttcgttaacaaacaaagcagttgatagtataatagaaaatttactgtccattttcgaaaactcgcatacaaataaggaaattgtccatcagattgggtgttacacagttcatgggttggctaatagaatcgttgtagagaatgaggggatgataaacattatagaagagattggatggagaggattaatgaagttgttaccgccgtcaaagagaaccccccatcatttcagatcatataaggaactcgagaaagttgttaaggattacaagctaaacaacgcaaaaaataataaccccgtcattgagaaactagttgaactgatggataactgtaaagtgatgaccaatgatgatttgatcattcgcgcaaaaaaatacttagagcttgattcttctgattcagatgcatcgtcttttactcaagatctccgcaataaatacaaggttgttcttatcgatgaatttcaggacctctatccaagtttagcacccttaattaccatgatttgcaaaggcaagcagctcattatgtttggtgatacaaatcaaagcatatacggatttttggggagtaacaacgagattatgtcacaattagacaatcttcacccaaaaaattccacgactgtcctgaaattatttgataattttaggtctacccccgaaataatctctctagcatcaaaaattatcaatcgtccactagcagagaaacagattatcgatgatactgatgaaacaccatcagagctagttcgcaagctaccgagtggtgtttcacctcaaataatgacatttgatgatctagccgcagaatctgaatttattattgataaaattacccaattgatttgttcttctgcaaagttttccgatatagcaattctatcaagaacaaattcacatctaacggctatagccagtattttgaagaaatatggtattccttatcaaaaactaaagagtcaacctgattggatggacgatttacgaattcaattccttttagatattctaaaagtgtgttctttagcctccgacgaaaagcataatcgtgagttcaatacgggtgataaatggcaaagtaacttcagcattttggtcacaatgagcgctctcaaagggattggcgatgcttcaatacaagccttgtataaagcatgcagcctgaaaaatctgtcaatttggaaatacctaactatggttcccaattttgaatggccattgggcctctccataaagaaaaaaatggaaaattacacttcaaatttatatgaaatgatcgaaaatgatcaagttcatcaattagatgatccgatggaacttttagaaaaagttgctagcatcacaaataacttaaacctaaatcctacctacttccaatccttaagtgatgctcaatcatctttagagtttaaaacacatctacaagagatggcacaagtaatgaaggtctcaaaatctaataagcccccgggtatttcatttgttaaatggtttctagagacatattttgatcaaacgatggtctttcaccagtctcagcaggcattacaaactaccggtccggggacagtaaaactatctaccatccattctgcaaagggtttagaatttcccatagtatttctaacaaacgggagcatgtccaatttcccaatggatacaaacgccctttatgtggggataactagggcaagaaacttgttgtacatgtgcaacatgaagcacgagagactggtcagtaaatcatcaccatactcaagaaacataatgtctaataatttattctggacttactacaataaggatttgaaacgatctgtatgtgacgttaaggtgacacatggttataatgtgcagcgatacaatcagttacgtaaaaattttggattttatagagcatattcttcactaagaggttgtaagagcgttttcagacgtatatag

SEQ ID NO: 4606 - DNA, 2121 bp, Saccharomyces cerevisiae
atggattctgtaatggttaagaaagaagtactggaaaatccagaccatgatttaaaaagaaagctagaagagaacaaagaagaagagaatagcctctctactacttctaaaagtaaaaggcaggttattgttcccgtttgcatgccaaaaatccattattcaccgctgaaaactggtctttgctatgacgttagaatgaggtatcatgcaaagattttcacatcgtacttcgagtacattgatccacatccagaggacccaagaagaatatatcgtatttataaaatactagcagagaatggtctgattaacgaccccactttaagcggcgtggatgaccttggtgatttaatgctgaagatacctgtaagagccgcaacctccgaagaaatcttggaagttcatacaaaggaacatttagagtttattgaaagcacagaaaaaatgagccgagaagagttattaaaagagactgaaaaaggtgattccgtatatttcaataatgattcttacgcgagtgctaggctgccttgtggtggcgccattgaagcatgcaaggcggttgtcgaggggcgtgtaaaaaactctctagctgtcgtaagaccacctggccatcatgcagagcctcaagctgcgggtggtttttgtctcttcagtaatgttgctgttgctgccaagaatatcttaaagaactacccagaaagtgtaagaaggataatgattttagattgggatattcatcatggtaatggcacacaaaagtcattctatcaagacgatcaggtgctatatgtgtcattacacagatttgaaatgggtaaatactatcctgggaccatccaaggacaatatgatcaaactggtgagggtaagggtgaaggattcaattgtaatattacttggccggtcggcggtgttggtgatgcagaatatatgtgggcatttgaacaggtagttatgcctatggggagagaattcaagcctgacttggtgattatttcttcagggtttgatgccgcggatggtgatactatcggacaatgtcatgtcaccccaagttgttatggacacatgacacatatgttaaaatctctagctagaggtaatctttgtgtagttttggaaggtggatataacttggatgcgattgcaagaagcgctttgagtgtagcaaaagtactaataggggagcctcctgatgaactacctgatccattaagtgatcccaagcctgaggtcatagaaatgatagacaaagtaattcggttacagtccaagtattggaactgttttagaaggagacatgctaactccggttgtaattttaacgaacctattaacgactcgataatatctaaaaattttcctctgcagaaggctattcgtcaacaacagcaacactatttaagcgacgaatttaatttcgttactttaccgttagtaagcatggatttaccagataatacagtgctatgtactccaaacatttccgaatctaacactataattatagtcgttcatgatacttctgatatctgggcaaagagaaatgttatttcaggtacaattgacttatcctcatcagttatcattgataattctctagactttatcaaatggggacttgacaggaaatacggcatcattgatgtaaatatacctctaactctgtttgaacctgacaattactcaggaatgattacatcccaagaagttctaatatatttatgggataactacatcaagtattttccttctgttgccaaaattgcttttattggaataggagactcatactcaggtatcgtacatctgcttggtcacagggatactagggctgttactaaaacggtaattaatttcttgggagacaagcagttaaagccactagttcctctagtagatgaaacattgagtgaatggtacttcaaaaactcacttatattttcaaacaatagccaccaatgctggaaagaaaatgaaagcagaaaaccaagaaaaaaattcggtagagttttgagatgtgatacggacgggttaaacaatataattgaagaaagatttgaagaggctacagactttatactggattcgtttgaagaatggagtgatgaagaatga

SEQ ID NO: 4607 - DNA, 2121 bp, Saccharomyces cerevisiae
atgtataactcaatctacgggtcccccttccctaaaataaatccgaaggtccgctacaaaactgctctagaaagagcagggtttgacactaagccgcgtaatccgttcagtagtcagaggaatgcttccactggaagtttacaagcttccgtgaagtcgccgccaataacccgtcaaagaaatgtatctgccgccccatctgttccggtcacgatgaagagtgcgtatacggcgtcttcaaagagtgcttattcatctgtaaagggcgagtctgacatttatccgcctcccgtattggagaatagcgagaggcggagtgtaactcctccaaagaatagcaattttacgtcttcgagacccagtgacatatctcgttctatttccaggcccagcgagcgtgcttcgcaagaggatcccttccgttttgaacgcgacttagaccgtcaggcggaacaatatgctgcctctaggcatacatgtaaatcacctgctaacaaggaattccaagccgcagataacttccccttcaacttcgaacaagaagatgctggtaatactgaaagggaacaagatttgagccctattgaaagaagtttcatgatgctgactcaaaatgacactgcaagcgttgtaaattctatgaaccaaaccgataacagaggtgtgctcgaccaaaaactcggaaaagaacagcaaaaagaggaaagttcaatcgaatatgaaagtgaaggacagcaggaggatgagaatgatattgaaagcctaaattttgaaccagatcctaaactacagatgaatcttgaaaatgaaccacttcaagatgattttccagaagcaaaacaagaggaaaagaatacagaacctaaaattccggaaattaatgttacgagggaaagtaatacaccatctttaaccatgaacgcactagactctaaaatatatcctgatgataacttttctggcctggaatcttcaaaggaacagaaatcacctggtgtgtcatcatcgtcaacaaaagttgaagatttaagtcttgatgggttaaatgagaaacgtctttcaataacttcttcagaaaacgtggaaacaccatacactgctacgaacctccaagtcgaacaattgattgctcaattagacgatgtttccctatctagaaatgcaaagctcgatatgaacggcaattgcctcaacgcagtggacagaaaggcttctagattcaaaaagtcaagcgcatatttatctgggtatcccagcatggatatacccgtaacgcagcaaacatcaattgtgcaaaacagcaatacgaacttatccagacaaactattctggtagataaaggcgatgtcgatgaagacgcgccatctgaatctacaactaatggtggcacacccattttttacaagtttaaacagtcgaacgtagaatactccaataatgaagggatgggttcgcaagaaactttcagaacgaaacttcccacaattgaagcactacaactgcagcataagcgcaacataacagatctgagagaagaaattgataattccaaatctaatgactctcatgtattacctaacggcggcactacgagatacagctctgatgcagattataaagaaacggagcccattgagtttaaatatccgcctggggagggaccttgcagagcatgcggcttggaagtcacagggaaaagaatgttttccaaaaaggaaaacgaactgtcgggtcaatggcatcgtgaatgttttaaatgcattgaatgtggtatcaaattcaataaacatgttccctgttatattctaggcgatgaaccatattgtcaaaagcactatcacgaggagaatcacagtatttgtaaggtttgttcaaatttcatagagggtgaatgtctggaaaatgataaggtggaacgattccacgtggattgtctaaactgtttcttatgcaagactgccattactaatgattattatatattcaatggggaaattccattgtgcggtaatcacgacatggaagctctcttgaaggaaggtatcgacaatgctacatcaagcaatgataagaacaatactctctctaaaaggagaacgaggctcatcaacttcaactag

SEQ ID NO: 4608 - DNA, 2121 bp, Saccharomyces cerevisiae
atgtcgtttttgccactaaggtctaggtcacgatcaggcgctcctcattgggtatacatcatcttatatcacatctttacgataccgaagatatattcactgccgttgttatccggatcacacgtactcaattctagggatgttgccgattccggccatagcgtaggtgatgaggcaagcgttaccacgtactatattatctctatcatcctagtgctgctgggtggtgtatttgcaggattgacgctggggttgatgggtcaagatgaagtctacctgaaggtaatcagcacttcaggctcgaattctgaaaagaaactggccaagcgggtgcttgacctaatatctagggggaagcattgggttctagtcacactgctgctttctaatgttataaccaacgaaacattgcctattgttttggacaggtgtcttgggggtggttggcaggctgtagtgtcgtcaactattctaattgtgatcttcggtgaaattattccgcagagtgtctgtgttaaatacgggctgcaagttggggcattcttctgcccctttgttcttgtactgatgtatctgatgtacccagtcgcatatccgatcgcgactctcctggactatatgctgggtgaagatcatggtacgatgtacaaaaaatccggcttaaagactttggtcaccttgcataggaccatgggggtggaacggttgactaaagacgaagttacaatcatctctgctgttttggatctaaaggcaaagagggttgaggaaatcatgactccgattgaaaacgtgttcacaatgagtgccgataccatcctagacgataaaactgtcgaaaaaatcttcaactcagggttttctagaatcccgatttttttgcccaatgaaccaaacaacttcatcggcatgttacttgtcagggtgcttatctcctacgatcctgatgactgcctcccaatctcccacttccccctagccacgttgccagaaacttccccgaacacatcttgtttgaatattctgaattacttccaggaggggaaagctcacatgtgcgtcgttagtaaagagccgggctcctcgcatggcgctattggtgttttaactttggaggatgtcattgaagaattgatcggtgaagaaatcgtggacgagtctgatgtctttgtggacatgcatcagcatattatgagacaacaaccggggcccttgagcaaaaggcacattacttcctatttgcatcatttgtacactagctctcacaaggagcacaaagctgctgaccaagctgatgaatcgtctccactcttgtctccatccaattctaatcacccatccgagcacccacagcaagatttgaataataagtcttggaagcagaagtcaaatgatggttacgacaggtccaacgctgtattgtctccaactccacaagtgacggaacatggcaccatcataccttcaaatctagcgtccaacccgttgaacgtaaataaatcttttgttaccattaaaaagcctgccaatgttccgaaaatcattactacacacactcctcattctagcaaagagccttctccagcaccacactcaaatgataaatcactctccgccgaagaacaacaactattaagtgatcatgcagagctatctcgccaagctgttctccatactcaacggtcgggtcaaccaactcaagttactacctcgactaaaaccacgagaaatagccctgatagtatatcaattccaaattctggcgcgaatcacggcaacgaaaatcaaaacgttacaatctcaacctcttaccaaaatacgaagaatggtattgtggaatctgtcatcacagtcaaaggtgttccaaaaaccatcattggccccgcaaaagattgggacgaatccaaaagtgaatatggaaacgagaatatcaatcaagagaattctaatcgaagtgacgatagagaaagttcaagttcaaatgcaagtttattttccagtattaagaataaatttaagaacgaaaacgctaacaacaatgatcgttctaatttcaccgactctttgtcaagaacttccaattatgatgccaacggctcctcgtcgaccataaaaagatga

SEQ ID NO: 4609 - DNA, 2124 bp, Saccharomyces cerevisiae
atgagtaaaaaattatcgttggaagagagactctccttggcaactaagaaaggaagaaagaaaaataaaaggtcaacgtcaaatttgtcgtctccatcgcctgtggtgctgtcaaacaatgaacaagaaagtgctcgtacatccattgatgatgcggctgccggtgtggtgtcaattgacaatgctgaaaacatagatgatcctgcggtacgatcagaaagcactgtggaaggcgatacaggtaaggcagattcaatcgctgtcgatgacgtggtgcatcccgatcacaataggactgattgcttcgacgacactatggtatcactgcctacatggctacctaaaaattacactgaatttactgttgaagaattagtcaaagaaattagtcctgaatatttaagattaaacaaacagattgatgacctaactaacgaactaaacagaaaatcacaaatcgaaaccacggattctagttttttcaaattgattaaagagaaggacgacttgatagatcagttgagaaaagaaggagctaaattagcggaaactgagctgaggcaatcaaatcaaatcaaagctttaagaacaaaagtgaaagacttagagtatgaggtatctgaactaaacgatagttctgctcagagtgtcgaaaactataatgagctgcaatcattgtatcacaacatacaaggacaactggctgaagctacaaataaattaaaggatgcagataaacaaaaagagtcacttgaaacattagagaaaaatataaaagaaaaagatgatttgataacaattttacagcaatctttagataatatgagaacattgcttgaaaaagaaaaaagtgaatttcaaacggaaaagaaagcactacaagaagcaacagttgatcaagttaccactctagagactaaactagaacaactaagaatagaattagatagctctactcaaaatttagacgctaaatcaaatagagattttgtcgatgaccaacaaagttatgaagaaaaacaacacgcatctttccaatacaatcggctcaaagaacagcttgagtcatcaaaggccaactgggatagtattgaatacgctttgaacactaaaattgtgaacttggaaaaccgctttgaatctacaatgaaagaaaaaaatgatattgaagaaaaatatcaaactgccttacgttcatctgaaacattaggtaagcaattagaaaaagaaaaagagaatcattcgaaggcagttttggaagtgaaagacttggagagacgggcggagacattgaagtcatcattgcaaagtataagtgatgattataatctactgaagaagaagtacgaaattcaaaggtctcagttggaacaaaaagagaacgaactaaaaccacatcaagaaaacagcaatgagaaaattatagataaaatacctgtagaattaacagatagtttaaactccatggagggaaatatagaagacgaatggactttacctcaagaaaattctatgctgtcattatcaatgtcaaaacttggcgaattagaaagcgatccgtctctaaaacccatttacaatgaatctcacgaaaccatatgtagcgaagaaagccaacattttgatagaaaaaatgtggatttcagcattgacgatattccagaagaggccgctgctttacaagcaatcagggaaggggaatcaatgaactcgttaaacaacacatcaataccatacagaagagctagcgtccagctatcgaattctaacggccacataagcgctcatctggtgaacaagttaagtacggagttaaaaagattggaaggtgaattatcagcatcaaaggaattatacgataatttactgaaagaaaagacaaaagcaaatgatgagattttaagacttctggaagaaaacgataaattcaatgaggtaaataaacagaaagatgatctcttaaaaagagttgagcagatgcaaagtaaattggaaacctccttacaactattaggtgaaaagactgaacaagtggaggaattagaaaatgatgtgtccgatttaaaagagatgatgcatcaacaagttcaacaaatggtagaaatgcaaggaaaaatgagataa

SEQ ID NO: 4610 - DNA, 2124 bp, Saccharomyces cerevisiae
atggttttgaaatctacttccgcaaatgatgtttcagtatatcaggtttctggtacaaacgtttcaagatcacttccagactggattgcgaaaaagcgcaaaaggcaattaaagaatgatttagaatatcaaaatagagtagaactgattcaagattttgaatttagcgaagcctccaataagattaaagtgagtagagatgggcaatattgcatggctaccggtacatacaaacctcagatccatgtctacgattttgctaatttgtcactgaagttcgatagacacacagatgctgaaaacgtggatttcactattctctctgacgattggactaaaagtgtacatttacaaaatgatagaagtattcaattccaaaacaaaggtggtctacattacaccacaagaattcctaaatttgggagaagtttagtttacaataaggtaaactgtgatttatatgttggtgcgagcggtaatgagttatacaggttgaacttggaaaaggggagatttttaaacccattcaagttggatactgaaggcgtgaaccatgtttctatcaatgaagtaaatgggttgttagcggcaggcacggaaacaaatgtagtggaattctgggatccaaggtcgcgttcccgtgtttcaaagctatatttagagaacaatattgacaacagaccattccaagtcaccacaaccagtttccgtaatgacgggttaacttttgcatgtggtacgtcgaacggttattcatacatttatgacttgcgtacttctgaaccttccattattaaagaccaaggttatgggtttgacattaagaaaattatttggttggataacgtcggcacggaaaataaaattgttacatgtgacaagagaattgcaaaaatatgggatagactagatggtaaggcatacgcttctatggagcctagtgttgatattaacgacattgagcatgtaccaggtacaggtatgtttttcaccgctaacgaaagtattcccatgcatacatattatattccaagtttaggaccatctccacgctggtgctcattcttggattctatcacagaagaattagaagaaaaaccaagtgacactgtttactctaactacaggttcattactagagacgacgttaaaaaattgaatttaacgcacttggtgggatccagagtattaagagcatacatgcatggtttctttattaacactgaactttacgataaggtttcattaattgctaatccagatgcctacaaagatgaaagagaaagagaaattagacgtagaattgagaaagaaagagaatccagaatcagaagttcaggggctgttcaaaaacctaaaattaaagtcaataaaacattggttgataaactatctcaaaaacgtggtgataaagttgcaggaaaggttcttacggatgaccgtttcaaagaaatgtttgaggatgaagaatttcaagtcgatgaagatgactatgatttcaaacaattgaatccagtaaaatccatcaaagaaaccgaagaaggtgctgctaaacgtattagggcgctaactgctgccgaagagtccgacgaagaaagaattgcaatgaaggatggcagaggtcactatgactacgaggatgaagagtctgatgaagaagaatctgatgatgaaacgaaccaaaagtcaaataaggaagaattaagtgaaaaagatttgagaaagatggaaaagcaaaaggcactaattgaacgcagaaagaaggaaaaggagcaaagcgaacgttttatgaacgaaatgaaagccggcacttccacgagtacgcaaagagacgaaagtgctcacgttacatttggcgaacaagtaggcgaattgcttgaggtggaaaatggaaagaaatcaaatgaatccattttacgtcgtaaccaacgcggtgaagcagaacttacttttattcctcaaagaaaaagcaaaaaagacggaaattataaatccaggcgtcatgataattcatcggatgaagaaggtattgacgaaaatggtaataagaaggacaatggtaggtcgaagcccagattcgaaaatagaagaagagctagcaaaaatgcgttccgtggtatgtag

SEQ ID NO: 4611 - DNA, 2124 bp, Saccharomyces cerevisiae
atgtcagaacaactcagacaaacatttgctaacgctaaaaaagaaaacaggaacgccttggtcacatttatgaccgcaggttacccaacagtcaaagacactgtccctattctcaagggtttccaggatggtggtgtagatatcatcgaattgggtatgcccttctctgatccaattgcagatggtcctacaattcaattatctaatactgtggctttgcaaaacggtgttaccttgcctcaaactctagaaatggtctcccaagctagaaatgaaggtgttaccgtacccataatcctaatgggttactataaccctattctaaactacggtgaagaaagatttattcaggacgctgccaaggctggtgctaatggttttatcatcgtcgatttgccaccagaggaggcgttgaaggtcagaaactacatcaatgataatggtttgagcctgatcccactagtggctccttctaccaccgacgaaagattggaattactatcgcatattgccgattcgtttgtctacgttgtgtctagaatgggtactactggtgttcaaagttctgtggccagtgatttggatgaactcatctctagagtcagaaagtacaccaaggatactcctttggccgttgggtttggtgtctctaccagagaacatttccaatcagttggtagtgttgctgacggtgtagtgattggttccaaaatcgtcacattatgtggagatgctccagagggcaaaaggtacgacgttgctaaggaatatgtacagggaattctaaatggtgctaagcataaggttctgtccaaggacgaattctttgcctttcaaaaagagtccttgaagtccgcaaacgttaagaaggaaatactggacgaatttgatgaaaatcacaagcacccaattagatttggggactttggtggtcagtatgtcccagaagctcttcatgcatgtctaagagagttggaaaagggttttgatgaagctgtcgccgatcccacattctgggaagacttcaaatccttgtattcttatattggccgtccttcttcactacacaaagctgagagattaactgagcattgtcaaggtgctcaaatctggttgaagagagaagatcttaaccacacgggatctcacaagatcaacaatgctttagcacaagttcttctagctaaaagattaggcaagaagaacgttattgctgaaaccggtgctggtcaacacggtgttgccactgccactgcatgtgctaaatttggcttaacctgtactgtgttcatgggtgcagaagatgttcgtcgccaagctttaaacgtcttcagaatgagaattctcggtgctaaagtaattgctgttactaatggtacaaagactctaagagacgctacttcagaggcattcagattttgggttactaacttgaaaactacttactacgtcgtcggttctgccattggtcctcacccatatccaactttggttagaactttccaaagtgtcattggtaaagaaaccaaggaacagtttgctgccatgaacaatggtaaattacctgacgcagttgttgcatgtgttgggggtggttccaactctacaggtatgttttcaccattcgagcatgatacttccgttaagttattgggtgtggaagccggtggtgatggtgtagatacaaagttccactctgctactctaactgccggtagacctggtgtcttccatggtgtcaagacttatgtcttgcaagatagtgatggtcaagtccatgatactcattctgtttctgctgggttagactacccaggtgtcggtccagaattggcatattggaaatctactggccgtgctcaattcattgcagctactgacgctcaggctctgcttggctttaaattattatctcaattagaaggtattattcccgctttggaatcttctcatgctgtttatggcgcttgcgaattggctaagacgatgaagcctgatcaacatttggttatcaatatttctggtagaggtgataaagatgtccaaagtgtcgctgaagtcttgccgaaattaggtccaaagataggttgggatttgagattcgaagaagacccatctgcctaa

SEQ ID NO: 4612 - DNA, 2126 bp, Saccharomyces cerevisiae
atgtcatttttaaagttcgcttatagaaactcttggcgatactatagcaagtccacacggcattttcataaaatacctataagacagttcataatacctacgtcaattgctttttatttgacacaaaattcgtttccaaaacaaaattgtttgatatacaatgattctctaaaaccggatcccaaaggtgatacttttgaaatgggcctctacgtttcctcagaaaacgaattgcaggaaaagcttaaatctttcaggtctgctaagatcactgaatcacgaaataaattaataagatatctaagaatcttttggttcggttttaatgataatattgttgagcctgtatgcacgattttaaggtttttagaaatttcagctatttttttacctcttctcctattataccccatatcatggtttggtcataaactcaaaattacggacaccaatataactgaaactcgaggttcattgatttggtgtcaactactgcgtaaagcattggaattggctggcccgagtttcattaaactcggacaatgggcaggatcgagaaccgatatattctctcacgcactgtgtcatgagttgggtaaattgcatagtaacgttacagctcactctctaagctttactctggaaaaactttctcaagcattaaaggttgacaagatcgaagatgcttttgatgaatttaatcgaacaccaattggagttgggtccatcgcacaagtttacgtgggtgaactatcccaaaagtacatcgataaatatgacaatatacaaattggtaaggatggaaatcgttggtgtgccatcaagatcttgcatccaaatgtaagatctcagatccggagagatttgaaaataatgaaattctgtgctgacgcaataaattggattccgactatggaatggctgtctttacccagcgaagtcgatcagttttccatattaatgaatattcagttggatctaagaattgaggcgttaaacctggaaagattcaatgagaactttaaaaattctattcaggtgaaatttcctaaaccatttctccccttgtcaaatagggatgttatgttcgaagagcatgtatatggtctttccatggaaaagtttttatctacgaagaagcaaattaacgacgttgaactttgtaaaaaagtcagtgatcccttcgttgacgcgtttctacaaatgctaattcttgatgattttgttcatgctgatttgcatccaggcaatgttataatcagatttgtgaagacgaacaaatacggcacaaacattatatcctccgaacttgaatcgtacagaataacgcacgacctgaggaagaagatagaggaggaccaagatcaggactttgttggaaaactgaagtctgtattaactaattacactccccaaatttgttttatcgatacaggaataattacagaattgaatgaaaaaaacagaattaatttcatagctctattcaacgcattggcccgatttgatggttatagagctggtgagttgatgattgagagatcaagaactccagaaacagctattgataaggaagtatttgcgtttaaggtagaaaagctagtggataaagttaaacaaagaacatttacattgggaaccgtctcaattggcgatttactcgatcaaatgcttagtatggtaaggtcgcaccatgttagaatggagtccgactttgtttccgtggtggtcgctattttacttctagagggtattggacgccagttagatccaaacttggacttatttgaaaggttcgtattttacgcatggattaacggttttaaagaataacatcaattttttaaaacccttttctattgcttttttttgctttttattgctactaaagaaattcttttactaacaaaaatacccacatcttgtaacttctcttcgtaaacagttcgctgcctatattacgtgaattcgggtttaagcgggaagccaaaagtctcttgaaagatgcaagcacattatcaatgctcaagatatgggttggtttagaagtgcgtcaattaatgcatctctcgatgaagcaaatatacgatcttgtcaggactgatcaattgtgtcctaattattaa

SEQ ID NO: 4613 - DNA, 2127 bp, Saccharomyces cerevisiae
atgccatctaccttgactattaatggaaaagccccaattgtggcttatgctgaactaattgctgctcgtattgtgaatgcgttagctcctaactccatagctattaagttggtggacgataagaaagcacctgctgccaagctcgatgatgctactgaagatgtcttcaacaagataactagcaaattcgccgccatcttcgataatggtgataaagagcaagttgctaaatgggttaatctggcccaaaaggaattagttatcaagaactttgctaaattatcacaatcattggaaacactagattctcaattgaacctaagaacctttattcttggcggcttgaagtattctgccgctgatgtagcatgttggggtgctttaagatccaatggtatgtgcggttccatcatcaagaacaaggttgatgttaacgtttctcgttggtacactttgttagaaatggatcccatcttcggcgaagctcacgatttcttgagcaaatctttactagaattaaagaaaagtgctaatgtgggtaagaagaaggaaactcacaaggctaactttgaaattgatttgccagatgccaaaatgggtgaagtcgtcactcgtttcccacctgaaccttctggatacttacatattggacatgccaaagctgccttgttgaaccaatattttgctcaagcttacaagggtaagttgattattagattcgatgacaccaacccatcgaaggaaaaggaagaattccaagactctattttggaagatttggatttattaggaatcaagggtgatagaataacctactcatctgactacttccaagaaatgtacgactactgtgttcaaatgatcaaggatggtaaagcttactgtgacgacactccaactgaaaagatgagagaagaacgtatggatggtgttgcttctgccagaagagatcgttctgttgaagagaacttaagaatttttaccgaagaaatgaaaaacggtactgaagaaggtttgaagaactgtgttcgtgccaagatcgattacaaggctttgaacaagactctaagagatcctgtcatttacagatgtaatctaacccctcaccacagaaccggatcaacttggaagatctacccaacttatgatttctgtgtcccaattgttgatgctattgaaggtgttacccacgctttacgtaccattgaatatagagaccgtaacgctcaatatgattggatgttacaagctttgcgtttgagaaaagtccatatttgggatttcgctcgtatcaatttcgttagaaccttgttgtctaagagaaagttacaatggatggttgacaaggacttggtcggaaattgggacgatccaaggttcccaactgtcaggggtgtgagaagaagaggtatgactgtcgaaggtttgaggaacttcgtcttatcccaaggtccatccagaaatgtcattaacttggaatggaacttgatctgggctttcaacaagaaggtcattgatccaattgctccaagacacactgctatcgtcaacccagttaaaatccacttggaaggctccgaagctccacaagaaccaaagattgaaatgaaaccaaaacacaagaaaaacccagctgtgggcgaaaagaaagtcatttactacaaagacattgttgtcgacaaagatgatgctgacgtcatcaatgttgatgaagaagtcactttaatggactggggtaatgtcattattactaaaaagaatgacgatggttctatggttgccaaattgaatttggaaggtgatttcaaaaagaccaagcacaagttgacttggttagctgatactaaagatgtcgtccctgttgatttagttgacttcgaccatttgattaccaaggacagattggaagaagacgaaagtttcgaagatttcttgactcctcaaacagaattccacacggatgccattgctgacttgaatgttaaggatatgaagattggtgatatcatccaattcgaaagaaagggctactacagattggatgctttacccaaggatggtaagccatatgtcttttttaccatcccagatggtaaatctgtcaacaagtatggtgcaaagaaataa

SEQ ID NO: 4614 - DNA, 2127 bp, Saccharomyces cerevisiae
atggaggattcggactccaacacagataaaaagttctttttcaaaaaaagaagaatcgattcctataattatagcgatgaggaagataataattcaagcatgaatagtgacatgacatacactaatgatgccttgaaaactagtagcggcaatgccccaacgatctcaaaattaacgaagacatatggtattggtgcgaagttactttcgagtatgggatatgttgcgggaaaaggccttgggaaggatggttctggtataactacaccaatagaaacccaaagccgacctatgcacaatgcaggtctaggaatgttttcaaataccaactccagtaactatcacagtgaaaatgaggattacttgagctctgaggatgaggtggttgaaggtatagaacaagtcaaattcaataaaacctccacggaggttttaggcgaagcgttgttaaatgatagtggtgatatgactatagtgcgaacactgagagaattgaggttagcaggggtacaattaccagagagtatcctaaaagaattagaccctttaaatgcagtaccaaagccgaaaaaagatgttgttgtggagatattgcaagagctgctgggtattgaaaaaagtttggaagctattcgtcagcgcacctctccgttagaagtgcaagtcaaagaatattatggacaagagaggcttctttctgaattggaggttactttgagggacgaaagcaagcatgtttccctgtatgataagattggtgctattttaaaattgtccgacgacgagctcatagataggctaacgtcctgcttattgagaaaagaattactaatagaatttgatttggatcatttagaaaagccaaacgatatacttgatgagttaacgcaaattatagaactactcgcatatagaatggatacaacttcgaaatttttgaacaggacacaaacaacaatctttaaagttatatatcccaaactcaaaaaattttgggaagggtttgatatgactaaatcaaaaatcgacagcgctatcaccctattactggatttccaacaagtgctaagttttatcgggtgtaaagagcatatcatggaggaattcgtctatccaaagctattacaggaattagataattgggaacttcacgatgaagtagaccatgtttcgccaagaatatgggtcttggattttatggttttaattgacgataagatcaaagacacaattgtggacaagattgaagcaaaattttttgcttattgtaaaaattggtaccatagggaatcattttgtatcactaattctgatattatatttatcaaagaacttatctgcgaacgaagatattacaaaattttatgtaaagagtttcttcctaaattcctggacgagctgtgggaaagacataatgaccccatctacgagttagaggattggaaggaaaaacaggaatggaaagaaaaagattctggatttttctattttatgaaaaaactgagaagttatacccattattttcatccaaaacagtatgaattgatgatgcggggaacctttaataatataaacaaaatactctatcaatggcatctttatagtacagtggaagacttacacaagtcaaagtggtggcttaattggctgatgaatacggtatttgagcactctttaccaacagaaatagaactatcggagatcagaaaaagctataatatattcgctatgtctcataggtaccaccttgataaatctacattagatgaagatttcgatttgagacagggtttacgaaacttaatggaaacacaagtgatcgacgatattagtcaaagcgaacaagaacctacctatactgtacaaaatattccgcttggaaaagttagcagctctttcaaggatgtggtagaagactactgcctggaaaaagggtacttgatcagcaaaataccaaataggtacactcaactgccatatggaagagaccaagattgtatagttcctttatttgagatccgaaacgggaagaaaaaaatggaagttgctttgaaacatgatattctttgggtggaggattccagtgggacctttaagccaatttatttatgggcccttgacctctag

SEQ ID NO: 4615 - DNA, 2127 bp, Saccharomyces cerevisiae
atggctactggcaggattcaatttgctgtttctactccctgcaatactaagggtaaaccgtctggttataggttatttgaatttaaaaacgatcgattagcactggtcccatcagaaagaggttgtacaaaagtagatgtgaatgcaaatatacaagcgttttgttatttaaggcctaatggtagagacacgtcaatatctccagacgcaacgcatattttggactcatgtgattacatggtgctggctaaatccaacggattcattgaaatcataagcaactatcaatacaagataaaaaatggcctgcgattagcgccctcttatatccttagatgtactccggaagatttcgaatccaatttttttagtgactatatgatcgctggtcttgaatatagtcaaggtttattatattgttgtatgtgctccggtcgaatatatgtctttgtaatgaaccttcccactgattacattcagtataagaacatgtacaaccccatgtttccagattgctttttcaaagtacatcacgataataatacaacacattcttcagaagaagaaaaattatttgaaggtagtacgcggtacactggaaggtcatgctctaagcatatctgctacttccttttgcctatagaaccatcccatttaagatcgtcacccgtggtatcttcgttttgcaatatgtatcaaggcctgcccatatataggccttcgatgtatttacatatagaacgaggtatttccacattccatataaatccattagaccggttttgtttcatgacagtatcgccacgatcaccactatttataaggaaaataattttaccattgacttatgttacatttttaagcacctttatcagcctaaagaacagtatacagggagatacatgcggtgagatactttcgtgggacaacgtagcgcaacaaaatggatttggttctttgttcagctggattagtaacaagtttacattcgatacggatattataaattcaaccatttgggatgatattgtaaaatattctggaacaggaatgctggattcaggaatcgtctggaaacagcgtcaaggtcacgctaaagatgacatatatgagttattccacactcaagatatgctgggaagtagtcgccgaaattcttcattcagtactgctagcagcgaaccgagaccgctgagtcgaagaaggagagaatcttttcaagccttaactagagacgcttttagagaaagaatggatgtaccctgttcaacgaagtgggaattagattcttttatccgaggattaagaaggaatacatttatggtagattttgaaattgttgaaaagatttctcatagaaatggaaatgatggggtgaatgaagatgataacactacagatgaaagtgatgaaacaatgacttcttttctaacagataattacaaaaagatggacattgtgtgcatcgatcatttcgtcacgttgagtgcattccgacctcggtactatgatgaaccaataattaaaatcgattcattatcgaacaaaaatggctctgaaaatggaactaatgaagaagagtgggcagaaagtcaaatgaaggtggatggccaagtgatagatgatgagacagctcaattcaagcaggcattgggaaatttatgttcattcaagaaattatttatgctggatgattctttatgctttatattggacacacatggagttttgttgataaatagatttgaaataaaaaataccaaaaatttgttaaggaattccaaggatactattcggataataccccatgatttcggattgattaatgatacaattgttataattaatgatatagacgtaggcacagacaatgtttgcgcccttacgtttcacttggtggtaacatcaatggcaggagagataactgttcttaaaggcgaatttttcaaaaactgcaggttaggaagaataaaactgtgcgattcactaaagctaaatagaaaagatcggtttgtcgacaaacttgctctaatcgattatgacggtttaaatgcacaaaaaagaaggttagattacgatgaaaaggacctttatacattcattgtgaaaaaggtaaaaagagactaa

SEQ ID NO: 4616 - DNA, 2127 bp, Saccharomyces cerevisiae
atggctcgtgacttacaaaatcatctactgttcgaagtagcaacagaagtaactaacagggttggtggtatttactctgtcttgaagtccaaggctccagtcactgtggcacaatacggagacaactatacgctgcttggacctttgaacaaggcgacttatgaaagtgaggttgaaaaacttgactgggaagatgaaagtatctttcctgaagagctgttaccgatccaaaaaactttgatgtccatgcgggaaaagggtgtgaactttgtctacggtaactggttgattgagggagcaccacgtgtcattttatttgagctggattctgtaagacactttttgaacgaatggaaggctgacctatggtctctcgtcggaattccatcaccagagcatgatcacgaaacaaacgatgccatattgttgggttatgttgttgtgtggtttttgggagaagtttcaaaactggacagtagccatgccatcattggccatttccatgaatggctagctggtgtagccctgccattgtgtagaaagaaaagaattgatgttgtaacgattttcaccacgcacgcaactttattgggtagatacttgtgtgccgctggtgatgtagatttttataacaatctacagtattttgatgtggaccaagaagctggtaagagaggcatatatcataggtactgcattgagcgcgctgcggctcatactgccgatgtttttacgactgtgtcgcaaatcactgcattagaagcggagcatttgttgaagaggaaaccggatggcattttgcccaatggtttgaacgttgttaagtttcaagcagtacatgaatttcaaaatctgcatgccctgaaaaaggacaaaattaatgatttcgtcagaggccatttccatggttgttttgatttcgatctagacaacacagtttatttctttatcgctggtagatatgaatacaaaaacaaaggtgctgacatgttcattgaatcattggctcgtctcaattacagattgaaggtttctggatccaagaagacggtggtagcgtttttgatcatgcctgccaaaaccaattccttcactgtggaggcactgaaaagccaagccattgtaaaatctttggaaaatactgttaatgaggtcaccgcatccattgggaagagaattttcgagcatacgatgagataccctcataatggcctagaatcagagttgcccactaatttagatgagctgttgaagagttctgaaaaggttttgctgaagaaaagggtattggcgctgagaagaccttacggggaattgcctccggtagtcacacataacatgtgcgatgatgctaacgatccaattttaaaccaaattagacatgttagattattcaatgattcgagtgatcgtgtaaaagtgattttccatcctgaattcttaaacgccaataaccctatccttggtttggattatgacgagtttgttcgcggctgtcacttgggtgtttttccatcctattacgaaccatgggggtacacgccagcagaatgtaccgtcatgggtgtcccatctatcacaacaaacgtttctgggttcggtgcctacatggaagacttgattgaaacagaccaagcgaaagactatggtatttatattgtagaccgtcgtttcaagagccctgatgaatctgtcgagcaattagcagactacatggaagagtttgtaaacaagaccagaagacaaagaatcaaccaaagaaacagaaccgaaagactatcagacttgttagattggaagagaatggggttggaatacgttaaggctagacagttgggtcttcgtagggcctatccagagcagttcaagcaactggtgggtgaaacaattagtgacgccaatatgaatactcttgccggtggcaagaaattcaagattgccaggcctttgagtgtacccggatcccccaaagtaaggtccaatagtactgtttacatgactccgggcgatttaggtacccttcaagatgctaataatgcagatgactattttaatttgagcacgaatggagccatcgacaatgacgatgatgacaacgatacgtctgcatactacgaggataattaa

SEQ ID NO: 4617 - DNA, 2130 bp, Saccharomyces cerevisiae
atgagtaataaggaagagcatgttgatgagacttccgcaagtggtgtcaaggaggttagttctatagctgctagacatgacaatggttacgcgccttcgctaatcacgtcgacgtcgggcatggactcctttcaatcgcacgcgctactgaatgatccaaccctaatagaggattattcagatatcattaataataggcctacaagtggaagtaaacttactttaggaaacgaggattcggagagtatgggcggaagtgttgtggtgactccgacttcgaataagagttcgcccttcaattcgaaacttaatatactgagtaatgcggcagaaaagggccatgatgttctgcgaaatagagatgatgacaaagagttagaggaggagaacgtggaaaaacatatgcatagcaacagtaaaagggatcagcgacattacaaagaaaattcttcggaattgcccgactcatatgattattcggattctgaatttgaggacaatttggaaagaaggctacaagagatcgaaactgattccgtggatagcgccgataaggatgaggtgcatttttcagtgaataatacaatgaaccctgacgttgacgattttagtgatggcttgaaatacgccatctcggaggacgaggatgaagaggaaaactactctgatgacgatgactttgacagaaaatttcaagattcagggtttcaaggggagaaagacgatttggaggaggaaaacgacgattaccaacccttatcgccgccaagagaactggaccctgataaactatatgctttatatgcgttcaatggccatgattcttcacattgtcaattagggcaagacgaaccttgtatacttttgaatgaccaggatgcctattggtggctggttaagaggatcactgatggtaaaatcgggtttgcgccagcggaaattctagaaacctttccagaaagactagctcgattgaattgctggaaaaatgaaaacatgtcttctcaatcggttgcttcctccgattcgaaagatgattccatcagctctggtaacaagaatcaaagtgatgcagagagtataattccgacacctgcactgaatggatatggtaaggggaacaaatctgttagtttcaatgatgttgtcggttatgcagacaggtttatagatgatgcaattgaagatacctcgttagatagtaacgatgatggcggtgaaggcaatggacagtcgtacgacgatgatgttgataacgacaaggaaacaaaagtaacgcaccgggacgaatacactgaagcgaagttaaattttggcaaattccaggatgatgatacgagcgatgtagtgagcgacgtctcctttagtacatctttgaatacaccactaaatgtgaaaaaagttcggagacaagacaacaaaaacgaaagtgagcctaagacatcatcgagtaaagacagagaagatgattataatgcaaatcggtatgtggggcaagaaaagtctgaaccggttgacagtgattacgataccgatctgaaaaaagtatttgaagcgcctcgtatgccatttgcgaatggtatggcaaaatcagactctcaaaattccctttcaacaattggcgagttttcaccgtcgtcgtcagaatggacaaacgaatcaccatccactccaatagttgaagaaagcagcagtattccatcatctagagcaataaaggacatttcacaatatattcatgcaaaatcgaaaattgaagagacaacaaacgtggaaaacacagaggggcaaattcaagccagcttggggtctagtggaggaatggcaaatcaaactgacgcagaacaacctaaagaggagctagaaaaacatcacagtacccccgaagaagaaaagcaatcaaccttatcgttacactcatcatctgaagaagatttttatatggatgaacaaagggcggtatcatcagcaagcataaatagttcactttccggatcaagggcattgtctaataccaatatgtccgatccggcttcgaagcccaattctttggttcaacatctctatgctccagtttttgacagaatggatgtgttgatgaaacaattggatgaaattattcgtaaatga

SEQ ID NO: 4618 - DNA, 2130 bp, Saccharomyces cerevisiae
atggatacatcaaactcttggtttgatgcctcaaaagtacaaagcctaaattttgacctacaaaccaactcttattactcaaatgctagaggcagtgacccttcgagttatgcaatagaaggcgaatataaaacactagcaacagatgatttaggcaatatattgaacctaaactatggtgaaaccaacgaagttataatgaatgaaataaatgacttaaaccttccgctgggaccactttctgatgaaaaatctgtcaaggtttctactttctccgagttaataggaaatgattggcaaagtatgaactttgacttagaaaataattcaagagaagtgactctaaatgcaactagcttgttgaatgaaaatagattaaatcaagacagtggtatgactgtttatcaaaaaacaatgagtgataagccccacgatgaaaagaagatttccatggcggataatttattgtcgactataaacaaaagtgaaattaataaaggcttcgatagaaacctcggggaattactgttacagcaacaacaagagttgcgcgagcaattgagagcacaacaagaggctaataagaagttagagttagaactcaaacaaacacaatacaagcaacaacaactacaggctaccttagagaactctgatggtccacagtttttatctcccaaaaggaagatctctcctgcttcagaaaatgtggaggatgtatacgcaaatagcctttcaccaatgatttccccaccaatgtctaatacttcgttcactgggtcaccttctaggagaaacaatagacaaaagtactgcctgcagagaaaaaactctagtggtactgtaggaccactatgtttccaggaattgaacgaaggtttcaatgactccctcatttcaccaaagaaaattcgctcgaatccaaatgaaaacctcagttcaaaaaccaaatttattacgcccttcactccaaagagtagagttagttcagctacgtccaactctgctaacattacccctaataacttaaggttagatttcaagattaatgttgaagatcaggaaagcgaatattcagagaaacctttgggcctgggtattgaacttcttggaaaaccaggtccttctcctacaaaatcagtgtctttaaagagtgcttctgtggatattatgcctacaattcctgggtctgtaaataatactccatcagtcaataaagtatccctttcctccagttatatagaccaatatacaccaagaggtaagcagttacactttagctctatcagtgagaatgcattgggtatcaatgctgcgacaccacatctaaagccgccgagccagcaagcacgacatcgggaaggcgttttcaatgatttagaccctaatgtacttacgaaaaatacagacaatgaaggagatgataatgaggaaaatgagcctgaaagtagatttgttatttccgaaacgccttctcccgttcttaagtcacaaagtaagtacgaaggaagatctcctcaattcggcacacacattaaggaaatcaacacatataccacaaatagtccctcaaaaatcacaagaaaactcacaacactgcccagaggttcaatcgataaatatgtgaaggaaatgcctgataaaacatttgaatgtttatttcctggatgtacaaaaacattcaagagaaggtataacatcagatctcatattcaaacacatttggaagatcggccatattcctgtgatcaccctggatgtgataaggcatttgtacgaaatcatgacttgataagacacaaaaaatcgcaccaagaaaaggcgtatgcatgtccctgtggtaagaaattcaatagagaagacgctttggttgtgcacagaagtagaatgatttgcagcggtggtaaaaagtatgaaaacgtggtaattaaaaggtctccaagaaaaagaggaagaccaagaaaagatggaacttcaagtgtttctagtagtccaatcaaagaaaatattaacaaggatcataatggacagttgatgttcaagcttgaagatcaactcagaagagagcgtagttatgatgggaatggaacggggattatggtttcgccaatgaaaactaatcaaaggtaa

SEQ ID NO: 4619 - DNA, 2130 bp, Saccharomyces cerevisiae
atggctagtgaaacttttgaatttcaagctgaaattactcagttgatgagtttgatcatcaacaccgtctattctaacaaggaaattttcttgagagaactgatatctaatgcctcggatgcgttggataaaattagatacaaatctttgtctgatccaaagcaattggaaacagaaccagatctctttattagaatcactccaaagccagagcaaaaagttttggaaatcagagattctggtattggtatgaccaaggctgaattgattaataacttgggtaccattgccaagtctggtaccaaagccttcatggaagctctatctgctggtgccgatgtatccatgattggtcaattcggtgttggtttttactctttattcttagttgccgacagagttcaggttatttcaaagagcaacgacgacgaacaatacatctgggaatccaacgctggtggttctttcactgttactctagacgaagttaatgaaagaattggtaggggtaccatcttgaggttattcttgaaagatgaccaattggagtacttggaagaaaagagaataaaggaagttatcaagagacattctgagttcgtggcctacccaatccaattagtcgtcaccaaggaagttgaaaaggaagttccaattccagaagaagaaaagaaagacgaggaaaagaaggatgaggaaaagaaggatgaagacgacaagaaaccaaaattggaagaagtcgatgaagaagaggaaaagaagccaaagacgaaaaaagttaaagaagaagttcaagagatagaagaactaaacaagactaagcctttgtggactagaaacccatctgatatcactcaagaagaatacaatgctttctataagtctatttcaaacgactgggaagacccattgtacgttaagcatttctccgttgaaggtcaattggaatttagagctatcttattcattccaaagagagcaccattcgacttgtttgagagtaaaaagaagaagaataatatcaagttgtacgttcgtcgtgttttcatcactgatgaagctgaagacttgattccagagtggttatctttcgtcaagggtgttgttgactctgaggatttaccattgaatttgtccagagaaatgttacaacaaaataagatcatgaaggttattagaaagaacattgtcaaaaagttgattgaagccttcaacgaaattgctgaagactctgaacaatttgaaaagttctactcggctttctccaaaaatatcaagttgggtgtacatgaagatacccaaaacagggctgctttggctaagttgttacgttacaactctaccaagtccgtagatgagttgacttccttaactgattacgttaccagaatgccagaacaccaaaagaacatctactacatcactggtgaatctctaaaggctgtcgaaaagtctccatttttggatgccttgaaggctaaaaacttcgaggttttgttcttgaccgacccaattgatgaatacgccttcactcaattgaaggaattcgaaggtaaaactttggttgacattactaaagatttcgaattggaagaaactgacgaagaaaaagctgaaagagagaaggagatcaaagaatatgaaccattgaccaaggccttgaaagaaattttgggtgaccaagtggagaaagttgttgtttcttacaaattgttggatgccccagctgctatcagaactggtcaatttggttggtctgctaacatggaaagaatcatgaaggctcaagccttgagagactcttccatgtcctcctacatgtcttccaagaagactttcgaaatttctccaaaatctccaattatcaaggaattgaaaaagagagttgacgaaggtggtgctcaagacaagactgtcaaggacttgactaagttattatatgaaactgctttgttgacttccggcttcagtttggacgaaccaacttcctttgcatcaagaattaacagattgatctctttgggtttgaacattgatgaggatgaagaaacagagactgctccagaagcatccaccgcagctccggttgaagaggttccagctgacaccgaaatggaagaggtagattag

SEQ ID NO: 4620 - DNA, 2130 bp, Saccharomyces cerevisiae
atgttggaagagcaactatatttgttagcttgcatttttgcatctagggctgacacgcgcaatatcaaaaagttgtctactagactgggctcacaatccaagtacttggagattctctgtgttttgtggccagaattagatgacccaaaaaaccttttgtttcttcgtgaattagaagaggaggtgcaaagtccggaaggggaagaaacaaccgacgaagatgtaatagtagaactattagaaagtgacagcagtttgattccattaattgaaagtgataccacaacgagatcgaacagatatcatgaactgcaagaattcataagcaaaaaactcaataacaagaccttggagaattttgaggagtggttgagagaaaggattttaatatgtaatgaaatgatacctgaaacacctttattatattctgtactatgggagactgccaagtcaaaagtgttatctacaaaatttataggatgggtagaaggagtattaaaacccctcgaccacctaaataaacggcttcatctcatatttaaaatcaacgaatgggaaaaaatgcctgatagcgagttatttaagataatatttgacggtgtagaggatatgcaaggatatattggtatagcagatgttattgaagatgaattagctcccactttgtcttatgggaagaaatgggaaacgttcattacggaattcttcaataaacagcagttctcactaaaatctgatactaattaccagttatttataaagctctattacagtctcgaaaaaggagtaaaagataacagtgaagcgtccagaaaattgcaaagtaatgtggttgatatattatttcacaacagtgagaatttatttaatttatccagtttaactcataagcttgatgaattatggagtatcttgagtggattccctgatgaaattacaatagaagaacagaaaactattactgctctagagatgaaacaatttatggaattcttcatcaaatgttccacgaaattttcatttaaagaaatctttgccataacacaggaagaagaatcggctcagttggcccatttctcttcactatgccatgaagaatttaacaaagccaacgaaatctccagttttttgcaagccatgtatgaaacggtcttggacatcagcaaggatgataaaattttcacccgaattagtatggatgaaaagctatacagtatattggaaatcctcttacaaatgaatgagttcgcgtacattgaagccatcatagaaagattcgactacagtaacaatacccaaatatatgaacttctggtgaagttcttctggcatttcttcaataatgcttctaatggattacgtaaagagcctgaaatgaaaaaagcttcgcaaacgttacaaataattcagaagcatatgtcgcaacgggcaggcacaaatctaactaagctggaagtattgcttgagatatcagacaaattgtcgcattattccataaacctaaataagtcgcacaatggcgcaagagataccgctttcaaaccaagcaacattctagaatatagagattgccccctcgatataatatccaacttattagagctgaacccgcgattgtataaggatctgccaactacaaaaagcttgttattcgggatttacgacagcttatccattaatagagagggccaaacgggtaaagtggaagtggatttgatggtattacatattgactatgccttggtgaatttagattttggcacagcatacgaattgggcaagcaagtgtttgaaatttgtcaagaagcgggccaacatatgatgaaggcgttgggcgatgagcattggttaacattttatcaaatggggaagtttgtcgatccaaattgggtggataatgaaattcccacagagataattgttctgcagatgagcatcttgggccgcttactggaggtttgcccccttgaggaagtcgaaattgttacatcgcaatggagcacactagaattggagctaagcgcccgtgacctggtgaaagacaagtacgcactggacggacagaacgacaataagagtaaggtaggcggcattgctagggagattttccacaacgtgactaatttctga

SEQ ID NO: 4621 - DNA, 2130 bp, Saccharomyces cerevisiae
atgtttccctctctcttccgacttgtagtattctccaaacgttacatattccgatcaagccagcgcctttacactagtttaaaacaagaacagagccgtatgtccaaaataatggaagatttacgaagtgactacgtcccgcttatcgccagtattgatgtaggaacgacctcatccagatgcattctgttcaacagatggggccaggacgtttcaaaacaccaaattgaatattcaacttcagcatcgaagggcaagattggggtgtctggcctaaggagaccctctacagccccagctcgtgaaacaccaaacgccggtgacatcaaaaccagcggaaagcccatcttttctgcagaaggctatgccattcaagaaaccaaattcctaaaaatcgaggaattggacttggacttccataacgaacccacgttgaagttccccaaaccgggttgggttgagtgccatccgcagaaattactggtgaacgtcgtccaatgccttgcctcaagtttgctctctctgcagactatcaacagcgaacgtgtagcaaacggtctcccaccttacaaggtaatatgcatgggtatagcaaacatgagagaaaccacaattctgtggtcccgccgcacaggaaaaccaattgttaactacggtattgtttggaacgacaccagaacgatcaaaatcgttagagacaaatggcaaaacactagcgtcgataggcaactgcagcttagacagaagactggattgccattgctctccacgtatttctcctgttccaagctgcgctggttcctcgacaatgagcctctgtgtaccaaggcgtatgaggagaacgacctgatgttcggcactgtggacacatggctgatttaccaattaactaaacaaaaggcgttcgtttctgacgtaaccaacgcttccagaactggatttatgaacctctccactttaaagtacgacaacgagttgctggaattttggggtattgacaagaacctgattcacatgcccgaaattgtgtcctcatctcaatactacggtgactttggcattcctgattggataatggaaaagctacacgattcgccaaaaacagtactgcgagatctagtcaagagaaacctgcccatacagggctgtctgggcgaccaaagcgcatccatggtggggcaactcgcttacaaacccggtgctgcaaaatgtacttatggtaccggttgctttttactgtacaatacggggaccaaaaaattgatctcccaacatggcgcactgacgactctagcattttggttcccacatttgcaagagtacggtggccaaaaaccagaattgagcaagccacattttgcattagagggttccgtcgctgtggctggtgctgtggtccaatggctacgtgataatttacgattgatcgataaatcagaggatgtcggaccgattgcatctacggttcctgattctggtggcgtagttttcgtccccgcatttagtggcctattcgctccctattgggacccagatgccagagccaccataatggggatgtctcaattcactactgcctcccacatcgccagagctgccgtggaaggtgtttgctttcaagccagggctatcttgaaggcaatgagttctgacgcgtttggtgaaggttccaaagacagggactttttagaggaaatttccgacgtcacatatgaaaagtcgcccctgtcggttctggcagtggatggcgggatgtcgaggtctaatgaagtcatgcaaattcaagccgatatcttaggtccctgtgtcaaagtcagaaggtctccgacagcggaatgtaccgcattgggggcagccattgcagccaatatggctttcaaggatgtgaacgagcgcccattatggaaggacctacacgatgttaagaaatgggtcttttacaatggaatggagaaaaacgaacaaatatcaccagaggctcatccaaaccttaagatattcagaagtgaatccgacgatgctgaaaggagaaagcattggaagtattgggaagttgccgtggaaagatccaaaggttggctgaaggacatagaaggtgaacacgaacaggttctagaaaacttccaataa

SEQ ID NO: 4622 - DNA, 2133 bp, Saccharomyces cerevisiae
atgggtaaagtttctaaatcgaccaagaagtttcaatcgaagcatttgaagcatactctagaccaaagaagaaaggaaaagatccaaaagaagagaatccaaggccgtcgtggcaacaaaactgatcaggaaaaggccgatgctgctggtactagggaacaacagcagttgaaaaaatctgcaaaggaagaggtttttaaggacatgtctgtcgaaactttttttgaaaagggcatcgaaattccaaaagagaataaaaaattgaagaaaaaaactacgaaagagcaatctgatgaagattcctcctcttccgaagaggaggaagacatgggacaaagcatggcaaagttggccgaaaaggatcccgaattttataagtatttggaggaaaatgataaagatttattggacttcgcaggtaccaatccattggatggaattgatagtcaagatgaaggtgaagatgctgaaagaaacagtaatattgaagaaaaatctgaacaaatggagctggaaaaggaaaaaattgagctttctttgaaattggttaggaaatggaaaaaacaacttcatgattctccaagcttaaaattactaaggaacataatcagtgctttcaaggttgctgtaaatttgaacaaggaagaaaacatcgaagactataaatatgctatcactgatgagaaagcattccacgaattgatgttcatggtcttgaaagatgtaccacaagcgattcaaaagatggccccatacaagattgtaaaaggcgcaaggaccttaccaaatggaggtaacgtctccagggtctcgtccattgtcaagtcgcatgctggctctttgttgattttattgaatgatattactaatacggaaacagcagcattagttcttcattctgtcaacgaattgatgccttatcttttatcatacagaaggatcttaaaggagcttattaaatcaattgttggagtatggtctacaacgagagaattagaaacccagattgcttcttttgcctttttgatcaataccaccaaagagttcaagaagtctatgctagaaacaaccttaaaaacaacgtactccacttttatcaaaagttgtcgtaaaacgaatatgcgttctatgccactgattaattttcaaaaaaattcggcagctgaattgttcggtatcgatgaagttctaggttaccaagttggatttgagtatattaggcaattggcaattcatttaagaaatacaatgaacgcgacaactaaaaaatccagtaaaattaattccgcagaagcttacaagattgtatacaactggcaattctgtcactccttggatttctggtctcgtgtactatcgtttgcttgtcaaccagaaaaggaaaatggcagtgaatctcctttacgacaattaatttacccattggttcaggttactttgggtgtaatcagattaatcccaacaccacaattcttcccattaagattttatttgattaaatcacttattagactttctcaaaatagtggtgtttttattccaatatatcctttactttctgaaattttaacctcaacggctttcactaaggcacccaaaaagagccctaacttggctgctttcgattttgagcacaacatcaaatgtacgcaagcttatctgaatacaaaaatataccaagagggtttgtcagaacagtttgtggacttattgggcgattattttgctctgtactgtaaaaacattgcatttcctgaacttgtaacaccggttattatctctttacgccgttacatcaagacttcaactaatgtcaaacttaacaaacgtttatcaactgttgtagaaaaattgaaccaaaacagcacattcatccaagaaaagagatcagatgttgaatttgggccaacaaacaaatctgaagtttcaagatttttgaatgatgtagcttggaataaaacacctttaggttcttatgttgcagtacaacgtgaagttaaggaagaaaaggccagattaatgagagaaagtatggaagaacaagacaaagaaagagaaacagaagaagcaaaattattaaacagtctggaaagtgatgatgacaacgaagatgttgaaatgtcagacgcttaa

SEQ ID NO: 4623 - DNA, 2133 bp, Saccharomyces cerevisiae
atgggtaattccggttcgaaacaacataccaagcacaatagcaagaaggatgaccacgacggtgacaggaaaaagacactagatctcccaccactgacaaaatcggatactacacattcgctgaaatcgtcaaggtcgctgaggtcgctgcggtcgaaacgctcagaggcgtcgttggcatctaatgttcaagctcaaacgcaacccctctcccgcagatcgtccactctgggaaacggcaatcgcaaccataggcgatcaaacaacgccccaatcactcctcctaataaccactacctaacctcacatcccagttcgtcaagaagactctcttcctcttcgagaaggtcgagcatggggaataataacaattcagaattgcccccgtcaatgatccagatggagcccaaatcacccatcttgaaaaatagtacaagcatgcattccactagctctttcaactcttacgaaaatgcgttgactgatgatgacgacgataggggggatgatggcggcgagagcccctcaatggccaaagttactcgcatcaacactagttcttccgcagatagaggctccaagcgtactcctttaagacgtcataattcattacaaccggaaaaaggtgtaacaggattttcctcgacttcatcgaaattacgcagaagatcagacaatactctgccagcaagttatcctttaaatgcagaagcaggagggaatggcagcgactatttctcaaacagatcaaactcgcatgcatcatccaggaagtcgtcatttggctccactgggaatacagcttatagcacaccactgcattcacctgcgttaagaaaaatgagctcgagggacaacgacgatagcggagacaacgtcaacggtagaggcacctcacctatccctaatctaaacatagacaagccttcgccgtcagcgtcgtcagcgtcaaaaagagaatatttaagtgcatatccaacactagctcacagagattcatcatcttcacttagtccgcggggcaaaggacaacggtcttcatcgtcttccagttccagtcaaagaatatatgtttccccaccatctcccacaggtgatttcgtacacgggagttgtgcagacggtgataatggatctaggactaatactatggtcgaaatgaaaaggaaaaaaccagttcgtccagtggacatagatgaaattatccagagattactagatgccggctatgccgcaaagaggaccaagaatgtttgcttaaagaattccgagattattcaaatttgccataaggctcgtgaattattccttgcccaacctgctctcttagaattatctccctcggtaaaaatagtgggtgatgttcacggccaatatgcagatcttttgagactttttaccaaatgcggtttcccccccatggcaaattacttatttttaggcgattacgtagatcgcggtaagcagtccctggagaccattttactattactatgctataagattaaatatcctgaaaatttcttcctcttaagaggcaatcatgaatgtgccaatgttacaagagtctacgggttttatgatgaatgtaaacgacgttgtaatatcaagatttggaaaacctttgttgacacgttcaacacgctaccgttagcagccatcgtcacaggaaaaatattttgtgttcatggtggactatcacctgttctaaattccatggacgaaattaggcacgttagtaggcccaccgatgtacccgacttcggcttaattaatgaccttttatggtcggatcctacagattcatcgaatgaatgggaggataatgagcgtggagttagtttttgttacaataaagtggctattaataaatttttaaacaaattcggattcgatttagtgtgtagagcacatatggtggtggaagatggttatgaattctttaatgacagaagcttagttacagtgttttcggctcccaactattgtggtgaattcgataactggggtgctgtcatgaccgttagtgaaggcctactctgttcttttgagttgttggacccactggacagtaccgctttgaaacaagtgatgaaaaaaggcaggcaagaacgtaaattagccaatcgctga

SEQ ID NO: 4624 - DNA, 2136 bp, Saccharomyces cerevisiae
atgagccactttttcgccgatcatgatgctcctctgagcatgctttctgttaaaacagaatactttcctcaattgactgataaggaacaaaaatatgcgcatttcatgtcaaaggcctcccatgcgggttcaagggttgtaatgagacaagtttctcatgagagtgagccaatttttgacctaatccttgccattcattcaaagctaaacggcaagtacccagaggacgatattacgcagaagcagcaaacgggtttgtatttggaatacgtttctcaattcttatctaatttgggtaatttcaaatcgtttggtgacactaagtttattcctcgttgtgaggtaaaattcttcaaacagcttttggagctggccaagattaatccgtgttcttctccgctcactttatctcctgttgacgttaaccatgaattcacatctcatcatcttttttccaccatcaatgagctaattgatattggtatttaccatgtggaagagaaggcggctctcttagggtttccctctcaaggttatacttcagcctattatctgggtttacctgtgacacctgaagatatggctcttttgaaagagcagttgtttgctgaacttgccatcttgcctgaaaacacaagaatcaacaaagttggtgaaaacagtttccaaatctgggttgcctctgagaatgtgaaaaaccagataacagaaacctaccccagtggacagatcacattatccaatgctgtaaccaaagtagaattcatttttggtgatcattcacgtgaaatgcgtttagtagcatcgtatttaaaggaagctcaaaaattcgcggctaatgatactcaaaaagcaatgcttcaggaatacatcaaccactttgtcactggctcttctcaagcacataaagaagcacaaaaactttgggtcaaagatatatctcccgtcattgaaacaaatatcggttttatcgaaacatatagagaaccctcgggcataattggagaatttgaatcgttggttgcaattcaaaacaaagaacgtactgctaaattttccagcttggttaacaacgcagaagaattcatttccttactaccatggtctaaagattacgaaaaaccgattttcaatccaccagatttcacctctctagaagtattaacgtttactggatcgggtataccagcgggcatcaatattccaaactatgatgatgttcggcttaaaattgggttcaagaatgtttctttggggaatatcttaagcgcggctgccaaaagctcatccaagcatccgccaagttttatatcgcaagaagatcgcccaatttttgaaaaatatcaaagtgattcttttgaagtccaagtaggcatccatgaattattaggacatggttcaggaaagttgttgacagaatttacagacggctttaattttgataaggaaaaccctcctttaggtttggatgggaaaccggtgagcacatactacaaagttggtgaaacttggggttccaaatttggacagttagctggcccatttgaagaatgtcgtgcggaagtaattgccatgtttttgcttactaataagaagattcttgatatttttggtttccatgatgtcgaatctcaagataaagtgatctacgctggatatctacaaatggcccgtgcgggtctcctagctttagaatactggaatccaaaaactggtaagtggggacaaccacacatgcaagcaagattttctatcatgaaaacatttatgaagcactctacagataagaatttcttaaagttggagatgaacagcacgaatgatgattttgccatcaagttggataaatctctcattaaaacagcgggacatgaatgtgtgaaagactatttaaagcatttgcatgtttacaaatgttcaggcgatgtggaacagggaagtaagtactttattgatagatcaacggtgacaccggatttggcgtctttaagagacatcgtcttatctaagagattgccaaggagacaattcatacaatcgaattcttatattgacgacaataacaaggtaaccctgaaagaatatgatgaaaccccacagggtatgctccaatctttccttgatagagaattatga

SEQ ID NO: 4625 - DNA, 2136 bp, Saccharomyces cerevisiae
atgcattggacgtccatcttgagcgctattttgcttttctgcctgtcaggagcaagagcatcacctgcaaagacagttattcgtaacaaggtgcccttgcttgtcactaatgcctgcacgaggatttttcaaaaagttacttgggagtataccagcaagtctaagcgttcatcaccagtatgttcttacgaaccagcgtttcaatcaatgctgtattgtatctatgaaacgttggatgaaaaaggttattcgaataaaaccttagaaaaaacatttagtaccatcaaaaaaaactgtgcaagttatagtgatgctcttcagaacatgactaattctgagttttatgacgttctaaacaacggaacgaggcatatgacgccctatgtcaaaggcagtgcaaacctaacatatccagttgaaatggatacacagttaagaaaagcctactatcatgcattgcatggtttctatgctaacttagatgtcggaaacatatatggtggcattatatgtgcttattttgtcgctatcatggcttttgcaggcgttcttcattgcatgaattacactccctttaaaactgttctattgaagcaaaagcttgtgggatatgtaaggggatacctcactctacctaccattggaagcaaacatgcgtcagatttctcttattttagaatattcacaggatatttacctacaagattagagggtatcattattcttggatatctcgtgcttcataccgtttttttggcatacggttatgaatacgatcctgaaaatataatattcaagtctcgtagagttcaagttgctcgatatgtggcagacagaagtggtgtactcgcattcgcacactttccattaatagttcttttcgcgggaagaaacaactttctcgagtatatttctggggttaaatatacttccttcattatgtttcacaaatggttgggaagaatgatgtttttggatgctatgattcatggctctgcatatactagttatacggtagcgaataaaacttgggcaacaagtaaaaaccgattatattggcaattcggggtggcagcactttgtttagctggcacaatggttttcttttcctttgcagtattcaggaagtatttttatgaagcctttctttttcttcatatcgtccttggtgcaatgttcttttatgcatgttgggagcatgttgttagtttaagtggcattgagtggatatacactgctattgcgatttggatcgttgaccggattattagaattatcaaagcttcttattttggtttccccaaagcttccctacaactaatcggggatgatctcattcgtttaacagttaaaaaaccggcaaggccatggagggccaaacctgggcaatatgttttcgtttcgtttttacatccactgtacttctggcagtcacatccatttactgttttggattcagtaagcaagaatggtgaactggttattatcctgaaagaaaaaaagggagtaacaagacttgtcaaaaagtatgtgtgtcgcaatggaggtaagacatctatgagactagctatagaaggtccatatggttcttcatctccggtcaataattacaataatgtattgttactcactggaggtaccggtttgcctggacctattgcacatgcaattaaacttggaaagacgtcagcggctgctggaaaacaatctgtaaaattagtgattgcagttagaggattcgacgtactcgaggcttataagccggagttgatgtgtttagaaaatctgaatgtacagcttcacatctacaacacaatggaagtcccatcattaacccctagtgatagtttagatatttctcaacaggatgagaaggctgatgaaaaaggcactgttgtggcaactactttagaaaagtctgccaatccacttggttttgatggtgttgttttccattgcgggcgaccaaatgttaaggaacttctacatgaagcggctgaattgagtggctcattatctgtggtttgctgtggacctcctatttttgttgacaaagtgaggaatgaaaccgcaaaaatagttttagataagtctgcaaaagccattgagtactttgaagagtatcaatgctggtga

SEQ ID NO: 4626 - DNA, 2136 bp, Saccharomyces cerevisiae
atgtattgggtcctcctttgtggttctattttgttatgctgcttgtcaggagcaagcgcctcccctgctaagacaaaaatgtacggcaagttaccactggttttgacagatgcctgcatgggagttctcggcgaagtaacctgggagtatagtagtgacgatttatattcctcaccagcatgtacatatgaaccggcattacagtcaatgttgtattgtatttacgaatcattgaatgaaaagggttattccaatagaacctttgaaaaaacctttgctgctatcaaagaagactgcgcatattacactgataaccttcagaatatgactaatgcagatttctataatatgctgaataatggaacaacatacataatacagtattctgaaggtagcgcgaatcttacgtatccaatcgagatggatgcccaagtgagagaaaactattattattcttaccatggtttctacgccaactacgacattggtcatacttatggtggtattatttgcgcctattttgtaggtgttatgattcttgccagcatactccattatctaagttacactccgtttaaaactgccttatttaaacaaagacttgtaagatatgtgagaagatatttgacaatacctactatctggggtaaacatgcgtcgagcttttcttaccttaaaatttttacaggcttccttcccacacgatctgaaggcgtcattatacttggatacctcgtgcttcatacagtttttctggcatacgggtatcaatatgatccttacaacttaattttcgactctcgtagagaacagattgctcgatacgtggcagatagaagtggtgtcctggcatttgcacattttcccctaatagctcttttcgcaggaaggaacaattttctagaattcatttctggagtaaaatatacctctttcataatgtttcataagtggttgggaagaatgatgtttttagatgctgtgattcatggcgctgcttataccagttattccgtattctacaaagattgggcagcaagcaaggaagagacatattggcaatttggagtagctgctctttgtatagttggtgttatggtgtttttttctttggcaatgttcagaaagtttttctatgaagccttcttatttctccatattgtgcttggcgcattgttcttttatacgtgttgggagcacgtcgtagaattgagtgggattgagtggatatacgctgctattgctatctggactattgataggctaattcgaattgttagagtatcttatttcggtttccctaaggcttccttacagttagttggcgatgacatcattcgagtcacagtcaaacgaccagtaaggctatggaaagccaaaccaggacagtatgttttcgtttcattcctacaccacctgtatttttggcagtcacatcctttcacagtcttagattcaattatcaaagatggtgagctgactattatcctgaaggaaaaaaagggagtaacaaaacttgtcaaaaagtatgtgtgttgcaatggaggtaaggcatctatgagactagctatagaaggtccatatggctcttcatctccagtcaataattatgataacgtcttgctacttacgggaggtactggtttgccagggcccattgcacacgccattaaacttggaaaaacgtcagcggcaactggaaaacaattcataaaattagtgattgcagttagagggtttaacgtactcgaggcttacaagccggagctgatgtgtctagaagatcttaatgtacagcttcacatctacaatacaatggaagttccggcattaactcctaatgatagtttggaaatttctcaacaagacgagaaggccgatggaaaaggtgttgttatggcaactaccctagaacagtcacctaatccagttgaatttgatggtactgtttttcatcatggaagacccaatgttgaaaagcttctgcatgaagttggtgacctaaatggatcgttagctgtggtttgttgtgggcctcctgttttcgttgacgaagtaagggatcaaacggcaaatcttgttctagagaagcctgcaaaggcaatcgaatactttgaagaataccaaagttggtaa

SEQ ID NO: 4627 - DNA, 2139 bp, Saccharomyces cerevisiae
atgcatagaacgcttctgtttttaacgtggctgatatctttaacaaaggcttttaatataaaattaccacacactgaaaaaaaagaccatttggaatccaacgctgtgctggcatgcgcatcctatataaatactctgaagtggtcatttgatagctccgtcgtaccgggtttctattctaccatatgctcttattcaccagcgtttgatacttggtcactttgtatcttcaattcgcttacagaccagattattcccatggacaacacaagtttcgaagaaagcttgggtaacgtacgaaaaacgtgctcgtttgtcgataaaaagtttagcaatatttcactggagcaatactactcatctttaaataatgcttcttctcacgctttggaagactatggttctattgaaagtttatcgacatccattcgagtcgatcgtgagacaagatctagatggatacgagcttttcatgcgcatgcctataatttagatatcagcagtgtttatggtgcatatttaacttactacttcgtcatagtgggtattatcgccgtcttcttccatatgagtcactataacggcctgaatcgagcgctatttgcaagccggttcgtcaattatattcggggccattttgtgttgcctacgtttttagtagataagcacgctaatcacttcaagtttctaaacgtggaagtctttacgggactgatgccgaattccttggaggcatggatcatttttggatacacattggcgaacatcatatttttgtccataagttacatcatagacccatataacctcattttcaacagtcacctgtcgcagtttacaagactgttggctgatagatctgggatactggcgtttactcagttccctctcattatcatttttacggcaaggaatagttttctcgaatttttaacaggagtcaagttcaattcctttattagtttccataaatggatcggtagaatcatggtcttaaacgcaacgatacattcgctttcttattcattattcgcaattatcaaccatgccttcaaaataagcaacaaacagctctattggaagtttggtattgcatccataacagtgctttgcgttctactagttctatcgctcggaatagtaaggaaaagacattacgaatttttcctgtacacccacatcatactagcccttttgttcttttactgttgttggcaacacgtcaaaattttcaacggttggaaagaatggatagtggtatccttgctcatttgggggctggaaaagcttttcagaatatggaacattttgcagtttagatttccgaaagcaacactaatcaatttgaacaccagcaacaacccgcacgatgaaatgtttaaagtaatcatacccaaatataaccggagatggcattcgaaaccgggtcaatattgtttcatttattttttacatccattggtattttggcaatgccatccatttaccattatcgacgaaggtgagaagtgtgttttagtgatcaaacctaaaagtggtctcactagattcatttataaccatattttgcaatctttaaatggtaaattacaactccgagtggccattgagggaccttatgggcccagtaatcttcacctcgataaattcgaccatttgctgttactaagtggaggaacaggcttgcctggtccattagatcatgccattaagctgtcacgaaaccctgataaacccaagagtatagatttgatcatggcgatcaaaaatccttcttttcttaacggctataaatccgagatactagagctaaaaaatagccgatcccacgtcaacgtgcaggtttaccttacacagaaaacagctgttacaaaggcagcaaacgcacgagaccaattaatacattttgatgatataatgaccgaactgacaagcttcgcccacatcggcaatgcaagacctaattttagcaatgtaattgaaaacgcaataaaaagtacgccgcctggagattcattagcggtcgtgtgctgcggccctcctgttctggtggacgatgttagaaacaccgtttctcaaaaactcctcggttacccagagagaattatagagtatttcgaggaatatcagtgttggtaa

SEQ ID NO: 4628 - DNA, 2139 bp, Saccharomyces cerevisiae
atgcgattgttgctgtgcaagaattggtttgcgtcacctgtaatctcaccactactgtatacccgctccttatattcaatggctaacactactagtttccctattgctccccaggccccgcctaattggtcgttcactcccagcgatattagtgggaaaaccaacgaaatcatcaacaacagcaacaatttctatgattctatgagtaaggtagagagcccttccgtgagtaattttgtggagcctttcatgaagtttgaaaatgaattgggcccaataattaaccaattaactttcttacagcatgtgtcgtctgataaagaaattagggacgcatctgtgaactcctcaatgaaactggatgagttgaacatcgatctatctctgcgtcacgacatctttttgcaattcgcccgcgtctggcaggatgttcaatcgaaggcagattctgtggaaagagaaactttcaaatacgttgagaagtcttacaaggactacattcattctggtttggaacttgacgagggaaaccgattgaaaatcaaagagatcaaaaagaagatctccgttaactctattaatttttcgaagaatctgggagaacaaaaggaatacatcactttcaccaaagaacaattggaaggtgtgccggattctattttgacgcagttcgagacaataaaatctgacaaagatagcaatgaaaccttgtataaagtcaccttcaaatatccggacatttttcccgtgatgaaattggcatcctcagctcagactagaaagcaggcctttttggccgaccaaaataaggtccctgaaaatgaagctatactgttggatacattgaagctgcgtgacgaattggcctcgttattgggctatgacacgtatgcgaactacaacctgtatgataaaatggctgaagatagcactacggtaatgaactttttgaatgatttgaaggacaagctaattccgctgggcagaaaggaactacaggtcttgcaagatatgaaagccgaagatgttaagaaacttaaccagggtgcagatccaaactactacatttgggaccaccgttactacgataacaaatatttgttagaaaacttcaatgtggacctagaaaagatttctgaatattttccactagaggctacgattactggtatgctggaaatatacgaaacattgtttaatttgaagtttatcgagacgaaagattctcaaaacaaatctgtttggcatgacgacgtcaaacaaatcgccgtttggaatatggatgatccaaagtctccaaactttgttggttggatttatttcgatttacatcctcgtgatggtaaatatggccacgctgccaattttggtttatcgtcatcattcatgattgatgacaccacaagatcgtatccggttactgcgttggtttgcaatttctccaaatctacgaaggataaaccttctctactgaagcataacgaaatagtgacctttttccatgaattgggccatggtatccatgacctggtgggacaaaacaaggaatcgaggtttaatggccccggatctgttccatgggattttgtggaggcaccttcccaaatgttagaattttggacttggaataagaatgaattaatcaacctctcatcacattacaaaacgggcgaaaaaattccagaatctttgatcaattcattgatcaaaactaaacacgtaaatggtgctttattcactctaagacaattacattttgggttatttgatatgaaagtacatacttgtaaagacttgcaaaacctgtcaatttgcgatacctggaaccaattgagacaggatatttctttgatttctaatggtggtacgttatccaagggttatgattcatttggccatataatgtcagactcttactctgccggttattacggttatctatgggcggaagtctttgcaactgatatgtatcacaccaaattcgctaaggatccgttaaatgccaagaatgggatacaataccgtgatattgtgttggctcgtggtggcctttatgatattaatgataatctgaaagaatttttgggtagggaaccttctaaggatgctttcttgaaggagctgggcttacagaactaa

SEQ ID NO: 4629 - DNA, 2139 bp, Saccharomyces cerevisiae
atgctcaattctgcgttactgtggaaggtttggctacgaatagacaactccactgatgaagtaaaccaaccaattgctgtacagttcgatgaaatagatactgttgatgatttgaagagcaggttttttcagaaactgagttcgactcgatggcgagaaattaacgataatgcttccattgcaataggcctctacgcacctaaatttgacaatcaagccgacaataccagtagtaacaacactaacgataatagttgtcgaagtaagagtaacggtgctggaagtggcgccaacctttccgttaatagcaataccaagagttcagtgagccccacagcaggatcatttggtctttcaaaagaccttgcaaaggacaggaatgttctccagcatcctaaacctacgcagaaaagaggagcattatacgacgcctttgccgccgtgccgacagtggccgcgactaccaatgtggattttcctcccaacgaggcgccaatgctaagcccgcaaagaccatactctactagtcctaaacagtttccagcaacaactaaaagtccgttactgcgatttgcctcagtctcaccctaccctaaatttcattctgataatcaaattatggcatcagctggtcttacatacgtctcaccgcataataaaaataaatacacaaggccgttgattagaaaaggtttaaattttaccacagaatcagttaatgattgcacttataaaatcatctttgaaccggatgaattggctattaacatatataaggaactattcggaaccatgggttcccaacctgcatcgcagcctttgctgatattttcgaatgttaatttacgccaggatgtaccgcctttagatatcttaaatgttgtagactatgttcctacgaatgaagaaatttcgcagcagaaaactcaaccaacagaccatggggccgttggtgtttttcatctagacgaccatatttctccgggcgaacaaggtcttaagcaaacaattggtgataaagcagatcttaaaggtaaagatggcaatagcagccctcaggaatttaaattaataactgatgaagagcaattgagaagagcgtcacaagaactgaaggatgaggaaaaggatgccgagtctccttggcaagcaatcttgctgttaccaaaaggttataaaggaggggtagattttcgaaataaaccagtggcccacacggattcatctttcaataatgaagacacaattactcattcagagttagaagtgaacaccggatccccttcgcaagaaagcggatcacttaatgaagctggtataggcataacgcaacccatgtcggaagtacaaagaagaaaagaagacgttacgcccgcatcaccaatattaacaagtagtcaaacgccgcattactcaaactcgctttataacgcaccttttgctgtttcctctccaccagatcctttaccaaacctttttaccaccacaagtgaaaaagttttccccaaaattaatgttttaatagttgaagacaacgtcatcaaccaagctatcttaggttcctttctgaggaaacacaaaatctcatataaactggctaaaaatggtcaagaagctgttaatatttggaaggaaggcggtcttcatttaatatttatggatttacagctgcctgtcttgtctggtatagaagctgccaagcagattagggacttcgaaaaacaaaatggcattggcattcaaaaaagtctcaataactcacactccaatcttgaaaaaggtacttcaaagagattctctcaggcgcccgtgattattgtagcattgaccgcatctaactctcagatggataaaagaaaagcacttctttctggttgtaacgactacctgactaaaccagtgaatttacactggcttagtaagaaaattacagagtggggatgtatgcaagccttgattgattttgacagctggaagcagggagaaagccggatgaccgacagtgttttggttaaatctccacagaaacctattgcaccttccaaccctcactcattcaaacaagcgacatctatgacccctacacacagcccagtaagaaaaaattcaaacctctcgcccactcaaatagaattgtga

SEQ ID NO: 4630 - DNA, 2139 bp, Saccharomyces cerevisiae
atggctggaaaaaagggacaaaagaaaagtggactaggcaaccatggaaagaactctgatatggatgttgaagatcgtctccaggccgttgtcttgacagactcttatgaaactaggtttatgccactgacagctgtcaagccaaggtgtttgctgccactggctaacgtacctctcattgaatacaccttagaatttttggctaaggctggcgtacatgaagttttcttaatttgctcttctcatgccaaccaaattaatgactatattgagaattctaagtggaacttgccttggtctccatttaaaattaccaccattatgtctccagaagctagatgtacgggtgatgttatgagagatctagataatagaggtatcattactggagattttattttagtcagtggtgatgtattgactaacatcgatttcagcaaaatgctagaatttcacaaaaaaatgcatttgcaagataaagatcacatctcgacaatgtgtttgagcaaagcgagtacctatccaaaaacaagaactattgagcctgccgcatttgtcttagacaaatccaccagtaggtgtatttattaccaagatttaccattaccaagctctagagagaagacttccattcagattgacccagaattgttggataatgtcgatgaatttgtcataaggaatgacctcatcgattgtagaattgacatttgtacatctcatgtacctttgatatttcaagaaaattttgactaccaatcattaaggacagactttgttaaaggtgtcatttcaagcgatatattgggaaagcatatatatgcctatttgacggacgaatatgctgtaagagttgaaagttggcaaacttacgacaccatttctcaagactttttaggtagatggtgttatcccttggtcttagactctaacatacaggacgatcaaacgtattcttatgaatcaagacatatatacaaggaaaaagacgttgttttggcccaatcctgtaaaattggtaagtgcactgcaattggatcaggaacaaaaatcggagagggtacgaaaattgagaattccgtgattggaaggaactgccaaatcggtgaaaatattagaatcaagaacagtttcatttgggatgactgtatcatcggaaataacagtataattgaccattcattaattgcctctaatgccacgttagggagtaatgtacgcctaaatgatggctgtataattggtttcaacgttaaaattgatgataatatggatttagatagaaacacaaaaatatctgccagtccattaaaaaatgccggctcaagaatgtatgataatgaaagcaatgagcagtttgaccaagaccttgatgatcagacactagccgtttctattgttggagataagggtgttggttatatttacgaaagcgaggtgtctgacgatgaagatagttctacagaagcctgcaaagaaataaacactttgagtaaccaattagatgagttatacttaagtgacgattcaatttcttccgccactaaaaagacaaagaaaagaagaacgatgtctgtcaatagtatatacacggatagagaagaaattgattctgaatttgaggacgaagattttgagaaagaaggtattgccaccgtggagcgtgctatggaaaacaatcatgatcttgacacagcattattagaattgaacaccttgagaatgagtatgaacgtgacatatcatgaggtgagaatagcaacaataactgcattattgagaagagtttaccactttattgcaactcaaacattaggtcccaaggacgctgtggtgaaggtttttaatcagtggggactgttgttcaagagacaagcctttgatgaagaagagtatattgatttgatgaacatcataatggaaaaaattgtagaacagagttttgacaaaccggatttgattctatttagtgcattggtttctctatacgataatgacataattgaggaggatgtcatttataaatggtgggataatgtttctactgaccctcgctatgatgaagtcaagaaattaactgtaaagtgggttgagtggttacagaatgctgacgaagaatcttcctcagaagaggaataa

SEQ ID NO: 4631 - DNA, 2142 bp, Saccharomyces cerevisiae
atgaaaaccgaaatcagcactgcggattcccttcgtgatcctccctctaatggtctaaaggccgactctgagctggttatcagagaggatatagaccaatttttgccttcggaagtatcttcgttggggtcagatcaccagaatgatggtgaggattcagacactgacagtgacaactttttgcaagaccctgaagacgatgtggatgaagaaagcactggtagaggtacagtcactaccacttccacatccactgagtcaagaggccgtccatcttcttgtatcttcgtggcaagcttagcagcagccctatccgatgacgaattatgtctgtcggtgactgaaaatttcaaaaaatacggtgatttggctagagttaaagttttgcgtgataacgcaaatagaccttatgcttttgttcaatacaacaacgatcatgatgctaaacatgctctgatccgcgctcagggtactttattaaatggcagaaggttgcgttgtgaacctgcaaaagtgaacaggacattgtacttgaaaaaccagcaaagtattgatttcaacgagatcagtcaaatttgtgaaaaatttggtggtttggaacagattgttcctgatagaactgataatcaatacacgagaagatatacttatccgatatcttcggcaaattcttggtttgttcaattcgtttacagagacgatgcaatcagagcttatgcgaatttacgaactgatcccaattggatcatcgaatgggcacaaaatataaacgtcccaaaaaattataaccttttacacaaaagcaaattcaaaagttccaaataccatcaaaacaacggtattatcaataacgatggtagtaacaacaacgataataataatagtaataataataatagagaggattcaaggaggaatggcgacgttatagaagaggagtgcggacatgtgcatggtagtgattcagaggaaaaattgacaagcgatggtatttatgacgacgaagataaagattccgagatcaccattgataaaagatccattttcgtgggtcaattagacaaagaaaccaccagagaggaattgaatagaagattttccactcatggtaaaatccaagatattaatttaatcttcaagccaacaaacatatttgcgtttattaaatatgaaaccgaagaagctgctgctgctgctttggaaagtgaaaaccatgcaatttttttgaataagacaatgcatgttcaatataaagaggtaggtggtcgtcacaacaggaagttctctggtaagaacggtggcagcaactttaaccatcatcagttttttagcaccagatcgggcaaaacatttacagggccagaactgaacttagcaccaccaccaatcaacatgtacaggaaaatgagcggcggatcccagcaggaaagcgaaactatgatgccatacatgcccatggggcccatgcccatggggcctccaccaccaaatgcagcaagtctcagtgattttgatatgttccccccaagttactccacgtttatgaagggaatgatgccattgaggcgtaaatctatgcccaattcttggtcatccccttcttcaaagagtgtgaactctgaaaatgaaagtgttaatggtggtgatgagaattccgaattgccttccgaaattcctgaatcatctggtagatataatgctgctaattcctttaccacatataataattcctcagcaggaaactctaacaacaacaacaacaacaacaacagtaacagtaataagtctcaatataaaaagcgctatgcaaggaggtcaagctacggatacaatgaagtacctccaaaaccatactatttccagccttattactatcaccccatgcaataccatatgggcccaatgggcccattgcatccttctcaaggttctgctggaaatcaccatccatatatgatggtttatcccatgtcaccacctccgccttctgggttagatggaagcatgatccctcctccaataaatgtaagccaatcacatgctgctaatcatggcagtacccatgttcatgcgaacgaattcatatcaaacgatactggtgacataaatgaagataacaaagcttatagtttagattactaa

SEQ ID NO: 4632 - DNA, 2142 bp, Saccharomyces cerevisiae
atgactgccagcgtttcgaatacgcagaataagctgaatgagcttctcgatgccatcagacaggagtttctccaagtctcacaagaggcaaatacctaccgtcttcaaaaccaaaaggattacgatttcaaaatgaaccagcagctggctgagatgcagcagataagaaacaccgtctacgaactggaactaactcacaggaaaatgaaggacgcgtacgaagaagagatcaagcacttgaaactagggctggagcaaagagaccatcaaattgcatctttgaccgtccagcaacagcggcaacagcaacagcagcaacaggtccagcagcatttacaacagcaacagcagcagctagccgctgcatctgcatctgttccagttgcgcaacaaccaccggctactacttcggccaccgccactccagcagcaaacacaactactggttcgccatcggccttcccagtacaagctagccgtcctaatctggttggctcacagttgcctaccaccactttgcctgtggtgtcctcaaacgcccaacaacaactaccacaacagcaactgcaacagcagcaacttcaacaacagcaaccacctccccaggtttccgtggcaccattgagtaacacagccatcaacggatctcctacttctaaagagaccactactttaccctctgtcaaggcacctgaatctacgttgaaagaaactgaaccggaaaataataatacctcgaagataaatgacaccggatccgccaccacggccaccactaccaccgcaactgaaactgaaatcaaacctaaggaggaagacgccaccccggctagtttgcaccaggatcactacttagtcccttataatcaaagagcaaaccactctaaacctatcccacctttccttttggatctagattcccagtctgttcccgatgctctgaagaagcaaacaaatgattattatattttatacaacccggcactaccaagagaaattgacgttgagttacacaaatctttggatcatacttcagttgtttgttgcgtgaagttcagtaacgatggtgaatacttagccacaggctgcaacaaaactactcaagtgtatcgcgtttcagatggttctctggtggcccgtctatctgacgattctgctgccaataaccatcgaaattcgatcactgaaaataacaccaccacgtccacggataacaatacaatgacaaccactactaccaccacaattactaccacagcgatgacttcggcagcagaattggcaaaagatgtggaaaacctgaacacttcgtcttccccatcatccgacttgtatatccgttcagtgtgtttttctccagatgggaaatttttggcaacaggtgctgaagacagactgattagaatttgggatattgaaaatagaaagattgttatgattcttcaaggccacgaacaagatatttattcattggactactttccctcaggtgacaaattagtctccggttctggtgaccgtaccgttcgtatttgggacttacgtacaggccagtgttcattgactttatccattgaagatggtgttaccaccgtcgctgtatcaccaggtgatggtaaatacatcgctgctggttctctagatcgtgctgtgagagtttgggattccgagaccggattcttggtggaaagactagattcggaaaacgaatccggtacaggccacaaggactctgtttatagcgttgtcttcactagagatggacaaagcgttgtatccggctcattagatagatctgttaagctctggaatttgcagaatgcaaacaacaagagcgattcgaaaactccaaattccggcacttgtgaagttacgtatatcgggcataaagactttgtattgtccgtggccaccacacaaaatgatgagtacatcttgtccggttccaaagatcgtggtgtcctgttttgggataagaaatccggcaatccgttattgatgttgcaaggtcataggaattcagttatatctgtggctgtggcaaacgggtctccgctgggtccagaatataacgtttttgctactggtagcggtgattgtaaagcaaggatttggaagtataaaaaaatagcgccaaattaa

SEQ ID NO: 4633 - DNA, 2142 bp, Saccharomyces cerevisiae
atgccatccctgtctcaaccatttagactagcaactctcccaaaaattgcttcattgagcaatttttctttacaagcagattacgttcaagtcgcagatggcacctttaatgaatctacaaataacataacgttaggtatttccgggtcatctatatctcaatatattattaatcctacaccaaagttaacattcgattacccaataccctctacaaatattatcacggcatgcaatgctgagaaaggtcaagcgaacattgacggaaatatagaagccagtaccgatgatgaagccaacaacgagaagactatcaacacccaaaaaaaaagaaatgttgaaatttgggcctttggtttaatggtaaataagggtaattatacgctaaatgttatcactaaggcactggaagataccactgatacctcaaatgaccatctgagtgagagtgatattgacaataaagcatacacgggttcagacgaatttttatctcagtataagatcaaggcgaaagccaaagtcatgagtattaaaattgacaccaagaacagcttagtaattgcaattttacagaacgggttgattgaaatttttgattttaagttaacacttttgcattcatttgatatatcttatgataacttaaaatatgctaaatggttcactgaaaatggaactgaatatgtttttgttctctgtccattacaggatgataaagtctgctataaattgctcgagctaacagattgtggcagtggagaaagttcgcccataaaagaattatcatctactatcatcgaaggattttcttttgaaaattcaaagctttgttatcaatttggaaaactttacaaattgaaccaggggaaaatatacatttactctttaccacattgccaattgcaacaagttattgaatttccgatggtggataaactcagtcctggagatgacttaatctctttccaacctgtttcagtaaacagagttctactgaccgtaaacaacgtcatttatctactagacttactgcattgttctactttaagccaaagagaattaactcacgtgaaaacattccaactattaaaatctgcagtgatcaattcagaaaagtcgcataattcaaaaacaatagcaattggtatttcaacgaaaaatggaccaaacccaacgtcttccttagaaataattaatattgatgttggaactaatacgttgaaggactcattaggcaagagttttcaagttggaaataatgatagctcagttattttaaagccgctatttgatgataaagacataaatgacaagagagtgaaatgtaacgacgtcagcggggattcaagcgttccagtcctccactgtaatgaagttattgaaaagctttcagcccttcaagataatgacattacatcatttgatgacatatttttcaaagaactaaaaatcaaagaagaacattatactgaaaaagatagatatatttctgatcctggctttttgaataaagttttagatctaattttcggaaagtttagcggaaatgattatccaaaaactttaacgtttttattgacacacccattgtttccattgagtcgtacacgcaacttgctatccttactaagagaccaacctagattatttaaacaagcaattgtaacatgcccaaacttgccattaaatgaactacttgaagaattgttttctatcagaaacagggaactattacttgatatctcatttaggattttgcaggatttcaccagagactctattaaacaagaaatgaagaaactaagtaaattagacgttcaaaatttcattgagttcataacaagcggtggtgaagacagctcaccagaatgcttcaaccctagccaaagcacgcagctatttcaactcttgtcccttgtgctagattctatcgggctattttcattagaaggtgctctattggagaacttaaccttatatattgacaaacaagttgagattgctgaaagaaataccgaattgtggaatttgattgatacgaaaggttttcagcatgggtttgctagctcaacctttgataacggaacttctcagaagcgagccttacccacttacaccatggaatacttggacatttga

SEQ ID NO: 4634 - DNA, 2142 bp, Saccharomyces cerevisiae
atggtcactaacaatggagatggtgagcaccttgggatccgaagaaacggaaatttaaggcatccttccaataatatgaaaattcccagaagggctcaatcaacagttctcaattcaaacccattttatagtaggaagtattctatgtctaccttaacgccgagggatatatgtcgaagcgttgattctagagtatttgtggatatgtcttctcccaattttcagactctggaggatccccacagagatgagattataaacagtgtacggcttaactacttgaacagtagcaaaagaagttccgtctctcatggaaatgaagcaatccctagggttaatccgactaagaattcttcagcaagtaccatagctgcagcaaatgttgatagtgatgacgatgagactaacctgagtagcgctggaggcgacataacgcatgatatttacaagttggttaaagcagaggatcctaaacggctcagacgccctcggtccatggaaaatgtaacacctaaaattgagcaccatactaaattgtcatcagcaagtggtttaaatgtccccggtggcttcagaagggaatttattgtcaacaaaaaaaggcaagaacatcaattaaatgattccgctagctcagacttcacttcgcatgaaagcgattcgattaaccagtcatctccatcttctaaccaagatatcgataaggtcccctttttaacaagaaactttttggaatttctatacgtgtttggacattttgctggtgaatccttcgaggatgattttatccctgatagctcaaacatgatgatacgcggagaagatgaaaggagtgcattgctgtctcggcctgaccatatgaaagtattaccttcagccaaaggtacgacttcgacaaagaaggtttttttgatattgcttaaatctttcattggaactggcgttttatttttacctaatgcctttcataatggtggtttgtttttctcagtaagtatgctggccttttttggaatttattcatactggtgttactacatattggtgcaggccaaatcttcatgcggtgtatcctcctttggtgatattggtttaaaactgtatggaccttggatgagaataataattcttttctccctagtaataactcaagttggattctctggagcttatatgatatttactgcaaaaaatttacaagcttttcttgataacgtattccatgtgggcgtcctacctttatcttacctgatggtctttcaaacgatcatttttattccactttcgtttattagaaacatttcgaaattgtcactaccatctttactagcaaattttttcatcatggctggtttagtcattgtcattatttttacagccaaaaggttgttttttgacctgatggggaccccagcaatgggtgtcgtctatggcttaaatgcagaccgttggacgctgtttatcgggacggcaatatttgctttcgaaggaatcgggttaattattcctgttcaagactcaatgagaaatcctgaaaaatttcctttagtacttgctttggtgattctaacggcaaccatacttttcatttccatagctacattgggatatttggcatacggctcaaatgttcaaacggttatactgttgaacttacctcaaagtaacatttttgtaaacttaatccagctgttctattccatcgcaattatgttgtccacacctttgcagttgtttccagctattaaaattattgaaaataagttttttccaaagttcactaaaatatatgtcaagcacgatgatctaacaacaagagtcgaattacgtcctaattcaggaaagctgaactggaaaattaaatggctgaagaactttattcgttctataatcgtaatcattgttgtatcaattgcttactttgggtctgataatttagacaagttcgtttcagttataggatccctcgcctgtattcctttggtatatatatacccatcgatgctgcatttacggggcaatagccttccagagactaaaggggaattttggagattcaaaccaatgttagataccattttaattttcttcggtattgcaagcatgctttatacgtcttaccagagtatattcggtgtctag

SEQ ID NO: 4635 - DNA, 2142 bp, Saccharomyces cerevisiae
atgtcccaatctagtaggttaagtgcacttcctattttccaagcatcgctttcggcaagccaatctccacgttacatttttagttctcagaatggcacaaggattgttttcattcaagataacataataaggtggtacaatgtactcactgattcactttaccacagtttgaactttagtcgtcatctcgtcttggatgataccttccatgtaatatctagtacgtctggtgacctactctgtcttttcaatgacaacgagatttttgtaatggaagttccttggggctattccaacgttgaagacgtttccattcaagatgcattccaaattttccactattcaattgatgaagaagaagttggtccgaaatcgtccattaagaaagttttgtttcatccaaagagttatcgtgattcttgtatagtggttttgaaagaggatgacactatcacgatgtttgacatccttaattcgcaagaaaagcctatcgttttgaacaaaccgaacaactcctttggtttagatgcacgtgttaacgacatcacagatttagaattcagtaaggacggattgacgttatattgtctaaacaccacagaaggcggtgatatctttgcattttatccatttttaccgtcagtattactgttaaatgagaaagatctcaacttgatcctaaacaaatctttagtaatgtacgagtccctggattctacaacagatgttatagttaaaaggaatgttattaagcagttacagtttgtgtcaaaactgcatgaaaattggaattcaagatttggcaaagtcgacatacaaaaggaatatcgtttagccaaggttcaaggaccattcacgataaacccctttcccggcgagctgtatgactatactgctacaaatattgcaaccatactaattgataatgggcaaaatgaaattgtttgtgtcagttttgatgatgggtctttaatcttactcttcaaagatttggaaatgtcaatgtcgtgggatgttgacaattacgtgtataataattctttggttctaattgaacgagtcaaactacaaagagaaattaagtctctaataacgttacctgaacagttgggaaaactttatgtcatttccgataatattatacaacaagtaaattttatgagctgggcttctacattgagtaaatgtatcaacgaatcggatttgaatccacttgcaggattgaaatttgaaagtaaacttgaggatattgccaccatagaaagaattccaaacctagcgtatatcaactggaatgaccaatctaatttagccttgatgtcgaataaaacattgacttttcaaaatatttcaagcgatatgaaaccgcaaagcaccgcagctgaaacaagtatcagtacagaaaaaagtgacacggtaggagatggttttaaaatgagtttcacacagcccataaatgagattcttattttgaacgataattttcaaaaagcctgtattagtccatgtgaacgaattatcccatcagcagaccgccagatacctttaaaaaacgaagctagtgaaaatcagttggaaattttcacggatatttccaaagaatttttgcaaagaattgttaaagctcaaactttgggtgtttctatccacaatagaattcatgagcaacagttcgaattgacgcgccaactacaatcgacatgcaaaataatttcaaaggatgatgatttaaggagaaaattcgaagcacaaaataagaaatgggatgcacaactaagcagacagtcagaattaatggagagatttagtaaattgagcaagaagctatctcaaatcgccgaatccaataaatttaaagaaaagaaaataagccatggtgagatgaaatggttcaaagagatacgaaaccaaatattgcaattcaacagctttgttcactctcaaaaatcccttcaacaagatttatcgtacttgaagagtgaactaactcgtatcgaggcagaaactatcaaagtcgataaaaagagccaaaacgaatgggatgagctacgcaaaatgcttgaaatagattcaaagataattaaagaatgcaatgaagaattgttacaagtttctcaggaatttactactaaaactcaatga

SEQ ID NO: 4636 - DNA, 2142 bp, Saccharomyces cerevisiae
atgtcgccctctgccgtacaatcatcaaaactagaagaacagtcaagtgaaattgacaagttgaaagcaaaaatgtcccagtctgccgccactgcgcagcagaagaaggaacatgagtatgaacatttgacttcggtcaagatcgtgccacaacggcccatctcagatagactgcagcccgcaattgctacccactattctccacacttggacgggttgcaggactatcagcgcttgcacaaggagtctattgaagaccctgctaagttcttcggttctaaagctacccaatttttaaactggtctaagccattcgataaggtgttcatcccagaccctaaaacgggcaggccctccttccagaacaatgcatggttcctcaacggccaattaaacgcctgttacaactgtgttgacagacatgccttgaagactcctaacaagaaagccattattttcgaaggtgacgagcctggccaaggctattccattacctacaaggaactacttgaagaagtttgtcaagtggcacaagtgctgacttactctatgggcgttcgcaagggcgatactgttgccgtgtacatgcctatggtcccagaagcaatcataaccttgttggccatttcccgtatcggtgccattcactccgtagtctttgccgggttttcttccaactccttgagagatcgtatcaacgatggggactctaaagttgtcatcactacagatgaatccaacagaggtggtaaagtcattgagactaaaagaattgttgatgacgcgctaagagagaccccaggcgtgagacacgtcttggtttatagaaagaccaacaatccatctgttgctttccatgcccccagagatttggattgggcaacagaaaagaagaaatacaagacctactatccatgcacacccgttgattctgaggatccattattcttgttgtatacgtctggttctactggtgcccccaagggtgttcaacattctaccgcaggttacttgctgggagctttgttgaccatgcgctacacttttgacactcaccaagaagacgttttcttcacagctggagacattggctggattacaggccacacttatgtggtttatggtcccttactatatggttgtgccactttggtctttgaagggactcctgcgtacccaaattactcccgttattgggatattattgatgaacacaaagtcacccaattttatgttgcgccaactgctttgcgtttgttgaaaagagctggtgattcctacatcgaaaatcattccttaaaatctttgcgttgcttgggttcggtcggtgagccaattgctgctgaagtttgggagtggtactctgaaaaaataggtaaaaatgaaatccccattgtagacacctactggcaaacagaatctggttcgcatctggtcaccccgctggctggtggtgttacaccaatgaaaccgggttctgcctcattccccttcttcggtattgatgcagttgttcttgaccctaacactggtgaagaacttaacaccagccacgcagagggtgtccttgccgtcaaagctgcatggccatcatttgcaagaactatttggaaaaatcatgataggtatctagacacttatttgaacccttaccctggctactatttcactggtgatggtgctgcaaaggataaggatggttatatctggattttgggtcgtgtagacgatgtggtgaacgtctctggtcaccgtctgtctaccgctgaaattgaggctgctattatcgaagatccaattgtggccgagtgtgctgttgtcggattcaacgatgacttgactggtcaagcagttgctgcatttgtggtgttgaaaaacaaatctagttggtccaccgcaacagatgatgaattacaagatatcaagaagcatttggtctttactgttagaaaagacatcgggccatttgccgcaccaaaattgatcattttagtggatgacttgcccaagacaagatccggcaaaattatgagacgtattttaagaaaaatcctagcaggagaaagtgaccaactaggcgacgtttctacattgtcaaaccctggcattgttagacatctaattgattcggtcaagttgtaa

SEQ ID NO: 4637 - DNA, 2144 bp, Saccharomyces cerevisiae
atgggtatgtgcctcggtttttctcattaaccccttttgatccataacggtcctcttttgtttccttttttttttttgttttagtattttatgtttactattttcttctgtttcagtcatacgtaggaattattgcatgaaagaggatataatattcatgtggatttttaagaaaatagatcaagtttaaatagccactaacaattgaacaatgctctctcttggcctcttttcttcttttttatcgtttctctaaaaatcaagctgattagacatggtcttgcaatgtttttgctttctctaatcagcttggttttccgcaaagaagagaaagtcacggaattgtctacatatgtttctattcaggaacaaataatacatctaataataatggcactacgaagaaaatgtccctagaagaatttctagggaacgacactttaggcgagtcagtatgggatgaggaagatattaatttggatgctataagcaatactacgaatattgacatcttgaaacaaaccaaggcaggcgaacatcaacgtgatggtcaccaacagcacccacacggtggtcatggacccatgaacagatcacgtttttctaatgcagggccttttggtggtggtagcatgggggactttgcaaatcatcaccacccgctgcagcatcagcaaggtcctccttatattgtgaagttttctgatttaccaccgagattttccaactttgacattgaagatctttttcaagcaaagtttaccaagtttattaagttcaaactgttttgggagataaataaaaatccaagtatttctactttgaaatcggggtcaatctttgatcaaaatttcaaacgtgactcgaaggtagcatttgtcgagttatatacatcccgtgatatggacaaaattttgaactattggaccactcctttgaaggaaatttaccacattacaacagcgcccgcagaattcgaagattttaaggattacagcacgaaggtgaaattattaacagaccctaaagacgatgctggcaaaccattcattactaagactcagcggtcaaaatccaatccttttggaagtgctaaaccggttgatacgcaatcgaagattttggacattgaagaaaaaatggaaaatttacacgtggaagatacaacaaccctgagggcatcattaatccctagtagtgattctatggcaaccactgcaacaggcagcaagatcacaatcttgaaaaagcagacacctacagaggaggaatcacattctgcaaccccaactcccaaacctttaagttactctgaagtagttgagagatctgtggtcaatgaaacttccaagaaaggaactccattaagcaagcttgactcaccagctcttgaactacaatctaagcccgataaatcggacgagttcaaaggtggcgatgaacaaggctttgagaaaggtggcgacgataaagctcaattagatgtctcaaatgataaagataaaggttcagaaaccgatgttgataaacagttcactttcaagaatgtggaaagggaacatagtatgagcagaaccaaatataacggaaaccataataacaataatggcaattttagagggagtaatagatatcgtggaggccccaatggcagcagttataaaggtgggcataacaatcgtggtaatcgcggcggatatcgtggtggcagctcatacaacaacaacaacaacaacactaatgataataataataataataataatagtagtagtaataataataacggttcaagatatcatgatcgacaaaacaatgaagaagggttaacctcggattcatctttagatgcctcaggaaataaaaagaatgatttcacgaactcaacatccaatacacaacaatattccattttcaaaccagcaagtgggttccttggccaaggtaataatgattctataaggaacaatggacgcggtaactataacagcagcggtatgaatggaggttcgagaggaagaggatttggcagaggaaggggatttggcagaggcgcatataacaatcgaggtagtcgtggtggacgtggaagcagcggtaactactccaactacaataacagaacaacagacatgcctttatga

SEQ ID NO: 4638 - DNA, 2145 bp, Saccharomyces cerevisiae
atgacagaaattattgatttagacttggtcgatgactttatcaagaaacctatggtcaaacaacagaaaaaccagtcttcaaagcctagggtaaaaagaaggggtcagttgacctttgatgatttcagaaacatcaaaattgtagaagaacctgttgtactttctcacaatagttcaattgacgaatcactggatgctgctacccaaaatactaaaaagcgggagaaatatgaaggtacctgtgatgaagaaatgaaaactaaagaaatggaggcaaatatggcaagcaaatattctaatatcaaaacacattcgaacgacactaacaaggtagagtcgatcagtgaacacactacttctaataatagaccattgaatacattaaactggtcaccaaatattcctttacgatattctgactttgcaaagtttatgagtgatgagacggtaacggaaagcaattgggcgcctcccctttgcacccctctcccatatgcaggcgatgttatgaagatcctttcttttatcgtcaaatttaaatgggtgttcagcgacgatctactgaacctgtcatttcaagatgtggagataggactagaattaaaggtggctggccattctgcgaagaatattcgaatttgtcaggataaaatgaatctactattttgcagtcttttgaggttattattctgctccgagaaaagagcagacaaccaaactcatagaaatttcacgctaaaaagatttcttagtttgaaaaatccatatggaaaactggttggcaaactcagaagcttaatccaggagtggggcttaccaaaagaatggcgtggtaatagtgatattttatctactctaaattttaatggaggtggtttgttgacgatggaaccattagatagaataatattattgagatgcatgatcgattggaattgtagctactccgcacttttccataatgaaattcaaaggctcactcacttgaaaggcgatacagggttcaaccatcaaacttttcacgccagcaggtttgctatgtgcggggccaataacatattagatagttgtgaagttttatgctctttgatgagtcaaaagttggaaaatcgaaagaaaaggaagcccagcgacaaaggaaaactgagtaagatcaatagtcagatgaaatttctaaagggtgttcggaaatcattgagcgaaaaagtaactacagacagattacgagctgcagttaaaataaatgaagaatggggtgaatattttgcaaacgaatttacacacacaccaattgatgatcccaccgtagacgaaatttacaagttaaggacatcagagtttatgatagcgagaattccacgagttggagatttctacttaccaccattctggattggcaacgaatgcagttcagtaaacactagttacagtttcaatgacatgtcaacttatcttaattacttcgtaaaattcaaagaggagggtacaaaaatactgcctgcaaaaaccgcacaaaatgaaaacaagtgtcaacttaaacttatatataggaacactcctgcatgtatccgtaatttacagttcaatgatgttcactttgccgaggtgccgcattggtttgaagttgcaggagactcgaattctttgagcaacttcattgagtatttggaaagtttatcatcacttactgaaaatgacaccgatgatacaaaaaagggtatagacaatctaattgagtttttgaaaattttcagtatattcataaatgagactattcagcgcataactgctgcccctacaggcagtactgaaggacgtcatttgcgaacaagctctcagagaagaaccacggtgcattactcgagtgatgtaaatggtgacgtttccgaggaaagtgaaaatgaagttgacattgacgttagcgatgactatgattcagaatatctgagtgaggagaatacattgacaagaaaaggtgaagataggacagataaatcttttgggaaaagagaattacacaatggcgctaaagattgtgataggaattgtgatgatatagagatcttctcagaacccgttaggcaactacaagataattctcgggaaaaaagaagcttgaggcgtaatgccagaaaaggtctatag

SEQ ID NO: 4639 - DNA, 2145 bp, Saccharomyces cerevisiae
atgctatcattttgcgactatttttggtctgaagaccttgtctcaggtctagatgtgctttttgatagattataccatggttgtgagcaatgcgacttgttcattcaattatttgcgtcaagaatgcaatttgaagtcagtcacgggaggcagttgtttggtatagaagccggtatggacaatctgaaggcagtgcaggaagatgaagatgaaggggtgacagtttcgagggccctgaggggaattctacaggaaatgtctcaggaagggacgcatcacttgacaatagcgtcgaacatagaaagtttggtgctgcagccattcagtaaatggtgcatagaacatagggagagaattcaatactccgagaagactttgttgaccaatgtaaataatttcaggaagtctaaaaagtacgtcggtaagctggagaaggaatattttaataaatgtaggcagctagaagaatttaaaagaactcatttcaacgaagatgagctagcaaatgcaatgaaatcattgaaaatacaaaataaatacgaagaagatgtggccagggaaaaggatcacagatttttcaacaggatagcgggaatagattttgattataagacaatgaaggagacgcttcagctgttactgaccaagcttcctaaaacggactataagctacctctcattagttattctttgagcaacaccaacaatggtggagaaataacgaagtttctgcttgaccacatgtcgttaaaggatattgatcaagctgaaacgtttggccaagatttgttgaatttagggtttttgaaatattgcaacggtgttggtaatacatttgtcaactctaaaaaatttcaataccaatggaagaataccgcgtacatgtttgccaatgtgccaatgcccggttcagaggagcctaccactggtgaatccttaatatcccggttcaacaactgggatggttcatctgcaaaggaaattattcaatccaagattggtaacgaccagggggcagcgaagatccaagctccgcatatatccgataatgaaaggacgcttttcagaatgatggatgcgcttgcagcgtcagataagaagtattaccaggagtgcttcaagatggatgccttgagatgctcggttgaggagttgttgattgaccatttgtcgtttatggaaaaatgtgagtccgatagactgaatgcgatcaagaaagcgacactagatttttgttctaccttgggtaacaagatttcttcgttaagactgtgcatagataaaatgctcacgctagaaaacgatattgatcccactgcagaccttttgcaacttttagttaagtacaagacgggcagtttcaagccgcaagccattgtttataataattactacaatcctggttcatttcaaaactttggtgttgatctagaaactcgttgtagactagacaagaaagtcgttccgttgataatttcttcgatattctcatatatggacaaaatatatcctgacttacctaatgataaagtaagaacttcaatttggactgattcggtgaaattaagtttaacacatcagcttcgaaacctattgaacaaacaacagttccacaacgaaggggaaatatttgatatactttctacgtccaagttggagccaagcaccatcgccagtgttgttaaaatttatttattagaattaccagacccactaattcccaatgatgtctctgatattcttcgggtgctttaccttgactatccacctttagttgaaactgcgttgcaaaattctacatcatctcccgagaatcagcaggacgatgacaacgaagaaggctttgataccaagagaataagaggcctttatactactctgtcctctctaagcaaaccacacatagcgacactagacgctattacaactcatttttacagattaattaaaattctgaaaatgggagagaacggtaatgaagtagcagatgagtttaccgtctcaatttcacaagaatttgccaattgtattatccagtcaaagatcaccgatgataatgaaattggttttaagattttctatgatctactgacacataagaaacagatttttcacgaattgaaaaggcaaaattcaaaaaattag

SEQ ID NO: 4640 - DNA, 2145 bp, Saccharomyces cerevisiae
atgtcacatcttatcactttagctacatgcaacttgaatcaatgggccctagattttgaaggtaatagagaccgtatcctacagtccattaagattgccaaagagaggggtgccaggttacgtgtcggcccagaactggaaataactggctacggatgtttagatcattttttagaaaatgacgtttgccttcattcatgggaaatgtatgctcaaatcattaagaataaagaaacccatggattaatacttgacattggtatgcccgttctacacaagaatgttcgttataattgtcgtttgttatccttggatggtgagatattgttcataagacctaagatttggttagctaatgatggtaactatagggaaatgagatttttcacaccttggatgaaacctggcgtggtggaggactttatccttccacctgagattcagaaagttaccggccagagacttgtgccatttggggacgctgtgataaattcattggatacatgcattggtacagaaacttgtgaagaattgtttacacctcaatccccccacatcgccatgtctttagatggtgtggaaatcatgacaaactcatctggttctcatcatgaactgcgtaagttaaataaaaggttagacctaattttaaatgccactaaacgttgtggtggtgtttacttgtatgcaaatcaaagaggttgtgatggtgacagattatattatgatggctgtgcactaattgccatcaatggtacaattgtagcccaaggttcacaattttcgctagatgatgtggaagtagttactgctactgtggacctagaagaggtgaggagttatcgtgcagctgtcatgtctcgtggcctacaagcctccttggcagaaataaagttcaagcgtattgatattcctgtagaattggctttaatgacctccagatttgatcctacagtgtgtccaacaaaagtccgcgagcctttctatcactctcctgaggaagaaattgcactgggacctgcttgctggatgtgggattatttaagacgttgtaacggaacagggtttttccttcccttatctgggggcattgactcttgtgcaactgcaatgattgtccactctatgtgccgtttagtgaccgacgctgctcaaaatggaaatgagcaagttatcaaagacgttcgtaagataacacgtagcggcgatgattggattccagacagtccacaggatctagcctcaaaaatatttcactcctgtttcatgggtacggaaaattcatccaaggagacaagaaacagagcaaaggacctttccaatgcaattggatcttaccacgtggatttaaagatggactcattggtatccagtgtggtgtccttattcgaagtagccactggcaaaaaaccaatatacaaaatatttgggggatctcaaatcgagaacttggctttacaaaacatccaggcgcgtctaagaatggttctttcttatctttttgcgcaactgttgccgtgggttcgtggtatcccaaactcgggtggattgttagtacttggtagcgcaaatgttgatgagtgcttacgtgggtatctaacaaaatatgactgctcctccgcagatatcaaccctattgggggtatttcaaaaactgacttgaaaagattcattgcctacgcatcaaaacaatataacatgccaatcttgaatgactttttaaacgctacaccaactgcagaattagaacctatgactaaagattacgttcaatcggatgagatagatatggggatgacgtatgaagaattgggcgtgtttggttacctaagaaaggttgaaaaatgtggtccttattctatgttcttaaaacttcttcatcaatggtccccaaagttaacacctcgtcaaatatctgaaaaggtgaaaagatttttcttcttctatgccatcaacagacacaagcaaactgttttaactcctagttatcatgctgaacagtattcaccagaagacaacagatttgacttacgtcctttcttaatcaacccaagatttccatgggcttcaagaaaaattgatgaagttgtcgagcagtgtgaagcacataaaggctcaacgcttgacattatgtctattgattag

SEQ ID NO: 4641 - DNA, 2145 bp, Saccharomyces cerevisiae
atgtcagtgaacgaccaaataactcatataggaaaaacattgtccacaacggcttccgcttttttaaactaccaaaaatcgaacagcaacactcaagatgtactgaccaataatgggccttataagaatttattatcaaataccgtcaacaatgcgagctcaacttcatacttttacaagaggactgaacacggtcgctttgtaaaaaatgcatctaacacttttgaggatatttactccaagacaagaaggggcgatgtattcaggaacaagttcacagacaacaaaacatgcttcagaatgctcacgtacataagtgatgatttgttgaacgagatcccaactaaggaaggtctcaaaagtgatgcagatggcaagcttctaaccgaaggaggcgaaaatgaaaatctcaggaagaacgcatccaaaaaagaaacatcgctgtttcagggctttaaaagctacctaccaatagcggagcttgccattgaaaacactgaaagattaaactatgatacaaatggtacaagcggtacggttggtgcgaaagatgttatgtctaaaacaaatgagcgagatgaaattcacacagagcttcctaacttccaagattcatttctcataccgcctggggtagaaactaaaaaaataagctcctcttattctcctagtgcattaaaaagtttttctcaaactcttgtaaatagtttagagtttttaaatattcagaaaaattctacgttatccgaaataagagacattgaagttgaagttgagaatctgagacaaaagaaagagaaactgttgggtaaaattgcgaacatagagcaaaatcaattactattggaagacaacctcaaacagattgatgataggttggactttttagaagagtacggattggaggtgatcgaagctaatagcgacgaaaatgcagaagatgatggtatgagtgagcgaaaggcccttaaaaatgatgctataagaaatgagggtgtcaccacagagagcatatcatcagaggcttctaatctacctccaaggagaaggcaacaacttcgagacgataactcattgaatagattaggtgccttttatagcaaatccaaaaaaagacacagaaaaagcttcccaacattccagcagctttacgagccaggaacaaaaattggctctataatgtccactcacgatgatttcctcacttgcctagattttgatgcgccctttggtaccttatgtacagccggatatcttgatcacacggtaaaaatttgggatttatccaaacaaaacaaaattggagaactagcaggacatcttgctacaattaattgtatgcaaatcaatcgtgactacggaactcttgttactggtggtagagatgcggctttaaaattatggaatttgaatttagctcaacaactttaccaggaaacgcaaaatcttacctctcctacaaatcatattgattctccatgtgttcatacatttgaggcgcatacagatgaggttactgcattatcattagatcctagtttcttggtgagtggttcacaggatagaacaattaggcaatgggacttacgttccgggaagtgcttgcaaaccattgatctgagctttgcaaatgtcttaacaacatccactaatgtcgatttatcaaagagcacacttcttactcaaagaaatgagaggcctagtataggtgcactacaaagttttgatgcagcgctagcaacgggtacaaaagatggtgttgtaaggctatgggatttaagatccggaaaggtgattcgtactttgaaagggcatacagatgccataacgtcattaaaatttgattccgcgtgcctggtcacaggttcatacgacagaacagttagaatctgggacttaagaactgggttgttgaataagtttcatgcgtacagtgcgccagttctttcgttagatctcttccaagagaacgctgcagtcgttgtcgcagacgaaccaagtgtccagatatacgatagcgaaaaggatgaaagctggtcttgcgtcgaacaaggtaacgagactagcgttagtaccgttaagtataaagaaaattacatggttgagggtcgtgaaaatggggacgtaaatatttgggccgtatga

SEQ ID NO: 4642 - DNA, 2148 bp, Saccharomyces cerevisiae
atgaaaagcaggaaacgccaaaacaatatgcaaaatgaaacacgggagccagcggtattgtcgtcacaggaaacctcgatttctcgcatttctccacaagatccagaagcaaaattctacgttggtgtagatgtcggaacaggctctgcaagggcatgtgttatcgatcaatctggtaacatgttgtcgctagcagaaaaacccataaaaagggaacaattgatatccaattttattactcagtcttcaagagaaatctggaatgcagtttgctattgtgttagaactgttgttgaagaatcaggagttgaccctgaaagagttcgtggaattggttttgatgcgacttgttccttagtagtcgtatccgctaccaattttgaagaaattgcagttggaccggattttaccaataatgaccagaatatcatattatggatggaccatagggcgatgaaggagactgaagaaatcaactcatctggtgataaatgtttaaaatatgtgggagggcaaatgtctgttgaaatggaaattccgaagattaagtggttgaagaacaacttagaagctggaatttttcaggattgtaagttttttgaccttccggattacttgactttcaaagccacgggaaaagagaataggtcattttgttctgctgtttgtaagcagggatttctaccagtgggtgtcgaaggttccgatataggctggtccaaagaattcttaaattcaattgggctttcagagcttacgaagaatgattttgaaagactgggtggatcgttaagggaaaaaaaaaactttctgaccgcaggtgaatgtatcagcccgttagataaaaaggctgcctgtcaattaggcttgacagagcattgtgtagtaagttcaggaattattgatgcatatgcaggctgggtagggacggtagccgccaagccggaatcagcagtaaaaggtcttgccgagaccgaaaattataaaaaggatttcaatggtgcaattggcagattggcagctgttgccggtacgtctacgtgtcatattttgttatcaaaaaaccctatatttgtccatggcgtttgggggccttatagagatgtccttgcaagaggcttttgggcggcagaaggcggccaaagctgtacaggcgttcttttagatcatttaataacgacgcatccagctttcactgagctatcccatatggctaatttggcaggtgtgtcgaaattcgaatatttaaacaaaatacttgaaaccttggtcgagaagcgcaaagtaagatctgttatttctttagctaagcacttgtttttttatggtgactatcacggtaatcgatcaccgatagcagatccgaatatgcgcgcttgtattataggacaatctatggataactcaattgaagacttagcggttatgtatttgagtgcctgtgaattcatatcacaacaaacaagacaaatcattgaagtaatgctaaaaagtgggcatgaaataaatgctattttcatgtcaggtggacagtgtcgaaatagcttgttgatgaggttgttggctgattgtactggcctgccgatagtgattcctcgatacgttgacgctgcagttgtatttggttctgccttgcttggggctgcagcaagtgaagattttgattataccagggaaaaaagaactctcaaaggccaaaaatcttctcagacaaagacggaacgttttaacgattcatattcgtcgatacaaaagttatcaatggaagatcgaaactcgacaaatggctttgtatccccacataatctacaactttcaactccaagtgcgcctgccaaaataaataactattctcttccgatttgcacacaacaaccacttgacaaaacctctgaggaaagtagtaaggatgcttcattgaccgtgggacaggagagcctaggagagggaagatataacgggacaagttttctatggaaagttatgcaagagctaacgggtaatgcaagaattgtcaatccaaatgagaaaactcatccagatagaattcttttagacacgaagtaccaaatttttctcgatatgattgaaacacagagaaaatataggcgtatggtagataaagtagaagggtcctttagtagataa

SEQ ID NO: 4643 - DNA, 2148 bp, Saccharomyces cerevisiae
atgagccagcatattaggaaattagattctgatgtttctgaaagacttaaatctcaggcatgcacggtatcgctagcatcagcggttagagaaatagttcaaaattctgtagatgcacacgctaccactatcgacgtcatgatcgacctccctaatttgagctttgcagtttacgatgatggtattggtttgactcgaagtgacctaaatatattggccacacaaaattatacttccaaaatacgaaagatgaatgatttagtaacgatgaaaacctacggttacagaggagacgccctatatagcatttctaatgtctctaatctgtttgtttgttccaagaaaaaggattacaactctgcatggatgagaaaatttccatccaaaagcgtcatgttgagtgagaataccatactcccaatagatcctttttggaaaatttgtccttggagccgaacaaagtctggtactgttgttattgttgaagatatgctgtataatttacctgtccggcgcagaatactaaaggaagaaccccctttcaagacttttaacacaataaaggcagatatgctacagatactggtaatgcacccgatgatttcactcaacgtacaatatacagacaaactcagaatcaatacagaagttcttttccgctcaaagaacataactgaggggttaacaaagcaccagcaaatgtctcaagtactgagaaatgtgtttggggcaataataccaccggatatgcttaagaaagtttccttgaagtttaatgaatatcagattgaagggatcatatcgaagatgcccgttggattgaaggatcttcaatttatatatatcaatggcagacgttatgcggacagcgcctttcaaggatacgtcgattctttattccaagcacaagatttcggggagaaaggcatgagtttactcaaaactaaaagcgtgggaaaaccgtatcgatcacatcccgtcttcatccttgatgttcggtgcccccaaactatcgatgacctgttacaagatccagcaaagaaaattgttaagccttcccatatacgtaccattgaaccattgatcgttaagaccattcgctcctttctgacatttcaaggatacttaacgcctgataaatcagattcatctttcgaaatagtcaattgttcacagaagacggcaacattgcctgatagtcgaatccaaatcagtaaacgtaatcaagtattaaattcaaaaatgaagattgcacgcattaattcatacataggaaaacccgctgtcaatggatgtagaataaacaatagtacaataaactacgaaaaaatcaagaatataagaatcgacggtcagaaatcaaggttacggaataaactctcttccaggccctacgatagtggttttacagaagattatgacagtataggaaaaaccataacagatttttcaatatcaagatctgtcctggcaaaatatgaagtgattaatcaagtagataaaaaatttattctcatacgttgtttagaccaatctattcataattgcccactattagttctagttgatcaacatgcttgcgatgagaggataagactagaagagctattttatagcctgttgacagaagttgtaaccggaacttttgttgcacgagacctcaaggattgttgcattgaagttgatcgtactgaggctgacttatttaagcattatcaaagtgaatttaaaaagtggggaattggctatgaaacaattgagggaacaatggaaacctcacttttggaaattaaaacactgcctgagatgttaacttccaaatataacggggataaagactacttaaaaatggtcttgctgcaacatgctcatgacctgaaggatttcaaaaaacttccaatggatttatcccatttcgaaaactacacttcggttgataaattatattggtggaagtactcaagctgcgttccaacggtctttcatgaaattcttaacagcaaggcatgcagatctgctgttatgtttggagatgaattaacccggcaagagtgcataattttaattagcaagctctcgcgatgccataacccattcgaatgcgcccacgggagaccttctatggtacccattgcagaattgaagtaa

SEQ ID NO: 4644 - DNA, 2148 bp, Saccharomyces cerevisiae
atgctacggtttactcatcgaggccttccctccagcactcgttttagaaacattttcgtaaggttaaatcacatttatgtaccatggttctatgccatagacgtacccaactccaaaccctatttacccacatatcaaactttacactcacccaaaaagtttaagccgttctccgttgatgattctaatcgtttggaaaaggccagtaagcgtcaagaacgcaggcctgttttagtcaacgaagattacctgtttaaagtcgacctctctcacatggaattgtcccctacctattgggaaggccctacttatcaagtacgaagaggtgtgtggttcgactcttcaaatcaacctttgtccagtgatcttacctccgaaattgaagggttgtataagcagctcaaattcgacgacagtaatgatgatccgaccacgacacctcctgcagaatcgcaagatatatttaggctcaaaggtaaatacccagtcgataaagaaaacgaaggagagcaaaaaaatggatccagcaataaagatgagaacgaatctactttcaagtttattttgtttgccaataaacaaactgcatttttactatcggatttagatggaggaaaactgcaattagcctttctaaggtctaatctggctcaatccttaccgattaatgctacaatgattacaagatcatacaaatattcatcctccgcaactactaaacagacatccacatcttttaaggcagcaaaaacgcctcaaacggaagtagcagatggtagtaacagttccaaatcgaggagcattgaaacaaagttagaaaagaaagtttcaaacctcttcaatttatcggactttttacagttgttcaatggtaatgctagtaaagatcaagatgatgcacagagcttggaaaagcaaatggaaacagactataacaatgcagataacagtcaaggcgctaatgctagtagcaaaatagaagatggcaaaaattcgggcgcaagcgatagacaaattagaagtaacagaagagatgtggataacttgatactatgcgttcacggtataggtcagactttgggtaagaagtacgaatacgtaaatttcgcacacacggtaaatctacttaggtctaatatgaaaaaaatctacaataattctgagaaactacaatcattaaacacagcacctgattataaaagcaactgtaacgttcaagtgctacccatcacctggaggcactcgataagtttccaaacggatgctaaggaggaaaatatagaaaatcctgacctaccgactttgtcacaagtcacagtaaatggagtgttacccttgaggaagctactggctgacggtctactagatattttgttgtatgtcgaaccatactaccaagatatgattctacaacaagtaacctctcaattgaacaaaacatatcggatttttaaagaatttaatccagagtttgatgggaaagtccatttagtgggccattcgttgggtagtatgatattatttgatattctatccaaacaaaaaaaatatgaattagaatttcaagtagacaacctgttctttattggctcaccaattggattgttaaagttaattcaaagaacaaaaattggtgaccgtcccgaatttcccaatgacttggagagaaaattaaccgtacagagaccgcaatgtaaggacatttataatgtttaccacgtctgtgatcccatttcttataggatggaacctcttgttagtaaagaaatggctcattacgaacaaacttatttaccacattgtagtgaagcttatggactaacttctaaagttttggaatttggcgaaaacatatggaaagatttgccaggtactgatgaaaataatttgcagtccaaaaaaacttctccagaaaaaaaagaggtcaagttatcagaaaatcttacgagaatgcttacaggtttgaattacaccggacgtctagattatgctatgtctccaagtctgctagaagtggattttatatcagctataaaatcacatgtttcttatttcgaagaaccggatattgcagcgtttatcctaaaagaaattttaagtaaacatgaaaatgcatcagaaatatatgtaaaaagaaagactggttga

SEQ ID NO: 4645 - DNA, 2148 bp, Saccharomyces cerevisiae
atgggatatcaattgagtgcaacacttaaagggcacgatcaggacgtcagggatgtggtagctgtggatgattcaaaggttgctagtgtttcgagggatggaacagttcgcttgtggtctaaagatgaccaatggctcggtacggtagtttatacaggacaaggatttttaaatagtgtgtgttatgattccgagaaggagttgttgctttttggaggtaaggatactatgatcaacggtgtgcccttgtttgccacctcaggagaggatcccttgtataccttgattggccaccaagggaacgtttgtagtttatccttccaagatggtgttgtgataagcggtagttgggacaaaaccgcaaaggtttggaaagaaggatcgttggtttacaatttgcaagcacacaatgcctctgtatgggatgccaaagtcgtatccttctcagaaaataaattcttgacagcttccgccgataagacgattaaactgtggcaaaacgataaagtgatcaaaactttcagtgggattcacaatgatgtagtaagacatttagctgtggtggatgatggccattttatcagttgttcaaacgatggcctcatcaagttggttgatatgcatacaggtgacgtactaagaacatatgaaggccatgaaagctttgtttattgcattaaactgctgcccaatggagatattgtaagctgcggcgaagaccgaacagtccgtatatggtcaaaggaaaatggttcgttaaagcaggtaattacacttcctgccatctctatttggtccgttgattgtatgtctaatggtgatattattgtgggaagtagtgataatcttgtgagaatattttcgcaagagaagtcaagatgggcttccgaggatgaaataaatgaactatctacgcaagtggaaaaatccactataagttccaagacaatagaatttgatgagtctaaactatcaccttatgaaattttacaatcgccggggcgcaaagagggtcaaattgtggtagtcaaatcacctcaaggtactatagaagctcatcaattttcaaattcttcatggaaaaaggttggtgatgttgtcggtgcaggtgctactggaaacgacaaaaaaatagaattcgagggtaaaacgtatgactacgtatttgatgtggatattgaagatggaaaacctcccttgaaattgccgattaatgtcagcgacaacccatatacagcagccgacaattttttggctcgttatgaactgccaatgagttatagggatcaagtagtacagttcatactgaagaacactaatggcatatcgctagaccagcccaacgataatgcatcatcttctgcagtatcaccttcaaaaacgagcgtaatgaaggttcttcctgtcaagcagtatcttatcatggaaaattataacccagatactattttcaatggaatagtaaaaataaattcaaatgagaagacctttgatgatgaaattctggcgcaaattggtggcgcactacatgacatagatgaaagctgggagttgctactttcatttgctaacactataagatctaactgggaaattaagactcctgcatacgacatagtacgattgattgtaaaaaaattaccttattcttcagatataaaagattacatcgaagaaggcttgggcaataagaatatcactctaaccatgttaactgtgcgtattttggtaaattgcttcaataatgaaaactggggtgtgaaattactggaatcaaatcaagtttataaatcaatttttgagactatagatactgaattttctcaggcatctgctaaacagtcacagaatttggctattgcagtttccacactaattttcaactattcagctctcgtcacgaaagggaactctgatttagaacttttgcctatcgtagctgacgccatcaacaccaagtatgggccattggaagagtatcaagaatgcgaagaagccgcatataggctaaccgtagcttacggaaatttggctactgttgaacctacattaagacaatttgccaactccgtaacttggcttgcaaacatcaaaaggagctatgggaacgtgccaaggtttaaggatattttcgacgatctctcctaa

SEQ ID NO: 4646 - DNA, 2154 bp, Saccharomyces cerevisiae
atggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatatcctcattgctttgggtgtaaacaaaataggagacagactcaaaattttaaggaagtcaaaatcgttccagagagataaacggattgaacaggtgaatagattgaaaaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggtccaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctattacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaaaattgccacgcccaagaattggttaaaaggtgcttgcattggatcaggcagttttgggagtgtttacttgggcatgaatgctcacactggtgaactaatggcagtaaagcaagtggagataaaaaataataacattggtgttcccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggtccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtattctggatgtcaccagaggtggtcaaacagaccgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcacacataatttga

SEQ ID NO: 4647 - DNA, 2154 bp, Saccharomyces cerevisiae
atgtgtggtatctttggttactgcaattatctagtggaaagatccagaggagaaattatcgacaccttagtggatggtttacaaagattagaatatagaggctatgattccaccggtattgctatcgatggtgacgaagctgattctactttcatctataagcaaatcggtaaagtgagtgctttgaaagaggagattactaagcaaaatccgaacagagacgttacttttgtctctcattgtggtattgcgcatactagatgggctactcacggtcgaccagaacaagttaactgtcaccctcaaagatctgacccagaagaccaatttgtggtcgttcataatggtatcatcacaaattttagagaactgaagactcttttaattaacaaaggttataaattcgaaagtgataccgataccgagtgtattgctaaactatatttgcatttatacaatacaaatttacaaaatgggcatgacttagatttccacgaattaaccaagctagttcttttagaactagaaggttcatacgggttattatgtaaatcttgtcactatcctaatgaggttatcgccactagaaaagggtcccctttactgattggtgtcaaatctgaaaaaaaactaaaagtcgacttcgtggatgtggaatttcccgaagaaaacgctggtcaaccggaaattccattgaaatctaacaacaaatcatttggcttgggcccaaagaaagctcgtgaatttgaagctggttcccaaaatgccaatttactaccaattgccgccaatgaatttaacttgagacattctcaatccagggctttcctatcagaagatggatctccaacaccggtggaattttttgtttcttcggatgcggcatctgttgttaaacataccaagaaggtgctatttttagaagatgacgatttggctcatatttacgatggtgagttacatattcatagatctagaagagaagtaggcgcatcaatgacaaggtccattcaaactttagagatggagttagctcagatcatgaagggcccttacgaccattttatgcaaaaggaaatctatgagcaaccagaatctactttcaatactatgagaggtagaatcgactatgaaaataataaagtgatattgggtggtttaaaggcatggttaccagttgtcagaagagcacggagactgatcatgatcgcatgcggtacttcttatcattcatgtttggctactcgtgctatcttcgaagaattatcagatatcccagttagtgtggaattagcgtctgactttctggacagaaaatgccctgtcttcagagacgatgtatgcgtgtttgtttcacaaagtggtgaaactgcggataccatgctggctctaaattattgtttagaaagaggagccttaactgtcggaattgttaacagtgttggttcttctatctctcgtgtcacccactgtggtgttcatattaacgctggtcctgaaattggtgttgcctctacaaaagcttatacttcccagtatattgccttagtgatgtttgctctatcgctgtcagatgaccgtgtatcgaaaatagacagaagaattgaaatcattcaaggcttgaagttaatcccgggccaaattaagcaggtattaaagctggaaccaagaataaaaaagctctgtgcgactgaattaaaggatcaaaaatctctattgttattgggtagaggttaccaatttgctgctgctctggaaggtgctttgaagatcaaagaaatttcttatatgcattctgaaggtgttttggcaggtgagttgaagcacggtgtcttggccttggtggacgaaaacttgccaatcattgcttttggtaccagagactctctattccctaaagtagtttcctctattgagcaagttactgcaagaaagggccatccaattattatttgtaacgaaaatgatgaagtgtgggcgcaaaaatctaaatcaatcgacctgcaaaccttagaagttccacaaactgttgattgtttacaaggtctaattaatattattccattacaactaatgtcatattggttggctgttaataaagggattgatgttgattttccaagaaacttggctaaatctgttaccgtcgaataa

SEQ ID NO: 4648 - DNA, 2154 bp, Saccharomyces cerevisiae
atgttattaaacccagatcaaattctaaacctagttcgaaaagtatatgaagtagatattaaacagttttattcgcaattacggctaaagaacttaagaggattgttagaccatgctgctcatctgtttaatgtttacctgagggatttagaaatcaatcaggaaatggaagctttgacagcatttattattggttgttattatctgtaccttattattccacaatcgttacaattccaaacaagaaataatctctacagcagttacgcaaagctaaaaaacgactatcaagacgaacacgtgatgggttatgtgttaaaagtggtaagagatgaaagtactgttattgttgaccggtatttagcggagtcaaacggaatttgcaggaccataaaaagaaaaagagcctactccttaccgctacggcctttacctgttcatatggcctctttgtcaatacataacaagtttgatggctcactacatgaaataccgaatgagctaacaaaaccaacaaatgataattcgaaagaggacatagtcagggaaagtaatcagatagcatcaagtaataaattggaagctggttctgaagtggcgtactacacaagcaaagaagcattatcaaaaccctcgtatttaaaactcagtactggaaaggatgcattattcaaaacgctgtctagtccagcaactgctccccccgtgcactccttggaggtttcgtcacaaatcagagattctagccaagattcttcatcctctttatccaaggtggaaaagccaaaggaggaagaaggaaagatcgaggccatagaatcttcggccccgaaagcttacaatctaccagtaattgaagattctaatgatctgttatcagagttatctattactggcctgcaaaatccatgcaatacatgctatattaacagtataattcaatgtctgtttggcactaccttatttcgggatttgtttttaaccaagaaatataggctattcctcaatactaacaaatatccgaaagaagtccaactttcccgctcgatttacgttttgttcaaaaaaatgtatttgaatggaggaagagcgattataccaaatagattcttaaaaatgtgcaagaagttaaggccagatttgaacatcccagatgatcaacaggatacacaggaatttctactaatagttttagcacgaatacatgaagagctctcgaacgaaaatgttgtcaagtattatccagatctagtgtcatatgatgcgaatgctttacaagttaacccatccaaatacgagaaatggtacgagagaaatgttattactgatggtttatctccaattgatcacatatatcgagggcagttggagaacattttgaaatgtcagcgctgtggtaattcttcttatagctattctaccttctatgttctgtcacttgcgattccaaaactatcattgtatagctttacaagtaagtcgagaaaaattaaattagaggattgcataaacttatttacaggcgatgaagaactgtcaggcgacaatgcttgggattgtcctaattgtagaattactgattctaaatccaaaaaagaagaaattactagccagaagaaaaaatcaaccatattcggttttcattccagatcaaggtcaaaatcaccccaccatcatcaccatcatcaccatagcagcgatgattcaacaaaaaatgcaaagaagcgaaattctaaaaagttaaccacgattaagagtttagactttatagttttacctccgatacttgtcattcatttatcaaggttctattatgatttaacaaaaaaaaacagcactgtaataacctaccctttgatattgaacattattttaaagaacggtaaagtgattcgatacaagttatatggaacggtgaatcattccggtaaccttatcaatggacactatacttctgttgtgaacaaagaaaagagccatgaaattggactgaatagacaagtttgggttacatttgatgacgattatatacagcaacatcgcaaggatcgcaacaactttgaagccggcaaaacagaaatgtctagcgatgaggtatacgtcttattctacgaaagaatggatgaagagaactatgaagaagaattctgttaa

SEQ ID NO: 4649 - DNA, 2157 bp, Saccharomyces cerevisiae
atgggatccgaccggtcgtgtgttttgtctgtgtttcagaccatcctcaagctcgtcatcttcgtggcgatttttggggctgccatatcatcacgtttgtttgcagtcatcaaatttgagtctattatccatgaattcgacccctggttcaattatagggctaccaaatatctcgtcaacaattcgttttacaagtttttgaactggtttgacgaccgtacctggtaccccctcggaagggttactggagggactttatatcctggtttgatgacgactagtgcgttcatctggcacgccctgcgcaactggttgggcttgcccattgacatcagaaacgtttgtgtgctatttgcgccactattttctggggtcaccgcctgggcgacttacgaatttacgaaagagattaaagatgccagcgctgggcttttggctgctggttttatagccattgtccccggttatatatctagatcagtggcggggtcctacgataatgaggccattgccattacactattaatggtcactttcatgttttggattaaggcccaaaagactggctctatcatgcacgcaacgtgtgcagctttattctacttctacatggtgtcggcttggggtggatacgtgttcatcaccaacttgatcccactccatgtctttttgctgattttgatgggcagatattcgtccaaactgtattctgcctacaccacttggtacgctattggaactgttgcatccatgcagatcccatttgtcggtttcctacctatcaggtctaacgaccacatggccgcattgggtgttttcggtttgattcagattgtcgccttcggtgacttcgtgaagggccaaatcagcacagctaagtttaaagtcatcatgatggtttctctgtttttgatcttggtccttggtgtggtcggactttctgccttgacctatatggggttgattgccccttggactggtagattttattcgttatgggataccaactacgcaaagatccacattcctatcattgcctccgtttccgaacatcaacccgtttcgtggcccgctttcttctttgatacccactttttgatctggctattccccgccggtgtattcctactattcctcgacttgaaagacgagcacgtttttgtcatcgcttactccgttctgtgttcgtactttgccggtgttatggttagattgatgttgactttgacaccagtcatctgtgtgtccgccgccgtcgcattgtccaagatatttgacatctacctggatttcaagacaagtgaccgcaaatacgccatcaaacctgcggcactactggccaaattgattgtttccggatcattcatcttttatttgtatcttttcgtcttccattctacttgggtaacaagaactgcatactcttctccttctgttgttttgccatcacaaaccccagatggtaaattggcgttgatcgacgacttcagggaagcgtactattggttaagaatgaactctgatgaggacagtaaggttgcagcgtggtgggattacggttaccaaattggtggcatggcagacagaaccactttagtcgataacaacacgtggaacaatactcacatcgccatcgttggtaaagccatggcttcccctgaagagaaatcttacgaaattctaaaagagcatgatgtcgattatgtcttggtcatctttggtggtctaattgggtttggtggtgatgacatcaacaaattcttgtggatgatcagaattagcgagggaatctggccagaagagataaaagagcgtgatttctataccgcagagggagaatacagagtagatgcaagggcttctgagaccatgaggaactcgctactttacaagatgtcctacaaagatttcccacaattattcaatggtggccaagccactgacagagtgcgtcaacaaatgatcacaccattagacgtcccaccattagactacttcgacgaagtttttacttccgaaaactggatggttagaatatatcaattgaagaaggatgatgcccaaggtagaactttgagggacgttggtgagttaaccaggtcttctacgaaaaccagaaggtccataaagagacctgaattaggcttgagagtctaa

SEQ ID NO: 4650 - DNA, 2160 bp, Saccharomyces cerevisiae
atgcactatgtggtactagagctgcaagttgcgcatttgccagatacccccaaggatcaatgtcgcattgcgaatatagcatttcaaattgtgaatgctgaaacattagtatgccattatgggaccaattctttaccgagcattgaagtaaacgggacgacaaagagtttggagagtgcaatggtgcaattggacaaggatattcatgacgttattggtaacgacgactttgttcttgtttccctgtattcaacatggcatatccgtgttaccttaccacgtcaagcgagagatgatgggtttattcttacttcttatttacaacatccgaaagtatttgacttatggaaggaattcgatagatggtgtgtcaaccatccggagattttgggacaaaagaaagcaatctccaacaacaattgtaatactaaaagtattagtattaatgcagccaaaaatacgaaggatttggacgaaatagttagaatattggaagtttcaatcccaactgaagaggcaggctctgttccagagatatactctcttttaaaaaggacaacggatatattaatacaattgcacaaaaagtgtacttcccctgaagatatggaatctgtcttaacaaaaccatatgactcacacaccgatattagagcgtttttgcaagagaaatctaagattttgtacatgaacaatttaccgcccgacacaactcaaagtgagttggaatcatggtttacccaatatggtgttagaccagttgggttttggactgtcaaaaacatcgtagaagatacgtctaacgttaataataactggagtctaaataacagtccctatgtggaagatcaagatagtatctcaggatttgttgtcttccaaacacatgaagaagcaactgaagtactagcgttgaatgggagatcaatcctatctaatctggcaaacactaagcaaccaagggtggtggaacatgtccttgagcttcaaccttcttccaccggagtactcgataaggctcaagaaattttatcgcctttccctcaaagtaaaaacaaaccaagaccaggtgactggaattgcccatcttgtggtttttcaaactttcaaagacgtactgcatgttttagatgttcttttccggcaccatcaaatagtcaaatacatactgcgaactcaaacaataatgttaacagtagtagaaataatttaaacaatcgcgtgaactcgggatcttcaagcaatattagtaacactgcagcgaatcacccctatggtgcccctgagttcaacatgattgctaacaacacgccagcagctttaacatacaatagagctcattttcctgcaattacgccattgtcgcgacaaaattcattgaacatggcaccatcgaacagtgggtcgccgataattatagcggatcatttttcgggaaataataatatagccccaaattatcgttataataataatattaacaataacaacaataatattaacaatatgaccaataatagatataacattaataacaacatcaacggtaatgggaatggtaatgggaacaacagtaataacaataacaatcataataacaatcataataacaatcatcataatggtagtatcaatagtaatagtaataccaataataataataataataacaatggtaacaatagtaataattgtaattccaatatcggtatgggaggatgtggctccaacatgccatttagagcaggagattggaagtgttccacgtgcacgtatcataactttgctaaaaacgtagtgtgcttacgctgtggtggtccaaaatcaataagcggcgatgcaagtgaaaccaatcattacatagattcatcaacatttggaccagcgtcgcgtactcccagtaataacaatatttctgttaatactaatggtggtagcaatgctggtcgcaccgatgggaacgataacaaaggtcgtgatattagtttgatggaatttatgtcaccaccgttatcgatggcaacaaagtcaatgaaggagggagatgggaatggtagctcgtttaacgagttcaaaagtgacaaagctaacgttaatttttccaatgttggtgataatagcgctttcggtaatggttttaatagttcaatacgttggtag

SEQ ID NO: 4651 - DNA, 2160 bp, Saccharomyces cerevisiae
atgtctggaatgggtattgcgattctttgcatcgtacgtacaaagatttataggataaccatcagcttcgattattctacactgatgagccctttcttcttattcttaatgatgcccactacattaaaggatgggtacaggatgaatagtcaagtaaatgaagatgctataggtatcaatcttgacctctcactgcccactcacatttcgcctacgactggttcagagagcgccagtggcagtaacgccagtacacttcgcaacgatggaaatgcactagatggaggtcttttgaggacttcagcagcgatttcagcacccacaggtaccagtcaaccaacagaaactattggtgaaaaactgagtaatgaagagcgggtgaactcgaatgtttccgcttcgaactcgacaacggcgggtacagggcgtatgttaagccaatccttgactaatgattcaccgtcgaacgaaatatcgacggatcagttgaagatttttcaaagaatggacgaaatgagtgcccgaatgattgagatggaggaaagcttcaacaagttatctaataagatcgcggaacagaatacaatggttttaaacctaaaacaagataactataaagttatgaacaaattgaatatattacttaagttggttgcgcagccaagcgcgcgcccaagcacaaacaatgcccaaaataagcttgctatcgaattgctaaattcgatatcagccgttagtagtgcttacttgcagaaaatgcagaataatggctctggtagacagcatactgctgatttatgtacaggagattccaacacccattctggtatcaaccagcatcggactacgaatggaaccatagatgtgaatacgaatactgcacagctaaacaaccaattttctaacgcactaaatactatcttacctgatcagcagcataatcgaaataatgtttcccaaaatataaaccaatcgctccctaaccgacaacttggtcctgttataaacacacaagccaatcagaaccagtcgcaggttttaattcataacacaaatacacatcagcaggtaaatcgctcgcctattagtttcccgaacgcttcaactgacaagccattcaagttgaacccaaatgggattaaacggcgcagaagaaatacgcaaagtaacaacaatgcgagcacaaatgaccatgctagtgctgcacaaaagcccatatcagccctatctccattaacgaattctcataattctacaactagcatgaattataccaattcttccattcattcaggcgtcaccagtgcttcaaattcatttcatgacttaaattcattgaataactttggcacgacaacagctttaagtttgcccagcttagccctagataacgcttcttttcccccaaatcaaaatgttataccccctattataaataatacccagcagcctctatcattttcccaattgatcaatcaggatagcacgacatctgaattgttaccgagtggtaagtcaggggtgaacacgaatattgtaaatagaaacagagcttctactctaccgtcgtacccaaaaccaatgacagtgaaaagtaatgtcgacgatgatggctatcaagaggatgatgatgatgacggtgatgacgaaggtgatggaagggataatgaagaagacagcactgctgaggaagatgaagtagatgatgaaatcgaaacagatatgaagaacgcttcgattaacaagcggaggaggagcttgcatcataaaaaaagtaactctttaaacggtagaagaaagcttcacggcgagtcggctactaagcccaacataaactctgatttacattataggatattgaaggctcccactgacgtaaagactatatgggaagagtatgatactggaataagaggaaagccatcgatcaagcatcttgaggccaagtatggtaacaagtggaggctcaataaaaataagaagaccttttcaaggcgaaaaagattgtacaagttcattctgaacggtatggagagaggtaaaacggcacaagagatgatagaaaccttagagaacaaaaggctatataaagatgatgaggatggcgaagtaaagaaaagaaccattggctggttgcaagagagccttgctggaatatag

SEQ ID NO: 4652 - DNA, 2160 bp, Saccharomyces cerevisiae
atgttgttggtacatattatatctttccttctgttcttccagctttcggccgcaaaggccccacccagtaaaacgtctctaataaatactcatgagagaaggtcgatatattcatgctacgttggtttacgtaaagaaacatgggggttcaatgggtccgctatatgtcggtatgaaccagcaatccaatcgatgctttactgtctttacgaagacacgcatgagaaagggtattcaaataaaactttggagaaaggttttgaagaaatgagacaattttgctatacaccaaagtttttgaacatgactgatgccgagttttacacctcattggataatggaacatactatatacaagatcaacctaaagctggcatcaatatcacttatcctatcagactgaacactacactaagaaaagcatactatgatgcatactatggttactactataaccatgacattccgtattatttcgggggcattatctgtgcatactttgtgggtgtcatgttgcttgcaggtttaattcgttttttgaattataccccaataaaaaagattatgtttcagcaaaagctagtcaattacgtgagaggttatactactctacccactctttatgaaaagcatgcagagcccttctcgtacttaaaagtgataacaggctatcttcctactaggtttgaaacgttggttattttaggctacctcatacttcataccattttcatggcctacaaatatcaatatgatccataccacatcatatttgccgctcatagagcagaagtggcacattttgttgcgtacagaagcggtatactttcttttgcacacctgccactcattgttttatttgcgggaagaaataactttctccaacttatttctggcttgaagcatacctcattcattgtgttccataagtggctgggaagaatgatgtttcttgatgcaataattcatgctgccggctttacgaactattatttgtattataaaaaatggaatacggttagattaagagtctactggaaattcggtattgctaccacctgtttagcgggaatgttaattttcttttccatcgcagcatttagaagacactactatgaaacgtttatggccctccatatagtattcgcagcactatttctctatacttgttgggagcatgttactaacttcagcggtatcgaatggatttacgcggcaatagcaatttggggagttgatagaattgtacgtatcaccagaattgcactcttaggatttcctaaagcagatctacaactggttggatctgatttggtccgtgtaacggttaaaaaaccaaagaagttttggaaggcaaaaccaggccaatacgttttcgtttccttcttgcgtccattgtgcttctggcagtcgcatccatttacagtgatggattcttgcgtaaacgatagagaattggtcatcgttctgaaagcaaagaaaggtgtgacaaaactggtaagaaactttgttgaacgtaaaggcggcaaggcatccatgagattagctatcgaaggcccttatggctccaagtccaccgcccatcgctttgataatgtattattgttggcaggtggctcagggcttcccggtccaatttctcatgcccttgaattaggaaagacaacagctgcaagcggtaaaaactttgtacagttagtcatagcagtaagaggactagacatgctcaacgcgtgtaagaaagaactaatggcattaaagggcttgaatgttcaagttcacatttataattctaagcaagagctagcttcggctgaaaaaatttcctcaaatgaagtcaaaaacggtgaaacgacagcagagaaggccccatctagtctaagcaattcagaaaaagctccttctgaaagtgaaaatacagaactacctctttccctgaatgacacgtctatctccgatttagaatttgccactttccatgttggaaggccaaatgttgaagaaatactaaatgaatctgttaaccattctggttcacttgccgtcgtatgttgcggaccacctattttcgtcgacaccgctagaaatcaaactgccaaagctgttatcagaaacccatcaagaatgattgaatacttggaggaataccaagcctggtga

SEQ ID NO: 4653 - DNA, 2163 bp, Saccharomyces cerevisiae
atgaattcgaatgaagatatacatgaagaacgcattgaagttccacgaactccccatcaaacccagccagagaaagactctgatcgcatcgctctcagggatgaaatatcagtaccagaaggcgatgaaaaagcatattcggatgagaaagtagaaatggcaaccacaaatgcatccagtaactttggctcaaatgaaagtgcaaaagacggcgaatcaatcggcgccttttcaaatccccatgaggctctgatgcagtcaaaattgagagaagaatcccagagtaaaaccatactaccatccgatgacctcagccagcaattagaaaccgaagaatccaaagttgaagaggctctaaaaagaataacctcacccccattaccaccgagggctgactgcatagaagaatctgcatctgctcttaaatcctcattgcctccagtgctagcaggaaataaaaatgatcaagccccccttgaccgaccacagttacctccgaggcaggtagttaatgcggaaactcttcatttgaaggcgccccatggtaatgcgactccctccaaatcaccaacgagtgctgtaggtaattcttcttcatcgacccctccaaccttaccaccacgccgtatagaagatcctttagacttggctgctcaaaaacatttcctagcgagtacatttaagagaaatatgctcttttataaaagtgaagataactctatcaaatgtgatttggataaaaatatactaaatttaaaagaagattcaaaaaaaattaacaacaatgaaattcctgaagaggttagttcattttggttaaaggttatcggcgactatcaaaatatcttaataaacgatatcgaaaccttacatttccaactatctcgaggtataccagccgcttatcgattggtagtctggcagttagtaagttatgcaaaatcgaaatcctttgaccctatatatgaaacgtatctaacggaaatggcaccttttgacgtccaggaatttgaaaatcagctaaaaatgatggacgaagttccctctgaatacgtaaaacgcataagtaatgtgttaaaggcttatttactttttgacccagagtgtgagttttctaccgacattgcttatattatcaatatgattcttgacgtttgcgaggaggaggcaaatgcatttggtctacttgtacgcctaatgaaagtttacggtttaagactcttgttcttaccaagtgcttctgagatcgatattctttgctataaatttgatagacttgtagaagaattttatcctgaaattcacaaccacatggttgaaaaaggcgtccgttcttccatgtttttgcccggtttcttcacgacactgtttcaaaagaaacttcccactgaaattcaaccacgtatcggtgatatggtatttttagaaggtattgactctattatgagaattttagccacacttttatctaattcccgagaccatctgttaaaaatgggttttgatgatatgctggagctattgaaatcaggtctgttagatgcttatattaagcagaatgatggtacacgcggtgacactcttctctcaaatgaatgtatggataaattactacaagactctatgatgaaagtagcaataaccccaaagactatgaagaaatattcttctgaatatgaggaaattcacagattggacaatgaaaaagaagtgcaatataagtctatcacggaaaaaaatttacatttacaaaagcatgttcgtaaattagaaaacgactacacatctttaaatagagagcatgtgacaattgcgaacgagttagtgaaaaatcggcttaatatcgagtctgtattaaatgaaaataatggttacaaacttcaaattttagatttgaagaaaaagttggattcagaaaaaaagaagcaagttttaggtgtatatgtgcccaatgatttaaagaaagatttggaagagacaatgaaaaagaatacccaagtaatggacgaaaatttgaaattgcaggataggatttcagaactagaaaggcttattgaagaaataaaaactgcaaacaaaaatggtacgttattcgaatattctaattctaaaaataatcctttgggagccggctggtcaggatttaaaaaggtttttaaatag

SEQ ID NO: 4654 - DNA, 2163 bp, Saccharomyces cerevisiae
atgactcagcaagaataccgttccccctcacaacgcttatccaaggggaggagcatgtcgctacccaaaatatttgctcgtaatttgagatctctgcaaaacaatgcacctcctggcaaaaacatcaatgtcaattgtttgaacgtcaattcttgttcgttgtccgcaagcccaagctcacaaattaatatggcttgtaatggaaacaagcaagatcttcccataccgtttcccctgcatgtagaatgcaacgatagctggtcaagctccaaacttaacaagttcaaatcaatgtttaatcataacagatcaaagagcagtggtactacagatgcgtcaacttcagaaaaaggtacgcataagcgtgaaccccggtcgacgatacatacagagctgttacaaagttccattatcggtgagccaaatgtccatagtactacaagtagcacacttatacccaatgaggcgatatgctccacacctaatgagatctcaggtagctcttctccggacgcggagttatttacctttgacatgcccacagacccgtcatccttccacactcctagctccccaagttatatagcaaaggacagtagaaacctgagtaatggatctttgaatgatattaacgaaaatgaagagctccaaaatttccatagaaaaatcagcgaaaatggcagtgcctcccccctggctaacttgtcattatccaattcaccaattgattccccaaggaaaaatagcgaaaccagaaaggatcaaatacctatgaacataacaccacgtttaaggagggccgcttccgaaccgttcaatacggcaaaggatgggttaatgcgggaagattacattgccttgaaacaacctccaagcttgggagatattgtagaaccgaggagatctcgtcgtttaagaaccaagtcattcggtaacaagttccaagacattactgtcgaacctcaatccttcgaaaaaattagactacttggccaaggtgacgtaggtaaagtgtatttagtgagggaacgcgataccaaccagatattcgccctgaaagttttgaataaacatgagatgatcaagaggaagaaaattaaacgagtactcactgaacaggaaattctcgcgacaagtgatcatccatttattgtgacactgtatcattcctttcaaaccaaagactatttgtatctctgtatggaatactgcatgggaggggaattctttagagccttacaaacaagaaaaagtaaatgcattgcagaagaagatgcgaagttttacgccagtgaagtagtagcagctttggaatatttacacctactgggcttcatatacagagatttgaaacccgaaaacatattactgcatcaatctggtcatgtcatgctttctgactttgatttatccatccaagcaacgggatcaaaaaaacccaccatgaaagactctacgtatttagatacaaaaatttgttcagatggattcagaactaattcctttgttggtactgaagagtatttagctccagaagtaatcagagggaatggccacactgcagcagtagactggtggactttaggaatattgatttacgagatgctatttggctgtactccatttaaaggagataattcaaatgaaacattctctaacattttaaccaaggacgtcaaatttccacatgataaggaagtttcgaagaattgtaaagacctgataaagaaactactaaacaaaaacgaggcaaaaaggcttggttccaaatcaggagctgcagacataaagagacatcccttcttcaaaaaagttcagtggtcgttcttaagaaaccaagacccccctctaatacctgcattaaatgataacggctgcgaacttccttttatattgtcttgcaataaacacccgaaaaggaactcagtgagtgaacaggaaaccaaaatgttctgtgagaaagttgcaaacgatgatgaaattgatgaggctgatccattccatgattttaattctatgagtttaacgaagaaagatcacaatatcttaacctactctgaaaattatacctacggaaaaattctatacaaagcaacttgtacaaggccaaggcataacagctcacatagaagtttctttaaagacatcatacctgaactataa

SEQ ID NO: 4655 - DNA, 2163 bp, Saccharomyces cerevisiae
atgcctttgagaaatctaactgaaacgcacaactttagtagcacaaacctggacacagatggtacaggcgacgatcatgatggtgctcctctttcctcatctccttcttttggacaacaaaatgacaatagcaccaacgataatgctggtctcacaaacccttttatggggagtgacgaagaatctaatgcgcgggatggagaatctctgtcttcttctgttcattatcagccacaggggagtgactcttcactacttcatgacaattctcgtctagatctaagtcaaaataaaggtgtatctgattacaaaggttactattccaggaacaatagtagagctgtgagtacggctaatgataactcatttcttcagccaccacatagagctatagcctcttctccttctttgaattctaatttatcgaagaatgatattctctcaccgccagaatttgatagatatcccttagtgggttccagagtcacttctatgactcaactgaaccatcatggtcgctcgccaacatcatctccaggaaacgagtcgtccgcctcattctcttctaatccgtttttgggcgagcaagatttttctccatttggtgggtatcctgcttcatcgttcccacttatgatagatgaaaaggaagaagatgattatttacacaatcctgaccccgaagaagaggcaagactggatagaaggaggttcatagatgacttcaagtacatggataaaaggtctgctagtgggctagctggtgtattgctcttgtttctggcagccatctttatttttattgttttgccagcgttgacctttaccggtgctattgatcacgaaagcaacactgaagaagttacatatttaactcaataccaatatcctcaactatccgccattagaacatctctggttgacccagacacacctgatacagcgaagacaagagaagctatggatggctctaagtgggaattagtattttctgatgagtttaatgcagaaggcagaacattttatgatggggatgatccatactggacagcccctgatgttcactatgatgctactaaggatttagaatggtacagtccagacgcttccacaactgtgaacggaaccttgcagctgagaatggatgcctttaagaaccatggcttatattacagatcaggtatgttgcagagttggaataaggtttgtttcacgcagggtgctctagaaatctctgcaaatctaccaaattatggccgtgtttcaggtttgtggcccggtctttggactatgggtaatttagggaggcccggttatttggctagtacccaaggtgtctggccttattcttatgaatcgtgtgatgctggtattacacccaaccaaagttccccggatggtatttcttacttgccgggacaaaagttaagtatttgtacttgtgatggtgaagatcatccgaatcaaggtgttggtagaggagctccagaaattgatgttttggaaggtgaaactgatactaagattggtgtaggtatagcctctcaatccttgcaaattgcaccttttgatatctggtacatgcctgactatgattttatcgaggtttacaatttcacaacaacgaccatgaacacttatgctggcggtccatttcaacaagccgtatctgctgtctcaactttgaacgtaacttggtatgaattcggtgagtacggtggctactttcaaaaatatgccattgagtatctgaacgatgacgacaatggttatatccgttggtttgttggtgatactccaacttatactattcatgctaaagccttacatcctgatggtaatattggttggagaagaatcagtaaagaaccaatgtcgattattctaaatctgggtatttccaacaattgggcttatattgattggcagtatattttcttcccagtggttatgtcgattgactatgttagaatataccaaccaagtaatgctatatccgtgacatgcgatccaagtgactatccaacatatgattatattcaatcgcacttaaatgcattccagaatgcaaacttaactacttgggaagatgctggttacacgttccctaagaatatcctaactggtaaatgtactagctcgaagttcaagttatcctcttaa

SEQ ID NO: 4656 - DNA, 2163 bp, Saccharomyces cerevisiae
atggccaaaagagttgccgatgcgcaaatacagagagaaacgtacgattctaacgagtctgacgatgacgtgactccctccactaaggttgcgtcatctgctgtgatgaatagaagaaaaattgccatgccaaagcgcaggatggcgttcaaaccttttggttctgcaaaatcggatgaaaccaagcaggctagttcctttagcttcctgaaccgggcggacggcactggagaagctcaggttgataatagccctaccacagaaagcaattccagactaaaagcattgaacctccagttcaaggctaaggttgatgacttagttctaggcaagccgttagcggacttgaggccccttttcaccaggtacgaattatacataaagaatatcttagaagctcccgtgaaatctatcgagaatccaacgcagacaaagggaaatgatgctaaacctgccaaagtagaagatgtccaaaaaagttccgattcttcatctgaagatgaggttaaggtggagggacccaagttcacaatagatgctaaaccgcctatttcagattccgttttctcatttggcccaaaaaaagaaaatcgcaagaaagatgaaagtgatagcgaaaacgatatagaaatcaagggccctgaatttaaattttctggaactgtatcaagtgatgtatttaagctgaatccaagcaccgataaaaatgaaaagaaaaccgagactaatgctaaaccattttcattttcttcggccacttcaactactgaacaaacgaagagtaaaaatcccctttcattgacagaagctaccaagaccaatgtggacaacaacagtaaagccgaggcttccttcacttttggaacaaaacatgctgcggattctcaaaataataaaccatcttttgtatttggtcaagcagctgcaaaaccatcgctagaaaagagctcattcacgtttggttcaacaacaattgaaaaaaaaaatgacgaaaactcaacctctaactcaaaacctgaaaagtctagtgatagcaatgattcaaacccatctttttccttttccatacccagtaagaatacacctgatgcatctaagccatcttttagttttggggtcccaaactcttccaaaaacgaaacttcaaaaccggtattttcgtttggtgcagcaacaccatcggccaaagaagctagtcaggaagatgacaacaacaacgttgaaaaaccttcctctaagcctgccttcaatttaatatctaacgctggtaccgagaaagagaaggaaagtaaaaaggactcaaagccagctttttcatttggcatatcaaacggaagtgaaagcaaagactctgacaaaccctctttaccctctgcggttgatggtgaaaatgacaagaaagaagcaacaaaacctgctttttcgtttggaataaatacaaatactactaaaaccgcggatactaaagctccaacttttacatttggctcctctgcactcgctgacaataaagaggatgttaagaaacctttttcattcggtacctcccagcctaataatactccatccttctcattcggaaaaacaacagcaaacttgcctgctaattcttcaacatctcctgctccctctataccatcgacggggttcaaattttctttgccatttgaacaaaaaggtagtcaaacaactacaaatgatagcaaggaagaatcaacaacagaagcaactggaaatgagtcgcaagatgcaaccaaagtagatgctaccccagaagaatcaaagccaataaacttgcaaaacggtgaggaagacgaagtggctttattttcgcaaaaagcaaaattaatgacattcaatgctgaaaccaaatcgtacgattcaagaggcgtaggcgaaatgaagcttttgaagaaaaaggacgatccttctaaagtgcgcctactttgtaggtctgacggtatgggtaatgtattactaaatgcaactgttgtagactccttcaaatatgagcctttagctcccggaaatgataatctcattaaagctcctactgttgcggctgatgggaaacttgtaacttatatcgtcaagtttaagcagaaggaagaaggccgctcatttacgaaagctattgaagatgctaaaaaagaaatgaaataa

SEQ ID NO: 4657 - DNA, 2166 bp, Saccharomyces cerevisiae
atgaagtttggtgagcacttgagcaagtctcttattagacagtacagctactattatattagttatgatgatctgaagactgagctagaagataacttatctaagaataacggtcagtggacgcaagaattggaaacagattttttagaatctttggagatcgagttagacaaggtttacacattttgcaaagttaagcatagtgaagtttttagacgtgtaaaagaggttcaagaacaagtgcaacatactgttcgtttgttagactccaataatcctcctactcagctagattttgagattctagaagaagaactaagtgatatcattgccgatgttcatgatctagcaaagttttcgagactaaactacactggtttccaaaagattatcaagaaacacgataagaagacaggttttatcttgaaaccagttttccaagttagattagactctaaaccatttttcaaggaaaactatgacgaactagtcgttaaaatttcccaactatatgatattgccagaacttcaggtcgcccaatcaagggagactcatctgctggtgggaagcaacaaaatttcgttagacagacaacaaagtattgggttcaccctgataacattacagaattgaagctgatcatcttgaagcatttaccagtgttagtcttcaacactaataaggaattcgaaagagaagattccgctattacttcgatctattttgataatgaaaatctagacctttattatggcagattaagaaaagatgaaggtgcagaagcccacagattgagatggtatgggggtatgtctacagacacgatctttgtagaaagaaagacccatagagaggattggactggtgagaaatctgtcaaggcaagatttgcgctaaaggaacgtcatgttaatgacttcttaaagggtaaatatactgttgatcaagtatttgccaagatgcgtaaagaaggcaagaagccaatgaacgaaattgaaaacttggaggcgttagcatccgaaattcaatacgtcatgttaaagaaaaagttgagacctgtagtgagatcattctacaatagaactgcttttcaattacctggtgatgcaagagttcgtatctcccttgatacagagttaactatggtgagagaagacaactttgatggtgtggatagaactcataagaattggaggagaactgatattggtgtcgattggccattcaagcagctagatgacaaggatatttgccgtttcccatatgcagtcctggaagttaaattgcaaactcaactaggtcaagaacctccagagtgggtacgtgaattagtcgggtctcacttagttgagccagtcccaaaattctccaagtttattcatggtgtggctaccttactaaatgataaagtggattcaatcccattttggttacctcaaatggatgttgatatcaggaaacctccactaccaacaaatattgaaataacaagacccggtagatccgataacgaagataacgacttcgatgaggatgatgaggatgacgctgctttggttgctgccatgacaaacgcacccggtaattctcttgatatagaagaatctgttggttacggggctacttcggcccccacctccaacactaatcatgttgttgagagtgctaatgctgcttattatcaaagaaagatcaggaatgccgaaaatcctatctccaagaaatactatgaaatcgtggcattttttgaccactattttaacggtgatcaaatatctaaaatcccaaaaggtactacttttgatactcaaattcgtgccccaccgggaaagacgatatgtgtgccagttcgtgtggaaccaaaagtttactttgccactgaaagaacctacctgtcttggttgtccatctcgatattgttgggcggtgtctccactactttattaacatatggttcaccaacagccatgattggctccattgggttctttattacttccttggctgtgttgatacgtactgttatggtttatgccaagagagtggtaaacattagactaaagagagcagtagattatgaggataagatcgggcccggcatggtttctgtgtttctaattctctctattttattttcctttttctgcaacctagttgctaaatga

SEQ ID NO: 4658 - DNA, 2166 bp, Saccharomyces cerevisiae
atgagtgacagttctgtgagggaaaagaatgataatttccgtggctatcggaaaagaggaagacaagaactgaggaagattaaaagatcttctgccagaactgaaggcggaagcacagaaacattagaggacgtagcagaagatattgaccatagatccgatgaggatgaagtgtccgatgtcgacagtggcgatgatttcgatattgaggatgaagagggtaaaaaggaaaaagtttatgacgctttattgacgattctcaaatctgaacatccagagccaaaaagaagaaggcgagaggctgacgagagtaacaaagctcctgccgaagttggggaggatgagcacgaaaatacagaacatggaccagtggatgatcaattggagatagagaatggccttttgggtaatcacgaggatgataacgacgatgacagcagtggagacgaaaaagatatagacagtgaagatgagcaagatcctttcgagtctcatttcaaccaagttccggagaaattcgttgataagttgtcgaatgctttcaagaccaaaagtgtaaaatacaaatccgtaaagggctcactaagtgacagtgaatcatatatatatgctaaaccggtagtaattggtgaggaagcattggtggaaagtccgtacaggtcatcatctatatattcatactttttgaaacaaaggctaaaagtgcaaaatggactattggataaaaaaactgatccattgactgctttgcaaaaaaaattagtagaccccatgtttcagtataaagacatattatacgagtatgactcctacgaaaaggacgaagacgagtacagagatttatatgctttgcatgttttgaatcacatctacaagacaagagatagaatcttgaaaaataatcaaagattacaggataacccagacactgaacacctagatcaaggttttacaagaccaaaagtgttaattgtagtccctactagagaggtggcgtaccgcgttgtagataagataatttcaaaatctggtatagatcaggttgacaagaagggaaagttctacgaccaattccgtgacgactccttacctccaaagtccaaaccaaaatctttccaacacatatttagggggaacaccaacgatttttttgttgtcggtctcaaattcacaagaaaggctataaaactttatagcaatttttaccagtctgacattattgtatgttcgccattgggtattcaaatgatcttagaaaatacagataaaaaaaagaggcaggacgattttttgtcctcaatagagttgatggtgattgatcaattacattcaatagaataccagaacatatctcatattttcaccatctttgaccatcttaacaaaatcccggatcaacaacatgaagctgactttagcagaattcggatgtggtacattaatgaacaagctaagctcttcagacagacaatggtattcacaaaatacatctcgccagcggctaattcattaatcaatggtagatgccgtaacatggcaggaagatggaagaatcacaaggtaataggatcagaaaactccagtattgggcaatccggtttgaaaatcaggcaaatctttcaaagatttgacattattgggaattcgattattgaagagcctgactacagatttaaattttttacaagtgtcatcattcctggtattgtcaaatccaccgggtatgaagacggaatactgatttacattcctgattacactgatttcattcgtattagaaactacatgaaagagaagacgacgattttatttggggatataaatgagtactctagccaaagacagctcaatgcaaataggtcattgtttcaacaggggcgtctaaaagttatgttgtatacggaaagactgcaccattatagacgttatgaaatcaagggtgtcaagagcgtcgttttttataagcctccaaacaatcctgaattttacaatgaagttgtcagatttattggtaagaacgcctttctaggtaataccgatttaaacatatccactgttagatgcatttatagcaagcttgatggtctttcactcgaaagaattgtggggacgaaaagagcagctgtattatcgcatgcacaaaaggaaatttatgaatttaaataa

SEQ ID NO: 4659 - DNA, 2169 bp, Saccharomyces cerevisiae
atgaagggaaactttaggaaaagagatagctccaccaactcaagaaagggtggtaattctgacagcaattatacgaatggaggcgtccctaatcaaaacaacagttcaatgttctatgagaaccctgaaattacgagaaactttgatgaccgtcaagattatttgttagccaatagtataggctctgatgtaacagtaactgttacttcaggtgtgaaatataccggtttattagtatcttgtaatttggaatctactaatggtatcgatgttgtattaagatttcccagggttgctgattcaggagttagtgattctgtggatgacttggctaagactttgggagaaaccttgctgattcacggtgaagatgtcgctgagttggaactgaagaatattgatttgtctcttgatgagaaatgggaaaattccaaagcccaagaaacaacgcccgccagaacaaatattgaaaaggaaagggtaaatggagaatcgaatgaagttacgaaattcaggactgatgttgatatttctggttctggtagagaaattaaggagcgtaagttagaaaaatggacacccgaagaaggcgcggaacattttgatatcaacaagggtaaagctttggaagacgattctgccagttgggatcaatttgctgtgaacgagaaaaagtttggcgtaaagtcaacttttgatgaacatttgtatacaacaaagattaacaaggatgaccctaattacagtaagaggttgcaagaagccgaaagaatcgctaaggaaattgaatcgcaaggaacttccggtaatattcatattgcagaggacagaggtatcataattgatgattctggtctagatgaagaagacttatactctggtgttgatagaagaggagatgagttgttggccgctttaaaaagcaattctaagcctaattccaacaaggggaataggtatgtcccacctactttaagacagcaacctcatcatatggatccagcaattatctcttcgagtaattctaacaaaaatgaaaatgccgtttccacggatacctctactcccgcagcagcaggtgcgccagagggaaaacccccacaaaagacttctaagaataagaaaagtttgagtagcaaagaagcccagattgaagagttgaagaaattttccgagaaatttaaagttccatatgatattccaaaagacatgctagaagtcttaaaaaggtcaagctctacattaaaatctaattcttcgttgcctccaaaaccgatcagcaaaaccccttcggccaagactgtttctcctactacacagatttctgcagggaaatcagaatctagaagaagtggcagcaacatatctcaaggccaatcatctaccggccataccacgagatctagtacttcattgagaagacgtaatcatggttccttttttggtgccaagaaccctcatactaatgacgccaagagagtgttgttcggaaaaagttttaatatgttcatcaaatccaaggaggcccacgatgaaaagaagaaaggcgatgatgcctcggagaatatggaacccttctttattgaaaaaccttattttactgcgccaacctggttaaatacaattgaagaatcgtataagacatttttcccagatgaggatacggcgattcaagaagctcaaactaggttccaacaacgccaattgaactccatgggcaatgctgtgcctggtatgaatccagctatgggcatgaatatgggcgggatgatgggctttccgatgggaggtccatcggcatcaccaaatccgatgatgaatggctttgctgctgggtcaatgggtatgtacatgccatttcaacctcagccaatgttttatcacccatctatgcctcaaatgatgccagttatgggtagcaatggggctgaagaaggaggaggaaatatttcgccccatgtccctgcaggttttatggcagctggccctggcgctcctatgggtgccttcgggtatccaggagggatacccttccaaggaatgatgggatcaggtccatctggcatgccagcgaacgggtcggcaatgcacagtcatggccatagtagaaattaccatcaaactagccaccatggccaccataatagtagtaccagtggccataaatag

SEQ ID NO: 4660 - DNA, 2172 bp, Saccharomyces cerevisiae
atgagctctagagcattaaggagattacaagatgataatgctctgctagagtcgctgctatcgaattcaaatgcgaataaaatgacgagtggtaaaagtactgccggtaatattcagaaacgggagaacatcttctctatgatgaataacgtacgtgattcagataatagcactgatgaaggacaaatgtctgagcaggatgaagaagctgctgctgctggggagcgtgatactcaaagtaatggtcaacctaaaagaattacactagcatccaagtcttctagaaggaaaaagaataaaaaggcaaaaaggaagcaaaaaaaccataccgccgaggctgcaaaagacaagggttccgatgatgatgatgatgatgaagaattcgacaagattatccaacagttcaaaaaaactgatatattgaagtacggtaagactaaaaatgatgacactaatgaggaaggtttcttcacggcatctgaaccagaggaagcatctagccaaccttggaagtcatttttaagcttagaaagtgatccgggcttcacaaagttccccatttcatgtttgaggcattcttgcaaattttttcaaaatgatttcaagaaattggacccccatacggaattcaaacttttatttgacgatatatctccagagtctcttgaagatattgattcgatgacatccacacctgtctcccctcagcagctgaaacagattcagagactgaaaagattaattagaaactggggcggaaaagatcatagattggcacctaatggccccggaatgcacccgcaacatttgaagtttaccaagatcagagatgattggatcccaactcaaagaggtgagctctctatgaaacttttaagttctgatgatcttttagattggcaattatgggaaaggccgttagattggaaggatgttatccaaaacgatgtcagtcagtggcaaaaattcatttctttttataagttcgaacctttaaattccgacctgagcaagaaatcaatgatggacttctacttaagtgttattgttcaccctgatcatgaagcccttataaatttgatttcttctaaatttccgtatcatgtgcctggactgctacaagttgctttgatatttattaggcaaggtgatagatcaaacactaatggattgttacaaagagcactctttgtctttgatagagctttgaaagcaaatattattttcgattccttgaattgtcaactaccttatatatacttcttcaacagacagttttacttggcaatatttagatacatccaatctcttgctcaaagaggtgttataggaactgctagtgaatggacaaaagttctctggtcactgagcccattggaagatcctttaggatgcaggtatttcctcgatcactattttctattgaataatgactatcagtacattatagaattatccaactctccattaatgaactgttataaacagtggaatactttaggattttccttggcggtagtactaagcttcctaagaataaatgagatgagttccgcccgcaatgcgcttctaaaagcctttaagcatcatcctttacaactgtcagaacttttcaaggagaaactcttgggcgatcatgcgctaactaaagatttatccattgatggccattcggcagaaaacttggaattaaaggcatatatggcccgcttcccgttactttggaatagaaacgaagaggtaacatttttgcatgatgaaatgtcgagtattttacaggattaccatagaggaaacgttacaatcgattcaaatgatgggcaagatcacaataacattaacaacttgcaatcacctttctttattgcgggaatcccaattaacttattaagattcgccatactatctgaggagtcttctgtaatggctgcaattccatcatttatctggtctgataatgaagtatatgagtttgacgtattaccaccaatgcctacgtcaaaagaatcaatcgaagtggttgaaaacatcaaaacctttattaatgaaaaggatttagctgtccttcaggcagaaagaatgcaagatgaggacctgttgaatcaaattagacaaatatctttgcaacagtacattcatgaaaatgaagagtcaaatgaaaatgagggttaa

SEQ ID NO: 4661 - DNA, 2172 bp, Saccharomyces cerevisiae
atgttcaggtcgcatgcctccggtaacaagaagcaatggtctaaaagatcctcaaatggtagcacacctgctgcttcggcatctggctctcacgcatacaggcaacaaacgttgtcttcgttctttatgggttgcggcaaaaaatctgctgctgcttcaaaaaacagcacgacaataattgatttggaaagcggtgacgaaggtaaccgtaatataacagcacctcctaggccaagattaatacggaataattcgtcttccttattctcgcagagtcaaggttcgtttggagatgatgatcccgacgcagaattcaaaaaattggtagatgtgccgagactcaatagctataaaaagtctagcagatcgctgtcgatgaccagctctcttcataagactgcctctgcgtccacgactcagaaaacataccattttgatgaggatgagactttgcgagaggttactagcgtgaaatccaattctagacaattatcgttcactagtacaattaatattgaagattctagcatgaaactttctactgattcagaaagaccagccaagaggtctaaaccttctatggagtttcaaggtttaaagctcacagtaccaaagaaaataaaaccactgctaagaaagacagtatcaaatatggactcaatgaaccaccgaagtgcgtcttcgccagtggtacttacaatggagcaagagagagtggttaatttaatcgtcaaaaaaagaacaaatgtcttttacaccggtagtgcgggtacaggtaagtcggtcattttgcaaacgatcataagacaattgagctctttgtatgggaaagaatcaattgcaattaccgcctcaactgggctagcggcagtgactattggtggttccacattgcataagtggtctggtataggaatcgggaacaaaactatcgaccaattggtgaaaaaaatacaatcacaaaaggacttattggccgcatggaggtatacaaaagttttgataattgatgaaatttctatggtcgatggtaatctgttggataaattagagcaaatcgcaaggagaattcggaagaacgacgatccctttggtggtattcaattggtcctgacaggcgatttttttcaactaccaccagttgctaagaaggacgagcataacgttgtgaaattttgttttgaaagtgaaatgtggaaacggtgcattcaaaaaacgattttactgacaaaggttttcagacaacaggataacaaactaattgatattctaaatgccataagatacggagagctgactgtcgacattgctaaaacaataaggaacctaaatagggatatagactatgccgatggaattgctcctacagaactgtatgccacaagaagagaagttgaactatccaacgtaaagaaattacagtctctacctggtgatttatatgagtttaaagctgtagataacgcgcccgagagataccaagcgatactagattcttcattaatggtggaaaaagttgtcgcattgaaggaagatgcacaggtaatgatgttgaaaaataagcctgatgtagaattagttaatggatcattgggaaaagttttgttttttgttacagaatcgctggtggtgaaaatgaaggaaatttacaagattgtggatgacgaagttgtcatggacatgagattagtgagtcgggtcattggtaatcccttgttaaaggaatcaaaggagtttcgtcaagatttgaatgccaggccattagctagattggaacgtttgaaaatcttgataaactatgcagttaagatctctccgcataaggaaaaattcccctatgtgaggtggacagtgggtaaaaacaagtacatacatgagctcatggtcccagagcgctttcccattgatattcccagagaaaatgtcgggttagaaagaactcagattccattaatgctatgctgggcactgtccattcataaggcacagggtcaaactattcaaagactaaaggtcgacttgaggagaattttcgaagccggccaagtttatgttgcactgtcaagagcggtaactatggacaccttacaggtcctaaactttgatccaggaaagattcgcaccaatgaaagagtaaaagatttctataaacgtttagaaactttgaaatga

SEQ ID NO: 4662 - DNA, 2175 bp, Saccharomyces cerevisiae
atgaatctgcaagaactattagcgaaagtaccgctgttgttatcgtatccgaccattattctatccagtaatctgatcgtaccttcccataatgatctcatatcacgagcagcctctacatcagcagcagagtatgctgacgaaaagctaatatttttcagtacagatcatgccatcagactgatttttctgccaaccttcgtagcttcttcctttaacctatttgcgcactattttaacttcatcaattactctagccgaaggaagtattatgttttatttactgcaatttatttcctatccatattgactgcgattttccatccaattcagtcaacatgcatcactctattgattatcaagctcctgactaccgctgatgagtcttcgccaaaaattgccctcaatttcaagaccattttgaaaacatttgttccctttattactttaacattagttatattgcgttgggatccttcttttgatgccagctcaggagatgtgaacaaaatttctacgtctttggccgcatatgctctcttaatattaacgctaagatatgcatcaccgctgatattatcgacgttatcaagtagcataggtgttgtttccaaagacaccagcgtcgcacagcattcgataagtagaaataagagatttccgctaattctcgtgttaccgattttttcctttgttcttttgtatctaatgactatagttaacaagacttacaatatccagttattaatggtatttgtgttttttggatgtctgtccattttctttttatcgttaaaagatttgttcacagaggatggaaatcaaaagaagggaggccaggaggatgaatattgtcgtatgtttgacataaagtacatgatttcctatttatggctgacaaggttcaccattttattgacaggcataatggctattgtagtacattttttatcgtttaatgaaattacttcttccatcaaaactgatttgttaagtttacttttcgtcgtagtggcagaatatgtttccagtttctctaacaaacaacctgattcgcactcccataatcatgcacatcaccattcccatctaaccgattcattgcctctcgaaaatgaaagtatgttcaaacaaatggcattgaataaggacaccaggtccattttttcgtttttattgttgaataccgctttcatgtttgtacaacttttatattcctttcgttccaaatcattgggcttattatctgattcgttgcatatggccttagattgcacatctttgctcttaggtctaattgctggtgtattgaccaagaaaccagcaagtgataaattccctttcggtctaaattatcttggtaccttggcaggtttcaccaatggtgttctgttactcggcatagtgtgcggtatctttgtggaggcaattgagagaattttcaaccccattcatcttcatgcaacaaatgagttgttggttgttgctacgttaggcttattagtgaaccttgtaggtttgtttgccttcgaccatggtgcacatgatcatggtggtactgataatgaaaacatgaaggggatttttttacatatattggcagatacattaggttctgttggcgttgttatttcgacgttattaatcaagttaacacactggccaatttttgatccgatcgcctctttattaattggttccttgattttacttagcgctctgcccctgctaaaatctacttccgcaaatattttactaagactggatgacaagaagcataatctagtaaagagtgcgctaaaccagatttcaacgacgccaggaatcacaggttatacaactcctagattttggccgacagagtcaggcagttccgggcattcacatgcacacacgcattctcatgcagagaatcatagccatgagcatcatcatgatcagaaaaacggttcacaagaacacccgagcttggtgggctatattcatgtacagtatgtagacggcgagaattcgacaattatcaagaaaagagttgaaaaaatattcgaaaatgtgtcgattaaagcgtgggtacaagttgagcctcaaaattccacttgttggtgccgggctacttctatgaacacaatttcagctaacccgaattctttaccgctacagcctatagcaaattga

SEQ ID NO: 4663 - DNA, 2175 bp, Saccharomyces cerevisiae
atggtaatgcaggaggagaagaagcggcaacaacctgtgacaagaagagtaaggtcattttctgagtcctttaaaaaccttttcaggccgcctcgttcaagagattcaagtcctattaatgtcacccgaattccttatcgatcgtcttctacctcacccaagagaagctctgagccaccaagacgatcaaccgtatccgcacaaattttagatccaaaaaattctccaatacgccagcgtagttatacattgaagtgttgcaccccgggcctgtcacatccatttagacagacaggaagtggtgctagtaatagtcctaccagacatcgctctatatctggggaagaacaggaaattgttaacagtttaccagaatacaaaagatctgcttctcatacttttcatggcatacggcgtccacgttcaagaagttcatctgtttcgtcatgtgacagttcaaatggaacgacaagttcatcagacagtcaatgggctatggattctttactagatgattcagacaatgacctcacaccttatcgtggctcgaacaaagatatactgaaaagtaaagaccgggcgccgtataattacatagatgactacaataagaaggctttacgcagagcaacatcatatccaaatcctctcccctccaagcaattctataatgaaaggttatacaccaggaggtcacatccagatgaagaaagtttggagagcttgcctcgatttgcaggagcagatgtgcaatgtataattgagcaaaatggcttcaaagtttacgaagacggaagtcatgaacataatataaagttatcaggggtaattgcgaaattagagaaaggtaactccttaccggcacatcgacagggatcattatctagaccaagattaggtattactctttctggtctattcaaacatcataaaaatgaatgcgatattgaaaacgctttatctcttctgccaaacgtagaaaaatctcagacaaaccatgagaaaagaaccggtcaaagtcctaacgatagcaaccgcagctcgcccacgcaaggaagggaagattatctaaaaatagtgaatcccgacgcatcattgggcagtgatgagttgaagttgattaattcattatcaagcagaattcataaaagtttacaaaattatttgcaagaaaaaaatctaaaaccggctgagtgtatcggcgagcaagcacctacttttcaagataattatggccatcctgttggtctcgttggcgctggagcttacggtgaagttaagctgtgtgccagactacggaatgaaaaggactcccccccatttgaaacatatcatgatagcaaatacatatactatgctgtgaaagaattgaaacccaaaccagacagtgatttagagaagttctgtacaaagatcacctctgagtttattattgggcattccttgagccactaccacaaaaatggtaaaaaaccagcccccaatattctaaacgtatttgatattctagaagacagttcttcgtttattgaagtaatggaattttgccctgctggtgacctttatggtatgctggtcggtaagtcgaaattaaagggccgattacatccgttagaagccgattgtttcatgaagcaactgcttcatggtgttaagttcatgcatgatcatggtatcgctcattgtgatttaaaacctgaaaatattctcttttatccgcatggtctattgaaaatatgtgacttcggtacaagttctgtatttcaaaccgcttgggaaaggagggttcatgctcaaaagggtataattggatcagagccttacgtagctccagaagagtttgttgatggggagtattacgatccaagactgattgactgttggagttgtggcgttgtttatataacaatgatattggggcattatctttggaaagtagcttcgagagaaaaagatatgtcttatgatgaattttacaaggaaatgcagcgtaaaaaccagtttagggtattcgaagaattaaagcacgtaaactcagagttggccacaaatagaaaaatcgcattatatcgcatctttcaatgggaaccaagaaaaaggatttctgttggcaaacttttagatatgcagtggatgaaaagtacgaattgctgcctaatatatgattccacataa

SEQ ID NO: 4664 - DNA, 2175 bp, Saccharomyces cerevisiae
atgtctgatttaattgaattacagaggaactatttgataggggttttgaatcagattgagacgaaaaataacttgaagtttcttattatcgataaaactgtggagacaatattgagttatcttttcctcacaccccaagaacttttaaataatgtcacatctgttgatttgattgattccccaacaagaaaaggacaatcctccatcgaggcaatttacatattggaaccaacgaaatataacatcaattgtatcgatgctgacttcatggtaagaccacctaagtacagaagatgtcacatcagatttttaccaggattaacaaaccctatatttcagttttttcaatcaaaacgttacattgctcaaaatttggagtcatttaagccgatcgaactagggtttttcgtcaaagaatctcaattcttcgaaactttacaaatggaacactcattacaggtttttttcaacaacaactgtaaggctttgattcctactaacgtgaggaagattgtaggctcactagttagtttgtgtgttattacgggggaatatccgattgttagatattctgtatctaatcctgtggaagaggaagatgcccgcaatggaaacgccgtagtcaacgcaaattctttaacaaggtctattgcaaacgctttccaaatagcgatagatacatacgctcgcaataatccagatttccctcctcaaaacactgaaagaccgcgttccattctaataatcaccgatagaacactggacccttttgcgccaatattacatgattttagctatcaagcaatggcttatgacctggtagctaatgtggacacacaaaaagatatatatcattattctgccgagaatgaagctggtgagcaagaggaaaaggtttcaaaattggtagatttgtatgatcctgactggattgatttgaaacatcagcatattatggatgccaacgaatatattcaaggaagaatcaaggaactgattgctaaaaaccctctgctggttgatagatcgaacgtaaagaatactaccgatctgctgagtgtcgtagcgcacctgaaagattttgatgaagaaagaagaaggctgattttgcataagacactggtagatgaatgcctaggagagaacgcggaaagaaaattagcggatatttctgctattgaacaaaacctatccggatttggaatggattttagtggtgagaagataaagcatattatcgatgatctcttaccagcgttagcaatgaaggaaccgacaatcttagataaattgcgttacattattgcgtatgctcttttcagaggtggaattatcgagttagacttcattaaattattgaactttataggagttactcatgaacatgaaaatttccagcaatatttaaaaatattcagaaattacgatttaattgatttcaaattgatcaaagacaaaccgaaggataaaccatttcaaaaggaatggtttcatgatactttagtgaatgatccaaatatctatcacacttcaaggttcgttcccgctgtagggaatattctttcaaaggttatagcgaatccattgttattgagcgaacaatacttcccatatttaaaggacaagccaattgagttattgaatgaagaagaattccaagcaggcttagcgaatacctctgctaactcctcctcatccttaaggaatccccgtcacaaggcagcttggaccacgaaaagctctaatataaaaaaaaacatacctagacaaagattcttctactatgttattggtggtatatcaattcccgaaattaaagctgcttatgatcaatcaaacttgaagaacagagatatctttattggcagcgacgagatattaacaccaacaaaattcttagatgaagtggaacgtttacaaaatcctagagaatttttcaaattcaaggaagatcagcgccagcaagtaaacccgcctgatttccttctaagggaaatgaaaccggtggcacaaccagtctctcatgttcatttaaaaagccaagacaatagtcctaagtctggtacttctagtcccaaagcagcaggttctctcaagtcagaaccacccgaaaaagagaagaaacgtagcaaattctcgaggttcttgaaaagaaaatctcaccatgataaatga

SEQ ID NO: 4665 - DNA, 2175 bp, Saccharomyces cerevisiae
atgttgtctcaaacctccataccggaagtgaaagaagacgtgataggctatgcgctacaccagaggagagccagagtgggacaattccaagacttgggtccgcctgatttaattactttgatcaaatcgttaccttcatcctcgagcacaacaactgctactgcctccgccaacgataacggagcaacttcaaacatcaatggacaagatcctacgaccatagttacggagttacattcccatgacaaattaaaggggcagatcggcactttcttttactgtatgggtatcgatacttcggatccaacttctattacaatctttgccaaaaagataaccgatcttttcttagacacgccccaaatttggtttggtaagaagaagcactttcacgtatcgaagatttctatcagttcttggaatgcgtttaggaaatatgatgttaacattatagttcacattccaggaactgtgcaaacctacattataaatagcgacggtgaacaatcgcaacttccctccgtggcagaagcgtcatctggccgcaactcacaggatttaaacgtcaacatgatttgggcggaaacgtttatgagtggtattgtacgtgacattatgattatgaaagataatcgtgcggatggagaatcccagaatttggtagaaacactaattttcaatccatttacctcgggtgagttggaagatgttgccaataactttattaaactgttccccttggtctatgaaaaaggtgtttatttagatgcacctactcacgttttaaatccctcgttaaccaataattatttagtggaaactttagtggaaatagttaggttaactaagagtttggaagcatgtcgtaaaatgctcaagaagttaatagaaattcatccagaagcagtaataatattaattcgtgtttattttgcgtgcgatttagagatagatgcagttgacctgatcaacgagcaactaaattccccctcttcgttcttagccgacgattcaaagactagccatatccagctaatcttcaaatccgaattattaagtattcaaagtgaattcttactggatgtcaagagagattacaagcttgctaaggaagtagccatggaggctgttaactgtgcaccaaacgaatttaaaacttggtatttattgactagaatatacattaaactaaacgatatgtcaaatgccttgctatcgttaaacgcctgccccatgtcacaggttaaggaaaaatacgttcttagaagaattgcgcctattacttcagatgaaaatcttcatctgccattaccattggatgcctcaattgaggagatttcgtcattgaaccccatggatgtccagttggagcaaaagtccgcagatccaaacctagtcaatctctctgcgtcaagtttaaagtctactttccaactagcctataaattattgacagaaattgtccaaataacaggatgggagcagctgttgaaatatagatcaaaaattttcgttatggaagacgagtaccaaggctccacttcttccattgatgaagcagaagttcgcggtaatgatatatccaaaatgagatcaaagaggctatgcgaaagatggttggataatctcttcatgttactatacgaagatttgaaaacttacaccgattggcaatcagagcaattgtattttgatgctcaaaacagtaaatatcacaaattaactgttgaatgggaattattcggcctttgtgcgaaaagactgggacatcttccagaagctgcgaaggctttccaaattgggctttcccaaagattttctccagtatgcgcaaagaatctattacagttttacattgacgagcataagcgtattaggagggattcagtctcagcaaactccgagttaacctcttctcaaatattgtcaagtatcaatgacatcgacagctcaatcatcgatctagtagtcaagatttgttgctggaatcatcgttggtacatcgagttctcaataatattaatagatgctctgagtgttgcagtacaagatatgggcattactaaagtacataatgaaattgcctctagattttctgacccagtagcccaattgattgacgataacattctaaattttctgaagaatttcacgaatgacactttcgataattag

SEQ ID NO: 4666 - DNA, 2178 bp, Saccharomyces cerevisiae
atgacattatctttcgctcattttacctacctgttcacaatattgttgggattaactaatattgccttggcatctgatccagaaacgattctagtgacgataaccaagacaaacgatgcaaatggggttgttacaactacagtttcacccgcgctagtctccacatccactatcgttcaagctggcactacgacattgtatacgacttggtgtccattgacggtatccacttcatctgctgccgaaataagtccttcaatatcgtacgctactaccctatccagatttagtactttgacattatctacagaagtctgctcccatgaggcatgtccttcgtcatcgacgttgccaaccaccaccttatctgtgacttccaagttcacttcatatatttgccctacttgtcacacaaccgctatcagctcattatccgaagtaggaactacaaccgtggtatcatccagcgccattgaaccatcaagtgcctctataatctcacctgtcacctctacactttcgagtacaacatcgtccaatccaactactacctccctaagttcgacatctacatctccaagctctacatctacatctccaagctctacatctacctcatcaagttcgacatctacctcatcaagttcgacatctacctcatcaagttcgacatctacatctccaagttcgacatccacatcttcaagtttgacatccacatcttcaagttctacatctacatcccaaagttctacatctacctcatcaagttcgacatctacatctccaagctctacatctacctcatcaagttcaacatctacatctccaagttctaaatctacttctgcaagctccacttccacttcttcatattcaacatctacatccccaagtttgacttcttcatctccaactttggcttccacttctccaagttcaacatctattagctctacttttactgattcaacttcatcccttggctcctctatagcatcttcatcaacgtctgtgtcattatacagcccatccacacctgtttactccgtcccttcgacttcgtcaaatgttgcaactccttctatgacttcttcaactgttgaaacaactgttagttcacaaagttcgtctgaatatatcaccaaatcctcaatttctactactatcccatcattttccatgtctacatatttcaccactgttagtggagtcactacaatgtatacgacatggtgtccttatagctctgaatctgagactagcacattaaccagtatgcatgaaacggttacaacagacgctacagtctgcactcacgagtcttgcatgccctcgcagacaacaagtttgattacatcttctataaaaatgtccactaaaaacgtcgcaacttctgtaagcacctcaacggttgaatcctcatatgcatgctccacatgtgctgaaacgtcacactcgtattcttccgtgcaaacagcttcatcaagttctgtaacacagcagaccacatccacaaagagttgggtaagttcaatgacaacttcggatgaagatttcaataagcacgctaccggtaagtatcatgtaacatcttcaggtacctcaaccatttcgactagtgtaagtgaagccacgagtacatcaagcattgactcagaatctcaagaacaatcatcacacttattatcgacatcggtcctttcatcctcctccttgtctgctacattatcctctgacagtactattttgctattcagttctgtatcatcactaagtgtcgaacagtcaccagttaccacacttcaaatttcttcaacatcagagattttacaacccacttcttccacagctattgctacaatatctgcctctacatcatcactttccgcaacatctatctctacaccatctacctctgtggaatcgactattgaatcttcatcattgactccgacggtatcttctattttcctctcatcatcatctgctccctcttctctacaaacatctgttaccactacagaagtttccactacttcaatctccatacaataccaaacttcatcaatggtaacaattagccaatatatgggcagtggatcgcaaacgcgtttgccattaggaaagttggtcttcgccatcatggcagttgcttgcaatgtaattttcagttaa

SEQ ID NO: 4667 - DNA, 2178 bp, Saccharomyces cerevisiae
atgcctcaatctactccaagtcaagaagtacagcgtgtaccatgggataataaacctgctttgaagcagataacactccgagcaaccatagcaggtatcgctatagggtctctggtgctaacatcaaattttcaatttggcctgcaaaccggttgggtttccatgatgtccctgccatcggcattgttagcttgtgctttctttaaaaatatctggccattaatatttccgaacgacaggcctttcagtgacgttgaaaatgtatacgtacaaagtatggcagtagctgtcggaacaggcccattagcctttgggtttgtcggcgtcatacctgccatcgagaagttccttactaacgacgaaagtggtggattaagggaacaaggacagtccttcacttttagagaattgttaatatggtccacagccctagcattcttcggtattttttttgcagttcctctaagaaagcaagtaattgttagagagaaacttcccttccccagtggtagcgccacggccactttaatttcagtgctaaatggaactgagattttacaagaggtttctaagtcagagttattggaaatgaggcagaggagattgaatgaatgccctgaagtgctacaacccaacagagatccagaggaggcggattatttaatgaactcttctcatagcgaacttggtgattatacggcaactagccaagatggaagttctatcctttctactggctctgagaactacagagcgaatattattattttattgaaaacttttgttgtttcttcgctttacaccatggtgtcatattttgtaccggtaatacggtctattccagtcttcggaaaatacctctcgaacaattatctctggaattttcagccgtcgcctgcgtatataggccaagggataataatgggtcttccaacagtatcgtatatgcttatcgggtgcttcttaggctggggtgtgttagcaccattggcgagatacaaaagatgggtaccaccagatgctgatgtccacgactgggaggagggagtgcaaggatggattctttggtcgtcgctttcaataatggttgctgacagtgtagtcgcttttattgttgtgacagtgaagtccattgtgaaatttattcttatagatgacaaagctgctttactgaacaacataatcgatgatacatttcaatctatgttactggaggaggaacgcgccattaatagcagcagaagaaatacatatgttgatggaaggcaggacaccgtaagattagtgagtagagataacgaaatagaagtagattcgaagcatttggttcgctataccaccgttatcagtggatgtctagtctcctcgataatatgcattgtttccataatatatttgtttgggatacaagtaattcccctatatgctattatcactgctttgatacttgcgttgtttctatctattctcggtattcgagcacttggagagaccgatctgaatcctgtgagcggcattggtaagatctctcaattgatttttgcctttatcataccaagggatagacctggatcagtgttaatgaacgtggtatcgggaggtattgcagaagcctctgcccaacaggcgggcgatttaatgcaggatttgaaaacggggcacctcctcggcgcctccccaagagctcagttctgtgcccaattgataggggcctgttggtcaattattttgtctagcttcatgtatttgtgctacaataaagtttattcaattccgagtgagcaattcaggataccgacagcagtagtgtggatagattgtgcaagactagtaactggtaaagggctccctgataaggccttggagtgctccatgattctcggagtcatatttgccgttttatcattaatcagaaacacttatagagattacggatacgggtggatattatatattccgtctggtgtagcagtcggtgttggtatatttaattctcccagttttacaattgcaagattcatcggcgggtgggcttcgcatttttggttgaagaatcataggggtgacttaaatgcgaaaacaaaaatgattgtattcagttcggggttggtcttaggtgaaggtatctttagcgtaataaacatgctcttcatctgcttaaatgtccctcactattag

SEQ ID NO: 4668 - DNA, 2178 bp, Saccharomyces cerevisiae
atggactgggcaatcaatgtcgcccatccacgattactttacaaggatcctaaactttcagtaacgtttattgtgccgagcttatttcatatcattattgctttcgtgttattaggaatatgtgcatccgattttctttgccccaacgtggcccatatatcagatcccaacagccttcgatcgaatggttctttagtctcaaaaacggcgtcccatgcatctcatactggggcattaatggcagttctactatcttggtgtaactcttcgcctgacctattttccaacttaatgagctgggcaacctctacgagagaaacaaggtcaacctcagtatcgctatcaattggtgaggtgcttggcgcttgcggcattatcctgtgcattgtagagggctccatttttattattatgtcaagaactcacattgaaatctcgcaaattcaaaaactatccatcatgagagacttgttattttctttagctgccatgtgcgtaatgagttacgtttcccttatgaatcaggtcactgtgctgaattgccttttgatggcgttcctttatgccttttatctagtcgttaagttaactttcaagcttaatcattctgcagaaaccccagatgaaactgctgcggatacgagcctcagagaaaactccgtttctccttttttggatgactctctgatggcttctggtttactaccaccaatacaacctggctttgacatatccaattctataacacacggcattaagcctagtttgctatctgctatggatttcaatagtttcttatcaatgcttgaaaactcatctttggaggaggatgactcaaggaatgaaatggcagaattgaacactctacgtagcatgacgccgggacaacattggtccgcctctgcaacagttgcaggagaggcaacgagtgctggaagacctttcagtgagccaacgaatgcgtttacggaatatagagattctgaaagagcaataaatagttccccagcggtgttcgccccctaccgtgacaaccctgatgatgaagagtctcaagagcaagtattattggagacaacaacgcatggtcattttggtgcgcaagaaatgcgaaggttctccaaaaggtctctgggctggattataaaaattttcataccacatctctcaaatttttcccagaaatccatctcagatgcgatcttttccataataactgttccgtttttcattattttcaaactatcatgtcctcaaccgccttcagatattttgagttatgatcccactttgaacagatactctttaacaacgttacccataattttattatttatccaatcaattactgcacccttcctcctttgcagtatactttctgtgcttttgacatatcatctaggctatctcgtttaccttttccctcttatattagctatggccttaattttactattgacggcttttattacaaaggtaaatctgcataacaagtttactctgtcattagacagctctaacattttacaggaaaagctacaaaaaagaaaactcctcgaaaggcttaacacaagcatccaaataatttttctagctatcggcataataaatatcataatttggatatcacttttagccaattctcttattgagatgatggaaatttaccaaaaaatattaggattatcgaaagctattttgggccttaccattttcgcatggggcaactcagtaggagacttgatctccaacatatctatgtgcaggctctacaaaacccaaactcactaccaagacagagttcgtttagccacaaaattttttatgatatcatgcgcatcttgcttaggaggcgtaatgctgaattctatgggtggaataggctttagtgggctagtatcaatgctttttattggcgcttttaatgataacgaatggtggttcctaagaaaggttaaattacaagaaacaagtcaattggataatacattaaattacaaattcatagtttcttgcgtcttcattatcctacagattattctcttgctgttattcttcggagggcctaacaatattaaacggcgcctcacaaaggagatgaagttagtcggaatctctatgtgcggactatgggcactagccacgttgattaatatacttctagaactgtttagctaa

SEQ ID NO: 4669 - DNA, 2178 bp, Saccharomyces cerevisiae
atgtttaaagtgtttggttttggtgcgaaggaagagattcctgagctttcacaggaagaaaaaactaaagccattctaaaacaagctcatgatttcgaacaggcactgcgtgcgatggactatgtcttagatgataatgctgacgagggtttggctttgctggatgagagtgatgctaaagaagcttccgaccaaactataaatgcgttagctcgtggtgtcattgaatttttggaggccactttaggttttgaagctgaagagatgaaaaaagcttctgcgactttggccaaggcagaagctttatctttgaaaagtagagagagggctcaaaaaattggattgaagagcagttctttatatcctccaggaacagtttatgccgtgacttatacagaatcatgccttctacatgccctattgatgattttcagtgaaagtatgatggaggcggccaaggccattttaaagctcagaaagtcgtactatatgttacaagaaatcttggaaactattaaagctgctaacaaagccaagaaattgaaaattacgtcaggcagtgaagataaggagtccaccccagcgactttcataactggtggcgatgcgttcaattccgttgatataccttatgaactgactcctgaagaacaaaaggataaggatcttttacaatttgctgaacaaattcatagcatgaggactgaaagattatctggcgcccacattggcaactctcctgcaattaacaggttgagaggtgagctaggactacaagcaatggaagacttgccagaagaggaaataacagatcataaagttctttcggatgatatagatttaagtcaagcaacaattgatgagtttgtccattctggtgtcaatttatgctttggtattttacaggttgtgatatcactattaccacccgctattggcgcggtcctatctgtggttggattcaggggttccagagaagaaggtttgagacttgtttggaaagccacaaagcaaagaaacgtgcatggttgtattggtttgttagccctgatgttttactatgatggacctttccaattcactgacgatgattttgatattcctgcagcagttaaggattccagtaacagtgaagattctgaagatgaagagatggatggccctacgttgttgcatcctgggaaaatactggaagatgcgttgctgcaatcaagagcgctatttcccaatagtgcgctatggttattgaatgaggcaaggatgctatctggtaaagggcgtttagaggaagcagtcgcattgatggattcgattgatgttagcaagatacggatgagacaggtcaaatccttgatgatttttgaccgtgctataacattgatccatttgcatcaatacgatagagctgcagaagatattttatcgctattagacatcagtgattggtcacacgctttttacacatattttgctggctgctgttatttagaaaattggagaatgtgcgaaatgggattaatgaagtcagacaaaaaggatgaataccaaaagaaggccgaagaacttatcttcacctctgtgaatttgctaggtaagaaaaccttcaaatcgaagaacctgccattagataggtttattctgagaaaagttgagcaatttaaagcgaaaaaggaggaacttggggtggaaaatcctctggatggtatcgctacttcaccagtacacgaaattgcgtacttctacaatggttataatagaatgtctgaagagcatttggagctaacaaagaaaatgctaactgagtatagaaatcccgccattgaagctttagactcagatcaggagttaatcaaagatctcttggtctctttgacattaagaagattaggtcatatccaagaaggttgtgatatattggatgaaaaggttctacctaagtttttctccattcaaaatggcaaggtcaaatatataaagaaaactgaagatccatgggcctatccgactgcactttatgaacgtgctctatttacatggaagttggagggcatggatggccttccagagagtaaagaatggttactgagggctcagggctacgcagatgattatgaattgagtacgagagtaggtatgaaaattaaggctgccattgaccgcgttgaccattcattgtaa

SEQ ID NO: 4670 - DNA, 2181 bp, Saccharomyces cerevisiae
atgccaccattggataaaagaatcaagaagtttctaaaagactccattagaattgcgccaaaaatatccggtaagggtgaactaagtgaattaagaactggattagtatctcaatacccacagactcggaaagatgcaataaagaaaacgatccagcaaatgacgttgggaaaagatgtctcttcgctgttcccagacgtcttgaaaaacattgccacaattgacgttgaacaaaaaaaactggtttatctttatgtgatgaattatgctgagacgcatcccgaattatgtattcttgccgttaacacattcattactgatgcacaagatccaaatcccttaattcgctgcatggcaatcagaacgatgtcaatgataagagttgacaaaatcctggaatacattgaaacaccactccgccgtaccttgcatgatgataatgcatatgttagaaaaaccgcagtgatatgtgtcgcaaaacttttccaattaaacaaggatttatgcgttgagttgggtgtcgtcgaagatttggtcaatgccctagatgactcaaatcctttagtcattgcaaacgcaacagcagcattaattgaaattcacaatatggatatggatgccgttgatctttcaagtttgatccagtcccacgtttcacaattcttattagctttgaacgaatgtacggaatgggctagaattatcatactaggaactctttcggaatattcggcaaaagattctttagaggcacaagatatcattgatcgagtaactgcgcatttacaacacgttaatccagccgttgttttagctacaataaaggtaatcgtaaggaacttgcctcaaattgaatattcctcgaacagtctgataatgaaaagattatcatctgcttttgtatcactgatgtctacgccgcctgaaatgcaatatgttgctttgaaaaatattaggatcatattggagaaatatccagagctgttaaccaaagaattgagaatattttatgtcaagttcaacgatcctctttacgtcaagttagagaagatcgatatccttgtaagactagtcgatccttccaacttgaaacaatgtactttgttgttgacagaattaaaggaatacgcaatggaatatgaacctgagtttgtttcaagagctattcaagctttgtcccagttgggtattaaatatgcacaagaatcattcgtcagtaaagtcttggatattctcctagaattgttagaaagacaagacacaataaaagacgactgctgtatatcattatgtgatttattaagacattgccccggaaacgataagatggccaaacaagtttgtgcagtatttaatacttggtcaaatccagaggtgttattacaatcagatattgcgaagtgcaactatgtctggttgctaggacagcatcccaacaatttctcagatttggagtcaaaaatcaatatttttatagagaactttgttcaagaggaagctttaacacagatgtctttactaatgacaatagtcagactacatgctactttaacgggtagtatgctacaaagcgtcctagaattggccacacaacagacacatgaattagatgtgcgagatatggctatgatgtattggagatgcctttcgatgccaaataatgaaagtttggttaatgatctatgtcaaaataaacttccaatgatctccaatacactggagaagttttcaccagaagtgctagagaaactattaatggaattgggtactataagttccatttatttcaagcccgactcaaataggagaaaaggcaaaaagtatgttcaaaatatagttaaaggaaaacatatagaggaattagaaagcatggcaaaaaatgaaatttctagcaaggctaacgatgatgtgctattggattttgatgaaagagatgatgtaacaaatacaaatgcaggaatgctgaatactttaacaactttaggcgatttggatgatttatttgatttcggaccatctgaggatgccacacaaataaatacaaatgataccaaggctgtacaagggttgaaggagctgaaactaggtggcgactcaaacggtatatcttctggtggtaaaaacaatcccgatgtttcgggcggcaatatagtgtcacaggatctcctcgatttattctga

SEQ ID NO: 4671 - DNA, 2181 bp, Saccharomyces cerevisiae
atggaattatcccctacttatcaaacagaacgcttcacaaagttctcagacactttaaaggaattcaaaattgaacaaaataatgagcaaaaccccattgacccgtttaacatcataagagagtttcgctcagccgcggggcagcttgcgttagatttggctaattctggagatgaaagtaacgtcatatcttctaaggattgggaactggaagctagattttggcatttagtagaactgttactggttttcaggaacgctgatcttgatctagatgaaatggaacttcatccttataactcgaggggtttatttgaaaagaaattaatgcaagacaacaaacaactttatcaaatatggatagtgatggtttggctcaaagaaaatacatatgtgatggaaagacccaaaaatgtaccaacttcaaaatggttaaatagtattacttctggaggattgaaaagctgtgacttggattttcctttacgagaaaacactaatgtcctcgatgttaaagataaagaagaagatcatattttcttcaaatacatttacgaactaattttggccggtgcgattgatgaagcattagaagaagctaaactttccgacaatatttcaatttgtatgatcctgtgtgggatacaagagtacttaaaccctgtcattgatacgcaaattgcaaacgaattcaatacccagcaaggtatcaagaagcactctttgtggagaagaacagtttacagcctttcgcagcaggccggtttggacccttatgaaagggcgatatacagctatttgagtggcgctattcccaaccaagaagttctgcaatattcggattgggagtctgatctgcacatacacttaaatcaaattttacaaactgaaattgaaaattatcttttggaaaacaatcaagtaggtactgatgaactgattttaccattaccttcacacgcgctaactgtacaagaggtgcttaatagagtggcttcaaggcatccctcagaaagtgaacatccaatcagagttttaatggcatctgtcatactagattctttgccatcagttattcattcatccgtggaaatgttgcttgatgtcgtcaagggaaccgaagctagtaacgatattatagataagccttatcttctgaggatagttacacatttagccatttgccttgatataattaatccaggttctgttgaagaggttgataagtccaagctcattactacgtatatcagtcttctgaaattgcaaggcctttatgaaaatattccaatatatgctactttcctgaatgagtcagactgcttagaggcatgctctttcatattgtcttctttagaggacccccaagtaaggaaaaagcaaattgagacaataaactttctaagattacctgcctcaaatattttgagaagaaccacacagcgtgttttcgatgaaaccgaacaagaatattcaccatctaacgaaatttccatatctttcgatgtaaacaacattgatatgcacttaatatatggcgtggaatggcttattgaagggaagctttatgtggacgctgtccactctatcattgccttatcgaggagatttttgttaaatggccgcgtaaaggctctcgaacaatttatggagagaaataatattggagaaatatgcaagaattatgaattagagaaaatagccgataacatatcaaaggatgaaaatgaagatcagtttttggaagaaataactcaatatgagcatttgataaagggcataagagaatatgaagaatggcaaaaatccgttagcttgttaagctctgaatcgaacattcctactttaatagagaaattgcaaggtttttcaaaggatacatttgaattgatcaagacatttttagtagatttaacttcctctaatttcgcggattcggcagattatgaaatcctgtatgagattagagccctatatactccatttctactgatggaattgcataaaaagttagtggaagccgcaaagttgttaaagatcccaaaatttatttcggaagccctggcatttacctcattggtcgctaatgagaacgacaagatttatttattattccaatctagtggaaagttaaaagagtatctggatctcgttgctcgcacagcaaccctttcgaactga

SEQ ID NO: 4672 - DNA, 2181 bp, Saccharomyces cerevisiae
atggcaagtgtcatgtcaaataataataataataataataataataatgccagttatatgtttacgaaccctttgtccaacacaggtggtggactcataaatgaaataaaagatgcaataaatgaaatggaacaattaaaggttctagagttaaagcaaatatgcaaatctctggatttatccataacgggcaaaaaggctgtcttacaagaccgaataaaacaattcttaagaaaatcctgtgatattggacatatagatccgtggaggcctaaggctattaagattcttatcgcgaaagtaaggataaactcatcattaccaaaatactctaccctttgggaaactttaaagacgggtgcgttcaagcatcctgtagcatcggggcaactacccgtgacagctctccagagtactgcattgccaccttattcccaacaacaggccttagcatattcttttacctcaccgttttacaaaccaatagtacaaataccggatgccaataaaaaattgaagcaatctgcaggaagaggttgtacaaaaatgaagttcaaggtaagtaaatctaatcatgatcttttgaaatctaacaagagttataaactgtatttgttttctggcttttcaataccgtttatatatgaaactgtgggccatgaggcaatagatttcccgtatccctgtgaactagtgtttaatggcaccaaactagaggacaacgtgaaaggtttaaagaaacaaaatgggacaggtaatcctgcaaatttaacgccttatcttaaagtaccgaccgagatgaatcacctagacttacattatctcaatattgataaagagtactctataagttgctttatagtggaagttttttcacctgaagctcttctggggaaaattctgaaaaggcccaaaattatcaagcaagccaccacagcatacatcaaaagaaccttgaatgagcaagatgatgacgatattattacaacctccacggtgctgagtttgcaatgtcctatatcttgtacaaggatgaagtatccggcgaagactgaccaatgtaagcatatccaatgttttgatgctctctggtttcttcactctcagtcacaagtccctacatggcagtgtccgatttgtcaacaccctataaaattcgaccagttgaagatttccgaatttgtagataatattattcaaaattgcaatgaagatgttgagcaagttgagatatctgttgatggctcatggaaaccgattcataatagttcggccgttataacggatactgttaaccaaaatcacagtgtgaaaaacgagaaccaaggcactgtcaaacaagagcaagattatgacagccgaaatgccttcgatactaatttgcgtaatggttcaaaccacaacgaacccgaaataatatctctggatagctcagatgatgaagcctttattccggctagtaaaagcttcccaacgcacgtgaacccccgtaatgaccaattaagagcagatatatttccctcagaatcggaaggatccagtgactacaaccccaatcatacatcaacgccgaaaggttctccaactatggaccaagataattatcaagatgcttttcaaatgaggtcatttttgaaccaaggcgctactacaaatataaatgacacaccgacgaacaatagcagtattaattctttcgttacggcgacgaatggtgacagcagaatattctacaatagagggccatcaacgccactattaccggctgttctacaaaatttgactaatcaaacggaagcgcagagaaacccctacggacctaattacaataccacagctcaagatcgtaatcttttgggaatcgaaggtgatttgcctccaatcccccctgtggacccaaattcagaagcagaaactgaactaccaacaaggaccacatcggcggcacatctccctccatatatacacgtgagcaccagcggccatggggatgatggaaaaattaggaagagaaggcattctaatgtttctatctacattccgaagaatccatacgccacccttatgaaacggagaccacaggcaaatcacgccataatgaataaaactctggcccaaactaatgactttaacacatcggctcaagataactcggaagtggtcgatttaacatcagattga

SEQ ID NO: 4673 - DNA, 2184 bp, Saccharomyces cerevisiae
atgaatgattggcatgagttcaatgccgcgataaagtcaatatattgtaatgcagaaggtgactcaagcagtataattaatagattggttggcttggcaatgaaaagcgaagattccacttttattgaggccgttttagttttgaaagaaaatgtgtcgaaagtagataaacaattaagatttttatggcttacttcaactattaattcaaggttttatccccctatacctatctcagaagcctcaccggtttcttggaataaaaccgaatattgcgcacctggtactgaagaactacaaaggcgttatccagggagagccaagttacagaatgaagaagactattcaggcggaatagaacaatgccgagatgtgccagattgctcattagttgcttctctaattaatcttaggtctaagaacttgaatctccctctaattaaacaaatatcatcaactaaatatcacgtcaatttaagttttaacggaagcaacaaaaggctagtgacagtagatatttcgcagatcccaacctcagtggatggcaaacaactttctttaaagagtaacgatatttcggacaaaattggagagcttgcattactgcttgtttctaaaggaacatattccacggatggctcaaatattagtatagatacttaccgcttaagtggcttcttaccagagataacacaagtaaacagctatcctttcgaaaaattatggaagtttcacaaatctaatttatgtctgatgggcgctggcaccgggaatcgttccaatgacatgataaagcccctagttgagaaccatgattactctataattgatatcacatatgattctaggctagtaaaattgcgagatccgaggaactcggcactaaatgttgaaatcagctatgaacagtatttaaaaaatttcaaacaactttatcttaattggaaccaagaaaaattattcaaacgttctcaggtacttcattttcggtacgatacttcacgctacaataaattttctatcgttgcagataaacctttatttcacctggtaaacaattctaaagtgacagagacggtatggttattgctagaatcccatttgcaagatgaaggcagccaagaaaatcggtcagtttcctttttgaatgaggctcccgaatgcataatttgtccaattgaacctccagtagaatgcggtggcaatcacattggacttcagctggtaaagttgagattagatgctgagactgagaggttattgtattgttattcaacaacaaacaacaatttcagtattcactctttctcagttgtgaaggaaatatgttttcaaagattgaaagatacaaaaagtctttttgccaaagtccttttctcttttccttatgaaatagagggaaaagcctcatttgatacttgtaatttttttcaaaatccgacttttgagttggaagttcactctgaacaagattatcaagtacttatggacgccgcatgtatctcaactagctcacatgatttaattaacatccaagtatattactttaatgactatgaattgataaagccaataatgtttgataaccactatcagcccgggcagggccttaaacaagacgtgcccatcttaactaatgtcaaatatatgattgtatgctcaacttacggccctccagcctcaacggaatttgaattacttgcctcgatacggttatcctcttcatggaggttaatatctggaataactttacggagtgttaacttgatatacggtacttatccatatcattgtcgcaacaggttccattggaaggaaacttcagacaaacttaaaattcagatgactttgccaaccaaaaagtattctacgaacaaactttttatacgtgtagtacccgtggaatcatcagcacgattaaggatgcgatgtaatattttcgagcctgaatcagctctctgtgtttatgaatgtcaagagtataggacatgtccatctgggggcatcgttatacctgatctggaagtctctcgtactaacattgttgtattgatgatagaaagaagtgtacctatttccagttgtttacctacggaaggacaattggatgaattggagttgtttgttgggtccagtcaaaaaatcagaattgaaaaatactccgatgatgtgataccaaaataa

SEQ ID NO: 4674 - DNA, 2187 bp, Saccharomyces cerevisiae
atggaggaaattcctgccctgtatccaacggaacaagaattcaaaaatccgatcgattatctctctaacccccacattaaaaggcttggtgtacgatatggtatggtcaaggtcgtaccaccaaacgggttctgcccgccactttctattgatatggaaaattttacttttcaaccaagaattcaaaatctggagaacctagacctgaaaaataggtgtaggctattttttatgaaacagttaaataattttaaaagatccgttaaggatccatcgaaacttatacttagggaaccttatacgattgtagaatattcagattctactcatgcatcggaaatactaaaaaaaaaagtgtacttttatgacgttttctctgaactaataaaagacaatcggacacttactgacactacacagtcattcaggcgaaaattgaaatttagagatatttcccaattaagaggcgacatcagtctatggaggaccatttctaaaaaattcaacgtaccaatcggcttgttaaaggaaatttttgagaaatatattgcctcatactacatatttcttcattcactgaacgagaacgtgcacacggcgctgcatgctgaccagtatccaaaatccttattaagtgatgacgaggacgatttcgatcttgggccagattcgaattctgggtcggattttgaggaggacgatgatgatgcttgtattgtttgtcgcaagacaaatgatccaaaaagaacaattttatgtgattcatgtgacaaaccattccatatatattgtttatcaccacctttggaacgtgttccctctggcgattggatttgtaacacttgtatcgtcggaaacggatattacggattcactcaggacacgcatgactattctctaccagagtttcaagaatattgtaaacgtcaaaattcaaggttattaccagcacgaaaactgtctatagatgagttggaagagatgttttggagcttagtgaccaagaatcgtcgcagttcattaacgacagttaaatacggtgctgacatacataacgaattgccaggtcaaattaccggctttccgacgagagaatttatacccaaaaatataaatggggacgaattgatagactacctcaaatattgcgatcatcctatgaatttaactaacttgcctatggctcataattcgctattaccgttatttaaaagaaatatttctggcatgactattccttggatttacataggctccttattttccacattttgttggcatatggaagatcagtataccctaagtgctaactatcaacatgaaggtgaccctaaggtctggtacagcattcccgaatcgggatgtacgaaattcaacgatctattaaatgatatgtcaccagacttatttatcaaacaaccagacctactgcatcagctagtgactttaatatctccgtacgatccaaatttcaagaaatcaggtattcctgtgtacaaagctgtgcaaaagcccaacgaatatattatcacgtttcctaaatgttaccatgctggttttaatacaggttataattttaatgaagctgtcaattttactatagatttctggctaccatatggatttggtgcgattacggattataaattaactcagaaagcatgtgtttttgatatgtttgatttaatgatcaatgttttggacaagtacaataaagatactctattgttcaatgatgcttttgttaggcaatgttactcttcattgatcgtcttttataatactgaattaaaacgcatacggaaaattcaggccattgtaccacggacaactcttttggaggtgcatactgatccaaacgatgaagatgaggaatacgatatattttgttcccaatgtaagactatatgttcaatagcctttgtattgcgaaagaataactatgattcaattagaacgtataaaagacacaagaaaaaccatttaagtattaggcagtggaatgaactatccacgacggacagtaaagtgagtatcctgtgtacgcaggattacttaaaatcaatacaaaacttgaacaatagcgacggtgaagaaccttatattgacgatgaattgtatttcactaagtctttgaaggatattgactctttaataaagcaagttggtgttaagttagatagatag

SEQ ID NO: 4675 - DNA, 2187 bp, Saccharomyces cerevisiae
atggtatttggttttacaaagagggacaggagggtacctgatttatctaggtatgattactactatcagaaccatgaagattataacaaaagtcctcagctctctgctgctgctgcctctgctgcttctgccgcatcaccggatcgaaccaattactcaaggtcgcactcgctggttagtcatgcaccttcaataccgagacaaagaagttcggtaaagagcccaggaagaaggctttccacatcctctgccgctccgccaacgtccagggcagcagctaagcagtattcacagaagacttactcgttgaggtcgcaaaggagcggagagtaccatttacacccgcccggttatactactaatgggagccgtatgaattctatgacgtctggtgcgaatgtcagaagaaactacggtaagaacaaatcgacggccggcaacaataacgattcaagggccaactccattaccgtaaagactacacaagtaacagacccttcaggaaggactcaatcaattaccaaaaagacaataagaaaaataaatgggtatgaatacgtagaaaccacgactacgactaagaatttggttccattaggtgactcgcagcgtcatttcgatgaatttagtgaaaattacatgttgcaagatgacgacattttagaggaacaagctagtgataacattcacgatataatcgaggaaaacgaaacagataacgaaaagccatattccccagtaagcgaaagtcatttacaagatgattcagagctaaacgtggaaaaaccagatttcccacttggatcatatttccaccataagtattctacagacgttatgcctctagaagaagaaagtagtttatcaaacttcagtgacgcattagattatattcctcccacccatcagaccagtagtaaatatattcataataaaaggaagcaagcatcgacgacaagaaggaagaaaagaccgcctgccgtgaaaaacgcagaagcagaggccaagaaaccattaaccgaagcagaaatgtatctgaaggcactagaggttgctaaaagaaacgtttatcacacggatgctgcttcggataacgcatcggcccccctcgggagtaacaaatccaggaaaagtaggatgggtcaaaaaatgaccttgagaagcagtagtgattctccgacggcgactgctaatcttgtcaaatctaatgtcgaggttcaaccaaaaagatttacaagttccttcttcagcagaaatactaaaagcgccccccatgaagtgcacaatcactctgtgtctacacattttaaatcgaataaggctgttgacccagttccagagcctaaaagtgcaaacacagggctaacagataaagaaatgtatgaccaagctttgaaaatcgcacaagcgaggtattacaactcacatggtattcaacctgaagcagtcgataatagcactacggcggctaaacctcgtcaggtcggcgttagccatctgggatccactgggagcatcccgcccaatgagcagcactatttaggggattctgaaattccagtccaaagcgaagtgcatgaatacgagcccattccattgcagaagacaaaaacaactggttcttccaaaaataagttcaaaaccatgttcgataaagtgctgcaattctctcaagaaaactacggctaccagcacaagaaggaacaaggcgaacaaactccagttactcgtaatgctgaagaaagcttcccagcagcgtctatttcggaaggtgtgacaaccgcaaagccatcttcaaacgaaggtgtgatgacgaatccagtagttacagattcaccttcaccccttcaacaacaaatagactcgactactgcgtcctcgaatgggcaaagtcagggcaatgtacctacctccgcagtagcttcaacaacgagaacaagatcaccggaactgcaggataatctaaagtcttcttcttcgcttttacaggaccaaacccctcagcgtcaggaagacgccacggatccaacaacatcatcgacgaatgaattatctgccgctgagccaacaatggtcacttcgacacatgccactaagacaatacaggctcaaacacaagatcctcccacgaagcacaagaagtccagtttcttcactaaactgttcaagaaaaaaagcagccgttag

SEQ ID NO: 4676 - DNA, 2190 bp, Saccharomyces cerevisiae
atggaatcacttccacgtactcccacaaaaggcagatctacgcagcatctctcgacaccatcgccgaagaatgatattttagctatgaatggccacaaaagaagaaatacaacaactccaccgcctaagcacactcttctgaagccgcaacgtacggatattcatagacactcattagctagtcagagtcgcatatccatgtcacctaatcgcgagcttttaaagaattataaaggtacagcaaatttgatttatggaaaccagaaaagcaactccggtgtaacttccttttataaagaaaatgttaatgaactcaatagaacacaagcaatcttatttgagaaaaaggcaacactagatttactcaaagatgaactaacagaaacgaaagagaaaatcaatgccgttaatctcaaatttgaaacccttcgtgaagaaaagataaaaattgaacagcaactgaatttgaaaaacaatgaacttatctcgattaaagaagaatttttgtcaaagaagcagttcatgaatgaaggacatgaaatacatttaaagcagctagcggcatctaataaaaaagagctgaaacaaatggaaaatgaatacaaaacaaaaattgagaaattgaaatttatgaagattaaacagtttgaaaatgaaagagcgtcgcttttagataaaatagaagaggtaagaaataaaatcaccatgaacccttccactttacaggaaatgttgaacgatgttgaacaaaagcatatgcttgaaaaagaagaatggcttacagagtaccaatcgcagtggaaaaaggatatagagctgaataataaacatatgcaagaaatcgaaagcataaaaaaggaaatcgaaaatacattaaaacctgagttggcagaaaaaaagaagctcttaacagaaaagcgtaacgcgtatgaagctatcaaagtaaaagttaaagaaaaggaagaggaaactacaaggctgagagatgaggtggcattaaaacagaaaactaatttagaaactttggaaaagatcaaagaacttgaggaatatataaaagacactgaactgggtatgaaggagttgaatgaaattctgattaaagaggaaacggttagacgcacattgcataatgagttacaagagttaagaggaaatatacgagtttattgtaggattcgtccagctctaaaaaatttggaaaattctgatactagccttattaatgttaatgaatttgatgacaatagtggtgttcaatctatggaagtgacgaaaatacaaaacacagcgcaagtgcatgaattcaaatttgataaaatatttgatcaacaggatacaaatgtggatgtttttaaagaagttggtcagttagtgcaaagttcattagatggatataatgtttgtatcttcgcatacggacaaacaggatctgggaaaactttcacgatgttaaatccaggtgatggtatcattccgtccacaatatctcatatatttaactggatcaataaattaaagacaaaaggatgggattataaagttaactgcgaattcattgagatctacaacgagaacatcgtagacttattgagaagtgataataataataaagaagacacaagcattggcttaaagcacgaaatacgtcatgatcaggaaactaagactaccacgataacgaatgttacgagttgcaagcttgagtcggaagaaatggtggaaataatcctgaaaaaagcaaataaattaagatccaccgctagcacagcatcaaatgagcattcctcccgttcacacagtattttcataattcatttgtctggatcaaatgcaaaaactggagcacactcgtatggcacactaaatcttgttgatttggccggttccgaaagaataaatgtctctcaagttgtaggggatagattaagagaaacacaaaatataaataaatctttaagttgcttaggtgacgttattcatgctttaggtcagcctgatagtaccaaaagacatataccgttcaggaactcaaaactgacatacctactgcaatattcactcactggggattcgaaaacattaatgtttgtaaacatttcaccaagctcctctcatattaatgagactctcaattcgttaagatttgcgtctaaagtgaattctaccagattggttagtagaaaatga

SEQ ID NO: 4677 - DNA, 2190 bp, Saccharomyces cerevisiae
atgttttacaataggtggctcggaacgtggctagccatgtctgctttaataaggatctcagtatcccttccgtcatctgaggagtacaaagtggcatatgagctgttgccagggttatctgaagtgccagacccttcaaatattccacagatgcatgctggccatattcctttacgttccgaagatgcggatgaacaggatagctctgacttggagtactttttttggaagtttaccaataacgactctaatggcaatgtcgaccgtcccttaattatatggttaaatggtggacccggttgctcttccatggatggtgccttggtcgaatccggcccttttagggtgaattcagacggtaaactttatctaaatgaagggtcctggatatccaaaggcgatcttttatttatcgaccaacctactggtactgggttttctgtcgaacaaaataaagacgaaggtaaaatcgacaaaaacaaatttgacgaagacctagaagatgtgaccaagcattttatggattttctggagaactatttcaagatttttccagaagacctcactaggaaaatcatactatcgggtgaaagttacgctggccaatacataccattctttgccaatgcaattttgaaccataacaaattttcaaagatcgacggggatacatacgacttgaaggcgctattgattggtaacggttggattgaccccaatacacagtccctatcgtaccttccgtttgctatggagaagaaactgattgatgaaagcaaccccaatttcaaacacttaacgaacgcacacgagaattgccagaatctgataaactctgccagtacagatgaggcagcccatttttcgtatcaggaatgtgagaatattttaaaccttctattgtcttataccagggaatcttcgcaaaagggaacagcggattgcttgaacatgtataacttcaatttaaaagatagttatccatcttgtggtatgaattggccgaaagatatttcctttgtcagtaaattcttcagcacacctggtgttattgattcgttgcatcttgattctgataaaattgatcattggaaggaatgcactaatagcgttggaactaaattgtctaatcctatttcaaagccatctatccatttattacctggtctacttgaaagtggaatagagattgtcttgttcaatggtgacaaagacttgatttgtaataacaagggcgtattagatactatagacaatctaaaatggggtggaataaagggatttagcgacgatgctgtttcgttcgattggatccataaatcgaagagtacagacgacagcgaagaatttagcggatacgtgaagtatgatagaaatttgacgtttgttagcgtttataatgcttctcacatggtacccttcgataaaagtttagtgagtagaggcattgtcgatatttactcgaacgatgttatgatcattgacaacaatgggaaaaatgttatgattactactgacgacgatagtgatcaagatgctactactgaaagcggtgataagccaaaagaaaacctcgaagaggaagaacaggaagcgcagaatgaggaaggaaaggaaaaagaaggcaataaagataaagatggcgatgatgataacgacaatgatgacgacgatgaagacgatcacaactccgagggcgacgacgatgatgacgatgacgatgatgaagacgataataatgaaaaacaaagtaatcaaggcctcgaggatagtagacataaatcttcagaatatgaacaagaagaggaagaggtagaagaatttgcagaagagatttcaatgtataaacacaaagcggtagtagttaccatcgttacatttttgatagtggttttaggagtttatgcgtatgatagaagagtgaggagaaaagcgcgtcacacaattttagttgatccaaataatagacaacatgacagtcccaataagacagtttcatgggcagatgatctggaaagcggactcggggcagaagatgatttagaacaagatgagcagttagaaggcggagcacccataagtagcacttctaacaaagcaggatctaaattgaaaactaagaaaaagaagaagtatactagccttccgaacactgaaatcgatgaatcttttgagatgactgatttttaa

SEQ ID NO: 4678 - DNA, 2193 bp, Saccharomyces cerevisiae
atgaccattgatggcacggggcaatctaaggaggcgctgcaagatgaacggttaaatactggctctgataaggtttaccaaaactatatgatgcctgctttagaactctacgatgccaaggtctccataaaccattggcagttgcgggattgtatcaaaccaggctccatgaaccagagtaaactgtattatatttacgatcattcgataagagtactagatacggattcttccgtattgaggtctccagtaaggcgacataattctattcaaccgagtaacagtggtaaaaactctactgaaaaaacgtctacaaaaggttctaggacaacgggctcgtatatctccaaaaatttacatgttccttccgagaaactggtagagttcaactttaagccgagatgtttcacggaattaaatgggttgactgtttgtggtggtctaatcggttctgatgataagggattcccttctaattggaaccgtttagctcaagatgcaaatatttcgttgccgccaccttcccaaccgattaatatttccaaaaatattagtttccctataaattcacattattcaaatcctaatatctggaagggcatcgtggagttttataatcaagaaacggacacaatgatgacttttacgttgggccagttcatcaataattgtgtcacactttatgacagggccagtatgcagtttgatctttttgcatgcaacaatgatggtcatctttaccaatgcgatgtaagtaatagagatgtaacactagtgaagcgttatgcggatttaaaatttcctttgaataacgcttctttgtcacatgatggtcaaacgatggtagtgtctggcgattctaataaatttgctgtttacaatcaaaatgaattaaccaaccaattctccttacattacgataatcatccttcctggggtagttctgtcaatcgtgttagacggataccacggtttgcgttacctgatgaatcagaatatatcgaaaacatatatgaagctccaaattcagaccatgggttttataactctttttccgaaaacgacttgcaatttgcgacggtatttcaaaatggtacttgcgcaatttatgatatcagaaacatggctactcccatggcagaaattagttcgactagaccacattcccacaacggtgcatttagagtctgtaggttcagttatggcctagatgatttattattcatttctgaacatcagggcagagtacacgttgtagatacaagaaactacgttaaccaccaagttattgttattcctgataaagttaatatggaatatataaacgaacggaagcataatacaaatcataatttcaccacaaataataacaacgaaaacgaaagtaatgatagcaaaaatgaattacaaggggcggattatcggtctttatcaagaagaagattttcgctgccctctatgccaaatgtaaccacagaaccatggataactatggctcaaagaatcccaaaaaagtatttggagccgcaaattctaccttttccgaaagttatggataaaattagtaacgaatcggttctgttttctacgaaaggtagttcatcaagtgacgtagctcatccatacaagagacgatgttcattcagggtaaggagagtatcgacttcggcaccaaccgccgattattctaataacaatgttaacgcaagtcttggcacacctgctgctgattctatcgcaacttcgtcgtcaaattccgcacctcaaaatttaattgaccccttaatactttctcaccagcaagctagtaatgatgtttttgaagatgatgaatattatgaagcttacaatgatgttcactcaacgtatcgtgtttcttcagactatcatggtgtttccgcaagagcttttgaaagttttctcagaccaccttcaacgccagacttaccgtcagatgatgacaattttgctgcaaatagtaggaataatagaggcacatccaattttttgagaagaccagtgattacaactcaggaaagtaacgaattctcagaagaaaacaatatatcaggtatcgattgggttgaagataggaatgggagctccttgattattggtacagattacggaattatgaggtggaatattaactcatgggcaagaagaagtttctctagttatgacttatgttga

SEQ ID NO: 4679 - DNA, 2193 bp, Saccharomyces cerevisiae
atgatttctgtttgcccacaaaatgacttgcaaaaatgctacagaagcctcacattcgatgttccaggacaacaattcgaagagagaaatgaacaaaaccttaaaaaacgggccaaaaagaaaggcagtttccaaccatctgttgcctttgacacagtgccttccaccgctggttattcttctatagacgacagcagggaaggattcaaaggtgtacctgttcccaactattacacgatggaagagtgctatgacgatgaaacagactctttttcgccaaatttgcaatattatttgagagatacattccaatcatcaccttttctgaatactagaaaagagaacaaatctgaatccagtagttttccaatgagatcctcaaagttgttggaaaagaattctgacatcaaaaaatatttcttggtatccaagaatggaaaaatagtgaggagagactatccaagcacgccagtaattgtcaacgaaacgttgatgataaacaggtttgaaaagaactggataaagttatggcgccaaagaaaactacaaataaatgaaaggctgaatgacaaaaaaaaatggtttacttacccagaacttatcttctctgaagagcgtattaaaccgttatatagaggagatgatagtgcaccatgtacaaaagaacaaaaaagaaagcataaaatacttcaacaaaaggtcggatatcccaataaccctaagacaatagtttgtcacattaacggaaaaaaacatacgtgggttgccctagactggacagtctacaagtttgcacgaaatcttgatcacattgttgtcataactacactgccaaaaatgatttctaacaggaaaaaaactgcaaaagatgatacagaatgggcaccgggatatcaaaaagaagtaatagatcaaaaattaaacgacatttttgattatattttacagctagtaaaagtggtcaaaatatccgtcaaaattactttagaaataattgtaggcaaaattaaaaaaagtctggtagatgtcattaatgtccatactccagatttcttagttcttgctactttaaagcacgagcgaaatgagaatcttattacatataaatccaaaaagctgacagatgtctttcctgttagttatccgattcccacatttgttgttccctcgaaacgaatgtattcgttcgaactgaatctacaaagagaagtaaatgaacattatgtctcaaaaaatcatatgaagcacgaacacactgacgttgagagcatgagcagttcaatgttcaaaaaaaatacaatatcagatatttcttcacatatttccgtagattcgtacgccgaagatttcaaaaggcaaggctacatcaaaaagcagttcaacacctctaatgattccattccaagaaaattgaccggtctcgcccagcattcaagaaggaagatcacgggtgatatagaaaaattacaagacgatgagaaagatagagaatgtactaaggaaaaacttttgttgaagaaaattgatatcataattagagagtcattgaagtcttctttagcgatagagacgttgcctggtaaaaatgtatcgcagtccagtcacggtgaccaaatttccagctttaagaatgctttgataggcaatgggtcgaaaaacacaaagtttagaaaatctttaataccatattcttcctcagaggaacaaaataccacaacaactattaaactcagtagctcgcctacgtcccaaatcaagtttgcaacctctgtaaaacacaaagatggaagagccgcccttggcaaagccagaaatctgcctgatataaggcacagtatttccttcgacaaagaaaattcctttgatccatctgataaaagcagtagtgttgataatagcattcctttgaggaaagttaaaagtgccggtgcgttaagaaaagtcaaaactaatgactcctcaagtagtgcagggtcaaagaaaagctcgtctagttttagtactgtgaacaccttcactgggggtggagttgggatttttaaggtgtttaaaagtggaagttcctctggaaataaatcatccagtagaaggaatagtagcagtggcgatgtttttgaaagtgatgatcgtaacgacaagaaaaagaagaagaaaaaaaagaagaaatcattgttcttattcggcaaaatatga

SEQ ID NO: 4680 - DNA, 2193 bp, Saccharomyces cerevisiae
atgcaagacgaccccgaaaattcgaagctgtacgacctgctgaatagtcatctggacgtgcatggtcgaagtaatgaagagccgagacaaactggtgacagtaggagccagagtagtggcaacaccggtgaaaacgaggaggatatagcatttgccagtggattaaacggcggcacattcgactcaatgctggaggcactgcccgatgatttatattttacggacttcgtgtctccttttacagcagctgccacgaccagcgtgactactaagacggtcaaggacaccacaccagctaccaatcatatggatgatgatattgcgatgtttgattcacttgccacaactcagcccatcgacatagccgcatccaaccaacaaaatggtgaaattgcacaactttgggactttaacgtggaccaattcaacatgacgcccagcaactcgagcggttcagctactattagtgctcctaacagctttacttccgacataccgcaatacaaccacggttccctcggcaacagcgtctccaaatcctcactgttcccgtataattccagcacgtccaacagcaacatcaaccagccatctatcaataacaactcaaatactaatgcgcagtcccaccattccttcaacatctacaaactacaaaacaacaactcatcttcatccgctatgaacattaccaataataataatagcaacaatagtaatatccagcatccttttctgaagaagagcgattcgataggattatcttcatccaacacaacaaattctgtaagaaaaaactcacttatcaagccaatgtcgtccacgtccctggccaatttcaaaagagctgcctcagtatcttccagtatatccaatatggaaccatcaggacaaaataaaaaacctctgatacaatgtttcaattgtaaaactttcaagacaccgctttggaggagaagcccagaggggaatactctttgcaatgcctgcggtcttttccagaaattacatggtaccatgaggccattatccttaaaatcggacgttatcaaaaagaggatttcaaagaagagagccaaacaaacggacccaaacattgcacaaaatactccaagtgcacctgcaactgcctcaacttcagtaaccactacaaatgctaaacccatacgatcgaggaaaaaatcactacaacaaaactctttatctagagtgatacctgaagaaatcattagagacaacatcggtaatactaataatatccttaatgtaaataggggaggctataacttcaactcagtcccctccccggtcctcatgaacagccaatcgtataatagtagtaacgcaaattttaatggagcaagcaatgcaaatttgaattctaataacttaatgcgtcacaattcgaacactgttactcctaattttagaaggtcttcaagacgaagtagtacttcatcgaacacctcaagttccagtaaatcttcatccagatctgttgttccgatattaccaaaaccttcacctaatagcgctaattcacagcagttcaacatgaacatgaacctaatgaacacaacaaataatgtaagtgcaggaaatagtgtcgcatcctcaccaagaattatatcgtccgcaaactttaactcaaatagtcctctacagcagaatctattatcaaattctttccaacgtcaaggaatgaatataccaagaagaaagatgtcgcgcaatgcatcgtactcctcatcgtttatggctgcgtctttgcaacaactgcacgaacagcaacaagtggacgtgaattccaacacaaacacgaattcgaatagacagaattggaattcaagcaatagcgtttcaacaaattcaagatcatcaaattttgtctctcaaaagccaaattttgatatttttaatactcctgtagattcaccgagtgtctcaagaccttcttcaagaaaatcacatacctcattgttatcacaacaattgcagaactcggagtcgaattcgtttatctcaaatcacaaatttaacaatagattatcaagtgactctacttcacctataaaatatgaagcagatgtgagtgcaggcggaaagatcagtgaggataattccacaaaaggatcttctaaagaaagttcagcaattgctgacgaattggattggttaaaatttggtatatga

SEQ ID NO: 4681 - DNA, 2196 bp, Saccharomyces cerevisiae
atgacagaattttattctgacacaatcggtctaccaaagacagatccacgtctttggagactgagaactgatgagctaggccgagaaagctgggaatatttaacccctcagcaagccgcaaacgacccaccatccactttcacgcagtggcttcttcaagatcccaaatttcctcaacctcatccagaaagaaataagcattcaccagatttttcagccttcgatgcgtgtcataatggtgcatcttttttcaaactgcttcaagagcctgactcaggtatttttccgtgtcaatataaaggacccatgttcatgacaatcggttacgtagccgtaaactatatcgccggtattgaaattcctgagcatgagagaatagaattaattagatacatcgtcaatacagcacatccggttgatggtggctggggtctacattctgttgacaaatccaccgtgtttggtacagtattgaactatgtaatcttacgtttattgggtctacccaaggaccacccggtttgcgccaaggcaagaagcacattgttaaggttaggcggtgctattggatcccctcactggggaaaaatttggctaagtgcactaaacttgtataaatgggaaggtgtgaaccctgcccctcctgaaacttggttacttccatattcactgcccatgcatccggggagatggtgggttcatactagaggtgtttacattccggtcagttacctgtcattggtcaaattttcttgcccaatgactcctcttcttgaagaactgaggaatgaaatttacactaaaccgtttgacaagattaacttctccaagaacaggaataccgtatgtggagtagacctatattacccccattctactactttgaatattgcgaacagccttgtagtattttacgaaaaatacctaagaaaccggttcatttactctctatccaagaagaaggtttatgatctaatcaaaacggagttacagaatactgattccttgtgtatagcacctgttaaccaggcgttttgcgcacttgtcactcttattgaagaaggggtagactcggaagcgttccagcgtctccaatataggttcaaggatgcattgttccatggtccacagggtatgaccattatgggaacaaatggtgtgcaaacctgggattgtgcgtttgccattcaatactttttcgtcgcaggcctcgcagaaagacctgaattctataacacaattgtctctgcctataaattcttgtgtcatgctcaatttgacaccgagtgcgttccaggtagttatagggataagagaaagggggcttggggcttctcaacaaaaacacagggctatacagtggcagattgcactgcagaagcaattaaagccatcatcatggtgaaaaactctcccgtctttagtgaagtacaccatatgattagcagtgaacgtttatttgaaggcattgatgtgttattgaacctacaaaacatcggatcttttgaatatggttcctttgcaacctatgaaaaaatcaaggccccactagcaatggaaaccttgaatcctgctgaagtttttggtaacataatggtagaatacccatacgtggaatgtactgattcatccgttctggggttgacatattttcacaagtacttcgactataggaaagaggaaatacgtacacgcatcagaatcgccatcgaattcataaaaaaatctcaattaccagatggaagttggtatggaagctggggtatttgttttacatatgccggtatgtttgcattggaggcattacacaccgtgggggagacctatgagaattcctcaacggtaagaaaaggttgcgacttcttggtcagtaaacagatgaaggatggcggttggggggaatcaatgaagtccagtgaattacatagttatgtggatagtgaaaaatcgctagtcgttcaaaccgcatgggcgctaattgcacttcttttcgctgaatatcctaataaagaagtcatcgaccgcggtattgaccttttaaaaaatagacaagaagaatccggggaatggaaatttgaaagtgtagaaggtgttttcaaccactcttgtgcaattgaatacccaagttatcgattcttattccctattaaggcattaggtatgtacagcagggcatatgaaacacatacgctttaa

SEQ ID NO: 4682 - DNA, 2196 bp, Saccharomyces cerevisiae
atgatccgtttagctcagcaaacacaagtactgaagggcaaacccccaaaccagtttgttccacatccgacaaagaattcgctgactcatccaatgaaatttaacggtacaatcgctatggagcaccatgaacacaactatgccattccttacacgcctgctacttttaacaatccagccctcgctacttatcaggtaagcccagccaaccattttgttcctcactttggtggcaacattggagccaacaacaacaatcatctagctcagaataacagcaataatagtaacaaccatcataacaataaccgtaatcatcaccacaataacaatcgtaaccatcatcaaaataaccataatcatagcaagtataataactccaatcaaggtaattcaattagcccagactccccatggtttcataaggtttgtgccttcgaagattgcgtttcacagactctttatatgtcacaaactccaaggcgtcaaaacatgaaacaccattcagaacatccaaattctaacgctaatccattattttgggattctataggtagagcaatggggctgtatcatgatctactcactacaccggaattaaattctgatcgtgtctccaagcttgtacatttacttcacaatgggttgagagctaatagaaatcagttgacgagaatgaacaagaaacctgattacgactctcaatcctttcacaaagaaatgacaaactatctttgcaaatctttgagagagatctccgaagacgttctaaacggcaaggtcgaactgaacgaatacggtgctatgcatttgataactgcgtttaaggagcttttgttgtttgaggaagctgtcgacatatggaaagctgcaatcaatgggcaaaatacctacacatctaatatttttctgaatccaagagttgtcggtgttatattacccatcttatacgacaatggtgtctcttatccagaaattcaagctctatatgaaaagtcttcatcgatgattaattacttccatccaaatctttcagttgggatgatcagagcctctttatctgctagtgaaaatgacatggctctcaaattattccaaaaattatgccaagaatcaaccgaaatgaaatacggttatttgatagaaacccatctttccttcattggtgaatgtaaagacttgaatgtggctcaaaccttttttgacaaggctttaaatgatgaaatgccatacaagatagacttgcaagtttcctacgtgaaatcctttttaagaaacatatggagccaaacccgtgatttcaaccacatctatcaaatctggtacaagtcttctttacattatggtagaaacgtcaaccacggtatttcttcatctttgaatgacacttttttcgacattttttttgaaaattatgctgtggacaagatgcaaggttttcaaactttacaaaatattattcaaacttacaacaacatcaagcatatagatgaacctttctttaacattatcttggctaaatgcactgtctggcatgaccgcagtattttagaatacatcgataagagttacgaggcgtaccacattccaaaaacaatagtcgcttatagaatcttattaaagtctatgggatctgtcgatgatgcttcgaatgcagaaattctccaaagatggatggatttaatccgcaaatcagatgaaattggtcaaagatttattgccaacgcagattgggcggccttaagagatgctactgtaacatggacccaaaatgatagagattccaagaaaagtaacatgaacagcactcaaataagcagaaccgcaactccttcgccatccttaactccaatggatactccagcaccagagcatttgttcaacaatcctcaaaatccaatggacttctactctcatccagcattgcaagcagcaactgcttctggtgcatttgatgaatttgctgcggaggctgcttcttcttccataccagttgacggcagaatggttttgtatttgaaaattgttaaacgttactctccatattgccgtgattccagacaactagccagattaacaacagggaccgctgtcaaatattccgttttgcaagaagttttgaaccaattccaaactttaatcgttaacgatattcctattcctgaattacataatttgaagccaacgtgtgtttaa

SEQ ID NO: 4683 - DNA, 2196 bp, Saccharomyces cerevisiae
atggacaaattagtcgtgaattattatgaatacaagcaccctataattaataaagacctggccattggagcccatggaggcaaaaaatttcccaccttgggtgcttggtatgatgtaattaatgagtacgaatttcagacgcgttgccctattattttaaagaattcgcataggaacaaacattttacatttgcctgtcatttgaaaaactgtccatttaaagtcttgctaagctatgctggcaatgctgcatcctcagaaacctcatctccttctgcaaataataataccaaccctccgggtactcctgatcatattcatcatcatagcaacaacatgaacaacgaggacaatgataataacaatggcagtaataataaggttagcaatgacagtaaacttgacttcgttactgatgatcttgaataccatctggcgaacactcatccggacgacaccaatgacaaagtggagtcgagaagcaatgaggtgaatgggaacaatgacgatgatgctgatgccaacaacatttttaaacagcaaggtgttactatcaagaacgacactgaagatgattcgataaataaggcctctattgaccggggattggacgacgagagcggtcctactcatggtaatgacagcggtaaccaccgtcacaacgaggaggatgacgtccatacccaaatgacgaaaaactattctgacgtagtgaacgatgaagacatcaacgttgccattgccaatgccgtcgcaaatgtagattctcaatcaaacaataagcacgatggaaaagacgatgatgccactaacaacaatgatggccaagataataatactaataacgatcacaacaataacagcaatatcaataacaacaatgtcggtagccacggcatttcctcccactcaccatcctccatacgagacacgtctatgaatttagacgtcttcaattctgctaccgatgatataccgggcccatttgtcgttaccaaaattgagccctatcatagtcacccactagaagataacttgtcactgggtaaatttatcctaactaagattccaaagattttacaaaacgatttaaagtttgatcaaatactagaaagctcttacaataattctaaccatacagtgagtaaatttaaagtttctcattacgtggaggagtccggtcttttagacattttaatgcaaagatatggattaaccgccgaagatttcgaaaaaaggttactttcccaaatagccagacgtataacgacgtataaagcaagatttgttttgaaaaagaaaaaaatgggcgagtataatgatttacaaccttcttcatcttccaataacaacaataacaacgatggtgagctttctggcacgaacttgagaagtaactctatcgactacgccaaacatcaggaaatatcaagtgcgggtacctcatcgaacacaaccaaaaatgtgaataataacaagaatgacagtaatgacgataataacggcaacaataataatgacgcctcaaatttaatggaaagtgtgctagataaaacctctagtcaccggtatcaacccaagaagatgccaagcgtcaataaatggagcaagccagatcaaataactcattcagacgtgtccatggttggcctagatgaatcaaacgatggcggtaatgaaaatgtccacccaaccttggctgaagtagacgctcaagaagctcgtgaaactgctcagttagccatagacaagatcaattcttataagaggtccattgatgacaagaatggtgatggccataacaattcgtcgagaaacgtggtagatgaaaacttgatcaacgatatggattcagaagatgctcacaagtccaaaagacagcatttgtcagatatcacactggaagagagaaatgaagacgacaaactaccacatgaagtggcggaacagttaaggttactgtcatcgcatttgaaagaggtagagaatctacaccagaataatgatgatgacgtagacgatgtaatggtggacgtggatgtagaatcgcagtataataagaacacaactcatcataataaccatcatagccaacctcatcacgatgaagaagatgttgctggactaatagggaaagccgatgatgaagaagacctttctgatgaaaacattcaaccagaattaagaggtcaatag

SEQ ID NO: 4684 - DNA, 2196 bp, Saccharomyces cerevisiae
atgtttagagtatttggttcatttggatcaaagggtaatcaatcttctggtgaagagcaatcaacaaagacaaaacaggttctgaagcaggctaatgactttgagatcgccttaaaggcaatggattttgtccttgatgatagaacggatgaagggttgaatttgctgaaaaaagctgaaatggaaactggttcagatcaaactatcttgactttggcaagaggtgttattgaatttcttcaagccactttgagttttgaaactgaagaaatgaaaagagctgcaattactttaggcaaagctgagcaaatgtcctggaaaagtaagcaaaatgctgaaaagaccaattttaggagcagttcaatatatcctcccggtactgtctatgctgtaacatatactgagtcatgtctgttgcatgccttgttgatgttatttagtgaaagcatgatggaagcagccaaggctttgctaaagttaaggagggcttatacaatgttacaagatatcatggttactgtcaaaaaagctgaacgatcgaaaaattcgagctctccctctccaagcgaaaagagccaagagtcatgcggaagttttgtttctgcagagacaactttcatatcggttgatataccatacaaattgtcttccgaggacaagtccaatccactcctattggaatttgctgaaaaaatctacacgatgagaatgggaaggttatcaggtgcccatattggcaatactccatcttttcataggttaagggatgatttgggtttacagacgactccgtctcaagcttccgaccgccattctgtttcagatgatttcgatttagaacaggctaccatcgacgaattcatccattcaggtgctaatttatgctatggtatcttgcaagtcgtcttatccttacttccacctgcaatcggtgctgtgctatctattgttggattcaagggatcccgtgaagaaggtttgaggctagtttggaaggctacaaaggagagaaatgttcacgggtgtataggtttgttaggtctgatgttttattacgacggtcctttccaatttacagatgctgactttgatataccaccaaacgataatggatcgagggctttaaacaaaagcagaacaaacgatagtagccttttaccaggttatatggacagtgcaaccttattgcatcctggaaaaattctggaggacgcattactaaaagcaagagcactttttcctaatagtgccctgtggctgctaaatgaggccaaaatgcttgctggaaagggcaggcttcgtgattctctggccctaatggactctattgatgtcaatagtatccgtatgagacaagtgaaatcgttgatggtgtttgaacgtgcgatccttttagtcaacttacacgaatacaacagagctgccgatgatttaataagtttgcttgatattagtgattggtctcacgcattgtacacttattttgcgggttgctgttacttggaaaattggaggatgacacaattaggcttattaaatgacggtaaagaacaattctataaagagcgggctcgagaactcatatttgacgctccatctttgttaggtaagaaaacgttcaaatccaaaaatcttccattggatagattcatgcttagaaaagttcaacaatttaataatatgcagaagaaattaaacctacaagaaccactagactcaatagcaacatcacctgtccatgaactggcttatttctacaacggttacaacaggatgactgaaaacgatttaattttgaccaaaaagatgttgacagagtatcacaaccccgccattgattcggaagacccagatcaagagctgatcagaaacttactactatccttgaccttaagaagattgggggatgctgaaagaggtttagccttgttagatgacattgttctgccaaaaatattctacattcaaaatggcaaagtcaaatatttcaaaaaaaccgaagacccatgggcatatccagccgctctttatgagagagctttattctgttggaaactgggtggcatggaaagtttgaatgaatgtagggaatggctgctaagagcccaaaattatgccgccgattacgaattgagtacgcgtatcggtatgaagatcaaagccgcccttgatagagttgaaaacgcgcttgcttaa

SEQ ID NO: 4685 - DNA, 2199 bp, Saccharomyces cerevisiae
atgaccacacaaataaggtctccccaaggcttgccgtatccgattcagatcgataaactcattccaagcgtaggttcgtaccttcatgagggtgataggttgcttgtctataagttctggtatttggtggaaagggcctcagacactggtgacgatgataacgagcacgatgtttcccccggcggcagcgccggaagtaatggtgtctctccgccaaccaaacaactgcgtgaatccatagaattcttcgaaagtccctacgagggggacttgattagttggaatgtagacgtaggagatgaagtagccactgctaaccaagtgatttgcgaaataaaaaggccatgtaaccatgacatcgtgtatggcgggctatgtactcaatgcgggaaagaagtttctgcagatgccttcgatggtgtaccactagacgttgtcggggacgtggatttacagattagcgagacagaagccattagaacaggcaaggcattgaaggagcatttgcgacgggataagaaacttatcttagtggtggatttagatcaaaccatcatccattgtggcgtggaccctacgattgcagagtggaagaacgaccccaataatccgaattttgaaacattaagagacgtcaagagctttacgttggatgaggagttagtactcccacttatgtacatgaatgacgatggttctatgctgagaccgcctcccgtaagaaaatgttggtactacgtgaaggtaaggcccggtttaaaggaatttttcgctaaagtggcgcctctttttgaaatgcatatctacacaatggctacaagggcttatgccttgcaaattgccaaaatcgtggaccctacgggcgaattgtttggcgatagaattctgtcgcgtgatgaaaatgggtctctaacaactaaatcattagctaaacttttccccactgaccagtcaatggttgtagttattgacgacagaggtgatgtttggaattggtgtccaaacttgatcaaagttgttccttataacttcttcgttggtgtaggtgacattaattctaatttcttgcccaaacaatctacaggaatgctacaactagggaggaagacaagacagaagagccaagaatctcaggaactgctgacggatattatggataacgaaaaaaaactacaagaaaagatagataaagaagttaaacgccaagaagaaaaattgaaccatcaactggcgactgctgaggagcctcctgcgaacgaatccaaagaagagttgaccaagaaactagaatattcagcatctttagaagtccaacaacaaaatcgacccttggccaaactacaaaaacacctgcatgatcaaaaactactagttgatgacgatgatgaactatactacttaatgggtacgctatcaaacattcacaaaacttattatgatatgctctcacaacaaaatgagccagaaccaaatctgatggaaatcataccaagtttgaagcaaaaagtcttccaaaattgctattttgttttttcaggattaatacccctcgggaccgatattcaaaggtcggacatagtgatatggacgagtacatttggtgccacttccactccagatatagattacctgacgacacatttaatcaccaagaaccctagcacttataaagcgcgtctagcgaaaaagttcaacccacagattaaaattgttcacccagattggatatttgagtgtttggtaaattggaaaaaggtggatgaaaaaccctacacgttaatcgtggacagccccatctccgacgaggaattacaaaactttcaaacacaattacaaaaaagacaagaatatctggaggagacccaggaacaacagcatatgttgacatcacaagaaaatctaaatttattcgctgctggtacttcatggttaaacaatgacgacgatgaagatattccggacacagctagcgacgacgacgaagatgacgaccacgacgacgaaagtgatgacgaaaacaactcggaaggcattgacagaaagaggagcatcgaggacaatcatgatgatacatcacaaaagaagaccaaggcggaaccttctcaagatggtcctgtacaacataaaggagaaggggatgacaacgaagacagcgattcgcagttggaggaagagttgatggatatgctggatgattag

SEQ ID NO: 4686 - DNA, 2199 bp, Saccharomyces cerevisiae
atgtcttccccagggaattcaggcgtggctatagattctaccgttctgaaagcaattgaattaggaacgaggctttttaaatctggagaatatttgcaagcgaaaaggatattcacaaatgctttgagagtatgtgattcttattctcaggagcagattatgcgcattaggaacgcgtatcaattagatactgcgagaccggataacaaacgattatatcatcctagatacataaagatattggataacatctgtgcgtgctacgaaaaattgaatgatttgaaatcttgtttggacgtatcacaaaggttacttaagttagaaccaggtaatatcaaatgctatatacgatgtacaaggacgttgataaaattaaaagactggaaaagggcatataaaacatgttctcgtggactgcaattatgcaataacgatagcaatcatctaagacaacaaaaacaattcattaaaaataacatggttcaaaaacaggacggcaagagaagttatatagatccattagaggagaccaaaatagcaaaaaaaaaaaagaataataatgttctagaatcgttaccaaagaagaagattaaaggtagtaccaagaaaactgatttagttggcaatttgccgatagaaatactacctatcatattccaaaggtttaccactaaggagcttgttacgttgtcgctagtttgtaacaaatggagggacaaaattttgtatcatttagactgcttccaagaattcaacttggcaccaataaattttaaaaattttgtaaagtttatggattttttacaacagaatttcaccaggacgtatagaaaatatattctttcacaagtaaaagtcagttctagaatcacttcggaagagttacgaataactcaattattattcagtaaaatgccgaaatgtataaacatcgaacggcttatactgtcaatgccaacactaactacaacacaaatctttaagttaatggttagaggaggcacagatttttttacaaggctgctggaattatctctcatgataacttataggcctgataaacaacatgaattggagatactgcagacttgtcctctgttgaaaaaaatagaattaatttttgtcaattcactggtaccaattttcgacggaaataatagcgttgggagggatggaagtttcaatgtgatggcccgtcatactaatatgcagatatccactgcggataatgatgaacagggaatagtagaagaaaaggtgatttatagtgagctagagaagataacattgatatgtgataagaagaaaattaagaattttccactttgtcgtgctctattaagaggccagtttcctctattgcagaaactgacgataactggtgtaacatttcctatgaataatcaagacataatgaattttcaatggctattgaacttcccagacctaaaagaactatggatagaagataacgacaactgtgaactcagtaagtttttgcaattgttaaaattttcgaatgtctggaaaaacttggaaaagttaacctttagagagaacaagctatatccaattgttaatttggatgaagatcagcctgttacgaatgacgacgaggtgccatccatgctattttacaaggaaaatctccaaaacctggaaaagttggatctaatggggacatcgataagtggttctgcgttgactagattatgcgagcaggaatacttggatggtcggaaattaagaagtttaaacattgggaattgccccaacatccagttcccaaataatcacgctcatacagcaaggatgatactggatgtgaatgcagttttgaagagactctccaagttggaagaaataaatttatcgcatctcagctccttgaatgatagtacgatgaagtcattcattattaatgtaccatttttggaaaatttaaagaggcttgacatttcgcacaattttgaaattacaggaatatcaatatatgaatttctaaaaaaatttcagatggatcatgacaacgaagcgggaggtcaaccactggcatatttaaatattgacggatgttcccaagtgtctcatatcacagttaatatgatccgagcgcagaacttagttactcaagtggattgtgtttatgaaagagatgtatggagaaaatttggaattaattcatattcatactcatag

SEQ ID NO: 4687 - DNA, 2202 bp, Saccharomyces cerevisiae
atgacttctgaaaatccggatgtacttttatctagggtgataaatgtggtgagagcagcatcatcgttagccagtcaagatgtagacttttacaagaatttagacaggggatttagtaaagatctgaaatcaaaagcagacaaacttgcggatatggcgaatgaaataatcctctctattgatgagcatcatgaatcatttgaacttaaagaagaggacatttctgacttgtggaacaactttggaaacatcatggataatttgttagaaatgtcagaccattcgctggataagctgaattgtgcaataaactcaaagtcaagaggttccgatcttcagtatttaggcgaattttcaggaaagaatttttctcccaccaaaagagtcgaaaaacctcagttgaaatttaaaagtccaattgataacagcgaaagtcatccgttcatacctttattgaaggaaaaaccaaatgctttgaagccactctctgagagtttgaggttggttgatgatgatgaaaataaccccagtcactacccccatccttatgaatatgagattgatcatcaagagtatagtccagaaattctccaaattagagaggagattccctcaaaatcctgggatgattcggtaccaatttgggtagatacaagtacagaactcgaatcaatgttggaggacttgaaaaatacgaaagagattgccgttgatcttgagcatcacgattataggtcatactatggtattgtttgcctcatgcaaattagtacaagggaaagggattatttagttgatactctaaaacttcgcgaaaatttacatattctgaacgaagtgtttacgaacccttcaattgtgaaagtttttcacggtgcattcatggatattatttggcttcagcgagatttaggtttgtatgtcgttggtctcttcgatacttaccatgcgtctaaagcaatcggtcttcctagacatagtttggcctatcttttggagaattttgccaattttaaaacttcaaagaaatatcagttggctgactggcgtataagaccgctttcaaaacccatgacggcatatgctagagcagatactcactttttactaaatatatatgaccagttgagaaacaaacttatcgagtctaataagttagcaggtgttctttatgaatcaagaaatgtcgcaaaaagaaggtttgaatattcaaagtacagaccactgacaccttcttcagaagtttattctccaatcgaaaaagagagtccttggaaaatattgatgtatcagtacaacataccacctgagagggaagtattagtaagagagctataccaatggagagatcttattgcaagaagagacgatgaatcgccacgatttgttatgccaaaccagttattggctgcacttgtcgcatatacacctactgatgtcataggtgttgtttctttgaccaatggcgtaactgaacatgtccgccagaatgcaaaactattagctaatttgataagagatgcattacgaaacatcaagaacaccaatgaggaagctactcccattccatcttccgagaccaaagcagacggaatattgttggagactataagtgttcctcaaatccgtgatgttatggaaaggttttcggtgttgtgcaacagcaatatttccaagagccgagccaagcctgtcactaattcttctattctgttgggtaagattttaccacgtgaggagcatgatattgcatatagcaaagacggcttgccaaataaagtgaagacggaagatatcaggatccgagcacaaaatttcaagtctgccttagcaaacttggaggatatcatattcgaaatagagaaacctctcgttgttcctgtcaagctagaggagattaagacagtagaccctgcgagcgcacctaatcactcgcctgagattgataatcttgatgatcttgttgttttaaagaagaaaaacattcaaaagaaacaaccagcaaaggaaaaaggtgtaacggaaaaagatgctgtggattattcaaaaattccgaatatcttatctaataagcctggccaaaataatagacaacaaaagaaaaggagattcgacccatcatctagcgatagtaatggaccaagggcagctaaaaagaggaggcctgccgccaaaggtaagaatctgtcatttaaaaggtga

SEQ ID NO: 4688 - DNA, 2202 bp, Saccharomyces cerevisiae
atgagtcttatactagatgatatcatcctctcactaacgaatgctaacgaacgaacgccaccacaggcccttaaaaccactttaagcctgctatacgaaaaatcaaaacaatatggtctttcttcgccgcaactacaagcacttgtaaggttactctgtgaaacttccataatagacacagttacaaaagtgtacatcgtcgaaaattgctttttacctgatggctacttgacgaaggaacttcttttggagattattaaccatctcggtacgccaacggtattctctagatatcgcatacaaacgcctccggtcctacaatctgcgttgtgcaaatggttagtgcatgtttatttcctatttcctgtacattcagaacgagaacacaatatatccagttctatctggttacatttatggcaattctcgttcttacagaagtggataactcccctggttatttggcaagccacgacgcccgttgatgtcaaaccttggaagttgtctattatcaagagatgcgctatgcatccaggttaccgggacgctcccggtagtgcgacgcttattttgcaacgatttcaatgtctcgtgggcgcatccagtcagattactgaatcaataattaccatcaattgcaatagaaagactttgaaaagtcatcgaaacttaaaattggatgcgcatttcctatccattttgaaaagaatattatccagagcacatcccgctaattttcccgctgacactgtccaaaacacaattgacatgtacttgagtgaaattcatcaattaggtgctgattctatatacccacttcgacttcaatcacttccagaatatgttccctctgacagtacggtctctctttgggatgtcacttcattggaacaattagctcaaaactggccacaattgcatattcccaatgatgtagattacatgatgaagccatctttaaacagcaatgttttactgccgcgaaaagtcatgtctagggattctctcaaacacttgtactctagtatcattctcattaaaaatagccgcgatgagtcgtcatcaccatacgaatggtgcatttggcaattgaagcgatgctttgcacatcagatagagactccgcaagaagttattcccattattatttcggtgtcctcaatggataataaactgtcttctcgcattattcaaacgttttgtaatttgaaatacttaaaactcgatgagcttacgttgaaaaaggtttgtggcggaatcttgccattatggaagcctgaactaatcagtggtacaagggaatttttcgttaagtttatggccagtatttttatgtggagtacacgagatggtcacgacaataattgcacattttctgaaacttgtttttacgttttacaaatgattacaaactgggttttagatgataaattgatagcactcgggttgacactactgcatgacatgcaaagcctgctaactttggacaaaatctttaacaatgctacttcaaacagattttctacgatggctttcatcagctcgttagatattttaactcaactgtcgaaacaaacgaagtcggattatgcgatccaatatttgattgtgggccctgacatcatgaataaagtgttcagttcggacgatcctttgctattatcagctgcgtgcaggtacttggttgctacgaaaaataaattgatgcaatacccgtcaacaaacaaattcgttcggatgcagaaccaatatatcatggatttgacaaattatctttacaggaataaagttctgtcatccaaaagtttgtttggagtctcaccagatttctttaagcagattttggagaatctttatatcccaactgcagacttcaagaacgctaaatttttcacgataactggtataccagcgctatcctacatatgtattattattctaagacgactggaaacggccgaaaataccaaaataaaattcaccagtgggatcataaatgaagagacgtttaacaatttctttcgagttcatcatgatgagattggccagcatggttggataaagggcgttaataacattcacgacttgagagtaaagattttaatgcatttgagtaacactgctaatccatatagagacattgcagcattcttgtttacatatttgaagagtctctcaaagtatagcgttcaaaattcttag

SEQ ID NO: 4689 - DNA, 2202 bp, Saccharomyces cerevisiae
atggaagtagacagtatattaggttccttgagcataactgatgattttgaccaattggttgacgtcacaagtctgtttgatgaattgtgttcaaaactaaaaccagaggctatcgtgaaagatcccaggtttgatttgttcgagggtacacattctttagaggtcaacaactccaaattagactccagtctgatagaattgacagcagaagaaatagaatttgatgtgaacgtggcctacgatccaccgttggcaagtgtagcagccatagcggatagattacttagatgtgttatctcctggctgaatgactaccagactttacccactactgtattaagctgcaggtatacagaaagcttattatcgtcattagttaagggaacaactgccggttcgtcctggtgtacagggaatattttgtatgataaagtactaggaagttgcatacttggcgtttgttatttaacaaaatttgtgcagaaactcttgagtgctggtattgtttttgaagaggaggatttaaattttaataacatggggtttaatacattcgataatttgccggggcaagatgttgttatcaattctctcaccgagagccttcagatattagaggcatattctgatgatagcttacatttaactatgctgaagcatatactaaaaattatcatttgcttagtccacttagaagaccatctgacagactattccacaaagacaagccacctggatgagctaattgaaaacgctaactcggttaatggcatatttccacaattacagctgtctccaccaaagggtgcgttctcaacatatatacaaaagcacaggtctaatcaattccctcccaggaagattacgaagttaccgacggattacagcggctttattacactggcaaatgatgttaaaacaatactccttgtagataaagccgagtctgcgttggagacctaccagtttgccaaattcttcaacaagttggaacaaaggcatgtcattgcaaggatcttattccccttatttttcattagagacgacagaacagttttgggtaaattttcatatacccaattttatttgctacatgtcaaggagttttcagcacaaactccatctgaatttgaatcctctattggtaatgaacttatccaagaaagctctaatatgcttttagaatggtaccaaaactgctcccaaaacacatgtagatatagacaaggttttaacaggcaacttattctatgggattctcttcaagcccagtttgaaagtgtcaattcacaagtttactgttcgtggacatattttatgaaactatcaagtatgatcgaattctctttaaaggggtttgatttggatatttacaaaccctttgaagcatactctatgttttggtatgtttattatttaagtcaccacttagaaacctttttgaaagatagtcaaaatgatattgaatcaaatattaatgccattcattccatgaacaaaaaacttaaaaaattgaaagctggtgaaaagaaggaccaattgaggctaaagtacaggtttgctatggataatgaaatggaacaattacaagctaccaaacaatttttaaactatcttttgaaggaaattaacattaccaaatctttatgtctaatagaggttttccaatttgcaattttaaagtcatttggtttaattgacaacaagaatagtactccgtcaaaattctctaatgaacggttaatccataatttgagattcaagccatttaattcaattggtgttcctgagttaccagaatatgaagtatttcaacaaactttaaaagattttgtcattgaagaaaaaggagctgcatttgatataaagttagaaagggccactaactttatcgaaactgaagtgcgcaatgtcgttagttctattgatgagataatgcaaggaatcaagggaggcgataataacggcgttctagtaacaggaacaagactggttcaagagctctctctggagtactattgtaaactaaaacatacttctaaagcattatcagtcaactcaaaagttatcgtcaacactttgaaaaagaacattaaaaacaaggactcccacgaatacaaggttgaattagttcatacaacagaaggatggaactatttccccatacaaacattgagaataaagcaagaccgctataaataa

SEQ ID NO: 4690 - DNA, 2202 bp, Saccharomyces cerevisiae
atgggcttcagtagcggtaaatcaactaagaaaaagcctctgcttttcgatatcagacttaaaaatgttgacaacgatgtaatactcctcaaaggtcctccaaacgaggccccctcggtgcttttatctggttgcatcgttttatcgattaacgaacccatgcagatcaaaagcatatcattgagactttatgggaagatacaaatagacgtaccattagagaggccccaggacgctagttcttcgtcgttgtcttcatcgccgccaaagatcagaaagtacaacaaagttttttataattacgcatgggataatgttaacctcaaggagtatctgagtggtttaagagggcaatctggccttgcgggcagtagctcatcaagtaatatcttgggcactcgccaaagagctcagtccacaagttccttgaagtctttaaaggggtcctcctcaccctcttcatgtactttagataagggcaactacgattttccctttagtgctattttgcctggttcgttaccagagagcgtagaatctttgccaaattgcttcgtgacatatagcatggaatccgttattgaacgcagcaaaaattatagtgatttgatctgtaggaaaaatattagagttctgagaaccatttcacccgcagcagtggagttatcagaaactgtttgtgtagataactcatggcccgacaaagtggattattctatttcagtacccaacaaagccgtagctattggttcagccacccctataaatatttccattgtacctctttcgaaaggtttgaaattgggctcaatcaaagtcgtattatttgagaattatcaatattgtgaccccttccctccagtaatttctgaaaataggcaagtgacagaactaaatcttgaagatcccttgaacgagtcatctggagaatttaatggtaatggttgctttgtaaataaccccttttttcagcctgatcattcattccaagacaagtgggagattgataccatcctgcaaatcccgaacagcttatcaaactgtgtgcaagattgtgatgtccgctctaacattaaggttcgccataagctcaaatttttcatcatcctaattaacccagatggtcataaatctgagttaagagcgtccttaccgattcaactttttatttcaccatttgtggcactttcaataaaaccattgtcatcctcgaatttgtattcgctttttagcaccactaaccagaaagacgaaaactcatcacaagaagaggaagaggaatatctgttttctagatcagcatcagtcacagggttggaattattagcggatatgcgtagcggtggctctgttcctaccatttcagacttgatgacgcccccaaattatgaaatgcacgtatatgatcgtctttatagcggttctttcactcgcacggctgtggaaacgtctggaacatgtactcctttgggaagcgaatgttcgactgtcgaggatcagcaacaggatttagaagatttacgtatacggttgacaaaaattagaaatcaacgtgacaatctagggctaccaccgtctgcctcgtctgctgccgcttccagatcgctatctccattactaaacgttccagcaccagaggatggcacggagagaatcttacctcagagtgctcttggtcccaatagtggctctgtgccaggagtacatagtaacgtatcacctgttttactttcaagatccccagccccaagcgtgtcagcccatgaagtgttaccagtgccctcgggcttaaattatccagagactcaaaacctgaacaaggttccatcgtatggcaaggcaatgaaatatgatatcattggtgaggaccttcctccttcctacccttgtgcgatacaaaatgtgcaaccaagaaaacccagtagggtacattccaggaactcttcgacaacattgtcatcttctataccaactagctttcattcctctagttttatgagtagcactgcttcccctatttccataattaatggctctagaagtagttctagtggggtatctcttaatacacttaatgagttaacttcgaaaacttcgaataacccatccagtaatagtatgaaaaggtcaccaacaagacggagggctacttctttagctgggtttatgggaggttttctatcaaagggtaacaaacgatag

SEQ ID NO: 4691 - DNA, 2202 bp, Saccharomyces cerevisiae
atgtcgaagaaccaaagtgtgagtgcgtcggaagatgaaaaagaaatactgaataacaacgctgagggccataaacctcaaaggctttttgatcaagagcctgatctcacagaggaagcattgaccaaatttgaaaacttggatgactgtatatatgcgaacaagaggatcggaacatttaagaataatgatttcatggaatgtgactgttatgaagaattctcagatggcgtcaaccatgcctgtgacgaggattctgactgtatcaatagacttacgttgatagaatgtgtcaacgatttgtgttcatcttgtggtaatgattgtcaaaatcagagatttcaaaagaagcagtacgctccgatagccatatttaaaacaaagcataaaggttatggcgtaagagccgaacaggacatagaagccaaccagttcatttacgagtacaaaggtgaggtgatcgaggagatggaatttagagataggttaatagactatgaccaacgtcatttcaagcatttttattttatgatgttacagaacggagaattcattgacgccacaataaagggttcgttggccagattttgcaatcactcttgcagccccaatgcatatgttaataaatgggttgttaaggataagctacgcatgggaatatttgctcaaagaaaaattttaaaaggtgaggaaatcacttttgattataatgtggatcgttatggtgctcaagctcagaaatgctactgtgaggagccaaattgtattgggtttctcggtggtaagactcaaacagatgcggcatctttattgccccagaacatcgctgatgccttgggagtgactgtttccatggagaaaaaatggctaaagttaaagaaattaagcggtgagccaataataaagaatgaaaacgagaacataaatattgaatttcttcaatcattggaagtccaacctatcgacagcccagtggatgtgacgaagatcatgagtgtattactacagcaagataataagataattgcatccaaactcttgaagagactttttactatcgatgatgactctcttcgtcatcaggctatcaaactacacggttacacctgttttagcaaaatgcttaaattgtttatcacggaacaacctcaggtagatggaaaaggaaacgagactgaagaagatgatataaagtttataaagggaattttagattttttgttggaattaccaaagacaactcgaaacggtattgagtcgtcacaaattgataatgtagtaaaaactctccctgcaaagtttccatttttaaagccaaactgcgatgagttattggagaaatggtcgaaatttgaaacatataaaaggataacgaagaaagacataaacgtcgcagccagcaaaatgatagatttgagaagggtgagattacctccaggctgggagatcattcacgaaaacggtcgcccattgtattataatgcagaacagaaaacgaaactacactatccaccttcgggatcatctaaggtctttagttcaaggtcaaatacacaagtaaattctccgagtagcagtggaataccaaaaacgcctggcgctttagactctaagaaacataagctgagtgacgaagaatatgagaggaagaaacaaaaaagactggaatacgaaagaattgcgctagaaagagccaaacaagaagaattggaaagcctgaagcaaaagctaaagcttgagaatgaaagaaaaagcgttttggaggatattatagcggaggccaacaaacagaaggagttacaaaaggaagaggccaaaaaactagtggaagcaaaagaggctaagcggttgaaaagaaaaacggtctcccagtcccaaagactagagcacaactggaataaattctttgcatcttttgtacccaacttaataaaaaaaaacccacaaagtaaacaatttgatcatgaaaacattaaacaatgtgctaaagacatcgtgaaaatcctaactacaaaggaacttaaaaaagattcttcaagagcgccgcctgatgacttaaccaaaggaaaaaggcataaagttaaagaattcataaattcatacatggataagattatcctcaagaagaagcaaaaaaaggcgttggcattatcatcagcatcaacaaggatgtcttctcctccaccttcaacatcatcataa

SEQ ID NO: 4692 - DNA, 2205 bp, Saccharomyces cerevisiae
atgagtgctagtgaagcaggtgtcactgagcaagtcaaaaagctgtctgtcaaggatagtagtaatgatgccgtaaaaccaaataagaaagaaaacaaaaaatccaagcaacagtccttgtacttggatcctgaaccaactttcatcgaggaaagaattgaaatgtttgacagattacaaaaggaatacaatgataaagttgcttctatgccacgtgttccattgaagattgtcttgaaggatggagccgttaaggaagccacttcttgggaaaccactccgatggatattgccaaaggaatttctaaatctttagcagacaggttatgtatttctaaggttaatggtcaattatgggacttagatagaccatttgaaggcgaagccaacgaagaaatcaaattagaactgctagatttcgaatctgacgaaggtaagaaggtcttttggcattcgtctgcccacgtcttgggtgaatcttgtgagtgccacctaggtgcccatatttgtttaggtcctccaactgatgatgggttcttttatgaaatggctgttagagatagtatgaaagatatatctgaatctccagaaagaaccgtctcccaagctgatttcccaggattggaaggcgttgccaagaatgttatcaagcaaaagcaaaaatttgaaagattggtcatgtccaaagaagatcttttgaaaatgtttcattattcgaagtataagacttacttggtacagacaaaggttccagatggaggtgctactaccgtctaccgttgcggtaaattgattgatctatgtgtcggccctcatatcccacatactgggcgtatcaaagctttcaaactattaaagaactcttcttgttatttcttaggtgatgcgacaaacgactctttacaaagagtttacggtatctcttttccagacaaaaaattaatggatgctcatttgaagttcttggcggaagcctctatgagagatcacagaaagattggtaaagaacaagaattattcttattcaatgaaatgtccccaggttcttgcttttggttacctcatggtactagaatttacaacactttggttgacttgttgagaaccgaataccgtaagagaggttacgaagaagtcatcactccaaacatgtacaactccaaattgtgggaaacctcaggtcactgggccaattacaaggaaaacatgtttactttcgaagtagagaaggaaactttcggtctaaaaccaatgaactgtccaggtcattgtttgatgttcaagtctagagaacgttcttatagagaattgccatggagagttgcagacttcggtgttatccacagaaatgaattttctggtgccttgtctggtttgactcgtgtcagaagattccaacaagatgatgctcatatcttctgtacccatgaccaaattgagtctgaaattgaaaatattttcaactttttgcaatacatttacggcgtttttggatttgaatttaagatggaattgtccactagaccagaaaagtacgttggaaagatcgaaacctgggatgccgctgaatcaaaattagaatctgccttaaagaaatggggtggtaactgggagatcaatgctggtgatggtgctttctacggtccaaagattgacattatgatttctgacgctttaagaagatggcatcaatgtgccaccatccaattagatttccaattgccaaacaggttcgaattggaatttaaatctaaagatcaagatagcgagagttacgaaagaccggtcatgatccatcgtgccattttagggtctgttgaaagaatgactgccattttgaccgagcattttgctggtaaatggccattttggttatcaccacgtcaagttttggttgtgccagttggtgtcaagtaccaagggtatgctgaagacgtccgtaacaaattgcacgatgctggcttctatgccgatgtcgatttgaccggtaacactctgcaaaagaaggtcagaaacgggcaaatgctaaaatataacttcatttttattgttggtgaacaagaaatgaatgaaaaatctgttaacattagaaacagagacgttatggaacaacagggtaaaaatgctactgtttctgttgaagaagttttgaaacagttgcgtaacttgaaagatgaaaagagaggtgacaacgtcttagcttaa

SEQ ID NO: 4693 - DNA, 2205 bp, Saccharomyces cerevisiae
atgtaccacacccatatgcatgaaagtttaatatctgtgacttcaacggtaagtgtttctgatgcgtcttatgcttatgcaaggctcactagaagagacgatagcgattcatcttcttcctcagcatccagcacgaaaaatagcaaatctgctgaatgtacaggctctaaacagcaatgtcaattacccacagattcgagtcacagcaccagtgtaactgttggtgtggctgttgcggtaccagtaggtgtcattatcattgttctggctgtgatactttgcattgtgtataggagaagcaaaaaggaagctgaggaagataatgatccagatttcgaaggagattctgaatttttaccgacaatgaaggattattcacctggaataaatcatttgtactctagcgactcgcagcaagacttcatggaaaagaccttgcaacagccgccttcagatccctttgttggtagcatgcatagtagtaaatataatgtgagaagcgctaccccacctgcaattggtcggtcatggtacgtagacccgtttcagcttccacaggaatcgaacgactctaacagtttgagagattttgccatgagagtacaagaagatggactaggtggctataaagttgcggccgagtctagaaatgccagtcaaacgtccttgcatcctgataacttttcgaattgtacaccaataagagcgtcttcaagatttcaagagagtgaaagctttcgatctcacggtagcccaatccataataaccagctttcccgtggttctgccacagaaggtgccaacaagcagtttacatttcctaatgaagacaatgattcgtcctcagttagtgaagaggctgaggttttgaatgagtcaaatgagtctgcaagcaatgacgcgttcgaattcgaacttgataatagttcagaaaagacacatgaaaggaatctgcgttttggtaaggatgatgataattatgaacttcaagatatcagagaagctgaacatatgaatgatcgtagtagcagtaaaagtcaagatgatgattactatgtatcactcttatcccctaatgaagaagaagatattaagagaatgaaaagtatttatcaagtttatttggatagagctaaaacaatgaaaaaggaagaggataaagcagataatgcaaatgatatatcgcaggaggagaatagagtggataatatagtccagaatccactgccttctatcaaaattaataataacgacaatatcgacaataatgaggtaccggaagcaaaacacctggtgaaagaagcacttcctctaaacaatactaacttggcagaatatggtccagaaatggcccaaagccagaaacaatatccagtgcaggatacactcaccgtgaacgatacggaagcagcgccttccaatagaattgcttcctcaatttattccgaagcaattcagccgttgaattatcaggatcaatatcaacaacaggaacaatcaccagtatataatggccacacacagtatcctggcaatggatatagcggaaatcctcagcaacaggggtatactgcgcaattcgtgcaaaatccacaatggtacggtgtaccaactcctcaacaacagcaacataatcatcctcagaccctggaaactattggagaattaccaactcccgcatatttagctcaatcagcttcctcgcattcattgacctcttttaaaagaccaaacaagcaacaacttcttcaattacagactgccagactaaacggaactgcgttaaatccggtcgatcatccggaaatgttttattcaccgacaaacgatgcctattatgctccacagcagcaaggccaatatatgaagtttaacgaaaatggggcggttccttcaccttatcaacttagacaaagtgtggtaatgaccaatccttcggatttgacggcaaaaccatcttataagccagcaggttctttcagaagtgtaagcgcaaccaattcaagaaataacagtctgaccacacaaaataatatctatctgcaacagcagcagcagcaactgtataattctcgtgttagtgggatattagaagagacagatgttgtacagccaccaagtgttggtggaattttgccacatagtggttcacaggacgatttaagaaaacaattaggctcttcacataattataccgtcaactga

SEQ ID NO: 4694 - DNA, 2208 bp, Saccharomyces cerevisiae
atggcagcaaatagcaatagtagagttgcatcaaaccatacttctaaaaaacaaaaggttaggaggaatatacatccattcacgaataacactcggattaaaagagctagtaaaatcgtaaagtttaatgattcaggcgagggcgaccatgtttcagaccaacgttcgaacaaggaaaatgtccttacttataaatctttgaaaagtcgggcaagcgatttactcaaaatgagagaaacacttcccgtttaccaacacaagcgagaaataatgtcatatattgaaagcaatcccgttaccgtccttattggtgaaacaggttctggtaaatcaacacaaattccgcaattcgtattagaaaaattatatgatacgaagaagcatgggtcgattgctgtaactcaaccccgtcgtgttgcggccatcaatttggctacacgtgttgctcaagaacatggttgcaaactgggtgaacaagtaggttattctgtcagatttgacaatacgactactacaagaacaagacttaagtatctgactgacggtatgttacttagagaacttatgatgaatagtgaccttagagaatacagcgtcatcgttatcgatgaagcgcatgaaagaactgtgcttacagatttgatattggggttcttaaaatccttgatacaagggccaagacctgatttgagaataattgttatgtctgcaacattgcaagccgaaaaatttagtgagttcttcaataatgccccaatcttatttgtagaaggaagaaaatttgatgtcaaacaatactacttgaaggcgccaacagatgatatagtagacgctgtcatcaggtgttgtatacaaataaaccaaggtgaagaactgggagatatcttatgttttttaccgggccaagaagagattgacaaagcagtgactataatggagaaaattgcaaagtatgtttcagatgaggccccagtaccattaatagttccttatcctttatatgcagctcttcccgcggtccaacagtccttggtcttcgctccgataaagggtttcaagagaaaagtcgtctttagtaccaatattgcagaaacatctgttaccatatccggtgttaaatttgtcgttgattctggtcttcgaaaagtcaaagtttggagacatcagctgggattagccactctacttaccgtacccatttctcaggcaagtgcgatgcagagaagtggtcgtgctggtagagaaagtgaaggaaagagtttcaggctttattgtgagtctgattatgtgaaattacctaaacaaagtgaacctgaaatagccagaagtgacgtcacatctcctgtgttaatgttgaagagatatggtgttgatgacctgctaaactggacctggtttgagaaccctggaaaggaagctatagtaatggggcttcaggaactttatgaattgggtgctcttgacactcgtggaaagataactaaacggggtcaacaaatggctctgttaccgctacaaccgcatttaagtagtgtcttaattaaagccagtgaagtcggatgtttgagtcaggtcattgatatcgtctcttgccttagtgtggaaaatttactgttgaatccgtcaccagaagaaagagatgaggtgaacgagcgtcgtttgtccttatgcaacgctggtaaaaggtatggtgaccttatcatgctgaaagagctttttgatatctatttctacgaactagggaaaagtcaagatgcaagctctgaaagaaatgattggtgtaaaggattgtgtatttcgatacgtgggtttaaaaatgtaattcgtgtcagagaccagttaagagtttattgtaagcgtttgttttcttcaatcagtgaagaggatgaagaatccaaaaagattggtgaagatggcgagctaatttcgaaaattttaaagtgtttcttaactgggtttatcaagaatacagctatagggatgccagacaggtcttatagaactgtttccactggagagccgataagcattcatccatcatctatgctatttatgaataaaagctgccccggtataatgtacacggagtatgtctttactacgaagggatatgccagaaatgttagtaggattgaactttcatggttacaagaagttgtcactaatgcagccgctgtagcaaagcaaaaagtttctgattcaaaataa

SEQ ID NO: 4695 - DNA, 2208 bp, Saccharomyces cerevisiae
atgggagaatttaaacctccgctacctcaaggcgctgggtacgctattgtattgggcctaggggccgtatttgcaggaatgatggttttgaccacttatttactgaaacgttatcaaaaggaaatcatcacagcagaagaattcaccaccgccggtagatctgtaaaaaccggcttagtggctgcagccgtggtttctagttggatctggtgttctacattgttaacgtcgtcaacaaaggaatatgcagacggtatatttggcggttatgcgtacgctgctggcgcatgcttccaaattattgcattcgcaattttggcaattaaaaccaagcaaatggctcccaatgcgcacacatatttagaattagtgagaacaagatatggtaagatcggccatggttgctacttgttttatgccatcgcgacgaatattttagtcacttcaatgcttttaacttcaggttctgctgtctttagtgatttaaccgggatgaacactatcgcatcatgttttttactgcctgtgggtgttgttgtttatactctatttggtgggattaaagcaactttcttaacggactatatgcacacatgtgtcattatcatcattgtcctcgtatttgcctttaaagtttatgcgactagtgatgttttaggctcaccgggaaaagtttatgacttagttcgtgaagccgccaagaggcatccagtagacggtaactatcagggtgaatatatgaccatgacatccaaatccgctggtattttattaattattaacctgattggaaatttcggcaccgttttccttgataatggttattggaataaagcgatttctgctagtcccgcagcgagtttgaaagcatatgccatcggtgggttagcatggtttgcagtaccttctttgatttcattgaccatgggattagcatgtcttgcggtggaaacgtctccgaacttccccacctatcctgatccacttacttcgttccaggcaaattctgggttagtcttgccggcagctgcaattgctatcatgggtaaggggggtgctgtggcatcgctgctaatgattttcatggccgtcacatctgctatgtctgctgaactaattgccgtttcatctgttttcacttacgatatctatagagaatatattgatcctcgtgcaagcggtaagaaattgatttacacatcacacgttgcttgtatcttttttggtcttgccatgagtggattttcggttggtttatactatggtggtatttctatgggttatatctatgaaatgatgggtataattattagtagtgcagtattacctgtcgttttgaccttatgttccaaagacatgaatttggtggccgctgtagtgtcgcctattttgggcacaggactggctataatgtcatggcttgtctgtaccaaatccctttataaagaattgaccgtggatactacgttcatggattatccaatgttaacaggtaacttggtggctttgctatcaccagccatttttattcctattttaacgtatgtgtttaagccacaaaattttgactgggagaaaatgaaagatattactagagttgacgaaactgcagagttagttcaggctgaccctgatatccagctttacgatgctgaagctaacgataaggaacaagaagaagaaacaaattctctggtctcagatagtgaaaaaaacgatgttagagtaaataatgaaaaattgattgagcctaaccttggtgttgtaataagtaatgccatttttcaagaagatgacacacagttacaaaatgaattagacgaagaacaaagagaactagcacgtggtttaaaaattgcatacttcctatgtgtttttttcgctttggcatttttggtagtttggcccatgcccatgtatggttccaaatatatcttcagtaaaaaattctttaccggttgggttgttgtgatgatcatctggctttttttcagtgcgtttgccgtttgtatttatccactctgggaaggtaggcatggtatatataccactttgcgaggcctttactgggatctatctggtcaaacttataaattaagggaatggcaaaattcgaacccacaagatctgcatgtagtaacaagccaaattagtgcgagagcacatagacaatcatcacatttcggacaagttgatgaaataatttag

SEQ ID NO: 4696 - DNA, 2208 bp, Saccharomyces cerevisiae
atgtccagacgcaatccaccaggcagtagaaacgggggaggtccgacgaatgcctctcccttcattaaaagagacagaatgagaagaaatttcctgaggatgagaatgggtcaaaacggcagcaattctagttccccaggcgtaccaaatggagacaacagcaggggatctcttgtcaaaaaggatgatcctgagtatgctgaagagagagagaaaatgcttttgcaaatcggtgtcgaggccgatgctggcaggagcaatgttaaagtaaaggacgaagatcctaatgaatataatgaatttcccttaagagctattccaaaggaggatttagaaaacatgaggacacatcttttgaagtttcagagtaaaaaaaagataaaccctgtaacagacttccatcttcccgtaagactgcataggaaggatacgagaaacttgcagtttcagctaacaagagcagaaattgttcaaaggcaaaaagaaatttctgagtataaaaaaaaagcagagcaagaaagaagtactcctaactcgggtggtatgaataaatcaggaacggtctcgctcaataatactgttaaagatgggtctcagacacctactgttgattcagttactaaagacaacacggccaacggtgtgaactcctccattcctactgtaactggctcttctgtccctcctgctagtcctactactgtatccgccgttgaaagtaatggactgtcaaatggttcaactagtgcagctaacggtttggatggcaatgcatctacagcgaatctagctaacggaaggccgttagtgacaaaactagaggatgcaggcccagctgaagaccctactaaagttggaatggtcaagtacgacggaaaagaagtgactaacgaaccggaatttgaagaaggaactatggatccactagcagatgtggcaccagatggaggcggtagggccaaacgaggaaatttgagaaggaaaactcgtcaattaaaagttcttgatgagaacgccaaaaagctgagatttgaggaattttatccatgggttatggaagattttgatgggtacaatacatgggtgggttcttatgaagcaggtaactcagattcttatgtcttgttaagtgtagaagatgatggaagttttaccatgattcctgctgataaggtttataagtttaccgcaagaaataaatatgctactttgaccattgacgaagcagaaaaaagaatggacaaaaaaagtggtgaagtgccacgttggttgatgaagcatttggataatataggtacaactacaactagatatgacagaacaagaagaaagcttaaagccgtcgctgatcaacaagctatggatgaagatgatcgtgatgacaattcagaagtagagttagattatgatgaagagtttgccgatgatgaggaggcacctattatagatggtaatgaacaagaaaataaagaatcagaacaaagaatcaagaaggagatgctgcaagctaatgcgatggggcttcgtgatgaagaagctccttccgaaaacgaagaagatgagttatttggggaaaagaagattgatgaggatggtgaaagaattaagaaggcattacaaaagacagaacttgcagcactatactcatcggatgaaaatgagatcaacccatacttatctgaatccgatattgaaaacaaagagaatgaatcgcccgttaaaaaggaagaagattcggacactctatccaaatccaagagatcttctccaaagaaacagcaaaagaaagctacaaatgcgcatgtgcataaagagccaactttgagggtgaaaagtattaaaaactgtgtcattatcttgaagggggataagaaaatactgaaaagcttcccagagggagaatggaatccacagacgacaaaagctgtagatagtagtaataatgcatcgaatacagtgccttcgccaatcaaacaagaggaaggcttgaattctacagtggcagaaagggaagaaactccagcgcctacaataacagaaaaagatatcatcgaggctattggtgatggcaaagtcaatatcaaagagtttggaaagttcatcagaagaaaatatcctggcgcagagaataaaaagctaatgtttgccattgtaaaaaaattgtgtcgaaaggttggcaatgaccacatggaattaaagaaagagtag

SEQ ID NO: 4697 - DNA, 2211 bp, Saccharomyces cerevisiae
atgaatcaaaatttaaaaaacacttcttgggctgatcgaataggaagcgacgatcaagaaagaaaagctaactcttcagaggtttcacaaagcccaccacccaataatagcttcgagtcatcaatggattcacaatttagctatgctcattcaaataaaagtagcatttcattcgaatctattcaaaccacggaaagacttcttgacaaattagacctcagcttggaagatgaactgattctgcaagaagctttattagaagaagaaaacgcgtcgagaaattcgcaactgtcacaaacaagtggtccaacattatgtatgcctgcgtcggaattcccttcattaaggtatagaactaatccctctccaacatatatacaagctagagatcgttctcttatcatagacaatttaaaagaaaaggattccactttgagaggcaaatactcttccggtaaagtggaaaggcatttgcccgtgaagtcgagatactcttatatcgtcgaagaagattatgactctgagacttttagtggcatgaaaccccaaatgaatagaaatgagaaagattataagtacccaaaccttgaaaatggcaatagaagcacaaatagccctaatcctttcaacttcgagaaatataggattgaaaatactagactgcaccatctttatcctacgctgatatcagacaataatactagcgttgacaataatgctaatagtaagaataacagaactactagtaataatattaatacatctacaaaaactgacagaatatccgagaagcagagttgccccaatgagttcacaaccacgcaaaagagtaattgtctttatcggaacggaagttcaacaagcaccaacacctccttttctgaagttggacaactatcaaagccgaaaactcagtcttcttttgaaagtgaatcatcctcattctccaaactcaagttaactaagagtgatacaacacccatcaaaccatctcctaaacggtctaattcctctacctcgacgataacgaaaacaaataccatgacaaatgatatttcattacctccaacgccaccatataaagctcataaaaaaaaaacgtcactaaattcgctaaaaaaactttttaaatctcctaggacaagagcaaaaaataagaaagaccttgagtctgaaggatcaagccctatccggtctgccaccaattcattggacttctctggggagaatattcaacttccatctacttcaagtaccattaataattccagtccacatttagctaggtatatttttcctccaaacccagttttccattttaaaacagcatcaacacctcagtcatccacggataaaaaaaagaacagtaaagcacgtccaaataggactcatttgagaactttctcggatttccatacaacggaaaaagattcaaaaataggtgaactaagtgcactaacagaacaatcaaataagccctaccacccgaaagttagaagaagaacactttctttagatggtatgttgcccaataattcgacgcaatgcatggattccttcagtcataaaaaagaaggatcgaacgcaacaagcaagtgcgggaagcttaaatttcacccagaaccttatgataatgatgaatcttcacacatcggacaggcaattactatgcgtcatcaaggcaaacttgaagaatctgcacaacgactgaaaaaagcctgcgcgtgcggaaacaaaactgcgtttctgttatatggactagccctgcgacatggctgcggagtggacaagaacttgaaattatcattaggatatttaatggctgccactgatatcaaatcctttgctgctgaggttcttgatttagatataaatccgttaaattttgcttcaatggacgatatccctgatatagcgcctgaaccaacagcacctgccttgtacgaatgtggtatggcatatttaaagggtcttgggatggatcatcccgacgagcgaaaaggtttgaaatttttggaaaaagctgctctattaggccatgtagactcaatgtgcttaagcgggacaatttggtccaaaacttcaaacgtaaagaaaagggatctcgccagagctgctgcatggtttaggatagccgataaaaaaggtgcaaatctattaggttcagattggatttataaggaaaagtacatgaaacaaggtccgaaataa

SEQ ID NO: 4698 - DNA, 2214 bp, Saccharomyces cerevisiae
atggattcacatcaactagaactaccagacggattgaataacatgacgatggatgcagacactttaattagcctttttgtgctcgttgtttgcagaagtgaacaaaagcaccttaaaagtcatctttactatttgcaaaatttttcgaataactcttcttctacaaaattcggcattctagggtatgctgtatccacactggaagcagtggtttgttatttcgaagacttcaacaaaaatacaggcaacgtggcgaaagctaacacattatgtgaaaaaactaagaatttattagataagttgtcatgtgaaaaccccacaaatgaagtagaagatctggcaacatacaaggatattttgacctacagaaatgagcaaggacaatccattctatccatatgtataacaaatcataaaaactacatcttattagatattctttctgaatatgaaaacgactttccagtagaagaccttttagaggacgaaacgattgatggttctacgctgcttatagaatcgataaaagcaggaaatttagaagccgcgaaagttctcataaagatcatgctgttcaattgtactgaagaggagctggtttcttatatcaataaaacagataaatatgcacgtaccgtggctcattatctaacccatgaaatggatatacttaaaagcatcggaaattatattgattggaaacgaaaaaattccagtggacaaacgcctttattttccatctttagaagttatgatcaaccaaattatgaagaaatggtgaagaccgcatttgatatcgcaaatacttggtatagaaagcacaacagtttgtttgactatctagaccacaccgataataagggcaatagcttgttgcatgttttgaaaacaaacattccaatccttttacaactgactaagctagatattaatgaggaaaattataagggattgacgccattaatggtatatgtgaagtacaaaagactaagtaatattgacgccatcacgaaagaccgtcgacttatattagagaaggttcaaaactcgaccttcttcacttgttttgattatgcaaaagatcactcggtactaagcaagataggagaaaggggtgtcaaagattcactttttggattaatatattttcattctttgcgatatcataatttaaatgcgacaacaaatataacatccgtttcaaatgcagagaaacctttcgccactactgttattaacatgaaaacaattcaaggcttactacgctcaattctgaaagacaatccgttcacctttttgccattaaatacctatatcgatgaaatatcgcacttaaaccgttctgatttaacaataatcgggaaaacagatgtcacatcgttacttcaccaattaactaactgcttcaacgttcttttattcctgaaaaaaattccagaaaatttgttcactgatgaggcttctatcttatattggatgcgcataaacacttctaaaagaaaccagaaaccctcaggaaaagaaaatccaaaaacaatggaacccgaggagattaatatgatacaaagctttttacgttttaattttgatgagatttcatcatttaaggcaagcttgaatattttgaggaaagtcttaatatttattaatttgaaatccgatgatttcgaggatgcttataagggtcttaacgaaatgggtagaaaattaattaatagtgaagcatccagcgcatttaaggggattataacaaatcataatatgttcagtgaattatcgctagcagcactactagaaaacgtgcgtttcttggaacaatgtactatccaactatctagtttcgttcagataattttatttgaaaaaattccgaactggtggaaacattatggtgagtttttagctttacataaaagctatcggaaggcttttcctaacatggttaagccaaaaagtgcatcagatacctctagtcgtgctccacttggtggttttattgaaacgaagcgtgaacaatcggagcaaagactagcggttcagataaaggcctcttcaaaaatgctcaaagaacttggaagcgaaatttttgtagctcacgaaaggttggccgaggaactaagcaattatatggagttcaggaaggcgtgcttagatcagcgtagtcttgtggcatttgccacaaccaacattagcgttcttcaagaatgtgtttaa

SEQ ID NO: 4699 - DNA, 2214 bp, Saccharomyces cerevisiae
atggcacttgtcaaatacagcacagttttttttccactccgatcattgcgactgtttgtgtccatcaagaaagcatattaccacagcgagccgcatagcatcgatctatttcatgataaggattggattgtgaaaagacctaaattcctaaatttacccaaaaatgaacattcaaaattagatatattccagtttaattttaacaagtccgaaagcaataatgtgtatttacaggattcatcatttaaagataaccttgataaagcgatgcaatttatctataacgataaattgtcatccttggatgccaagcaagtaccaataaagaatcttgcttggttgaaattaagagattacatatatcaacaactaaaagatccgaaactgcaagccaaaacctatgtaccttcggtaagtgagatcatacatccttcatctcctggcaatttgatttcgttgctgataaattgcaataaaatcagcaatttagtctggaaatctgttctcaaatatagcctgagtaacaatataactacattggataaatttatccacgtcctgcaacagaccttcgaccatgtgtacgagcaggagatactacccatgatgacgaatacagatgatacagatggcgctcacaacgttgacataacaaatccagcagagtggtttccggaggcaagaaagattagaagacatataatcatgcacattgggcccacgaattcaggcaaaacttatagagcgttacagaaattgaaatccgtggaccgtgggtactacgcagggccgttaagactgctagcaagggaagtgtacgatagatttcatgcagaaaagataagatgcaatttactgactggagaggaagttattcgtgatttggatgatagaggaaattcagcagggctgacatcaggcacagtagaaatggtgccaataaatcaaaaatttgacgttgttgttcttgatgaaattcaaatgatgtctgatggggatcgtggctgggcttggacgaacgcgcttttaggtgtcgtttccaaggaggtccatctttgtggtgaaaagagtgttctacctttggttaagagcattgttaaaatgactggcgataaattaacgattaatgaatatgagaggttaggaaagttaagtgttgaagaaaaacctatcaaagatggcatcaaaggtttgcgcaaaggagattgcgtcgttgcgttttcaaagaagaaaatattggatctcaagctaaagatagagaaagacaccaatttgaaagttgctgtaatttatggctctttgccgcctgaaacacgtgttcaacaagccgccctattcaacaatggagagtatgacataatggtagcatcagacgctattggtatgggtttaaacctgtctattgacagagttgtattcacgacaaatatgaaatataatggtgaagaactaatggaaatgacttcttctcaaatcaaacaaataggtggtcgtgcgggaaggttcaaatctagatctgcctccgggggtgttcctcagggttttatcaccagtttcgaatcaaaagttttgaaaagtgtaagaaaagctattgaagcacctgtggagtatttaaaaactgcggttacatggcctacagatgaaatatgtgctcaactaatgacacaattcccaccaggaacgccgaccagtgtcctgctgcagactatttcagatgagctagagaaaagttctgacaacctgttcacgttatctgatttaaagagcaaactgaaagttattggcttattcgagcacatggaagatatcccatttttcgacaagctgaaactaagcaatgcgcccgtgaaggacatgcctatggtcacaaaggcgttcaccaaattttgcgaaacaatagcaaaaaggcatacaagaggcctactgtcataccgattaccttttaacctactggactacaattgcataccgaatgagagttattcattagaggtttatgagtcattgtacaacatcattactctatacttctggctcagcaacaggtacccaaactacttcattgacatggaatctgctaaagatttgaagtatttctgtgagatgattattttcgagaaacttgatcgattaaagaagaatccttacgcacataagccctttggttctacaagaggtcacctctcatcttcgagaagaagattgcgtacataa

SEQ ID NO: 4700 - DNA, 2214 bp, Saccharomyces cerevisiae
atgtcacagaatattcaaattggcactagaaaacgttcaagagcaaatatgaataattccactactacgggccctgctaacaatacaagctctaacaagacctttttggataatttcgaagaaacgcgcacaaacaagctgctggacgagatgtttgctcggcaaaattcttttctaacagacaatctgaggaacagtctagacctgaatcaagcagacaatccgctccgtcctcggcaacaccaacaccagttgttcttggacaatgaaaatgccatagaactagacgaggagccgcgtatcattaacaccacaatcaataacagtaataatcataacagtagtcgagtggacgaggatgctgacgatgacatcatttttatcaaagagcagccaattcagttttcgtcacctttgattctgcctagtagcagcagtatcaataacaacaataatattgttacttcaaataatccagggtgcggtaccgcagctacaagcaatagtacgtatatcacgacaccaaagaaattcaagaagcaaagaaccatctcactgcctcagttgcctctatcgaagctgagctaccaatcgaactattttaatgttcctgatcaaaccaacgctatcgtgccaagagtaacgcaaactgaaaatgagctgttgcatctaacggggtcgtgtgcaaagactctggagggcaacaaggcagtgaatctcacgattgctcacagcacttctcccttttccaacccaccagcacaaatagcttccctgcctcaatccaacctcaagaaacaaattggttcttcactacggaaatttacatcaaacggctcttcagaaagcgcatcatccaataaatcaaatttcaaaacggacaaagacggtcactacgtttaccaggaaaacgacatatttggcagtggcggccgctttgttgtgaaggacctattgggccaaggcacgtttggtaaagtacttaaatgcatcgataacaagtatgaacctaattacgtggctgtaaaagtgataagggctgtagatagatatagagaagccgccaaaacagaactaagaattctacagactatcctgaataatgaccctcaaggtcagttccagtgcctcttgctaagggagtgcttcgattacaaaaatcacatttgtttggtgacagatctatacggcaggtccatttacgattttatgtgctccaacggcattgccaggttccccggctctcatattcaggccattgccagacagctaatcagatctgtctgcttcttgcacgatttgggcataatacacacggatttgaaaccagaaaatatcctgatttgtgacgaaacccatattgctcaaaaattgcctttgaaaaccgtacagtcgctaagcaagagacgccgtgaagccagtaaggggaagcgcaaaatcttgaaaaatccagaaatcaaaatcattgatttcggtagcgcaattttccattacgaatatcatcctcctgtaatatccactcgtcactatagagccccggaaattgtccttggcttgggctggtcgttcccctgcgacatttggtccatcgcgtgtgtcctagtagaactggttattggcgaatctctttaccccattcatgaaaatctagaacatatggctatgatgcaacgaatcaatggaacccctttccccacagacattattgataagatgttttacaaatctaaacataaattgggcaactctccatcagacctaaattcaacggtgataaagcatttcgacagaaaaactttaagcttacaatggcctgaaaaaaataaacgcggagataccataaccaccgaaaagtcaatgaaaagggtcttgcagtcatgtgatcgcttagatatttacatctcaaaggtcttgaaacaggattacggcgatagcttaagcatcaattggaatctaccgccggagaaaaactggtctttgataaattcgaaattggcatggaaaagacaaacacattcctcttcttcctcaactactgatgaactcgataaggaaactttcttgttttggtactggttcatcgatctactcaggaaaatgtttgagttcgacccaacaaaaaggattaccgcaaaggacgctctggaccatgaatggtttaatctgggcatactggatgatggtattgcaacttataataatacccaaggatag

SEQ ID NO: 4701 - DNA, 2217 bp, Saccharomyces cerevisiae
atggttgccgaagaggacatcgagaagcaagtccttcaattgatagacagcttttttctgaagactacactactaatatgctccaccgaatcaagtcgataccagtcttctacagaaaatatattcctatttgacgacacatggtttgaagatcactcagaattagtgagtgagctacccgagataatatcaaaatggtctcactacgatggtcgaaaagagttgccacccttagtggtagagacatatttggatttaagacagttaaactcgtctcatttagttagattaaaggaccacgaaggccatttgtggaacgtttgcaaaggaactaagaagcaggaaatcgtgatggaacgttggcttatcgaattagataattcatccccaactttcaaatcatacagtgaagatgagactgatgttaatgaactttctaaacagctagtccttctcttccgttatttgttgactttaatacagttactacccacaacagaattataccaattattaataaagtcttataacggcccgcaaaatgaaggaagttccaatccaataacttccacgggcccactagtaagtatccggacgtgtgtccttgacggatctaaaccaattttatcgaaggggagaatagggttgagcaaaccgattattaatacatattccaatgcgcttaacgaatcaaacctgccagcccatttagatcaaaagaagatcacacctgtatggacaaagtttggactcttaagagtctcggtatcatacagacgtgattggaagtttgaaattaacaatacaaacgacgaattattttcagctcgacatgcatctgtctcacataactcacaaggaccccagaatcagccagaacaagaaggacaaagtgatcaagacatagggaaacgccaaccacaatttcaacagcagcagcagccccaacagcagcagcagcagcagcaacagcaacagagacaacaccaggtccagacacaacaacaaagacagatacctgataggagatctctttcactttctccttgtacaagagccaattcttttgaaccacaatcttggcagaagaaagtctatccaatatcgagacctgttcaaccatttaaagttggttcaattggaagtcaaagtgcgagcagaaatccctctaattcatcgtttttcaaccaaccacctgttcataggccaagtatgagctccaactacgggccacaaatgaatattgaaggtaccagtgttggaagcacctcaaagtattcctcctcctttgggaacattcgtcgtcactcaagtgtaaagacgacagagaatgctgaaaaagtatcaaaagctgtaaagagcccactacaacctcaagaatcacaagaagatttaatggattttgttaaattactcgaagaaaaacccgatctaactataaagaagacaagtggaaataatccacccaatatcaatatttctgattctctaatcagatatcagaatttgaagccaagtaatgacttattaagtgaagatttatccgtaagtttatccatggatccaaatcatacatatcacagaggcagatcagattcccactcaccattgccttcaatatccccttcgatgcattatggatcgttgaactcgagaatgtctcaaggcgccaatgcaagccatttgattgcaagaggcggtgggaattcatctactagtgccttgaatagtagaaggaattctttagataagagctcaaacaagcagggtatgtcaggcttacctcctatttttggtggagagagtacttcatatcaccacgacaacaaaatacaaaagtacaaccaattaggagtagaagaagatgatgatgacgagaatgaccgtttgctcaaccaaatgggaaacagtgctacaaaattcaaaagttcaatatctccaagatcaattgatagcatttcaagttctttcataaaaagtaggatacctatcagacaaccataccattactctcaaccaactactgcgccctttcaagctcaggcgaaatttcataaacctgcaaataagttaatcgataatggtaataggagtaatagtaacaataacaatcataatgggaatgatgcagttggtgtgatgcataatgacgaggatgatcaagatgatgatctagtatttttcatgagtgatatgaacctttctaaagaaggttaa

SEQ ID NO: 4702 - DNA, 2217 bp, Saccharomyces cerevisiae
atgtctacacaatttaggaagtctaatcataatagtcatagtagtaaaaaactaaatcctgcgctaaagtccaaaatagatacgcttacagaattgttccctgactggacgagtgatgatttaattgatatagttcaagaatatgatgatttggaaactataattgataaaattacttccggcgcagtgacaagatgggatgaagtaaagaaacctgctaagaaggaaaaatatgaaaaaaaggagcaacaacactcatatgtccctcaacaacatttgccaaatccagaagatgatattacatataagagttctaataatagcaattcttttacttctacaaagcataacagtagtaacaattatactcaagccagaaataagaagaaggtacaaacaccacgagctcatacaaccgggaaacatgttaatctcgacaaggggaagcacgtaccatccaagcctgtttcaaacactacatcgtgggcagcagctgtttctgtagatactaaacatgacgttcctcaagattcaaatgataacaataatgaagaattagaagcacaagggcaacaagcgcaggagaaaaatcaagaaaaagagcaagaagagcaacaacagcaggaagggcataataacaaagaagaacacaaacaaatagagcaaccttctttatcttcaaagaaaacaacttctaggacatctgcttcacaaccaaagaaaatgtcgtgggctgcaattgctacaccaaagccaaaggctgttaaaaagaccgagtctcctcttgaaaacgttgctgaattgaagaaagaaataagcgatattaagaaggatgaccaaaagtctgaagctagtgaagaaaaagttaatgaacaagaaacatctgcacaagaacaagaggaggagactgctgaaccttctgaagaaaatgaagacagagtccctgaagtggacggagaagaagtccaagaagaagctgaaaaaaaggaacaagtaaaagaagaggaacagacagcggaagagctggaacaagaacaagataatgttgctgctccagaagaagaagttacagttgttgaagaaaaggttgaaattagtgctgttatttcagagcctccagaagatcaagctaatactgtacctcaaccacaacaacaatcccaacaaccacagcaaccacagcaaccacagcaaccacagcaaccacagcaaccacagcaacaacaacaaccacagcaaccacaacaaccacaacaacaactacaacagcaacagcaacagcaacaacaaccagtacaagctcaagctcaagcccaagaagaacaattatctcaaaactactatactcaacaacagcagcaacaatacgctcaacaacagcatcagttacagcaacagtatttgtcccaacaacaacaatatgctcagcaacagcaacagcatccacaacctcaatcacaacaacctcaatcacagcaaagtccacaaagtcaaaaacaagggaacaacgtggctgcccaacagtactacatgtatcaaaaccaatttcctggatattcttatccaggtatgtttgattcacaaggatacgcttacggtcaacaatatcagcaacttgctcaaaacaacgctcaaactagtggtaatgctaaccaatataatttccaacaaggttatggtcaagcaggcgcgaacactgctgctgctaatttgactagtgctgccgctgctgctgccgcttctccagctacagctcacgcccaacctcaacaacaacagccatacggtggctcattcatgccatactacgcccacttttaccaacagtcattcccatatggtcaacctcaatacggtgtagctggtcaatatccataccagttaccaaagaacaattacaactattaccaaactcaaaacggtcaggaacagcaaagtccaaatcaaggtgttgcccagcattctgaagactctcaacagaagcaatcacaacagcaacagcaacagcaacctcaaggtcaaccccaacctgaagttcaaatgcaaaatggccaacctgttaacccacaacaacaaatgcagttccaacaatactatcaattccaacaacaacagcaacaagctgctgccgctgccgctgctgctgcccaacaaggtgtaccatatggctacaacggttatgattacaattctaaaaattcaagaggtttctactaa

SEQ ID NO: 4703 - DNA, 2223 bp, Saccharomyces cerevisiae
atgatagcaccagactcgcaaagattattcggttcctttgatgaacagtttaaggacttaaaactagattcagtcgatacagaaaacaataacacacacggtgtttctactatcctggattcctcccctgcgagcgttaataacaatacaaacggtgctgttgctgcaagcgtgaatacagtccctggatcgacgtttagatccaatacacctcttttaggaggtcgacatccactcagtaggacgtcttccttaatcgattctattggtatacagcgtgctgcgtcaccattttcttctatgaaagagccttttattcctcaaagttcgggagtaatgagttcctctttttggcacggcgaccatcctgaatcacgggttagtacgcctgttcagcagcatccactattgcaaagaaacgagtcctcctcctcctttagttatgctgctaatcttggagtgaatctgagtacacattcattggcggtagatattactccattaagtacaccaactgctgcccaatctcatgtcaatttgtttccgtcctctgatattcctcctaatatgagcatgaacggaatgtcacaactcccagcaccagtttcagttgaatccagttggaggtacatagacacgcagggacagattcatggtccatttactacccaaatgatgtcacaatggtacataggtggctattttgcttcaacccttcagatttcaagattgggaagcactccagaaacgctaggaataaacgatattttcatcacacttggtgagttaatgactaaactcgagaagtatgatacggatccattcactacttttgacaaacttcacgttcaaacaaccagctctgattctatcaacttgaatctagctccttacgcaagcggtgttgccgctactggcactattaaagctactgaaaacgatattttcaagccattgacacatgacaatatctgggatatggatggaggtaccacctccaagggagtcgatattaaattagcctcagcaaccaccattagtcaaacagatgaatctcacaagcaagaatacaaatcgaccactatgctggaaaaagggaagaaggaaaaatccgaatctgtagcaaaagcgttattggatgaacaagagaaacggaacagagaactcaaaaggaaggaagaagctcgcttatcgaagaaacaaaagcaaaaagaggatgatttattgaagaaacaaaaggaacaaaaggaacaaaaggaaaaagaagctttggaagcagaaaagcaaaaaaaatcagaaaagacaaaaaaggacacacaaacacaaacagaaggctttaagacatcaaaagatttgccttcattaaattcctcaagcgcgaatccggcaccatgggcctcaaaagtcaaagttaacaatgcaatcgaaacttcaattaaaaatggtgtaagtagcactggaaagaagaaaggagaacccttaggtctacaacagaggaacagcaaagaagaaaagcaaaaggaggaactaaaatccgtgcttaactgggctaacaagtccagcctaccatcgaatcaaactattgatattaaatctcagtttcaaaaaagcccaaaagggatgaaagagtcgtctccgttaaaggagttggaagatccaaatttcatagaagagcagaaaaaactatgggaaaaggttcagagttcttccaaacaagtaaagtccacatcctctgcatctactaccacatcttcttggactacggtgacttctaaagggaaagcacctataggaaccgttgtctccccatattcaaaaaccaataccagtttaaattcttcattaacggcaaaaactagcacaacttctactaccactacctttgctagcatgaacaatgtttctccccggcaagaatttatcaaatggtgtaaatcacagatgaaattaaattctggaataaccaataacaatgtcttagaactattattgagtttacctacggggccagaatctaaagaattgattcaagaaacaatttatgccaatagtgacgttatggatggtagaagatttgccactgaatttattaaaagacgtgttgcgtgcgaaaaacaaggtgatgatccactaagttggaatgaagcgctagctctatcaggcaatgatgacgacggctgggaattccaagtagtgagcaagaagaagggtagaaaacactga

SEQ ID NO: 4704 - DNA, 2223 bp, Saccharomyces cerevisiae
atgtcctccagcatctttgaaatgacaatagaccacgacggtatggatagtacggggctgaagctttcacagacagcctcatccatatccatgggcgacgagtttctttgttccagtactactagtaattctattctggattctccgcttccgaaagtgacttttaaccatatcgatagcataacagacattaacacaaacatcatgaacgaaatagtggagccacaatccggagtagatgttgatgttgctgacaaaaacgtgctttactgcatagatccgtacccagtggaacctccgtgttatgattttgcgaatccgtctaaagtcattaggtaccctatatatgagcattgtcgtccgtgcctcacttctgtgaaacctcccagttatacaccgtctgtagaacactatactgtggtttctatgaagatggaaaaactatcgccctttgaaaatgcttcttctcgattatggaacaactttattcttcaaataaactctacgcagataaacttttattctattgacgattcattaaccaggcatattaaaaactatcgtggtggtgacatgtttgaccattcccaccattccaaaactgctagcgatcgccatcattcggctcggtcgttattaaatgcgttcacgacgaaatccacttaccaattcgataaatatgacaaggaaaggatatgcggggaaatagcacgagacgagcacaaatttttatcagatgagcgcctctttaagagttactccctgcaatgtgccaaagttggtctgcctatagattattcctctagagattttgttttaagaatgcgttgtgagggacaacagtttctagtgcagttttctcatgtagacgaattgatctattgggctatgtatttgaacatgggtatatccctgtccttggatctggaattgagggaaatgcccacctatagaagcgttcccagaaggagacatccgagggcaagaagatttaagcaacacaataagaacaaaaacaaaaacaagagcagacaaaatagtgatagaaatgattctcgctcccactctttacttttaagaagatcacacacctcttctgttgtaacaaaagtggccaccggcaacgaacgtccgacaaacaaatcaagatcaagaagtttaagcttgctacctccctctgtatccgatgcgagtcatgactccaatgggcccaatgactctggttcattggcaggggagagttctcaaactgatttttgtggcttatttacatcaaaactaagaaatttctttaaaacagattccagttcgagaaaaaactctaatatggacattggacaaaaaatgagatcgaaggaactgaatagtgttcaagaagaaatcgatgacaatggtagtactactaataccaatacttctgttctatcttccactttttctcccacagcacattctgttttaacggcacaaacatccatccatgaaaacttcagaagtagatcgaattccaaccctatagatcctttgcgctgtgatcggtcagtgttgaaaattaataattttgaaccggtatacgagggaacaggaaggtcaactatttcgaattctgctgagcgtacgaatcgtgaagaaaagttaaaccgtggcaatgaagatgtaaatggagatgaagatgatgacgaagacgaagacgatgctaattacgaagaggatgatgaagatggatatgttgaggatgatgacatcaatagattggtatatttggatgaaagagaatctcgctatgagaatgcggacgttgagtacggtacaatattcagtacgaaaagcttttccgtgactggttgtttaaatcatgattttccaaagaaattgtcactaaaatgtggaaataagaatcaatccagtaacgattcgaagtgggcaccggcgacacaactagtttcaaggaaaagatatatcaaagactcattaagatgcatcaaaccgttaacggaagaccacccatgggtaggtaagattattttcaaaccggcactgccaccagcattcgaaacgaataatccacctataagagtttatagtggtgaagatagtacggacttgatgcacgtgaaaaaccattatttaaagccatacatagtgggatcctgcgggtttttgaaaactggctcaaaactttttcacttttacgatagaactaacgaccttacgaatttatga

SEQ ID NO: 4705 - DNA, 2226 bp, Saccharomyces cerevisiae
atggttgataccgcaccatacattggttcactagggagaagttccctttttgatactggtgatatagaacaagcccctggtaataatgcaattggtattaatgaggaagatattcacgcgtttgtatcaagtactggcgaaacggttcaattaaagaagaagcctgcgaagttagcaaccgggaatattagtctatacactaacccagatactgtttggagatcagacgacacgtacggcatcaatataaactatttgttagacaaaattgaggcatctggcgatgaccgcactaacgcacaaaagacttcacctataactggcaagataggtagcgacacactctgggtagagaaatggcgtcctaaaaaatttctagatttggttggtaatgaaaagacaaacaggagaatgttaggttggttgagacaatggacgccggctgtgtttaaagagcaattacccaaattgccaaccgaaaaagaggtcagtgatatggaactcgatccattgaaaaggccaccaaagaaaattttactactgcacgggccaccaggaataggcaaaacctcagtagctcacgttattgccaaacaatcagggttttctgtctcagaaatcaatgcaagtgatgaaagggctggacctatggtaaaagagaaaatatataatcttttattcaatcatactttcgatacaaatcctgtgtgcttagtggcggatgagattgatggaagtattgagagtggatttattagaattttagttgacattatgcaaagcgatattaaagccactaataaactattatacggtcaaccagataaaaaggacaaaaagcgcaaaaagaaaaggtctaaattgcttacgcgacctattatttgtatttgcaataatctatatgctccttctttggaaaagctgaaaccattctgtgaaattattgctgtgaaaagaccttccgatactaccctactagagcgattgaaccttatctgccataaagaaaacatgaatattcctataaaagcaatcaatgacttaattgatttggctcaaggtgacgtaaggaattgtataaacaatttacaattcttggcctcgaatgttgattcaagagattcctctgcatcagataaacctgcttgtgcaaaaaatacgtgggcgtcatccaacaaggactcccccatatcatggtttaaaatcgtgaaccaattgtttagaaaggatccacatcgtgatataaaggagcagttttatgaattgctaaaccaagtagagcttaatggtaactctgacaggatattgcaaggctgttttaatatatttccctacgtaaaatattccgacaatggtataagaaagccagcaaacatttcagattggctatttttccatgatttaatgtaccaatcaatgtatgcgcataatggcgaattgttacgttactccgcccttgtgcccctagtcttcttccaaacgtttggcgatatcgcaaacaaagatgatattagaatgaagaatagtgaatacgaacaacgtgaattaaaacgagccaattcagatatagttagtctgattatgagacatatctcggttcagtccccactaatggcaagttttacggatagaaaatcgttaatctttgaaatactaccatatctagattcgatgatctcttccgattttaataaaataaggaacctgaaactcaaacaagccatcatggaggaattagttcaattgctgaaaagctttcaactgaatctaatccaaaatcggtcagaaggatttgatgtaaggggtggcctaacaatcgatcccccaatcgatgaagtcgtattgttaaatcctaaacatattaacgaagtccaacataaacgggctaataatttgagttcactgttagcaaagattgaggaaaaccgggccaagaaaaggcatatagaccaagtgactgaggatagactacagtcacaggaaatgcatagcaaaaaagtcaaaactgggttaaattcttcctcaagtacaatcgactttttcaagaatcagtacggattattgaagcaaactcaggaattggaagagacacaaaaaactattggatcagacgaaaccaaccaagcagatgactgcaatcaaacggttaaaatatgggtgaaatacaatgaggggttctctaacgctgtcaggaaaaatgtgacttggaataacctgtgggaataa

SEQ ID NO: 4706 - DNA, 2229 bp, Saccharomyces cerevisiae
atgagcgatgaagattctatgctgttaaacttcactaccaatgaggacactgcaggaagttcctataagcaagctgccaaggtgacaggcggtagatggaaggatagaagaagaatgaaaatgaagcttgagggcaagacagtctcgaggaaaagaaaggcgaacactacaggggacgaagggataattccgggtagaggcgagaattctattaaaaaattgcataaggagagttcctatagttctgaagagcaggaaaaatataagggtagaaatgctcataacactcaagggagaactctaccagccgattctcagtttgtttcatccctgtttacatctaacagagagattacaactgcggtaaacactaatattcatgatgaaaacgttgccatcaatccgtctaacgcgcccttgaaaggtgatcagtttgcgtctttaggtgtctctagtcttcttgtttctcatctggagcaaaaaatgcgtattaaaaagcctacgagcatccagaagcaggccatacctcaaataataggtaacgcggggaagaacgattttttcattcacgcccaaacaggctcaggtaagactttatcgtatcttttacctataatatctactattttgaacatggatactcatgttgatcgtacttctggtgcatttgcattggttattgctcctacacgagaactagcatcacaaatatatcatgtttgttccacgcttgtgtcatgttgtcactacttggtcccatgtttattgattggtggagaacgtaagaaatcagaaaaagctagattgcgtaagggttgcaatttcataatcggtacaccaggtcgtgttttggatcatttacaaaatacaaaagttatcaaggagcaattgagtcaatctctaaggtatatcgtattggatgaaggagataagttaatggaattgggttttgatgagacgatcagtgaaattattaaaattgttcacgatattcccatcaactccgaaaaatttcccaagctaccgcataagttagtgcacatgttatgtagtgctacacttactgatggtgttaataggttaagaaacgtggcgttgaaagattacaaattgattagcaacggtaccaagaaagattctgatatagtaacggttgcgcccgatcaactattgcagaggattactattgtcccaccaaagttgcgtcttgtaacattagctgctactttgaacaacattaccaaagatttcatcgcttccggtcaacagtccaaaacgctgcgtacaatcgtattcgtatcatgttcagacagcgtggagtttcattatgacgcattttcaggaagtgacgggcaccataaaaatctaacgggtgattctgtaagactattgacaaaaggaaacactatgtttccttgtttttcagattctagggacccagatgtagtgatttataaattgcacggttctttatcccaacaaatgagaacctctacattgcagcattttgctcgtgataatgaagccaccaagggaaaacatcttattatgttctgtacagatgtcgcaagtagaggcctagaccttccccacgttggatctgttattgagttggatccaccatttgctgttgaagaccatttacatagagttggtcgtacagcaagggccggtgagaagggtgaaagtttgttatttttacttcctggcgaagaagaaaaatatatggactatatccagccgtatcatccgatgggttgggaattactgaaattcgataaagaaatactaatgccggctttcaaagatgtgaatgtcaacagaaatgataaattcattagaaaagatgagaaatcgtccaaaaataaagacgtgggcgataaagaatatgagtgggataccaatgctacgacatggcatttgaatatagaaagacgagtagtgggagattccgcattcaaaaatttggccgttaaaggtttcattagtcatgtgagggcttacgcaacgcatatctctcaagaaaagaagtttttcaacgtgaagttcttacatctaggccatttagctaaaagttttgggttacgtgaaaggccaaaggctatgggattgcaaagtagtaaggatggtaatagtgaaaagaagccaactaaggaaaactctaaaaataaaatgtttcgtatggctcgtatggcagagaagcaaatagcaagtgagtttaactactaa

SEQ ID NO: 4707 - DNA, 2229 bp, Saccharomyces cerevisiae
atggaacttcagaatgatttagagtcgctcgataacgagctgaatgattttagtgaagatccatttcgtgatgatttcataacggatgaagatgctgtaagatcggggtggcgatctgcgtggaccaggatgaaatattggttttataagaatagactgaagtggacaaacaatcccatagtgattggcgacgcgaaagatagtagggatggttctaactttagaaggggtataccgctatatgaattagacgcgaatggtcaacccattgatactgaacttgttgatgagaatgaactttcttttggaacgggatttcattccaaagtgccttttaaaataatatttcgcacattgtttggctcgctggtgtttgccatttttttaattctgatgattaacatagcaaaaccccatcactccacgagagtgctatcgcactttggcagtcctgaatttgacccttacgtgaagtattttaacggtacgcatgaatttttccccttaacgatagtaatttcactagacggtttccatccttcactcatatctaagaggaacacaccgtttttacatgacttatatgaattgaaatatgatggaggtatgaatatcacgtccacaccttttatggtacccagcttccctacggagacctttcccaaccattggacgttggttactggacaatacccaatacaccacggtatagtctctaacgtattttgggatcctgatcttaatgaggaattccatccaggtgtattggaccctcgaatatggaacaataatgatacagaaccaatatggcaaactgttcagtctgcatttgacggtgatataccattcaaagctgctacccatatgtggccaggtagcgatgtgaattataccaagtataatgaagagaaactacaacctgaacataaaaatcctattgctagagagagaactccattttacttcgacgaattcaatgctaaagaaccactttcgcaaaaattatccaagattattgaatatgtggatatgagtacactgaacgaaagaccacagctaattctcggttatgtaccgaacgtagatgcctttggacataagcatggatatccgtcagagtcggaatactattatgaagacttcactgaaacactgggggaagtagatacatttctgaagcaactagtggaatcgctgcaagaaagaaatttaaccagctttactaatttggtcattgttagcgatcatggtatgagcgatatcgtagttccctcaaatgttattatatgggaagacttactggacgaaaaattgaggaaggattatgtatcgcacgcatatctagagggtccgatgatggctatatcgttgaaagattccggaaacatcaatgaggtttaccacaatttaaagacttctatagatgaagacaagtatacggtttacgttaatggaaatttccccaaagaatggaactttaatgatggaaaaaatcatcacatggcgtcaatctggattgtgcccgagcctgggtatgcagtgatgaagaaagaacaattgaagaaggtggcaaaaggtgatcataaggacaaaaacgaagacaatgtgttcacgattggatcacatggatacgacaataacgcgatcgatatgagatctgtatttattggtatggggccatattttccacagggatacattgagccgttccaaaataccgaaatttacaaccttttgtgtgatatttgcggtgtggcagaaaaggacagaaattccaatgatgggactgggatgcttatgaaccaactccgcgaaccccagagcagcgaagaagtagagattgaagatgactttgattatttggtcagtaagtttggtgaattcagcacttataatataatttggggcgggtaccccgaagagacagaacaagacaatgttgacaatgataatgatgacaacgacgatggaaacactgatgaaatagccgctatgccatcttcgtcattaacgataaaactagaaatgacaacttcaataccatcagcaactgagactctactgggcgaaacatcaccatcatcaagaagcagcagcagcagcagcatacaagctagcgctactgctagcacagtgggggattggcttcaagacataatcaacgacgcaaaagatctcattgacgacataattgacagcatcgacgatttagtcgattctgatacctaa

SEQ ID NO: 4708 - DNA, 2229 bp, Saccharomyces cerevisiae
atgggttcatcaattaactatcctgggtttgtgactaaaagcgctcatttggctgacactagtacggatgcgagcatttcatgtgaggaagcaacaagctcgcaggaagcgaagaagaatttctttcaaagggattataacatgatgaagaaggcgcctgctccaacgaagtctaaactgtctttggccttgcagacttccaagtcatcctctagtgccaacggtactgtacaagaggatacttcctcgaagacagaagatttttctacaaagagcattaagaaaaaaccagatagcggcgttgaatcgcatgtgtccatccaatcggattcggggccacaatcagactcagatttggattcagattcctctatctcatcatgtgacgaaaggaacgaagagtctttgaaagattacaggccgggtgggtaccaccctgcctttaagggcgagccctataaggatgcacgctacattttagtaagaaagctgggatggggccacttctccaccgtttggttggcaaaggatatggtaaacaacactcacgttgctatgaagattgttcggggcgacaaagtttacacagaagctgctgaagacgaaattaagcttttgcaaagagtgaatgacgccgataatacaaaggaggattccatgggggctaatcatattttgaaattgctagatcatttcaaccataagggccccaatggcgtccatgtggttatggtatttgaagtcctcggcgagaacttactggctttgataaagaagtatgaacataggggcattccattgatttatgtcaagcaaatatcgaagcagttactgcttggtcttgattacatgcataggcggtgtggtattatacacacagatattaaaccagaaaacgtgttgatggagattggagatgttgagggtatcgttcaaatggtcgaggcactggataaacagaagagagaggcaaaaaggttgcagaggcacgtttcgcggtcttctgatattaccgcgaacgatagcagtgatgagaaatgggcagaatgccaaacaagtatgccctgcggctcaagctcaaattccaaatctcgttctatagagaaggacttgtcaaaaagatgctttagaagacctagacgtcatacaattatcacagggtcgcaaccattaccttccccaattagttcatcaaatttctttgaaatgagggcgcacttttgtggtagtagtcacaatagcttttcctccgtatctgggaataggaacattccatcttccatcaataataacagtattaataatggcataggcattaagaatagcaacaatagtttcttaaattcagtaccacattctgtgaccaggatgttcataaatgaagacagtaatgataacaacaataatgataatagtaaaaataaaaataacaacaataacaacagtaacaacaataataacgaggacataatgaacacacctttgcatgaagagcagctggcagactctttatctacatttgatatttccaatatatcacaaagctccgatacaaatggtccatatatttctaatactatggattcaaattcaaacgtcagtaccgatatcaactccccagaaaatttgattcagatcaagattgctgatttaggtaatgcttgttggtatgacgaacattacacgaattctatacagacaagagaatacagatcaccagaggtgttactaggcgccccttggggttgtggtgcagatatatggtctactgcttgtctaatttttgaattgattaccggagattttcttttcgaaccggacgaaggtcattcctacactaaggatgatgaccatattgcacaaatcatcgagttattgggagaattaccatcataccttttgaggaacggcaaatatacaagaactttcttcaattcaagagggcttttaagaaatatctcgaaattgaaattttggcccttagaagatgttttaactgaaaaatataagttttctaaggacgaagccaaggaaatatctgattttttgtcgcctatgttacagctagacccaaggaaaagagctgatgcaggtggcttggttaaccatccatggctcaaggataccttgggtatggaagagattcgggtacctgatagagagttgtacgggagtggttccgatatccccggatggtttgaagaagtccgcgatcataaaagacattga

SEQ ID NO: 4709 - DNA, 2232 bp, Saccharomyces cerevisiae
atgaataaagagcatttgctgaaggtggatcccatccccgatgtgactattaaacgcggccctttgaggtcttttctcataacaaaaccctgtgataatttgagttcattacgaacagttacttcatctaaggaaaagcttctagttggctgtttgctgatatttactgccatcgtaaggctacacaatatctccctgccaaatagtgttgtttttggtgaaaatgaagttggtacatttgtttctcaatacgtgaacaacatattcttcaccgatgttcatcctcctttagtggcaatgctatatgcaaccgtgtcctctgtttttggttataaagggcttttcaattatgggaacattggtactgaatacacggcaaacgttccatacgtcgcgatgaggttcttttctgctactttgggcatcgtgtccgttttggtattatacttaacgttacgagtttctggcgtgaaaattgcggtagctgccatttgtgcagtatgttttgcaattgaaaactcctttgtaacgttgtctcgtttcaccttgatagagggaccctttgtttttttcatggcatgtgcagtttatttctttagaagatcggaactttatttgccaaattcatgtaaagcaaacaagtcattacttgctgcgagcattgcattgggatttgcagtttcttcaaaatgggctggcctcttcaccatcgcatgggctggtattattgtcctttggagagtatggttcatgattggtgatttgtcaagacccattggttcttctatcaaatatatggcgttccagtttacctgtctattagctattcctgccttcatctattttctcattttcagcgtgcatattaagacattaaacgtgaatggtattagtagtagcttttttcccgctgagtttagaaaaactttaaaatacaacaacgttattaaagagactgtggcagaagttgcagtgggttccgctgtttcactgaatcatgttggaacggcaggtggttacttgcattctcatcttcacaattatccggctggttccatgcaacaacaagttactttgtatcctcacatcgaccaaaataacaaatggattattgagctggctgaacatccaaatgaaaatgtcacaagtttccaaaatttaaccgacggtaccataattaaattaagacagcttaagaacggctgcaggttacactcacatgaccacaaacctccagtttctcaaaatgcggattggcaaaaagaggtgtcatgttatggatacgagggcttcgaaggtgatataaatgatgattggataattgaaatcgataaaaagagatcagagccgggacctgcccaggaacatattagggctattgaaaccaaatttaggctgaagcattatctaactggttgttacttattttcacatcctgaaaagctacctgagtggggattcgggcagcaggaagttacgtgtgcatactttgcaagggaagacttaacttcatggtatattgaagaaaacgaaaacgaaatttctttgccaaatccagagaaggtttcttataagaaaatgagcttttggcagaagtttgttgctatccacaagttcatgttctaccttaacaattatatggatactagtcatgcctactcatctgaaccaaagacttggcctcttatgttgcgtggtattgatttttggaatgaaaatggcagagaggtgtactttttaggtaacgctgttttgtggtggtctgtcacagcatttatttgcacgttcatcattggagtggctgttgagcttcttgcttggaaattaggtgtgaatattctacgggataagcacatcataaatttccactatcaggtctttcagtacttattaggctttgccgcccactatttcccttacttctttgtggggcaaaagttatttttgtacgattatttgccggcctattattttggtatcctagcatttggtcatgctttagacctgatttcaacctatatttctaacaaaagaaacaatactggatatatagtggtggctattttcatggttgtatgtttctatttcttcagcgagcattctccacttatttatgctactggatggtcgagtaacctgtgtaagaggtccaagtggttaggaagctgggacttttattgcaattcactattactatccgatagccactatgaattaaacgctgaatcatga

SEQ ID NO: 4710 - DNA, 2232 bp, Saccharomyces cerevisiae
atggatggtcccaattttgcacatcaaggcgggagatcacaacgtactactgaattgtattcgtgcgcacgatgcagaaaattaaagaagaagtgtggtaaacaaataccgacatgtgcaaactgcgataaaaatggggcacactgttcatatccaggtagagccccaagacgtaccaagaaggagttagcggatgctatgctacgaggggaatatgttccagtgaaaaggaacaagaaggtaggaaaaagcccattgagcactaagagcatgccaaactcttctagtccgctatccgcaaatggcgctataactcccgggttttcgccttacgaaaacgatgatgcacataagatgaaacagctaaaaccgtcagatccaataaatcttgtcatgggggcaagtccaaattctagcgaaggtgtctcatcgctaatttcggtgctaacatcgctgaatgataattctaatccttcttcgcacttatcctctaatgaaaattccatgattccttcccgatcattgccagcttccgtgcagcaaagttcgacaacttcatcattcggaggatataacacgccttcaccactaattagcagtcatgtgcctgcgaacgcccaagccgtaccgctacaaaacaacaatcgcaatactagcaacggggataacggcagtaatgttaaccacgataataacaatggcagtaccaacacaccgcaattgagtcttaccccatatgcaaacaattcagcccccaatgggaaattcgattctgtgccggttgatgcatcctcgatcgaatttgaaactatgtcctgttgctttaaaggtggtagaacaacatcgtgggtcagagaggatggctcgttcaagtcaattgatagatccttactggacaggttcattgccgcatacttcaaacacaatcaccgtctatttcccatgattgataaaatagcattcctaaatgacgccgcgacaattactgatttcgaaaggttatatgacaacaaaaactaccctgacagctttgttttcaaagtatacatgatcatggctattggttgtacaactttacagcgtgctggtatggtttctcaggacgaagagtgtctgagtgaacatttggcttttttggccatgaaaaaatttcgtagtgttataattttacaagatatcgaaactgtacgatgcctattgttgttgggtatttattcgttttttgagccaaagggctcctcgtcatggacaattagtggtatcatcatgcgattgaccataggattaggtttaaatagagagttaactgccaaaaaactcaagagcatgtctgctttagaagcagaggcaagatatagagtgttttggagtgcttactgctttgaaaggctagtatgcacctcgttgggccgtatatccgggatcgacgacgaagacatcactgtgccactaccgagggcgttgtatgtggatgaaagagacgatttagagatgaccaagttgatgatatcattaaggaaaatgggcggtcgcatttataaacaagtccactctgtaagtgcagggcgacaaaagttaaccatcgaacaaaagcaggaaatcataagtggattacgcaaggagctagacgaaatttattctcgagaatcagaaagaaggaaactgaaaaaatctcaaatggatcaggtggagagggagaacaattctactacaaatgtaatatccttccatagttctgagatttggctagcaatgagatactcccagttgcaaatcttactatacagaccatctgcattgatgccaaaaccgcccattgactcactatccactctaggagagttttgcttgcaagcctggaaacatacttatacactgtacaagaagcggttattacccttgaactggataacccttttcagaacattaaccatttgtaacactatcttatactgtctttgccagtggagcatcgacctcattgaaagtaaaatcgaaattcaacagtgtgtggaaatactaagacatttcggtgaaagatggatttttgctatgagatgcgcggatgttttccaaaacattagcaacacaattctcgatattagtttaagccatggtaaagttcctaatatggaccaattaacaagagagttatttggcgccagcgattcatatcaagacatattagacgaaaacaatgttgacgtctcttgggttgataaacttgtatga

SEQ ID NO: 4711 - DNA, 2232 bp, Saccharomyces cerevisiae
atgtctgctcccgctgccgatcataacgctgccaaacctattcctcatgtacctcaagcgtcccgacggtacaaaaattcatacaatggattcgtatacaatatacatacatggctgtatgatgtgtctgtatttctgtttaatattttgttcactattttcttcagagaaattaaggtacgtggtgcatataacgttcccgaagttggggtgccaaccatccttgtgtgtgcccctcatgcaaatcagttcatcgacccggctttggtaatgtcgcaaacccgtttgctgaagacatcagcgggaaagtcccgatccagaatgccttgttttgttactgctgagtcgagttttaagaaaagatttatctctttctttggtcacgcaatgggcggtattcccgtgcctagaattcaggacaacttgaagccagtggatgagaatcttgagatttacgctccggacttgaagaaccacccggaaatcatcaagggccgctccaagaacccacagactacaccagtgaactttacgaaaaggttttctgccaagtccttgcttggattgcccgactacttaagtaatgctcaaatcaaggaaatcccggatgatgaaacgataatcttgtcctctccattcagaacatcgaaatcaaaagtggtggagctcttgactaatggtactaattttaaatatgcagagaaaatcgacaatacggaaactttccagagtgtttttgatcacttgcatacgaagggctgtgtaggtattttccccgagggtggttctcatgaccgtccttcgttactacccatcaaggcaggtgttgccattatggctctgggcgcagtagccgctgatcctaccatgaaagttgctgttgtaccctgtggtttgcattatttccacagaaataaattcagatctagagctgttttagaatacggcgaacctatagtggtggatgggaaatatggcgaaatgtataaggactccccacgtgagaccgtttccaaactactaaaaaagatcaccaattctttgttttctgttaccgaaaatgctccagattacgatactttgatggtcattcaggctgccagaagactatatcaaccggtaaaagtcaggctacctttgcctgccattgtagaaatcaacagaaggttacttttcggttattccaagtttaaagatgatccaagaattattcacttaaaaaaactggtatatgactacaacaggaaattagattcagtgggtttaaaagaccatcaggtgatgcaattaaaaactaccaaattagaagcattgaggtgctttgtaactttgatcgttcgattgattaaattttctgtctttgctatactatcgttaccgggttctattctcttcactccaattttcattatttgtcgcgtatactcagaaaagaaggccaaagagggtttaaagaaatcattggttaaaattaagggtaccgatttgttggccacatggaaacttatcgtggcgttaatattggcaccaattttatacgttacttactcgatcttgttgattattttggcaagaaaacaacactattgtcgcatctgggttccttccaataacgcattcatacaatttgtctatttttatgcgttattggttttcaccacgtattcctctttaaagaccggtgaaatcggtgttgaccttttcaaatctttaagaccactttttgtttctattgtttaccccggtaagaagatcgaagaaatccaaacaacaagaaagaatttaagtctagagttgactgctgtttgtaacgatttaggacctttggttttccctgattacgataaattagcgactgagatattctctaagagagacggttatgatgtctcttctgatgcagagtcttctataagtcgtatgagtgtacaatctagaagccgctcttcttctatacattctattggctcgctagcttctaacgccctatcaagagtgaattcaagaggctcgttgaccgatattccaattttttctgatgcaaagcaaggtcaatggaaaagtgaaggtgaaactagtgaggatgaggatgaatttgatgagaaaaatcctgccatagtacaaaccgcacgaagttctgatctaaataaggaaaacagtcgcaacacaaatatatcttcgaagattgcttcgctggtaagacagaaaagagaacacgaaaagaaagaatga

SEQ ID NO: 4712 - DNA, 2235 bp, Saccharomyces cerevisiae
atgacaatcgatgattcaaatcgattacttatggacgtcgatcaatttgattttttggacgacggaacggcgcaacttagtaataacaagaccgatgaagaagaacaactatataaaagggacccagtcagcggggctatcctggtccctatgactgtaaatgatcaaccgattgaaaaaaatggcgacaagatgcctttaaagttcaagctggggccactttcttaccaaaatatggcattcataactgcaaaagataaatataagctttatcctgttagaattcctagattagataccagcaaagagttttctgcatacgtatcaggtttatttgaaatttaccgtgatttaggtgatgacagagtgtttaatgtaccaacgattggagttgttaattctaatttcgcgaaggagcataatgcaacagtaaatctggccatggaggcgattctgaatgaattggaagtgtttattggtagagtcaaggatcaggatggaagagtgaaccgattttatgagttggaagaatctttaaccgttttaaactgtctgaggacaatgtacttcatattagatggtcaggatgtagaggagaacagatcagagtttattgagtcattgctaaactggattaatagatcagacggtgaaccagatgaagaatatattgaacaagtgttttcagtgaaggattctacagcaggtaaaaaagtgttcgaaacacaatatttctggaagcttttgaatcagcttgttttaagaggcctgctctcccaagctataggttgcattgaaagatcagatcttttaccatatttgagtgatacatgtgccgtttcatttgatgcagtaagtgactccatcgaactcctgaaacaatatccaaaagattcgtccagtacatttagagaatggaaaaatttggtgctaaaattaagtcaagcctttggtagttctgctactgatatttccggtgaattacgggattacattgaagatttcttgttagtaattggtggaaatcaacgaaaaattctgcagtattcaaggacgtggtatgagtccttttgtgggtttttattatactatatcccctcattagaactatcagcagaatatttacaaatgtcactggaagctaacgtcgtagacataacaaatgattgggaacaaccatgcgtcgacatcattagtggtaagatacactcaattttaccggtaatggaatctttagatagttgcacagcagcatttaccgctatgatttgtgaagcaaaaggtttgatagagaatatttttgagggtgaaaaaaatagcgatgattatagtaatgaagacaacgaaatgcttgaagatctattctcttataggaatggtatggcatcttatatgctaaatagcttcgcttttgagttgtgttcactgggtgataaggaactatggcccgttgccattggattgatagccttatctgcaacagggacgagaagtgcaaagaaaatggtgattgcagaattacttccacactacccatttgttacgaatgatgacattgaatggatgctaagtatatgtgtagaatggagactaccagaaatagcgaaggaaatatacaccacgttgggtaatcaaatgttatcggcacacaacataattgaaagtatcgcaaattttagtagggcgggcaaatatgaactggtaaagtcatattcgtggctattatttgaagcttcgtgcatggagggccagaagttggacgaccctgtgttgaatgccattgtgagcaaaaactctcctgcagaggatgacgttataataccacaagacattttagattgtgtagtgacgaattctatgcgtcaaactttagcgccatatgctgttctgtcacaattctatgagctgagggacagagaagattggggccaagcgctgcgcctattgcttttgctgattgaattcccttatttaccaaaacattacttggttttgcttgtggcgaaattcctgtacccaattttccttttagatgataagaagctaatggatgaagattcagtggcgacagtcattgaagttatagaaactaaatgggatgacgctgatgaaaaaagttcaaacttatatgaaaccattattgaagcagataaaagcttacctagtagcatggcaacacttttgaaaaatttaagaaagaaactaaatttcaaattatgtcaagcgttcatgtaa

SEQ ID NO: 4713 - DNA, 2235 bp, Saccharomyces cerevisiae
atgataactaataagaaaataaagataagtgtcccagaaaaactcggtttgtcagaagaatcttttgaggaatcctgggaaacagttaaatatgccattgatcatatatacagcgatgacatggccgacctttccttcgaacaagtgtacaagaccatttatactatcgttttaaataaaaaggggccaatactttataacagattgaaagattatttaatccaaaaattagcgcttttgagggaaacgatagtcaaggacaatactcatgattatgagtttcttggaactatggcacggttatgggaggtgcaatgccattgttttaaaataacgggagacttaatgatgtatatggacaaagtttattgcaaaccaaatagatgcatggaggtatacgacatgtgcctcgatcttttccgaatcgaaatattgcaaaaatgctcatcttctctcatctcagcactgatatctgatatagaaaggattcgtaatttaggatctgtcgactccgaacatactagtttgtggaaagtactaataggaatgatggagacattacatgacaatagagatagttttttcttaaccgattttgagccggttttgattagcgcgacagaagaatactacaataaagctattgatattgaattattaacgccaattgagagcctggaaaagattaggaagttaaggcagtttgaaagtatgctagactcctcttttctaaatgtggattctcataataagttgaagactgtattagaaaatgtccttatatggggaaagttgagtgatattattgaagatctaacgcacgaagcaatggtaatttcaaatggaaagctactccaagaaatttatgacttgtcaagcgaggaaaaatatcgcgttactgtcattgaatctattaaatcttacatcaataaaaatgccataaatattccttttaatgaaggtaaccgcaaaaaagggcagaatgcgattacttggtcttcggaaattgtagagctatatcgcagtcaacactcgtttttggaaagtattgattttggttctgttcgtcttaataatttgaccggggatgtatctaatgcaatacttggcgatgttttctcaatgtatttctctaaagaaggagcattaccatctgagtatctttctacctacgtggaccattgtatgaaacgaaccaaggaaaaagatgctgaaatagtgaagatcaagcaagatttgcttgatagtaccaaattaatcggactcctaactgagaaggatatatttgaaaagatttacaaaaaacaactctccagaagattactgcagcagaggtctttagtggaaattgaaaaatggatggtgcaaatgataaagaaggttctaggaactttttttacctcaaaattggagataatgctgcgagatatatctttatcctctgaaatgtatcaagcattccaacactcaacaatcaacagcatagaatatttgagttttgcaccacaagttttgacgagaacgagctggccctttcagagtactaatccaattgatgaaggtatttcactacctcctagaatgtcacaaattttagctggctttgagggctattacagcttaaaatacaaagaaagagtgctaaagtgggctcatcatctaagtgtaattgaaattggctgccaatttaatagcggttactacgaaataagtttttctgtttacgctggagtgattttccttctatttgaagattatgaagaattaacgttgggggaaatatatgaactaactcatattcccatagatgacgttaagtctcttgtaatgtcaatgtcgacaatacccagatgtaagattttgaaaaaatcatccagttcaggaaatatgaaattttcagttaattatttcttttcttctccaaacaggaaagtgaaagtgccggttattgcatgccctctaccatctcagaaatcagataatttggcaaccgcaagttccgtggacacttatgataatgaaattgttatggagcttagtgctattattgttcgtatcatgaaaacagaaggtaagctaagccatcagcaattacttgaaagaactacgaaacggacacagtctcggctcagtcttacaccgagcattttgaaacgaagcattcagcttttaatagagaaagaatacatccagagaaacgcagatgacccctcttattaccattacctttcctaa

SEQ ID NO: 4714 - DNA, 2235 bp, Saccharomyces cerevisiae
atggccgctccagattatgcacttaccgatttaattgaatcggatcctcgtttcgaaagtttgaagacaagattagccggttacaccaaaggctctgatgaatatattgaagagctatactctcaattaccactgaccagctatcccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaacgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagtgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatggaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttaaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcaccgatgggctacaaggattcgaaaaattgcataacatcaaagtcggacttgagcctttaactctcgaggatgatgttgtgacgccaacttttaaaataaagcgtgccaaagcatcaaaattcttcaaagatacattagaccaactatacgccgaaggttcactagtcaagacagaaaagctttag

SEQ ID NO: 4715 - DNA, 2238 bp, Saccharomyces cerevisiae
atggaattatttaacaaggaagaagcgagcttcgagactctgttaaaacgattactcgttgtctgtgagtcccatagcaggtaccatggttcgagcttggacccaatggttaaagttggtcatgaaatgagaaaaattagcggttacttgagatgcattttgagaaagcatgctgcaaatcatgatgacatgtctctaacacaatccatagtgaattcttacaagagtttattcaaagatgcgcaaatactcgatttgtatcataatcttttatttggatgtatgcatttgcttctcgatgcgaacatgtcatactttaggatggattcacaaaagctttttgcggtattactattcaaggtttattataagttgagggacattttctatgtcacaaatgaagtacgactaggctccctaatcagtgcgtttgtatacaaatttaaaagttgctatgactttataagctgtaactcactgaaatacggaagcgttcgtgacgttatatcaggcgaagtttccctgattaatcttccgccaatcgattccaataaggttataaatagagcatattacagactagatgtaaagaagttggcgatcaataataaactagttgaaatccttgaattagataatggggagatagctatatttgaggttctttctgaaaaaatgccatacacattacaaaccattgataacttgttccaatcccttgcgttaggaaaccatgacttaatgaatgtcgggaggtcgctgctatttcgaccatttaggtccggcgatcttgatctcatcagacttgatgatagtggagcaaaactaaaggtaccgataaataatagcattgtattgaggttaacttgcaaagatcctattcaatggcaagagtattggaaacatgttattagaaagcttttcgactcaacagctacaaaagaatacaagcgatctggaagtaaaatttctcaacaggtttatgttaggagtaacaaccctgattatacttctcctaaaagaaatgacgatatgcctattagctctgtaaagatatcagatacaatacacaatggtcgcacactgcatagatcaattcctttgccgggaagtctgtcttccttaatagagacctctaatgaataccctgacgaggagtcactgtcaatcatgagtgagagggcaacagttagcgaagattcagatcttgacacctctctgaaagatattgaatccctaagttgtgaaaagctaattgaattggataagagcattcaagtacctctctcgcctaaatatatggacacacctaccttaaaaaacattagaacagcttctcaaactttcagcctggagagtgtctctcccgaactaatagagagtgttgcgtctgaaattgacgattctgagagtataatttctgaagatggaaaggataaacgagataaagatttattcgatccagatatcgatttctataagccaacgctttatcggcgtaaatcttcatctttactaagcatcttctcaaaaaacaaaaagaatctaactatcgatattcccaaaaatcattcaagatcattgtttagtttgccaggcaatcaacaatcagttaccccggtatcagcaaccccccatgacgataacgttgatgaaacgtatgtatcgtttccgttaagcataaacacatctggaggagcagtatatttcgaaaacgattcggtaaaagtttccctttggaacggcaagtcatgggtgcctttgagtaaggacatgctgtgtttgtctttaattttatccggagacaacgagaccttactaattgtatataaagacttcgaaaaggagaagtgtaaattggttgtgaaattggaacccacctggaagtacaatagatcaacggcacaagatgttcaacttcggattccttcctctgatttcaaagctagtgtatttggaacactccacgatctcacgctgtctatacgctgtgcgcaagctgctaagttggtgaatgtgttacaatatcagttacaaagtagccagacatcatccctttcaccctcaaccaccacaggaactttatcaacggtatcttcgtcttcatgcttcagtcgtaatgttactagatcatctactgaaaattcagaattggctaatatgaaagactcatcagaatatataagttcttcacttctgttatcttctgttaaagtaaggcaactgagaaatatgtga

SEQ ID NO: 4716 - DNA, 2238 bp, Saccharomyces cerevisiae
atgtcacacactaataagatcgcatacgtgttgaacaatgacacggaggaaacagcctcgccctcttccgttggttgttttgacaagaaacagctcactaaattactgatacatactctaaaggagctgggctacgactccgccgctaaccagttactgctagagagcggcggatatcaaaatgagtctaaccacatccagactttcttcaaactcatcaagaccggccaattccatcttattaattggcagattgtttgctcgctgccccttgcccatagctctccgctaaggtccgaatggcttcaaaggctgctcattcccacgccgacgcccgccacgacttcacttttcgaccacatgctcctgcaactgcaatacctgcaacagctgatgagctctgtaaattcatctacttgttcggacgcagagatcgccacgctcagaaattacgtagagatcatgattctagttaatagacaaatattcctcgaattcttccatccagtcacaaattccgcctctcacaagggccctcacactgcactgcccgtcctgtatttgcgcaaaatcctcaaaaacttcatcgagatatgggattccctgctggtgtctaacgatcagttcctaaatgaagaaaacatcttcaatccggaaacgaccttgagagaactgtcgacgtacctgaccaacccaaaactaaccgcgcagttgaacctcgagcgagaccatctgattgacgccatctccaaatatatcgatccgaacgaactcgttcccaagggtcgtctcttgcatctcttgaaacaggccatcaagtatcaacaatcacaagacatttttaatatcatcgatccggatgatgacgcctctttctcctctccaccccaccggatcaaccttttgcaggataacttctcacacgatctgactgtgacctttcaagaatggaagactatccaagacaccacagacgaaatttggtttttgacattttcgcccaatggcaagtatttggcttctgcgacttccgagtcttcaagaggctacttcattactgtttatgatgtggaacaagacttcaaaatttataagacttgcgtgagcttgtcacaatccgtattgtacctcatgttttctcctgatagccggtatctggttgcttgccctttcagcgaagatgttaccatttacgacatgaatgccacctccctgcccgatgcgtctgccacagactcgttcctactatacccttctaccaggctctcgcccatggactcgtttaaactggacaccaccacgtacccagatgataccgaatcatcagcatcatcttcctcgaggccggcaaacgcgaattctaatcaatcaagagtatggtgctgcgatgccttccacactgcggaacgtgcgggctggatggtggttggatcgcccgacagagaagctattgtacactcactcaccacgaaagagtcactttttagcttaaaaggcaggacttgtatcgcgttgggccacgatgaaaacatctctgggagaaaatcaatcgatcctgcaaaagtcctttacaaaccaacaagtagcaatggtaactggcaatatgtggaggacgacgaaacctttccacgtgtgcacgacgtgaaaatcagctatgacgataaatacgtgcttttaatgacccaccagggcgttatagatgtctacgatttcagtgggttcccctccaaagaggagctatctaagcaaacagtggatcccaaaaactttctgattccaaggatcgcaagattggacgtgggcaaaaacatgacttgtatctcattaccgctaaataccacgcatcaaggcttccataggcaacaaatatccgagtctcaacatttggtattagttagccttcaagataacgaattacaaatgtgggactataaagaaaatattctcatacaaaagtactttggacagaagcaacagcactttattatcagatcttgcttcgcctacggtaataagcttgtcatgagcggatcagaagatggtaaaatttacatttgggatagaattagaggtaacctagtatctgttttatccggtcattccacggtaatgagtaattccacaaaacccatggggaaaaattgtaacgtagttgcatcaaaccctgcagataaagaaatgtttgcttctggcggtgatgacggtaagataaaaatctggaaaatttcaagaaattaa

SEQ ID NO: 4717 - DNA, 2241 bp, Saccharomyces cerevisiae
atgaatttgttttggccatcggaaaccaaaaagcaaaatgaaatacctggtggcgattatacacctgggaactcaccttcagtacaaaagggttatcaattcctcaatcgagacatatttaaaagttgtccacgaattatggaaaggcagtttggtgagtgtctgcacaatagaacgcatttaatcaaggatttaatttcttctggcaatgttggactaggtcccattgagattgttcacatgtcctacttaaacaaacatgaaaaagaagagtttggtgaatatttctacgttacagggatcgaagtttccggtcctgcaatgcccgtagagtttcttgaagtgctaaaatcgagtaagcggatttccaaaaatatatcgaataatatcatattgacttattgctgttttaattttttcagcaatctagacatccgtattagatacgatgctgacgatactttccagacaacggcaattgactgtaacaaggaaaccactgacctgaccatgacagaaaaaatgtgggaagaaacgttcgcaagttctgtcatccgagcgataataacaaatactaatccagagttaaaacctcccggtttagtagagtgtccattctacgttggaaaagatactatctcctcttgcaaaaagatcatagaattactctgccgattcttaccacggtcactgaattgcgggtgggattctaccaagagtatgcaagccaccattgtcaataactatttaatgtatagtttaaaaagttttattgcaatcacgccaagcctagtggattttacaatcgactacctgaaaggacttaccaagaaagatccaatccatgacatatactacaagacggctatgatcacaattctagatcacatagaaacaaaggagttagacatgataactattttaaatgagacgctcgacccccttttatctctgctaaatgatttaccgcctcgcgatgctgattcagcacgattaatgaattgcatgagtgacttgctgaacattcaaacaaattttttgttaaacaggggtgattacgaactagcattaggcgtctctaacacatcaaccgaactagccttagactcttttgaatcttggtacaacctagcgagatgccacatcaaaaaagaggagtatgaaaaggctctcttcgcaataaattcaatgcctcgtttgcgcaaaaatgatggacacctggaaacaatgtacagtaggtttcttacctccaattattataaaaagccattgaatggtacccgcgaacactacgacttgactgcaatggaattcacgaatctctcgggaacgttgaggaattggaaagaggatgagttaaaacggcaaatttttggaagaatcgcaatgataaacgaaaaaaaaatcggttatacaaaggaaatctgggatgatattgcgataaagttgggtccgatttgtggtccacaatctgtgaatctgattaattatgtctcccctcaagaggtcaaaaacataaaaaatatcaatttaatagcaaggaatacgatcggcaaacaattgggatggtttagtggtaaaatatatgggttattaatggaaattgtgaacaaaattggttggaatggcttattaaacatccgaacagaagctttcatgatggaaactgaattctatcaagcttctaacaacattatcgatgaaaacggtcatataccgatggaatcccgaaagaaaaggttttgtgaagggtggctagatgatttatttttagatttatatcaagacttgaaattgagcaagattagcctaagcaataaagatgaaaaacacagcggattagagtgggaacttttgggtttgatcatgctgcgtacctggcattgggaagatgccgtagcttgtctaagaacaagcatagtagctcgattcgaccccgtaagttgccagcagctgctaaaaatatacctgcaacctccaaaaaatattcaagaggttacattactagacacagataccataataagtttattaattaagaaaatatcatatgattgcaggtattataattattgccagatatttaatctgcaactgctagaaaagctatgcaacgaattggggacgcatatactgcgtaataagatccttcttcaaccttccataggagacgaaatcatggtcatgatcgatgccatgcttgcgtggatagccgacctagatcacacagtacaaccttga

SEQ ID NO: 4718 - DNA, 2241 bp, Saccharomyces cerevisiae
atgagtaagatactattctgcaaatctaaagtgttcttacacccaacaagcgatgctagagataatattgctggtttcctgctactcacattggaagcgaataagctatcccaccaagcaattctccaatatatcccagaatctggcttatccacattagagatatcaaaactactaaaacatgaagctaaagtgggcacatgtccaacttctacaccatttgttattgaaaattcaataaactttagtaacctggtcaatacttctttaggtcaagctttcgaaatttctctctcacaaatatactgcatccaatttaggcctcctagtccaaatggttggtatgtcggatctctggtaatatatcccttgacagaacagtttacgggctttcaacctcctgtcttgttctttcatgaccaactctgcccatcaactacggacaagttaaaaagactacgcaaatccatgaacccatttgatgactcggacgaattgtattggggtggcgtagatttgagaaacaaaatcaacgaactgatggaactcaagaaatcaaacttagagccagagttttggttagtaaatccctctttgaatgatttgagaaatttcgtttccaaggatctattggaaagttataacaattcgaagaaagatacaactgaactcgctaccgccggtgtgaaactaaacgagaaattccaagaatggaaatggaacgtaatgagcaagatagcagacgtgactaccaagtctaccaattttatcgatagttggctgactaacaactcacccatacaaaaatcacaaatcgacaatgaatacttgcaaaagcttctgaacaatgagaaggttaaacaaattgaacaggattatgactctgcaagagtgtatttggcaaactggtcattaggagtaaaacaggaagctgagaggtatcaaaagcagaacaaactctttgattcgtataggaataacattttcaacgacctgaatctaactgatgaattaagtgatactgaaataaataatgctctgcaaagacaatttcctttaacggaagcgaaatggaattcgctatgggatgagaacgatgggaggctgagggtcacggtaaacgaagttaaggatttcatatttcatggtgggttagaaaatgacagtttgcgagggaaagtttggggttttctcttagaaatatatccgtgggattcttctcaagacgagagggtacaaatcgatcaaactttagccgcggaatacgatcaattgaaactaacctggtcaaaagattttttacaatttgacgatgaagatgaagaggaatattggaacgatcaattattcagaatatctaaagatgtgagacgctgtgatagaaacttggagatatttcaatacaataccatcgatggattaccaccaccgccacaacaactcccagcaaatgaaaataacagtaccagccccgaatccgctaatgacgagagcgatgatgcagacgatggagtcaggaacccacatttgatacatttacaaaacattcttatcacttataatgtctacaacacaaacttaggctacgtgcaggggatgaccgatcttttatcgcctatttatgtcatcatgaaggaagaatggaaaacgttttggtgttttacgcacttcatggacattatggaaagaaattttctaagagaccagagtggcatccatgaacaaatgttaactctcgtggaattggtacaattaatgctacccgaattgagcgaacatttaaacaagtgtgattcaggaaacttgttcttttgctttcgaatgcttctagtatggttcaagagagaatttgaaatggaagatattatgcacatttgggagaatttctggactttctactacagttcacaattccaattattcttcatgttggccattctacagaaaaactcacaagctattttacaacatctaaatcagttcgaccaaatattaaaattttttaatgaacttaacgggaagttggattggaatgacctaatggttagagcagagcttttgttcaagaagtttgagaaaatgatgcacgtcatggaaagagatttacaaaacgtatcctcctcttcatcctcatcctctaccggcgtattgccttgtcagagcgagaggttgaccctgcttctttctaaaaaacctatcataagacatgaagggcaaaggagcaaaaattccgttaaatag

SEQ ID NO: 4719 - DNA, 2241 bp, Saccharomyces cerevisiae
atgattacgcagaattctataccagaggtaaaagaagattttattggttatgctttacatgagagaagaattcggttaccgcagtttcaagacttagggccggcagacttggtcacactaacaaagtatttgcccacttcaagtaacacaaatgccataaacagtacgagtagaaatggtgcggccattattcagtcccctgcagccgttgtagccgatgactctgccgcttccatggcaaccaatggcgatgctagtgacaccgccgttaccacaaattatacaaatgcatctatatacagtagcagcagaaatgccaatgatggagccccgatggtcgctgagctccatccacttgataaactgaaggacgaagtagggacatttttttactcaatgggtgtcgatacatccggtccaacttcaatcgcaatttttttgaaggagatttcagaggtcatcagcgagaaaccccaagtttggtttggcaggaagaaaaccttcaatgttgctcgaatttcattttccacttggaatgcgttcaggagatgcgacataaatgtcgtcgttcatattccaggatcgattcagaactttatagtggattgcaacggtgaaagtcaaaatatagagatgtgtgcggattatgacttaatttgggctgaaacgttcgtaagtggcgtagtacggtcaatcatgttaatgaaggaaaacgctgaagagggagaattacaaaatttagtggaaaccttgattttgaacccgtttactgcaggacaaatcgacgatgtaccagaaatgttcattgatctgttccctatagtttaccataagggcccattattgggagctccgtattatattaccaatgtgacgaacactaataactatttggtagaaacactcgttgagatagttaagctgactcgtaatgttagcagggcggaaataatgttgaagaatctggctaccgacaaccctgaggcgatcataatactaatcaagatctttttggtgtgtgatcaagaattagacgcaataaagctcacatacgatatgctttcgcaggataaaataataaacaacactaataaccgcatggattataaatctgaattactgtgcttacaagcgcaatttttgatagacaaaaggcaggattacagcttggcgcaaaacatagcgcaagaggcagtcaattgttctcccagtgaatttagaccttggtatcttttatccaaggtgtatgtaaagctaaatgatattgaaaatgccttactgatactgaattcatgccctatgtctccattaaaggaaaaatacgtactgaaaagagtagctccgttgccttcgaataatagtcttcatttgccattgccaattgacgttgtactggatgaagtgacgtcgttgaatccacaagacgttcagaatgaacaccgctctgcggatccaatgctggtcaatttagctgcgtcgaacttgaaatctactttccaattggcataccgattattgacagaaattgtgcagatcaccggctgggaaaatctgttaaagtacagatcaaacattttcgttatggaagaagagtaccaaaaatcatcatcttcgttaccaaaggacgttaacaaacaagaagaacagcctctgagggctaaacggctgtgtgaacgatggttagacaacctcttcatgcttttatatgaagacctgaagatgtatacattatggcaaaccgaacaactgtacatggatgcacagaataacaaccacaataagttgactttcgaatgggagttatttggcctttgtgcacgtcgactgggccatttccctgaggccgccaaggccttccagaacggtttatcgcagagattttcatcaaggtgcgcgaggaaactgctggaatattgtataaacgaacgccaacgggtcaaaaattttataaactcacctaattcgcatgacatggtccctgaaatagtaagctcacgcataagagagctagacaatagcattatcgacctttgcgtgaagatatgctgctggaaccaccgttggtatacggaattttccataagtttacttgattgtttaagtgtggttattcaagatatgagtctgaccaaagtttcgaatgaaatctcgtcaagatatccagaaactgttctcaacttggtgcaggagaatttgctcaatttcttcactacttgcaccattggatgctacgatgcataa

SEQ ID NO: 4720 - DNA, 2244 bp, Saccharomyces cerevisiae
atgaacgtttcaaaaatacttgtgtcgcccacggtcacgacaaatgttttacgcatatttgctcccaggctacctcaaatcggtgcttctttgttagttcaaaaaaaatgggccttaagatcaaagaagttctaccgtttttattctgaaaagaatagcggtgaaatgcctcctaagaaggaagctgatagctctggaaaggcatccaataaatccacgatatcttcaatcgacaattcgcaaccaccacctccatcgaacactaatgataaaaccaaacaagcgaacgtagctgtgtcacatgctatgctagcaactagagaacaagaggccaataaagacttaacgagtcctgatgcacaagcagccttttacaaacttctcttacaatcaaactacccgcaatacgtggtctctaggtttgagacccccggtattgcgtcatcgcctgaatgcatggaactgtacatggaggccctgcagaggataggcagacactcggaggctgatgccgttagacaaaacctactgacagccagctctgctggcgcagttaacccatcattggcgtcatcttcatcaaaccagtcaggttatcatggtaactttccatcgatgtattctccgctttatggatctcgcaaagagccactacatgttgtcgtatctgaatcaacttttactgttgtatcgagatgggtaaagtggctgcttgttttcggtatcttaacctactctttttctgaaggttttaaatacatcacagaaaatacaacgctactaaagtcgtcagaagtagccgacaaatcagttgatgtagctaagacaaatgttaaatttgatgatgtctgcggttgtgatgaggcccgtgcggaattggaagaaattgttgatttcctgaaagatccaactaagtacgagtccttgggtggtaaactaccaaagggtgtactgttgactggacctcctggtacaggtaaaactttgttggctagggccactgccggagaggctggtgtagattttttctttatgtcaggttctgaatttgatgaagtttacgtcggtgttggtgctaaacgtatccgtgatttgtttgctcaagcgcgttctcgtgcaccagctattatttttattgatgaattagatgccatcggtggtaagcgtaatccaaaggaccaagcttacgccaaacaaacgttgaatcagttattggtcgaattagatggtttctcacaaacaagtggaattattattattggtgccacaaatttccctgaggctttagataaggcgttaactagaccaggtagatttgataaggttgtgaatgtggatttgccagatgttcgtggtcgtgctgatattttaaagcatcacatgaagaagattacattggcagacaatgtggatccaactattattgcgcgtggtacccccggtttatcaggcgctgagctggcaaatttagtcaaccaagcagcagtttacgcgtgtcaaaaaaatgctgtttccgttgatatgtcccacttcgagtgggctaaggataagatattgatgggtgctgagagaaagactatggtcttaacagatgcagccagaaaggccactgctttccacgaggctggacatgccattatggccaaatacaccaatggtgctaccccgctatacaaggccacgatattgcctagaggtagggcattgggtattacttttcaattgccagaaatggataaggtcgacatcaccaaaagggagtgtcaagccagactggacgtgtgcatggggggcaaaattgcagaagaattaatttatggtaaagataacaccacaagtggttgtgggtctgacttgcaaagcgccaccggcacagcaagggctatggttactcaatatggtatgagtgatgatgtaggtcccgttaacttgtcagaaaattgggaatcttggtctaataagattcgcgatattgctgataatgaagtgattgaacttttgaaggactccgaggaaagagcaagaagactattaactaagaaaaatgttgagctacatagacttgcgcaaggtcttattgaatatgaaactctagatgcccacgaaatcgaacaagtttgtaaaggtgaaaaactggacaaactgaaaacttccaccaatacagtcgtagaaggaccagacagtgatgaacgtaaagatataggcgatgataaacccaaaattcctacaatgttaaatgcatga

SEQ ID NO: 4721 - DNA, 2244 bp, Saccharomyces cerevisiae
atgagacgagaaacggtgggtgaattttcttcagatgacgatgatgatattcttttggaattaggcaccaggcctccaaggtttactcaaataccgccatcatcagcagcattacaaacacaaattcccactactttggaggttacaacgaccacattaaacaataaacagagtaaaaatgataaccaactggttaaccaactgaataaagctcaaggtgaagcaagcatgcttcgtgataaaataaactttttgaacattgaaagggaaaaggaaaagaatattcaagccgtcaaagttaatgaattgcaagtcaagcatcttcaagagttggctaaattaaaacaagaattacagaaactggaagatgagaagaagttcttacagatggaagcgagaggaaaatcgaaaagggaagttattacgaatgtaaaaccaccgtcaacaacattatcaacaaacacaaacactataacgccagattcgtcctcagttgcaatcgaagcaaaacctcaatcaccacaatcaaaaaaacgtaagataagtgataatttactgaaaaaaaatatggttcccctaaacccaaataggattattcccgatgaaacgagtttatttctagagtcaatattacttcatcaaataataggcgctgacctgagcacaatagaaatattaaatagattgaagcttgactacatcacagagtttaaatttaagaatttcgtcattgctaaaggagcccccatagggaagtccatagtttctctacttttgcgatgtaaaaagacgttgaccctcgacaggttcatagatactttgctagaggatatagctgttttgatcaaggaaatatcagttcatccaaatgaatcgaaattagctgtcccatttctcgttgcattgatgtatcagattgtacaatttcgtcctagtgccactcataatttagcactgaaggattgttttctttttatttgcgatttaataagaatctatcatcatgtattgaaagtaccgatacatgaatcaaatatgaatttgcatgtagaacctcagattttccaatatgaactgatagactatttgataatttcgtattcctttgatctcctagaaggtatattaagggtactgcagtcgcatcctaagcaaacttatatggaattttttgatgaaaatattctaaaatcatttgaatttgtctacaaactagcactaaccatttcatacaagccaatggtaaatgtaatatttagtgcagtcgaggtcgttaatattatcactagtataatattaaatatggacaattcctcagatctgaaatccttgataagcggtagttggtggagagattgtattacaagattatacgctcttttggaaaaggaaattaagagtggcgacgtatataatgaaaatgtggatactacaactcttcatatgtcgaagtaccatgacttttttgggttaatccgaaatataggtgataatgaattgggaggattgatatcaaagctgatttatactgaccgattgcaaagtgtcccaagggtaatttctaaagaggatattgggatggatagcgacaaattcactgcccctataataggttacaagatggaaaaatggcttttgaagttaaaagatgaagttttaaatatttttgaaaatttattaatgatctatggagacgatgcgaccatagtaaatggagaaatgctcatccactcctctaaattcttatccagggagcaagcgttaatgatagaaaggtacgtgggacaagactccccgaacttggacctcagatgccatcttattgaacatactttaaccataatatataggctatggaaagaccatttcaaacaattgcgtgaagaacaaatcaagcaggtagaaagccaattgattatgtcactatggaggtttctcgtatgccaaaccgaaactgtgacagcaaacgaaagagaaatgagagatcatcgacaccttgtagatagtttgcatgatctgacgataaaggatcaagcctcttattacgaagatgcctttgaggatttaccagaatatatcgaagaagaattgaagatgcaattgaataaaagaacggggagaataatgcaagtaaagtacgatgagaaatttcaagaaatggcaagaactattcttgagtcaaaatcattcgatctaaccacactagaggaggccgattcattatatatctcaatgggactgtaa

SEQ ID NO: 4722 - DNA, 2244 bp, Saccharomyces cerevisiae
atgatcagaagatggctaactataagtaagtctgggaagaagaaaaaggctgttaatgataccattacagaagaagtagaaaaggttgactttaagcctgtaaaccacgatataaatgatgaactctgttatagcgaatcatccgataatccctctagctcattgtttgtctctaatttggataccaaggaaacttttttgaatgaagacaataatttgcagatttcttccggactagactattcttctgaaacgtgcaatcaaggcagtaattacagccaggatgggatattttatatttcaaacgcaaaggctataaacgcatacggaggcattatcacgcaagggcccgaggcacccatattagctatgaaggtgtccgactcaatgccctatggagacggctccaacaaagtttttggatacgaaaattttggcaatacatgttactgtaactcagttcttcaatgtctctataatctgtcctcattacgtgaaaatatattgcaatttccaaaaaaatcaagagaatctgatcaaccaagaaagaaagaaatgagaggtaagaaaccaagaatatttaccgaagcaagttttgagaaaagcattgctggtaccaatggacatttgcctaaccctaaacctcaatctgttgatgatggaaagcctacccctgtaaattctgtaaattcaaatacagctgggccttcagagaagaagagtaaattttttaaaagttttagcgcgaaacatgtacaagacaataataaaaaggaaggaagtcctgctatattaaccactggaaaaccctcttctcgtcctcaagacgcacctccattgatagtcgaaacacctaatgagcctggtgctccgagcagattgagtttcgagaacgtcacagatagacctccggatgttccgcgtaaaataattgttggcagagttctcaattatgaaaatccttcaagaggtagcagtaatagtaataacctggacttgaaaggagaaagtaatagcagcttatccactccacttgataaaaaagatactagaagatctagttcctcttctcaaatatccccagaacatagaaagaaatccgcacttattcgtgggccagtgctcaatattgaccatagcttaaacggctcagataaggctactttgtattccagtttgagagatatctttgaatgcataactgagaatacgtatttaactggtgttgtatcgcctagctcttttgttgatgttctcaaaagagaaaatgtattatttaatactactatgcatcaggatgctcacgaatttttcaatttcttattaaacgagttgagtgaatatatagaacgtgagaataaaaaaatagcagccagtgatatcaacagcgatagcgaaccgagtaagagtaaaaatttcatcagtgacttgtttcaaggcactttaacgaatcaaataaaatgtctgacgtgcgataacattacatctagggatgagccatttttggatttccccatagaagttcagggagatgaggaaacagatatacaggaaattttgaaaagttatcaccagcgagaaatgctaaatggctcaaacaagttttattgtgacgaatgttgcggtttacaggaggcagagagattagttggtttgaagcaattgcctgatactttaacattacacttgaaaagattcaagtattctgagaaacaaaactgtaatattaagctttttaataacattcactatcctctgacgctaaatgtttgctcttcaataaattctaaggtttgtcaaaagtatgaattggctgggattgtcgttcatatgggcggtgggccacaacacggccattatgtttccctatgtaaacatgaaaagtttggctggttgttatttgatgacgaaacggtagaggcagttaaagaggaaacagtgttagaattcacaggtgaatctccaaatatggcaacagcatatgttttgttttataaagcgatgtattcaaacgctgttgaaaagaatgatcgtgaaaatatggcaaaagaacaagatgataatatagacaatctaatcaagtacgatgattggctaagaacttgcaatagtggtcaaaagaaaaaggaagagctgcctatagcagacgatttggatactgctatagacgacagctttgtttctaacacacccataaagtcttctaaaaaaaagtcgagaatgtttagttttaggaaaagctga

SEQ ID NO: 4723 - DNA, 2244 bp, Saccharomyces cerevisiae
atgtcgttattagagcaattagcaagaaaaagaatagaaaaatctaaaggccttttaagtgcggaccagtctcatagtacatcgaaaagtgcatccttactagaaagactacataagaatagagaaactaaagataacaatgctgagacaaaaaggaaggatctgaagacgctacttgcaaaagacaaggtaaaaagaagcgactttaccccgaaccagcatagtgtttcattgagtttaaagttgtctgccttaaagaagtcaaatagtgatttggagaaacaaggaaaatcagtgacattagacagcaaagaaaacgaactccctaccaaaaggaaatcgcctgatgataaactcaacttagaagagtcatggaaggctattaaagaaatgaaccattactgtttcttgaaaaacgatccatgcataaatcaaaccgacgattttgcgttcacaaactttatcataaaagataaaaaaaactcgttgagtacatcaataccgctatcgtcgcagaattcatcatttctgtccttaaaaaagcataacaatgagctccttggtatttttgtgccttgtaacctgccgaaaacaactcgtaaagtagccattgagaatttcaatagaccaagtcctgatgatataatacaatcggcccaacttaatgctttcaatgaaaaattagaaaacttaaatatcaaatctgtgcccaaggccgaaaaaaaggaaccaattaaccttcaaacaccacctactgagtcgattgatattcattcattcattgccacccatcctctgaatttgacatgtttgttcctcggtgatacaaacgcaggcaaatccactttgcttggtcatcttttatatgatctaaacgaaatttctatgtcatcaatgagggaactacaaaaaaaaagcagtaatttggatccttcatcttcaaatagttttaaggtcattctagacaataccaaaacagaaagagaaaatggattttccatgtttaagaaagttattcaggtagaaaatgatttactaccgccatcatcaaccttgacgcttatagacactcctggtagtatcaaatacttcaataaagaaactctgaactcaattttgacctttgatcctgaagtttatgtattggttattgattgcaattatgactcgtgggaaaaatcattagatggtccaaataatcagatttatgaaattttaaaagtgatctcttatttgaacaagaattccgcatgcaaaaagcacttgataattcttttgaataaggcagatctaattagttgggataagcaccgactagaaatgattcagtctgagctaaattatgtgttgaaggaaaactttcagtggacagacgcagaattccaatttatcccgtgttcgggtttattaggttcgaatttgaataaaactgaaaacatcacaaaatctaagtataagtcagaatttgactctataaattatgttcccgaatggtatgaaggtccgacatttttttcgcaactatatctattggtagagcataatatgaacaaaatagaaacaactttggaagagccatttgtaggcacaatactgcaatcttctgttcttcaaccgatagcggagataaattacgtgtcactcaaagtcttgatcaacagcggatatattcaatcaggccagacaattgaaattcatacacaatatgaagattttcattactatggtatagtttcaagaatgaagaattcaaaacaaatactggagactaacacaaaaaataatatatcagtcggtttgaaccctgacattttagaggttcttgttaagattcataataccgaagacttcacgaaaaagcaatttcacattcgtaagggtgatataataattcactctagaaagacgaatacactatcaccgaatttaccaaacacactaaagttgttagccttgcgtttaataaaattatcaatacaaacgcacgcgctaagtgatcccgttgacttgggttctgaattgcttctttaccataatttgacgcacaacgcggtaaaattggtgaagattctcgggactaacgacatctcaattaatccaaatcagtcacttattgtcgaagtcgaaattatagaaccagactttgctcttaatgtgattgattccaaatacattaccaacaatattgttttaacatcaatagatcataaggttatcgcagttggcagaattgcatgccagtaa

SEQ ID NO: 4724 - DNA, 2247 bp, Saccharomyces cerevisiae
atgaataggggatcattagatgatgggcctaaactacgtgaagaaaagcacttccaagatttttatcctgatcttaatgccgatactttactgccgttcatcgttcccttagtggaaacaaaggataacagcaccgatactgactcagatgatatttcaaatcggaataacagagagatcgggagtgtcaaaagcgtacaaactaaagaattgattttcaaggggagagtcaccactgaaccactagtactgaagaagaacgaagtggaatttcaaaaatgtaaaataactacgaatgagttaaaaggtaagaaaaatccatactgcgttagatttaatgagagctttatatccaggtactatcatataaacaaagtaagaaataggaagagttataaacaacaacaaaaagaattcgatggtgtggaggcaccctacttcaccaaattctctagtaaagaagccccgaatattactatttcgacgagtacaaagagtgcaattcagaaattcgctagtatttcacccaatcttgttaatttcaagcctcagtatgacatggatgaacaggatgaattatatttgcactaccttaataagaggtattttaaagatcaaatgtctcacgaaatatttgaaattttaatgactacactagaaactgaatggttccatattgaaaaacatataccctcaacgaatagtctgattgctaggcataatattctaagggactgtaagaattatgagctatatggttctgatgatggaacaggtttatcgatggaccaggcgtgtgcagtttgtttaggcacagacagtgacaatctgaatacaattgtcttttgtgatggatgcgatattgctgtgcatcaagaatgttacggtataatttttatcccggaaggaaaatggttatgtagacgatgtatgatctcaaaaaataactttgccacttgtctaatgtgtccaagtcatacaggtgcattcaaacaaacagacaccggttcttgggtacataacatttgtgctctatggcttccagagctatacttttcaaacttacattatatggaacctatagaaggcgttcaaaatgttagcgtatcacgatggaaacttaactgctacatctgtaaaaagaagatgggtgcttgcattcagtgctttcaaagaaactgttttacagcatatcatgtcacgtgtgcccgtcgagctggtctctacatgagtaaagggaaatgcactattcaagaattggcctctaatcaattctcccaaaagtattcagtcgaaagtttctgccacaagcatgcacctagaggatggcaaacgagtatagaaggtattaataaagctagaaaatacttctctctactctctacattacaaaccgaaactcctcagcataatgaagctaatgataggacaaattcaaaattcaacaaaacaatttggaaaacacctaatcaaacgccggtagcaccacatgtttttgctgaaatattgcaaaaggtcgttgatttttttggcttagctaacccaccagcaggcgcatttgatatttgcaaatattggtcaatgaaaagggagcttacaggaggtaccccattaactgcctgttttgaaaataattcattggggtccttaaccgaggaacaagtgcaaacaagaatagattttgccaatgatcagctcgaagacttgtaccggctcaaagagctgactactttggtgaaaaagagaacacaagcttcaaacagcttgtccagatcccgaaagaaggtttttgatatagttaaatcgccccaaaaatatcttttaaaaatcaatgtactggatatctttataaaatctgaacaattcaaggctcttgaaagattggttactgaacctaaattattggttattttagaaaagtgtaaacattgtgattttgatactgtccaaatttttaaggaggaaattatgcatttttttgaggttttggaaactctacccggtgcatcaagaatactccaaactgtctcatcaaaggcaaaagagcaagtaacaaatttaattgggctcatagaacatgtagatattaagaagttgctatccagagattttataataaatgatgacaagatagaagaaagaccatggagtggcccggtgattatggaagaagaaggtttaagcgatgcagaagaactgagtgcaggggaacaccgtatgctgaagctaatccttaacagcggataa

SEQ ID NO: 4725 - DNA, 2247 bp, Saccharomyces cerevisiae
atgacgagacgtactactattaatcccgattcggtggttctgaatcctcaaaaatttatccagaaagaaagggcggattcgaaaatcaaagttgaccaagttaacacatttttagagtcatccccggagaggagaactctgacgcacgccttaatagaccaaatagtgaatgatcctatattgaaaactgatacggactattacgatgctaaaaaaatgcaagagagagaaattactgccaaaaaaatagctaggcttgctagttatatggagcacgatatcaaaacagtgcgcaaacactttcgcgacactgacctgatgaaagagttgcaagcaaatgatccagacaaagcttcgcctttaacaaacaaagacctttttatattcgataagagattgtcacttgtagcaaatattgatcctcaattgggtacgcgcgtgggtgtacacttggggctatttggtaattgtatcaagggcaatggtactgatgagcaaatccggtattggttgcaggagagaggtgccactttgatgaaaggtatatatggctgttttgcaatgactgagttaggacatggttccaatgttgcccagctgcagactagggctgtgtacgataagcaaaatgatacttttgtaattgatacacctgatctaactgccaccaaatggtggattggtggggctgcccattctgccacgcacgctgccgtgtacgccagattgatcgttgaaggtaaagactacggtgtaaaaacattcgttgttcctctgagagacccttcgactttccaactgttagctggtgtttccataggggatattggagcgaagatgggtcgtgacggtattgataatggctggatccagttcagaaacgtagttatccctagagaatttatgctaagtagatttaccaaagttgtccgttctccagatggttcagtcaccgtcaaaactgagccacaattggatcaaatttctggttatagtgcattgttaagtggtagagttaacatggtcatggattcatttaggtttggctccaaatttgctactattgctgtacgttacgcggttggtcgtcagcaattcgcacctagaaagggattgtctgaaacacaattaatcgactatccccttcaccaatatcgtgttttaccacaattgtgtgttccatatttggtgtcacctgtagcttttaagttaatggacaactattattccactttggacgagttatacaacgcttcctcatctgcatacaaagctgctctggttaccgtgagtaaaaagttgaagaatttatttattgatagcgccagcttgaaagccaccaatacttggttaattgctacactgattgatgagttgagacagacttgcggaggacatgggtattcacagtataacggatttggtaaaggctatgacgactgggtggttcagtgcacatgggagggtgataataatgttttatctttaacttcagcaaaatcaatattgaaaaaatttatcgattcagccacaaagggtagatttgacaacacactggatgtggactcattctcttacttaaaacctcagtacataggatctgtggtttctggagaaataaagagtggtttaaaggagttgggtgattatactgaaatttggtctatcaccttaatcaaattactggcacatattggtactttagttgaaaaatcaagaagtattgatagcgtttctaagcttttagtcttagtatccaaatttcatgccttgcgctgcatgttgaaaacctattacgacaagttaaactctcgtgattcacatatttccgatgaaattacaaaggaatctatgtggaatgtttataagttattttccttgtattttattgacaagcattccggagaattccaacaattcaagatcttcactcctgatcagatctctaaagttgtgcagccacaactattggctcttttgccaattgtgaggaaagactgtataggtctgacagactcctttgaattacctgacgcgatgttaaattctcctataggttactttgatggcgatatctatcacaattacttcaatgaagtttgccgcaataatccagtggaggcagatggggcagggaagccttcttatcatgcgctgttgagcagcatgctcggtagaggtttcgaatttgaccaaaagttaggtggtgcagctaatgcggaaattttatcgaaaataaacaagtga

SEQ ID NO: 4726 - DNA, 2247 bp, Saccharomyces cerevisiae
atggaacttcagagggcacaacggaatttgaagtttttacaaaacgaggattatgtgaacgttaccgatcaaactaacctgaatggagagagccagaatgcttactctttaggaatggaaactcaagtaccggaaatgcagttttccttatcatctgatgatgattcaataggtacgcaagtaaaaagcgtaactgcacaaaaatcgcctatgacgcaagagactacgaaaaacgatacagaaagaaataaagatgttgataaaagttgtaacccagtcagcacttcccatcccgatttaggcggatcaaatatcgaggagaacatattcattaacactcaaattcaaagccgacttgatgacgcagaggaagaaacaaatcttaagttaaaacttgaaaaattcaagtattcgttcaagagtagtaacgcagatgatacccacagcaatgcaaatgtaacagctaaaagaagaccagcaataaggaaggctaattcgaaactcaaaacaaaacctaaaactaaacgagaccctaaaattatcaaaaatataactgatttcaatattaataactacgaacgttcaaggactgccagcttattaaagcaattatcaggtaagcacaagaaggttttggacataataaagacgcaaaatgaaggaaacagtgataaacctcccagagcaaggaataacaagggtgaaaaagctacttttgatacatatagtgaacaggagtggaaagatattatgaaacttcttctacaaaagtttccgcaaagtgaggaaacggatttgaatgaagtccagaaatttttatatggaagcgaaaaaagctcgaattctctagacaatcaagaatcctcacaacaaagactttggacagcatcacaattaccacccgagcttcccgatgaggctattcaaccagagcaggaagaaaggatacgcgatacccaaagtgcagtaaatttcttatcgttgtctcaagtaatggatgacaaaagtgaaattatgaaagacgaagaaagcataattatttcacggggagattctacaagctctcaagaatatggaaacgggttagagccacaacaaccggtaggaaatgttgttggtgaagatattgaactggctgtgggaacacgtataaatgcattttcactgacagattataaagcttgcaaacctatgtctgttgaggtaagtagaagatgcgaaaacagtacggataatgattatgacaatatttctattgtctcagatactacagatgagacatccacattgtttccactagaccagtatcggtatgttttcattgaaaatgatgaaagaccaccattagccaccgacacgataggcagcacacagtttttcactccaaacacatcgcctttggatgggataatcgatttaacacaggaatcattcaaagctgttcgatcgttaatatcacctttgaaagtagaaaacaacaaaacaggggtaacatcacaagcatcaaatcaggttcaggtaccagctacaagaacccctacaattattcctcaaaagaaccttactacaactttaaaaactgaagaagaaaagaataacataggaagttccatcagagttaaattattgcaagaaagcgtagttaagctaaaccccaaactggtgaaacataacttttatagagttgaggcaaatgattctgaagaagaggagacagaatttgatgaccaattctgcattgctgatatccaattggtagattcctccaaaatttcgactaaagattctacacaaaatcctactactagcaacgacattattgatacctctgcagctagttccatagcttctcccgagaaattttgtgagatcatgatgtcccaatcaatgaaagagcttcgacaaagcttgaaaacagtggggttgaaacctatgaggacgaaggttgaaatcattcaatccttacaaactgcatctcaaattctgtccacagctaatccagataataaaggtgagcatggtggggtggcaaatttcagtaagatagaaatatttgatcatttaaccgaactaattgaagccttccctgattttttggagcgaatatatacctttgaacccattccgctaaatgagctaattgaaaagctgttcagcgccgagccatttgtttcgcaaatcgacgaaatgaccatcagagaatgggccgatgttcaaggaatatgtctgagaaacgataaaaagtag

SEQ ID NO: 4727 - DNA, 2250 bp, Saccharomyces cerevisiae
atgaccagtatgtcaattattgatgatgagaacgtgaaaaaaacttctaatggggcagctgttgtcactgatgtggctcaacacgctgtaagtgattcggacaataacaaagcgcaacttctaggcgatggatccaacactgaatatgtggttgatattttcattgaagccgctaaggatggggatttaaaagtggtgaaggacgtggtcgaaagtggagcagtggatattaataacgaccgcattgatgaattatccggcttacactgggcctgtataaacaataggttttctgtagcaaagttcctattacttaggggagcaaatcctaaccaggcggcaggccccggaggggctactgctttgcactgggccgcaaggtacggtaatatctacattgttgacctgcttctcaaacatggcgctgatccgacgctcaaagatgagcagggtcttaacatcatgcattttagcgtttacagttctaacattttacttgttgtttatgttctttattttgtcgtaaacaacaatgacaacgtcgatatcgattcaaaagataacaataacagaacacccctactttgggctgcttatcaaggagattttctcactgtagaacttttattgaaatttggctccacagttgcatggacggacaacagagggttcaatgctctccattgtgctctagttggaggtgatcaaagggtcatatgtgacttaatacttagcggtgcaaatttctacgaaaggaataaccagaagcaagactgttttgatctagccgaaggaatgggaaccaaatcactttttgaacaagcgttgcaacatcatggatatgacaggcttggaaatcagaaagacaaactgttcaagaaaagctcgcatgcacaattcacaatttttttgtcaccatttttactcatggtttacatatacttaatttctctcgttctttctccagtgctagccattatgctttccctactggtcactgttgtcatggtcaacacattaaagaagtttgtattaccatgccttcccagaaaaaacacttacaaagtttctttgactagaactccctttttcagtggcctctttctgtccactttctgttttttaatatatatatggacgaagaaactctatccatatagtgtatctgactataccatgaaaaacgtccagtttttggttacttcctttctcacagttgtactatttctgagattagtacggtcagatcctggttgtctgaaaacggatgatagtttgacttcgatacaagaaacaataaaacaactgattgacttagggaagtttgatagggaaaacttttgtgttgagacattagaaaggaagcctttgaggagtaaatattctttctttagcggcgccctggtggccagatatgaccattattgtccatggatttataatgatgttggcttaaaaaatcacaaactttttgtcttctttgctgtgacggtccaatatcacatgtttttgttcatgtggttatgtctggcatattttaagaaaacgaactatatttacgaacaagttgaagaatatgcaagatgtgccctgctcaagaatgagactttgtgtaagggttctaattacgatccctctaccttttttttattcatttggattagcgtaaacttcatctggctgggggctatgttgattgtccagttcttccagatattaaaaggaatcacgactcctgaattgttcatcttaatcaaggaggagcacaaggcaaaatttatcaatctgatacccttcgaaaactctatatataccagtgaaagtaaaggtgttgaagatagtgatatgattcctgaaggtccaagtgcgaccaccattactcacacaatttctattgatggtttggaaccaagaaataggcgccgcgccattcttagcgcttgcttttcaatgatgggtattaatcaatggctcgttactattaaggaaatagtaggtataacccacattttgcatggacaggttccacaacaacatcacagttcattgcttcgaagtttcttagtgacaaatcactggaagacgaatttgacggatttttggcttaatagtgatgtaacagcgcccttgtggcaacgatttttctattcttcggatacttcaaaagctatgttgggtggaactgaggttgactactacgagctatacgaatatccggcccgagaaggagaagtattacgtccaaactaa

SEQ ID NO: 4728 - DNA, 2250 bp, Saccharomyces cerevisiae
atgacttcgaaaccatccaccagtgacggcagggctcactcgatttcccatgtacctggcacgcacatgagaggaacatcggcatcacacagccccagaccgtttaggccatgtgcggattgtacgtgttctccaggcttactgtctaggcaaggtcgtagagcctctctatttttaagacagttagaaaattcaaggaggtcctccagcatgcttctcaacgagttgaagggcgctggcggaggtagcagtgctggaaatgggtctgtttactcatgtgactctctatgcgctgttaacagggaagttaacactactgatagattgttgaagttgcgtcaggagatgaagaaacacgatttgtgttgttatattgtgcccagttgtgacgaacatcagtccgaatatgtatcattgcgagatcaaaggcgcgccttcatttcagggttttccggatcggccggtgtagcctgtatcaccagagacttgttaaatttcaacgatgaccatccggatgggaaatccattttgagtactgatggaagatatttcaatcaagctagacaagaactagattataattggacacttttgaggcaaaacgaagacccaatcacttggcaagaatggtgtgtcagagaagctttggaaatggccaagggacttggcaataaagagggaatggtgttgaagataggtattgacccaaaacttatcactttcaacgactatgtttcttttagaaaaatgattgacactaaatatgacgcaaagggtaaagtggagctggttcccgtggaggaaaacttagttgacagtatttggcctgattttgaaactctacctgaaaggccttgtaacgatttactactgttaaaatacgagtttcatggtgaagaattcaaagacaagaaggaaaagttactgaaaaagctgaatgataaggcttcctctgcgacgaccggtaggaatactttcatagtagttgcgttggatgaaatttgttggttgttgaacttgcgtggatccgacattgactataatccagtttttttctcctacgtggctattaacgaagacgaaaccattcttttcaccaataaccccttcaatgatgacatatcggaatattttaagataaacggtattgaagtcagaccttacgaacagatatgggaacatttaacaaagataacttcgcaggcttcttctgcggagcatgaatttttgattcctgatagtgcatcgtggcagatggttcgttgtttgaacacctcaaccaacgctaacggtgcaatagctaaaaaaatgactgcacaaaactttgcgataattcactcacccatcgatgttttgaaatctatcaagaatgacatcgaaataaaaaacgcacacaaggcgcaggtcaaagacgcagtatgtttagtgcagtattttgcatggctggagcagcaattagtggggcgcgaggcactgatagatgaatatcgtgccgcagaaaaattgaccgagattaggaaaacccaaaggaacttcatgggcaattccttcgaaacaatatcctccacaggtagtaacgccgccatcatacattattcgccgcccgtagagaactcttcgatgattgatcctaccaagatatatctttgcgactccggttcgcaattcttggagggtacaactgatataacaagaacaattcacttaacaaagccaaccaaagaagaaatggataattacacactggtacttaaaggtggcttagccctagagaggttgatttttcccgaaaacactcccgggtttaatatcgacgccatcgctaggcagtttttatggtcccgcgggttagattacaaacatggcacaggccatggtatcggatcatttttaaacgttcacgaaggacccatgggtgtcggctttaggccacatctgatgaatttccccttaagagcgggtaacataataagtaacgaaccaggttattataaggatggtgagtatggtatcaggattgaaagcgacatgttaatcaagaaggccactgagaagggtaacttcttgaaattcgaaaacatgactgtggttccctattgcaggaagttgatcaatactaagttactaaacgaagaagaaaaaacacagattaacgagtaccacgcaagggtatggaggacaatagtgcattttctgcagcctcagagtatttcatacaagtggctgaaaagagaaacaagcccactatga

SEQ ID NO: 4729 - DNA, 2250 bp, Saccharomyces cerevisiae
atggatgtgagagcggcattgcaatgtttcttcagtgcattgagtggacgattcactggaaaaaaattgggactagagatctattctatccagtacaaaatgagcaatagtggtgggtcctctcctttcttggaaagccctggaggttcgcccgacgtaggcagtacaaatggacaaagtaatcgtcagattcaggcgttacaattcaagctcaatactctacaaaatgagtatgagattgaaaaattgcagctacaaaaacagacgaatatcttagaaaagaaatataaggccacgattgacgaattagagaaagcattgaatgatacaaaatatctttatgaaagcaatgataaattggagcaagagttaaagagtttgaaagaaagatcagctaattcgatgaatgataaagacaaatgcatagaggaattgcgaacaaccctccaaaacaaagatttagaaatggagactttaaggcagcagtatgattcgaagttatcaaaggtcactaaccaatgtgaccatttcaagttggaagcagagagctctcattcgctactgatgaaatatgagaaagaaataaagaggcaaagtgtggatatcaaagatttgcagcatcaagtgatggaaaaggatgatgaattatcttcggtaaaagcatctaagatgataaactcacatccaaactactccaccgaagagttcaacgagctcactgaaatgaacaaaatgatccaagaccaagttcagtatactaaagaattggaactagcgaacatgcaacaagccaatgaattgaaaaaacttaaacaatcccaggacacttctactttttggaaattagaaaatgaaaaactacaaaacaaattaagtcaattacacgtactcgaaagtcaatatgaaaatcttcaattggaaaacatagatctaaaatcgaaattaaccaaatgggaaatttataatgatagtgacgatgatgatgataacaatgttaacaacaatgataataataataataataaaaatgataataataatgataataataatgatacaagtaataacaacaatattaataataacaacagaaccaaaaataacataagaaataaccctgaagagattatccgggactggaaacttaccaaaaaggaatgtttaattttgacagatatgaatgataagttaagattggacaataacaatttaaagctactgaatgatgaaatggctttagagagaaaccaaatactagatttgaacaagaattatgaaaacaacatagtaaatttgaaaagattaaatcacgagttagaacaacagaagagtttatctttcgaagaatgtcgattactgcgcgaacaattagatggcctatattccgcacaaaataatgctttactagaggtcgaaaatagtgaaacacatgcgtcaaacaagaacgtaaacgaagatatgaataatttgatcgatacttataaaaataagacagaagatttaacaaacgaactaaagaagctaaacgatcagttattatcaaattccaatgatgtagaaacacaaagaaaaaagaggaagttgacaagtgaccaaattggtttaaattattcacagaggctcaacgaattgcaactggaaaatgtaagtgtctcgagggagttgagtaaagcacaaactacaattcagctactacaagaaaaattagaaaagttaactaaactaaaggagaaaaaaatacgtatactgcaattacgtgacggccccttcataaaagatcaatttatcaagaaaaacaaattacttcttctagaaaaggaaaatgcagatttacttaacgaattgaaaaagaataatccagcagtggaaacagtacccatttctgtttatgattcactaaatttcgagttgaaacagttcgaacaggaagtttttaagtcaaataaaagattttccagactaaagcaagttttcaataataaatctttggagtttattgacgttgtaaactcattattaggttttaaattggaatttcaacaagatagtcgtgtgaaaatattttcctgtttcaaacctgaaaaatatttgattgctgatctaaatgaaaacactttgaaatctaaccttgatgcagatatagaaggatgggatgatctcatgaatctatgggtggaagatagaggtcaacttccgtgctttttggcaacaataacattgcgtctgtgggaacagcgacaagccaaataa

SEQ ID NO: 4730 - DNA, 2250 bp, Saccharomyces cerevisiae
atgtctaataccttgccagtaacagaatttcttttatccaaatactacgaactttccaacactcctgccacagactcatcatcgctcttcaaatggttataccacaagactctctcccgtaaacagctgctcatatccgatttgtcttcccagaaaaaacacgccatctcctacgatcaatggaatgacatagcgtcgcgattagacgacttaacgggactttccgaatggaaaacaatcgacgagtcctcgttgtataactataagctgctgcaagacttgaccatccgtatgcgccatttgagaaccactcacgactaccaccgcctgctttatctgattagaactaagtgggtccgtaatcttggcaacatgaataacgttaatctttacaggcactcgcataccggcacaaaacaaattatacatgactacctagaagagtctcaagcagtgctcaccgcgctgatccatcagtcaaatatgaacgatcactatctcctcggtattttgcaacagacgagaagaaacatagggcgcacggctctcgtgcttagcggtgggagcactttcggccttttccacattggtgttcttgccgccctttttgaatcggacctgatgcctaaggtgatcagcggtagcagtgctggcgccattgttgccagcatattttgcgtccacacgacccaggaaattccctccttgttgaccaatgtacttaatatggagtttaacatcttcaatgacgacaattccaaatctcccaacgaaaacttactaatcaagatatcgaggttctgccaaaacggtacctggttcaataatcaacctttgattaacacaatgctttcgtttttaggaaacttgacctttagggaagcctacaacaagactggaaaaatcctgaatatcacagtctcgcctgcttccatatacgaacagccgaaactactaaacaatttaaccgctccaaacgttctcatctggtctgccgtatgcgcatcttgttctctacctggagttttcccctccacgccgctattcgagaaagatcctcacactggaaagattaaagagtggggggcaacaaatttacatttatcaaacatgaaattcatggacggatctgtagataatgacatgcccatttctcgtctttctgaaatgttcaatgtcgaccacattatcgcctgccaggtaaatatacatgtctttcccctgttaaagttttcaaacacttgcgttgggggtgaaattgaaaaggaaattaccgcccgtttcagaaaccaagtaacaaagatcttcaaatttttttccgacgaaactattcattttttagacatcctaaaggagcttgagttccatccctatttgatgaccaaattgaaacacctttttttacaacaatactctggcaatgtcacaattttacccgatctatcaatggttggtcaattccacgaagtattgaagaacccatctcaacttttcctattgcaccaaactactttaggtgcaagagctacttggccgaaaatttccatgattcaaaataactgtggccaagaattcgccttggataaggccatcacattcctaaaggagaaaataataatctcttcgtcaataaaaaaccctttacaattctaccaacctcgattcagtgagcaaatcaaatctctttccataatggatgctgacttgccgggagttgacttggaagaatcctcctccaattcactatcaattatcaagtctcccaacaaaacagcggcaccgggaagatttcctcttcagccattgccttctccatcttctaccttcaacaagaggaaaatggatatgttatcgccttctccatcgccttctacatctccacaacgttcaaaatcttcattcacgcagcagggtacaaggcagaaggcaaattctttatcgtttgccatcggtgcatctagtttacggctaaagaaatcaccattgaaggttccatcacgacctcaattcaaaaaaagatcttcttattataatcaaaatatgtcggcagagatgaggaaaaatagaaaaaaatctggaacaatttcctcttatgatgttcaaacaaactcagaagattttcccataccggctattgaaaacggttcatttgataacactttattcaatccaagcaggttccccatggacgctatgtcggctgccacaaacgacaatttcatgaacaattcagacatttttcaaaattga

SEQ ID NO: 4731 - DNA, 2253 bp, Saccharomyces cerevisiae
atgaggatcgaaaagcaccgtacccccctgtcgaagggaattatttggacgatattgtctgtgtgccttttattcatgttcaccacactgatattggttattgtagccactgctggctccaccgccaactacaaacccttaacgaatatatacatcggtgaagccgatatcaaacacatcaatgtaagcaaggtgatcccgcagataggccctattttgacaatattagggtccgctttgacggctccgaacagctccttggatgatatttttggcgccatgaaaaatattgctgatactcccgcgctgacgccgctattgacgcttttgtctaatgctgacaacaccacagtaaccatcgaatcattgaccgaattggctcccttagcgatcagcggcaatcctgcttctagcacgaggcagttgacagagattaatgggctgctgaagtattcagacaacgcaactgaaacactagatggcctctcaaggttagtttctgcttcgctgtcttccgcaagctctaactcttccagtgactcaactactttggttctggacttattaaaagactccgataacccacagaattccacagatgcattgctaactctgaataatctgacaatgtcagaaaaggcgcaattgttaccggtattcaggctattcgctttctccacgaaccaaacagctacaatgacggctctggcgaccttgatgaacactactatttcatcttctttagcccaaacactattaactcagttacaaaacacaatttcaaacggaggttccctaaataacacgtttagtactttgcaaccactagtgccgcaggcaagcgcccccgcatttgatgcagtggaattgctgctaaaccagaccacctctacaaatcagacattgagcactctatctgatttgctggaacaaaacctcactcagtcatcatctgcaaaaaaggcgtttgctgccttaacccaattgatggaaaattcggacaactcgacaatggttgtcacttcggtccaatctctagctgcggtgacaaatacaactcaatctactcaacagctaattggattagatgatgtgataagctcctcgagtaacaccaacgaaactttgtccatcttgtccgaattacaatcgggcctatccggtaattcaagctccgtacagtacattccatatctcttcagtcttttaggggcatccactgatcctaaaacaacattttcatctttagtgacgctgacttcctgggctcaagaaaaccctcagaccttcttgcccattttagatatattagcggatgccaaatccgtccaaccgatttccgcagaagaattgaacgccatgacgccgaatatactagagtatctgaaaattccgatttactatcgcttatccattttcacgctatgccatgctaacctggaaaacaagatcctagattgtaactccccacatgctgtacaaaacttggattttagatcgattatttatgacgcattagtcacatcagacttccaaccatatctgaacgccctgaatattagcgccaacgatctttacctagaagggaaacttttacacagagagcaccaatatgtgccagcagtgaggtctgttttggctttgaacctcttagcgatcatcttttccttctttaccatgatttttattatattactgtactttaacagatatatgttcaaacaaccattatggctcattgccctagctctacacgtttgcgttggtgtagccactgtattggcagccattatcatatccgttatgattgccattataaagagcggtacggcagatgataaatatggtgttgtgtttaaagccggtcccgcctatacagggctgatatggacagcatttgcgttgtcttttatcgccacaggattgataatttatacgtggtggaggaacagacggagtggtcgttacatgtccggatctgtgacgaataggaaaggcgaaatttacacgtatggggatggttctgccatttctgcagaccgtttcggcgaccataacttgggtgatgatgatgatgctgatttcgaaaaacaggtgaatcgtaatgaaataaccgctatcgacaacagtagttctgccaataatacagatgtcacaggtagtacgagtaatagaacagagctaagtcaccccgacgtgacaccaaaagattcaaatggacctgttaacaataatgcacatttggtagcataa

SEQ ID NO: 4732 - DNA, 2253 bp, Saccharomyces cerevisiae
atgagtataattagttcttggttacttgtctctattatttgcttaactacttctattgtaacaaaattgcaagctgctggagttactacccatctattttatttaacaagaggtgctcccttaagtttaaaggaaaactattatccttggttgaaagctggttctttctttccggatgctttgtactcatgtgcaccttcaaataaggattggtctgattttgcagaattcactcattggcccaatttcttaatgattgcagtatcttattggcagcaaaagtatggtcagaacgatcgacttcggggaactcacggctcactcgcactaaagtcatttttaataggggtattcactcatcagatagttgatgtttcctggcattcgttagttaccgattatagaatgcacggactactccgagttctcagcgaaacagaatttgatggagatattgaaactgctcatacgtttttagacgttatgggtgaattcctcaccttaaataatgtaatccgtgacagtaataataacgaaaattgggattttttaactcgctctgattggaaattgcccagagaagaggatttaatggaaattataaggaacgctggactttcaaaggaaaagttgtcctacgcagaactggaattttgcgttaaaagaggaatggcagcggctattagtgaagggtacctattccgctctcaaagaaaccaattgttaactaatatttactcaacatcccccagggctaatgatctaatactgaatcattggctaggagggcagtccaatttggttgcaatgctccaaagatgcgtgcctttcttcgagactttgtttcatgacgagaatactaatgaagctcaagcagaagaactgagattatgtgctaatttaccgccagtatcacaaaaacggataaatgcacgacctttggtctcttcattaaaagcacgtaagggaaatagccacattgtcgtatctcccatgaaatcattttccgattttggcacaagcctgactatgggaaaatttcgagaagacaacaaggattatctcgctgtaagtgcaccacttgaagacacagttggtgcaatctatatagttccatgggatattctaactgtagcaagaaaagaggattttagcattttacaacccatcactgccatgtacggttcaaaggtcgggacatacaaggcaagtgatgttgactacctactcgtttcacagcctggtacctgtacaatcgacttttacttcaaaggagtaaaaatactgacaatcaaggatgagaccaccgaagaagcacatcagttacaatttgctgtaacaggtaatttttatgatgataagattcctgatttggtggtgtcaagcccaagttatggtgccaacgaaactggaattgcaacatttatcccaggatcttccataataagctatttgaccaattcagacaaatatcaagtagttgatatctcaacttttaagggcgttattaaccttgacgggtaccctatgaaaataccatttcagcatttcggggcaacaattcagatatctgacacgactgacaaacaaaagttaatatatattacatgtcaaagtcttggtactgtttttgtttattcgagtaatgatttacacgatttgtccatcccaatatattatataacgaaaaatggcgtcattccagcaaaggacagtgaccacgttgagtggcatataattccctcaaaagaacatggtatgttcggtgcagccatatattcttggaattttgaaggtatgagttttgtagccgtatctcaaccaatgtttgacactgtgtttatatatattgagaagtctgggcaaatagagtttttcttaaaactggttctaaagattaagacaaaatcagattcaatcccggatgagtttggttcatctttgctgtttaatgacgaagaaaagaaattgtacgtttcctccccaggcagtttcgatgcaagaggaagtatatggaaaattagtatggatgagctattaaaggcgggaaacgatccgaagcgcaaaacccttttgattaataatttaaggcatctcatgctcataaatcctgacaaaagtagcaagggtgtgtcaaattttggtaatagcatgattttgggtccccaaaatcaccttatagtaggcattccccaatatgggtatggaaattttgatcacatgcagctaaccggtagaatcctggtactttaa

SEQ ID NO: 4733 - DNA, 2253 bp, Saccharomyces cerevisiae
atggatcgcatagcacagcaatatcgtaatggcaaaagagacaataacggcaatagaatggcttcttccgctatatcggaaaagggccacatacaagtcaatcaaactagaacacctggtcaaatgcccgtctatagaggtgaaactataaatctgtctaaccttccccaaaatcaaattaaaccgtgcaaagatttggacgacgttaacatacggcggaacaactctaataggcattctaaaatacttttactagatctgtgcgctggccccaataccaactcatttttaggcaataccaatgctaaggatatcacagttttatcgttgccgctacccagcactttggtgaaaaggtcgaactacccgttcgagaacttactaaagaattaccttggatctgatgaaaagtatattgagttcacaaagatcatcaaagattatgatattttcattttcagtgattcgtttagcagaatttcgagttgtttaaagacaactttttgcctcattgagaagtttaaaaagttcatctgccatttttttccatctccttatttgaaattctttcttctcgaaggctctctgaatgatagcaaggccccctcattaggaaaaaataagaaaaattgcatcttgcccaaattggatttgaacttgaatgtaaacttaacttcaaggtcaactttaaatttaagaataaacatacctccacccaatgattcaaataaaatatttttacagtctctgaaaaaggatctaattcattattctcctaattctttgcaaaagtttttccaattcaatatgcctgctgacttagcacctaacgacacgattttaccgaattggctaaaattctgctccgtaaaagaaaatgaaaaggtaatattaaagaaactctttaacaattttgaaactttagaaaattttgaaatgcaaagattagagaaatgcctgaaattcaagaaaaagcctttacatcaaaagcagctatcacaaaagcagaggggtccgcaatccacggatgattcaaaattatattctttaactagtttgcaacgacagtataaaagttctttgaaaagcaacatacagaaaaatcaaaagctaaaattaattataccaaaaaacaacacatcttcttcgccatcaccattatcttccgatgatactataatgtcaccaataaatgattacgaacttactgaaggaattcagtcttttactaagaatagatattctaatatcttaccttacgaacattcaagagtaaagttacctcactccccgaaaccacctgcagtttctgaagcatccacaaccgaaactaaaacagataagtcatatccgatgtgtcccgtagatgcaaaaaaccactcctgcaaaccgaacgactatatcaatgcgaactatttgaagctcacgcaaattaatcctgatttcaagtatattgctacccaagctccgcttccttctacgatggatgatttttggaaggttattactttaaataaagttaaagtaataatatcattgaattctgacgatgaattgaatttaagaaaatgggatatttactggaataatctgtcatattccaaccacactatcaaacttcagaacacctgggagaatatttgcaatattaatggctgtgttctcagagtctttcaagtcaagaaaacagctccacaaaatgataatatcagtcaagattgtgaccttccgcataatggtgaccttacttccattaccatggctgtatccgagccgtttattgtttaccaattacaatacaagaattggttagattcatgcggcgtagatatgaatgacatcattaaactacacaaagtcaaaaattcgttattgtttaacccgcaaagttttattacaagcctcgaaaaggatgtttgcaagcctgatttgatagatgataataatagtgagttacatctcgatacagcaaattcatcgccactattagtccattgttctgcagggtgtggaagaacaggtgttttcgttaccttggatttcctactaagtattctttcacctacaacaaatcactcaaacaagattgatgtttggaatatgactcaggaccttatctttatcatagtgaatgaattaagaaagcaaaggatttcaatggtacagaatctaactcaatatatcgcttgttatgaggcattattaaattattttgccctgcaaaagcagataaagaacgcgttaccttgttaa

SEQ ID NO: 4734 - DNA, 2256 bp, Saccharomyces cerevisiae
atgagtcaagttaatacaagccaaggaccggtagcccaaggccgtcaaagaagattatcatcactaagtgaattcaatgatccattttcgaacgcagaagtctactatggccccccaacagacccaagaaagcagaagcaggcaaagcccgctaagatcaaccgtacgaggactatgagtgttttcgataatgtatctcctttcaagaaaactggttttggtaaacttcaacagactagacgtggttctgaggatgacacctattcaagtagtcaaggtaatcgtcgtttctttatcgaagatgtcgataaaacacttaatgaactactggctgctgaggataccgataaaaattatcagatcaccatcgaggataccggtccaaaagttttgaaagtcggtaccgcaaactcctatggctataagcatattaatattaggggtacgtatatgttatccaatttgttgcaggaactaactattgcgaaaagttttggtagacaccaaattttcttagatgaagctcgtataaacgaaaatcccgtcaacagattatcaagattgataaacacacagttctggaactctttgaccaggagagttgatctgaacaacgtaggcgaaattgcaaaagataccaagattgatacgccgggggcaaaaaatccaagaatctatgttccttatgattgtccagaacaatacgaattttatgttcaagcttctcaaatgcatccatctttgaaattagaagttgaatatttaccaaaaaaaataacggcagaatacgtcaaatccgtcaatgatacccccggtttactagcattggctatggaagagcacttcaatccttctactggtgaaaaaactctcattggttacccttatgctgttcctggtggtagattcaatgaattatatggttgggactcctatatgatggcactaggtctcctagaagccaacaagactgatgttgcaagaggtatggtggagcattttatttttgagattaatcactatggaaaaatattgaatgctaacagaagctactatctatgtagatcacagcccccattcttgactgaaatggccttggtagtattcaaaaaacttggtggtaggagtaatcccgatgctgtggatttgttgaaaagagctttccaagcaagcataaaagagtacaaaactgtttggaccgcatctccaaggcttgatcccgaaacaggcttatccaggtaccatcctaacggtctcggtattcctccggaaactgaaagtgatcacttcgataccgttttactaccatatgcatcgaaacacggcgttaccttagacgaatttaagcaactttataacgatggtaagataaaggagcctaaattggatgagttttttcttcatgaccgtggcgttagagaatctggacacgacactacatataggtttgagggcgtatgtgcctacctggccactattgacctgaattctcttctttacaaatacgagattgatattgcagacttcataaaggaattctgcgacgacaaatatgaagatcctttagaccattctataacaacttcagctatgtggaaagaaatggccaaaatcagacaagaaaagattaccaaatatatgtgggatgacgagtcggggtttttctttgactacaacacaaaaatcaagcacagaacgtcatacgaatccgcaactacattctgggcattatgggctggacttgccacgaaggagcaagcacagaaaatggtggagaaagcactacccaagttagagatgcttggaggtttagctgcatgtacggagcgttctcgaggcccaatttctatttcgagaccaattagacaatgggactatccatttggttgggcaccccatcaaattcttgcttgggaaggcctccgttcttatggttatttaactgtaacgaataggctagcttatagatggcttttcatgatgacaaaggcttttgtcgattataatggtattgtggttgaaaaatatgatgtcacaagaggaacagatcctcatcgtgttgaagcagaatacggtaatcaaggtgctgactttaaaggggcagctactgaaggttttggatgggtcaatgccagttacattcttggtttgaagtatatgaacagtcacgcaagaagagcgcttggtgcttgcattccaccaatatcattctttagcagtttaaggcctcaagaaagaaacctctatggactatag

SEQ ID NO: 4735 - DNA, 2256 bp, Saccharomyces cerevisiae
atgtcagtacctaattccaaagagcagtcgctcctagatgatgcatccacattgttattgttttcaaaagggaaaaaaagagctgaagaagcttcaaaaataggctctaaaacagatactattgagcatgatgagtctcatgagagagaaaaaaaaggagcaatagaaatggcagcagcagcactggctacagcatccacagtttctttacctttaaagaaagctactgagcaatcggcggcagaagcagcaacatccacggcagcaaaagaagagaccgaaaatcaacctcaaaagcaacctcaatggccggtacctgattcgtatatagtcgatcctgacgcgggtataattacatgtatatgtgatttaaatgatgatgatggattcactatccaatgtgaccactgcaacagatggcagcatgctatttgctatggcatcaaagatattgggatggcacctgatgattacctttgcaactcatgtgatccaagagaggtagacattaacttggctaggaaaatacagcaggaacgcataaacgtaaaaacagtagaaccttcttcatcaaacaatagtgctagtaataagaataacggtcgggacagagcatcgagtacaactattagtgacgttggcgatagcttttcaacggatcaggacaatactaaccacagggacaaaagaaggaaaagaaacccatcaaataatagtatagactccaaaaacgaaagcgcttctgtcaattcttccgatggattgacttctatgcccaagaaaaaagagcatttcctgagtgcaaaagacgcatatggtgcaatatacttgcccttgaaagacaatgtgtttaaaagtgatctgatcgaaccgttcttaaataaacatatggatgataattgggtcatacaatatcctcataagacctttaaatctgtgtcaattgaagtcaaaccgtatgctgacattgcatattccaggacttacccaggcttcacgaaattaggagtttatctcaaaaaggactgcataaaaggtgatttcattcaagaaattttaggcgaattggacttctataaaaattatctcactgacccacgaaaccattacaggatatggggtacagctaaaagaagggtcattttccattcccattggccgatatatatagatgcacgcttatcaggcaattcaactaggtatttgagaagaagttgccagccgaatgttgaattagtaactataaaactgcaagatacagacaataggaatgacaaaagcagtggaagaaaatcaagtagaataaaatttgttttaagagctttgagagatatttcagaggatgaggagttatacatcaaatggcagtgggattcaaaacatcctatattaaaattaataaagggcatgacaatagactctttagatgaccttgaaaggtatgggctgataaattcggtagaaacaattttgagtaacggcgaatgcggctgtggaaataattctaaagattgttatttattgaaagtgaagagatacgcgcaaagtctttataaatctgtgaaatccagaggaaaaatgaacaacagatataaattaaatgaaattctcaaccaatataattgcaaaaagagacgtgagccaccaattttgcataggctagaagaaaaggctcaaaatactatagaaagagctccaatacttttgaataatttttatcgacaaaaattccttaatcgaaataatggtccaaaaattcctcaaaagaatactattgatagtacaaataatcctgatgatattgcaaaacccttcaaattcgccttatttgcacaacattcttctaatatttctgttcccaaaaaaaatgaaacttcagaaaaacctttaataattacgaagagcacagattatgacgaatcacacattaccaatattgaagaattaccaattccagttcttttaccaataaacaagacgtcaaggcaaactgcaaacgatgtcgaagagagtcaatcaaagaatgaacataaattaagtagaaccccttctctttcaaatttcaataaagaactgtcaaaggaagcacaacacagtcaagcaaaaacaaaagaaatcatgacagaagcttcggttaattcaaggcgagaatccactccagaaagtataatgcacttatcagatttttcgtcctcacaactgcattcgaaaaagaaattaagctttgcggattacagaaaaaaactactgaaataa

SEQ ID NO: 4736 - DNA, 2256 bp, Saccharomyces cerevisiae
atgtctttcctcatttcctttgataaatcgaagaaacatcctgcccatttgcagttagcgaacaatttgaagattgccctagcacttgaatatgcaagcaaaaatttaaagcctgaagttgacaatgataatgctgccatggaattgcgcaatacaaaggaacctttccttttgtttgatgctaacgctattctaagatatgtcatggatgattttgaaggtcaaacttccgacaagtatcaatttgcattggcatctttacaaaacctgttatatcataaagaattacctcaacaacatgtcgaggttttgacaaataaggccattgaaaattacttggtcgaattaaaagaaccattgactactacagatttgatcctgtttgctaacgtttatgctctaaattcttctttagttcattctaaattcccagaattgccatccaaagtgcataacgctgtagcattggctaaaaagcatgttccacgtgattcttcttctttcaaaaacatcggcgcagtgaaaatccaagctgacttaacagttaagccaaaggattcagaaattttgcctaagccaaacgaaagaaacatcttgatcacttcggcattaccttatgtcaacaacgttccacacttgggtaatatcatcggtagtgttctttcagcagacatttttgctcgttactgtaagggacgtaattataatgccttgtttatttgtggtactgatgaatatggtactgccacggaaactaaagctttggaggaaggtgtgacaccaagacaattatgtgacaaatatcacaaaatccacagtgacgtttacaagtggttccaaattggatttgattatttcggtagaactacgacggacaagcaaacggagattgctcaacatatttttacaaagctaaattcgaatggttatctagaagaacaatctatgaagcaattgtactgtccagttcataattcttatctggctgatcgttacgtggaaggtgaatgtccaaaatgtcactacgatgatgctcgtggggatcaatgtgacaaatgtggtgccctgttagatccatttgaattgatcaatccacgttgtaaattagatgatgcttctccagaaccaaaatattctgatcatattttcctatcgctggataaattagaaagccaaatttctgaatgggttgaaaaggcctctgaagaaggtaactggtcaaaaaattcaaaaacaattacgcaatcatggttgaaggatggtttgaagccacgttgtattacaagagatttagtttggggtacgccagtgcctttagaaaaatataaagacaaagtcttgtacgtttggtttgacgctacaatcggctacgtttccatcacttccaactacaccaaagaatggaaacaatggtggaataatccagagcatgtttcattgtatcaattcatgggtaaggacaatgttcctttccatacagttgttttccctggttctcaattgggtacggaagagaactggactatgttgcaccatttgaatactacagaatacttacaatatgagaacggtaaattttctaaaagtaggggtgttggtgtttttggtaataacgctcaagactctggaatttctccaagtgtttggagatactacctggcatctgttagaccagaatctagtgattctcatttctcatgggatgactttgttgctagaaacaacagtgaattgttggctaacttgggtaactttgttaacagattaattaagtttgttaatgccaaatataatggtgttgttccaaaattcgaccccaagaaggtttccaattatgatggtttagttaaagatatcaacgaaattttatcaaattacgtcaaggaaatggaacttggacatgaaagacgtggtctagaaattgccatgtcgttaagtgctcgtggtaaccagtttttgcaagaaaataagttggacaataccttgttttcacagtccccagaaaagtcagatgctgttgtcgcagttggtttgaatattatttacgctgttagctctattatcacaccatatatgccagaaataggtgagaaaataaacaagatgttaaatgcaccagctttaaaaattgatgatagattccatttggcaatcctagaaggacataatataaacaaggcagaatacttgttccaacgtattgatgaaaagaaaatcgatgaatggagagccaaatatggtggtcaacaagtgtaa

SEQ ID NO: 4737 - DNA, 2259 bp, Saccharomyces cerevisiae
atggcaagcatcggttcgcaagtgagaaaagctgcttctagtattgaccctatcgtcacggattacgcagtgggctactttaaccacttgtccggaataacttttgatgctgttcaaagtaagcaggtagatttgtccactgaagtgcaatttgtgtccgatttattgattgatgcgggtgcgtcaaaggctaaagttaaagaactatcggaaagtattttgaagcaattgactactcaactaaaggagaacgaagccaaattggaattgaccggtgatacgtccaagagattacttgatattaatgtcttaaagagtcataacagtaaatccgatatcaacgtctcattaagcatgctgggtgtgaacggtgacatcgaacatactggtagaaagatggaaacaagagttgatttgaaaaaactggccaaggctgaacaaaagatcgcaaagaaagtcgccaagagaaataacaaatttgttaaatacgaggcttctaaattgatcaatgaccaaaaggaggaggattacgattctttctttttgcaaatcaaccctttagaattcggttcatccgctggtaaatccaaggatatccatattgacactttcgacttgtacgttggtgacggtcaaagaattttgtccaacgcccaattgactctaagttttggtcacagatatggtcttgtgggccaaaatggtattggtaaatctactttgttaagggctctatctagaagagagctgaacgtccccaaacatgtttcgattttacacgtggaacaagagttaagaggtgatgatacaaaggctttacaaagtgtgctggatgcagacgtttggagaaaacaactattaagtgaagaagccaagatcaatgaaagattaaaggaaatggatgtattaagacaggaattcgaagaagacagtttagaagttaaaaaattggacaatgaaagagaagacttggataaccatttgatacagatttctgacaaattagtcgatatggaatctgacaaggctgaagctagggcagcatcaatcttatatggtttggggttcagtacggaggcacagcaacaacccactaattccttttccggtggttggagaatgagattgtccttggcaagagccttattctgtcaaccagatcttttgttgttagatgaaccttccaatatgttggatgtgccatccatcgcttatttagcagagtatttgaaaacatatccaaatacagttttgacagtttctcacgaccgtgcattcttgaatgaagtggctacagatatcatttatcaacacaacgaaagactagactattacagaggccaagatttcgataccttttacaccacaaaggaggaacgtagaaagaatgctcaacgtgagtatgataaccaaatggtttacagaaagcacttgcaagagtttattgacaaatacagatacaatgctgccaaatcacaggaagctcaatcaagaattaagaaattggaaaaattgcccgttttggagccacctgaacaagacaaaaccattgatttcaaattccctgaatgtgataaattgtctccaccaattatccaattgcaagacgtttcctttggttatgatgaaaacaacctattattgaaagatgttaacctggacgttcaaatggattccagaattgcccttgtaggtgccaatggttgtggtaagactacactgttgaagattatgatggagcagttaagaccactaaaaggctttgtatcaagaaacccaagattacgtataggctacttcactcaacatcatgtggattctatggatttgaccacgtctgcagtggactggatgtccaaatccttcccaggtaaaactgatgaagagtatagacgtcatctaggttcatttggtatcactggtaccctgggtctacaaaagatgcaattattatccggtggtcaaaaatctcgtgtagcattcgctgcattgtgtttaaataatccacacattttggttctggatgaaccttctaaccatttggataccactggtctagacgctttggtagaagccttgaaaaatttcaacggtggtgtcttaatggtttcccatgatatctctgttattgactctgtttgtaaagagatttgggtttcagagcaaggtactgtcaagaggttcgaaggtacaatttacgactatagagattacatcttgcagtctgctgatgctgcaggtgtggttaaaaagcattga

SEQ ID NO: 4738 - DNA, 2259 bp, Saccharomyces cerevisiae
atggtggtaggaactaaaaaatactctaatttggactttgtccctacaatcagtgacagtgaagacgatgttccaattctagattcttctgatgacgaaaaagtcgaggctaagaagactacgaagaagcggaagggtaagaataacaagaaaaaggttagtgagggggataacctcgatgaggatgttcatgaggacttggacgcggggtttaagtttgatttggacgccgatgataccacttcgaacttccaaggctggaactttctagcagagggcgagtccaataaggacgatgccgaagcttttgtgaagaaggacgttgacttggataagattattagaagaaaaggtgggctggtgaaaatggcccatattgatagtaaacaagaagaagaaaccgagaaagaaaaagtagaaaaagaaaacgatagcgacgatgaggaattagcaatggacgggttcggtatgggagctcccatgaacaatggagacgaaaatcagtcagaagaagaagaagaagaggaggaaaaggaagaggaagaggaggaagaggaggaacaagaagagatgacgttagaaaaaggcggcaaagatgacgaaatagatgaagaagacgattctgaagaggcaaaagccgatttctatgcgcctgaaactgagggagatgaagctaaaaagcaaatgtacgaaaatttcaacagtttgtctttatctcgtccggttcttaagggccttgcaagtttgggttacgtcaagccttcccctattcaaagcgccacaatccccattgccttattgggtaaagacatcattgccggtgctgtgactggttccggtaagactgctgcgtttatgattcccataatcgagcgtttgttgtataaaccagccaaaatcgcttccaccagagttattgttctattgcccactcgtgagttagctatccaagtcgctgacgttggtaaacaaattgcacgtttcgtctccggtataacctttggtctggccgttggtggtttgaacttgagacaacaagaacaaatgttgaaatctcgtccggacatcgtcattgctaccccaggtagattcattgatcatatcaggaactcagcaagttttaatgtggactcagtagagattctggttatggatgaagccgatagaatgttagaagaaggttttcaagatgaactgaacgaaattatgggcctattaccaagcaatagacagaacctattgttttctgctacaatgaactccaaaattaaaagtttagttagtctttctctaaaaaaaccagtaaggattatgattgatcctccaaagaaagctgctactaagttgacacaagaattcgttcgtattcgtaaaagagaccatttgaagcctgccttgttatttaatttgattaggaaattggatccaacgggtcaaaagaggattgtcgtttttgtggctagaaaagaaactgctcataggttaaggattatcatgggtcttttaggtatgagtgtgggtgaattacacggttctttaacccaagaacagcgtttagattccgttaataaattcaaaaatttggaagttcctgtacttatctgtacggatttggcctccagaggtcttgatatccccaagattgaggttgttatcaactacgatatgcccaagagttatgagatctacctgcatagagttggtcgtaccgccagagctggtagggaaggtcgttccgtcaccttcgtcggtgaatcatctcaagatagaagtattgtacgtgctgctataaagagtgtagaagaaaataagtccctaactcaaggtaaagcacttggtagaaacgtagactgggttcaaatcgaagaaacaaacaaacttgttgaatccatgaacgatacgattgaagatattctggtggaagaaaaggaggagaaggaaatattaagggctgaaatgcaattaagaaagggtgaaaatatgttgaagcataaaaaggaaatccaggcaagaccaagaaggacatggttccaaagcgaatcagataagaaaaattccaaagtattaggtgctttatcaaggaacaagaaagtcactaacagcaaaaagagaaagcgtgaagaagctaaggcagatggcaatggtgcacgttcttatagaaaaaccaaaaccgaccgtattgcagatcaagaaagaacttttaaaaagcagaagagtacaaattcaaataagaagaagggcttcaaaagccgtaggtaa

SEQ ID NO: 4739 - DNA, 2259 bp, Saccharomyces cerevisiae
atgtctaataccgaggaattgatccaaaactcaataggttttctccagaaaacttttaaagcactcccagtttcgtttgactccattcgacatgaaccacttccatcttcaatgttgcatgcaagtgttctcaattttgaatgggaaccgctcgaaaaaaatatttcggcaattcatgatagagattctttgattgacattatacttaaaagattcattatagattcaatgacaaatgctattgaagacgaagaagaaaataatcttgaaaaagggttactaaattcgtgtataggtctcgattttgtgtataactcaagatttaatagatctaatccagctagctggggaaatacctttttcgagttattttccaccatcattgatttgctaaactcaccatctacgtttttgaagttttggccctatgctgaatcacgtatcgaatggttcaaaatgaatacatctgttgagccagtatcattgggggagagcaatttgattagttacaaacagcctttatacgaaaagctgcgccactggaacgatattttagctaaattagagaataatgacatccttaataccgtcaaacattataatatgaaatacaaactagagaactttttatccgagctactacctataaatgaagaatcgaacttcaatagatccgcttctatttcagctttacaagaatctgataacgaatggaacagatcagcacgtgaacgagaaagcaaccgcagttccgacgttatatttgctgcagattataacttcgtgttttatcatctaattatttgcccgatcgaatttgcttttagcgatttagaatataaaaatgatgtggacagatcattaagtccccttcttgatgcaatcttggaaatcgaagagaacttttacagcaaaatcaagatgaacaataggactagatattccttagaggaagctctgaacactgagtattacgcgaattacgatgttatgacccctaaattacccgtgtatatgaagcattcaaacgcaatgaaaatggacaggaatgaattttgggcgaatctacagaatattaaagaatcagatgactacactcttcgacctaccattatggatatctctttgagcaatacgacctgcctttataaacaattgactcaagaggacgatgattactaccgcaaacagttcattttacaactatgtttcacaacaaatcttatacgcaatttaatttcttctgatgaaacgaggaatttctataaaagctgctatttgagggaaaacccgttgagcgatattgattttgagaaccttgatgaagttaacaaaaagcgtgggctcaatttatgttcatacatttgcgacaatcgtgttttgaaattttataaaattaaagaccctgacttttatcgtgttatccgcaaattaatgtcttctgacgaaaagtttacaaccgccaagatcgatggctttaaagaattccaaaacttcagaatatctaaggagaagataccgccacccgcttttgacgaaacttttaaaaagtttacgttcatcaagatggggaataaattgattaataatgtttggaaaatacctactggtctagataaaattgagcaagaagtaaagaagcctgaaggtgtctatgaagcagcccaagcgaaatgggaatcaaaaatttcttctgaaacttccggtggagaagcgaaagatgaaataatcagacaatggcaaactttacggtttctaagatcgcgatacttgttcgattttgataaagttaacgaaaagactggtgttgatggtttgttcgaggaacccagaaaagtggaagcgttggatgatagtttcaaagagaaacttttgtacaaaatcaatcaagagcacaggaaaaaacttcaggatgctagggagtacaagattggaaaggaaagaaagaagagggcactggaagaagaggcttcgtttcctgaaagagagcaaaaaattaagtcgcaacgtataaacagcgcttctcaaacagaaggagatgagttgaagagcgaacagacgcaaccaaagggagaaatatcagaagagaataccaaaataaaaagctcggaagtttcttcgcaagatcctgacagtggtgttgccggggagtttgctccacagaatacaacagctcaactagaaaatccaaaaacagaagataacaatgcagctacttcgaacatttctaatggttcatctacccaagatatgaaataa

SEQ ID NO: 4740 - DNA, 2262 bp, Saccharomyces cerevisiae
atgccgtacagagtggcgacgggctacagtgaaaaaagtactgacgatgatttgatatggagaacgccaatagtaaaagaggaactcgaggatgctgacaactttttaaaggatgatgccgagttgtatgataaagtcaagaacgagagtgcagtatcacacctggataccatagttatgccgatcattttcacggtactgggcatgttcactagaatgtacaagattggtcgtaataatcatgtggtctgggatgaagctcattttggtaagttcggctcttactatctgagacacgaattttaccatgatgttcatccacctttaggtaaaatgcttgttggactgtctggttatttggctggctacaatggttcttgggacttcccatctggtgaggtttatcccgactatatcgattatgtgaaaatgaggttatttcaagcaatgttttcatcattgtgtgtgccactagcctatttcacaggaagggctatcggattttctaggctgagtgtttggctatttaccattctagtaatttttgagaattcgtatgcaacattaggcaagttcattctccttgattcaatgctacttttctttaccgtctcttcttacttttgccttgccaagttccatactatgagaaagtctcccttttcggctaggtggtggctatggttgtgcctcactgggttgaatttgggttgcgctatatctgtgaaaatggtaggtcttttcatcatcagtgtagtaggaatttacaccatcagtgaactatggaatctcctaagtgatagatcggtgtcttggaaggtttatgtcaaccattggctagcaagaatattcgggcttatcatcattcctgtttgcgtttttttgttatgcttcaaaatccattttgatctgctgtccaactcagggcccggcgactctaccatgccatcattatttcaagccagtctgaacggtacaaaagttggtaagggaccacgtgatgttgctttgggttcttctattatttccatcaaaaatcaagcgttgggaggcgctttattacattctcatgtccaaccattcccagaaggttctgagcaacagcaagtaactgtctatggttacagtgatgctaacaatgaatggttttttcaaagaatcagaggagtagagccttggactgatgctgagaacaagacaattgagtttgtaaagggtggcgaaatgtatagattaatgcatcgcctaacaggcaagaatctacacacccatgaagtcccagcgcctatatcgaaaagtgaatatgaagtttctgcttacggagatgtagacttaggtgactacaaagataactggattatagaaatcgtggaacaagtaggggaagaagatccaacactactacacccgctatccacatctttccgtattaaaaattctatactgggttgctatttagctcagtcaggtaaacatttaccagaatggggtttcaggcaaggtgaagttgtctgtttaaaacacgcctccaaaagggataagagaacctggtggaatatcgaaacacatgaaaatgaaagattgccacagggagaagatttcgtatatccgaagacttcattcttcaggaatttcatgcagttaaattcagcaatgatggcaaccaataatgctttggtaccaaaccctgaaaagtttgatggtatagcttcatctgcctggcaatggccaaccttgaacgtcggggtaagattatgcgaatggagtgaaaaatctataaagtacttcttattaggatctcctgcgtccgtctggccctcaagcatcgcagtttgcgcactgataatacacgttatattcttaactctgaaatggcagagacaatgtgttatcctatccgatccagtcgaacgtgacgtgttcgttatggcagccttttatccattgcttgcttggcttttacattatatgccattcgtagtgatgtcaagagttgtatacgctcaccactatctgcccaccctttattttgccttaatgatcttgtcatactacttcgatatgattaccaaacgttgggctacaagaaacactggaaaatttctaaggctaggagcttatattgtatacggatcaatcgtgatcgctggatttttttatttctctccttttagttttgggatggatggtccagtagatgattacgcgtacttggcatggctacctacgtggcagattgttgaagatatacgtaacacatag

SEQ ID NO: 4741 - DNA, 2262 bp, Saccharomyces cerevisiae
atgcgggttttaataactaacgatgatggtcccttaagtgatcagttttcaccatacattagaccttttattcagcacattaaaagaaattatcctgaatggaaaatcacggtttgtgtacctcatgtccagaaatcatgggtgggtaaggctcatcttgctggtaaaaatttgacagctcaattcatatattctaaagttgacgctgaagacaatactttttggggcccatttatccagccacaaattaggtcagaaaactctaaattaccttatgttctcaatgctgaaattccgaaagatacaattgagtggatattaatcgatggaactccagcatcgtgcgcaaacatcgggctgcacctattgtctaatgaaccgtttgatctagtactgtcgggtccaaatgttggtagaaatacatctgctgcttatattacctcttctggtaccgtaggaggcgcaatggaatctgttattactggaaatacaaaggccattgctatttcttgggcctattttaatggattgaaaaacgtctccccacttttaatggagaaggcctctaagagatctttagatgttatcaaacatcttgttaagaattgggacccaaaaacagatctatatagtatcaatattcctttagtggagagtttaagtgatgatacaaaggtttactatgcaccaatttgggaaaatagatggattccaatattcaacggccctcacattaacctagagaatagctttgctgagatcgaagacggtaatgaatcatcatcgatttcctttaattgggctccaaaatttggggcacataaggattctattcactatatggacgaatacaaggacaggactgttttaactgatgctgaagttattgaatccgaaatgatcagtgtcactcccatgaaagccactttcaagggtgtgaaccaccttcttggagagttgaaactgactgaggaagaaaataatttatcaaaaacaaataacctcatcgtggtaagtatagacccaatggaatatatatacaaacctctaacccacgccctgaaaaaatatctgccacaagtggagattgtatcaaacttgccagaatttgacaatggagggtgtgaaaaagaaatgaaggtttttcattacggtgattacgaacagctagatatggacaaactaatggaactgcccaataattacttcacaaactcttatatatataggaaggcattgataagaaaacactttctttcgcataccatacagacttatactgcgaagaacccagagtccattttaaagaaggcatatttggaatcattcactattgatttagattatgctgaatttctagacgacgcattagatgaaaattgggaattacgccaagagttggagaatgaaagccaagataaatggtggatcgtgaaaccgagtatgagcgataaaggtcaaggtatcagggtatttaagactattgaagatttacaggctattttcgattcctttgacgatgaagacagcgaagcagaagagagtggaaatgacgacgatgctgatgatgtaaatggcgaattcatggataataacaaggttaacatttcccaattgcgccactttattatacaagaatatttaaccaatccgttactattggcatctatggataatagaaagttccacataagatgttacgtcgtctgtaggggagatttgcaagtttttgtttatgatagaatgctagcgctctttgctgccaagccatttgttcctctagatccatatgcgtattccgtaactgatttgaaagatttggaatgccacttgactaacacatgtctgcagagcaaaaagaaggataaagattcttctgttttggagtttgactccatagaggaaattccaaatgagagaaagtccaatattaaggagcaaatccatagcataacgaacgacgttttcttagctgctgtaaatgtaaatagattaaacttccaaccgttaccaaacgcatttgaaacatatggcgtagactttttgattgattcgaattacgaagttaaattactagagatcaacgctttcccagacttcaaacaaactgggaaagatttgaagaacctcattgatgaattatttgatgacactgtcaaatactgtgttacccccatctttaacgagaatagaaataagacagatgatgaaacagacccgaacttcgtaaaagtcattgattacacttcaaacggttggtga

SEQ ID NO: 4742 - DNA, 2262 bp, Saccharomyces cerevisiae
atggaagaaaaccaattaacgtgcttaataggtatggcaaagaagtttaagaaaacagacattcgaacaaaaatttactaacatataaatgtaaatttaaatttccttttttttacagttggagaaacaccagcagcacaatttctaggatggagactaagtttgagcaactcttttataatactggtctcgcaatatgtgtctagtgacgagttagttgcctggaaatcgacaaaactaggcgccaatttctacacgccaaacattctcactaaggatattaaagagctgcaccacaaattaaaacataacggtgcaaatacgtattcaattgacattgtgttagtgtctgcaatttccttacagtctttcgaaacaacttgtcgattgttgtcagattacacgaacgacaatacgactgtgcttattagcactgattttggttgcgaactggagcccatagccataagttattttggagggaagtgcaagtgtgttatttccatttcgtgtgaggttgaatgcagacagttatcgcttggatcatatgcattggtcaacgacgatcaatgtgtaataactttgggattaacttattgtgatgctaattttgaagcaagtccaaccattctggaaaacacgaaagcagcttcgttagaattgcaagggattaagggttcaaatgttcgcaggttccttcttggattgaccgttgcgaaatggatgaaatctaaattaattttggacccaaaacaaatggcattgaaaatgtgggaattgcttattcctaaaatctcacttaacatcctttctatcatctatgaacaatttgattatgagaaaatgttagaaaacaaatccacagaaattatttttaaagatctggtgaaagagttacttggaatttgctttgcacaatgtggaagcaaaattgcaaggtttttgctagtaaaatcacaaggtgaagaagagattaattttgggaaaatcgtagaatattgcaaaggtaaaaaactgcaacttatcaactctacggcaaacgaacatccggaatatttatccttaccgtttgagccttattgtttctaccaccgatttgaatatcctgctcaaattcttttgcatcagcccatcattttggccaaaaagtatggtgtttcgtgttcaaatttaaatttcctatatggattctatacgaggttactgacactaagtgggctatcaataaatggtggaaggtgtgagcatgccttgtcgatgttggacagcaggattggtggtggtattaacgttgcttcaggaattaatagcggccaagattttaccgatggtgataacgaggatcaagataaaggcaaaaacagagtggacaaaaatgtaaaggaaggttctttcattagtttaacacaacgattcacgatgacaagtccactgggtgtcaatgatccagctttaccagcggacttagaaaagttgtatttaggtgcagaatacattagcaattgcgacgcaaatacatctggtggtcaaaaacgagtaaaatctccaactaaagcagatacaggctacgatgataaacacttgcctgatgatacgatacatacatttgaagatgaatatttggccgatgaagacgacttttcttgccttggaattgacaaaagaagctcaacaaagcccacaaagcctctagaaaaatttggagtggttgctgtgccacacttcatcaggaggttttctattaaaaggtcgagtaaggataaatcaaatgatatgaaaagaccatatactacaagcagcttggagttgcaattaaggtcaaatcactttatgttcgccaaagaataccaagacttacatagacaattatattacgaagttaaaccaaggacgcaatcagaattggacgcaagacgtcgaaactattctgaattagaatctcagatgtggaaaattaaacatcggttcaatattcatagaggagcactgcctcgtccacgaacgaatccgtatgagctattactggaccacattgatgttttgaaccgtggcaacactggggatattttgagatttaccactagtagatacggtggtgtagatacgtatgattccatcttgagggaccaatccacgatcatggaacttttagataaacggtgtgcctattcacctccagtactgttcgataatgaggctaaagaacgtgatcatgatcgcgattgttatcaagattacaatcacgaccaccggagtcattaa

SEQ ID NO: 4743 - DNA, 2262 bp, Saccharomyces cerevisiae
atggttgagttttctttgaagaaggccagaaacaattggaagcatgtaaagaagtctgcaagctctcctgctaagcaaaagacacctccatcgcctgctaagcctaaacaaaaaacaaaaaagaacccttatagtgatctcaaggatccggctaccagttatacgctaccaacaatcaatgcaagggagagaagtagggtagcaacttcaatgcagagaagactatcaattcataatacaaattatgctccacctacactagattactcaatgcccctacctgatatgccaaacatgatagttcccaatgataatgtggatagtagtcataataatagtagtttcaccactgagaacgaatcggtaagctctaaaggcccttccaacagtttaaatctttcaactgccgatctctccctgaacgacagctcctataataaggtgcctgctagatcagcaatgcgaaatactgtcaatccttccggcagtaatgatcctttcaataatagcacgtcgctaagaaagatgttggcaaacccgcattttaatgctaaagattttgttcatgataaactaggcaatgcgagtgccattactattgataaatttacctcaaatttaacagatttatcgatacaggtccaagaagaagtaaagttaaatatcaataaatcatataacgaaatcatgacggtaaacaacgacctaaatgttgctatgttggagcttaaaagggttagagcaaatataaatgatttaaacgaggttttggatcagtgcaccaaaatagctgaaaaaaggttacaattgcaggatcaaatagatcaagagagacaaggcaattttaacaatgttgaaagtcattctaatagtccagcgttacttccgcctttgaaagcaggacaaaatgggaatctcatgaggagggacagatcgagcgtcttgatattagagaaattttgggatacggaactggatcagctgtttaagaacgttgaaggtgctcagaagtttatcaattctacgaaaggaagacatattttaatgaatagtgccaattggatggaattaaatactaccactggtaaacccttgcagatggtacagattttcattttgaatgatttggtacttatcgccgataaatcaagagataagcaaaatgactttatagtaagccagtgctatcctttaaaggatgtcactgtcacgcaagaggaattttccactaagaggctacttttcaagtttagcaattcgaattcaagtttgtatgaatgtagagacgcagacgaatgctctaggttgttggacgttataagaaaggctaaggatgatttgtgcgacatattccatgtagaagaggagaactctaaacgtattagagagtcctttagatatttgcaatctacgcaacaaaccccaggtagagaaaacaacagaagccctaacaaaaacaaaagacgtagtatggggggttcaatcactcctggccgaaatgtaacaggcgcaatggatcaatatcttttgcagaacctaactctatcaatgcattcgaggccaaggtccagagatatgagttcaaccgcccagaggcttaaattcctggatgaaggcgtggaagagatagatattgaattagctaggcttaggtttgaaagtgccgtggaaacattattggatattgaatcacaattggaggatctttctgaaagaatttctgatgaagagttaatgttacttaacctgatatctttaaaaatcgaacaaagaagagaggccatttctagcaaactttctcagagcattttatcatcgaatgaaatagtgcatttgaaaagcggtactgaaaatatgattaagttaggattaccagagcaagctcttgacctattcttacagaatagatctaatttcattcaagatttgattctacagattggatcagtggacaatcctacgaactatttgactcaattggctgttatcaggttccaaaccattaaaaaaacagtggaggacttccaggatattttcaaagaactcggggctaagatttcttccatcctagtagattggtgtagcgacgaagtggataatcacttcaaattgatagacaagcaattactgaatgatgaaatgttatccccagggtccattaagtcatccagaaaacagatagatggattgaaggccgtaggtttggattttgtctacaaattggacgagtttatcaaaaagaacagtgataaaattcgctaa

SEQ ID NO: 4744 - DNA, 2265 bp, Saccharomyces cerevisiae
atgaatgaagacctgcccaaggaatattttgaactaataaggaaggctcttaacgagaaagaggcagaaaaagcgcccctgagtagaagaagaagagtcagaaggaagaaccagcccctaccagatgccaagaagaagtttaaaacagggttgaatgaattgccacgagaaagcgttgttactgtaaacttagattcttcagatgatggcgtcgttacggtaccgacggatgatagtgtagaggaaatccagtcatctgaagaagattatgattcggaggaatttgaagacgtgacagatggaaatgaggtggccggtgtagaagatatatctgttgaaattaagccctctagtaaaaggaatagtgatgctagaaggacaagccgcaacgtttgttctaatgaagaacggaaaaggagaaaatatttccacatgttgtatctagtttgcttgatggttcatggatttatacgaaatgaatggattaacagcaagcgcttgtctagaaaactgagcaacttagttcctgagaaagtgtttgagctactgcatcctcagaaagatgaggaactcccacttaggagtactaggaaattattagatgggttgaagaaatgcatggagttatggcaaaaacactggaagatcactaaaaaatatgataatgtgggactttatatgagaacctggaaagaaattgaaatgagcgccaataacaaaagaaaattcaagacgttgaaaagatctgactttttaagggccgtcagtaaaggtcacggagatcctgatatttcagtgcaaggtttcgttgcgatgctcagggcttgtaatgttaacgcacgacttatcatgtcatgtcaaccgccagattttaccaatatgaagattgacacttctttgaatggaaacaatgcgtacaaagatatggtcaagtatccgattttttggtgtgaagtgtgggacaaattctctaagaaatggataactgttgacccagtaaatctcaaaaccattgaacaggtcagacttcattccaagttggcaccgaaaggcgtggcgtgctgcgaaagaaatatgttgaggtacgtgattgcttacgatcggaagtatggctgtagagatgtaactcgaagatatgcccaatggatgaactctaaagtaagaaaaagaagaattactaaagatgactttggtgagaaatggttcagaaaagtgataacagcacttcaccatagaaagagaaccaaaattgatgattacgaagatcaatatttttttcagagagatgaaagtgaaggcataccagattcggtgcaggatttgaaaaaccacccatattatgttttagaacaagatatcaaacagactcaaattgtaaagccaggatgtaaagagtgtggatatttaaaagtacatggaaaagttgggaaggttttgaaagtttatgcaaaaagagatattgcggatttgaaaagtgctagacaatggtacatgaacggccgaattttaaaaactggtagcaggtgtaaaaaggtgataaagaggacagttggaaggcctaagggcgaagcagaagaagaagatgaaagattatatagctttgaagacacagaattatacatccctccattagccagtgcgagcggtgaaataaccaagaatacatttggaaacatcgaagtttttgcaccaacgatgatacctggtaactgttgtttggttgagaatcctgtggcaattaaagctgctaggtttttgggggtggaatttgcacctgctgtaacttcttttaagtttgaacgcggcagtacagttaagccagttttaagtggcattgttgttgcaaagtggctcagagaagctattgaaaccgctattgatggaatagagtttattcaagaggatgataataggaaggaacatttgcttggtgctttggagagttggaatactttactgctaaaactgcgtattcgtagcaagctgaactccacatatggtaaaattgccgaggaagaacctaacgttacgaaggaacagaatattgcggacaatcacgataatacggagacttttatgggaggtgggttcctaccaggtatagcaaaccacgaagcaaggccgtatagtgaaccttcagagccagaagatagtttagattatgtttctgttgacaaagcggaggaaagtgctacagacgacgatgtcggggaggattattcggattttatgaaagaactagagatgtcagaggaatcagactga

SEQ ID NO: 4745 - DNA, 2265 bp, Saccharomyces cerevisiae
atgacatcaaataattcgttattggggcgtggaaggatgtcatattcctctaccgctccaccaagattcaaaagatcagtcgaccagcgtgacactttctcggacaattttgattatgataaggattcatccaatcgaggcaggacctatattgcagcatctaattcaactactggggtacccccacccaacaactcaagatcaggatgcaccaataatacaaataatacaaataatacaagtaatacaagtaatacgaacaataatgatagcgttgatgagaatacagtgtttgaaactttaccttattacctgccctgcttttcatggcttcctgagtacactttcaataaactgtggggcgacgtaatcgcaggtatctcagtagcgtcatttcagataccacttgcgctatcgtacacaacttcaattgcacatgtcccacctttatgcggactatattctttggctattagcccatttgtctatggtattttaggttctgttcctcagatgatagttgggcccgaaagtgcaatttccttggtcgtgggacaagcagtcgaatctataacactacataaagaaaatgtttctctaattgatatttcaacagtaataacatttgttagtggcactatcctacttttttctggtatttccagatttggtttccttggaaatgttcttagcaaggcacttctacgaggtttcataagttcagtaggactggttatgataatcaactctttgatttctgaattaaagctagacaaatttttagtaagcttgcctcaacactaccatacccctttcgagaaaatacttttcctcattgattatgcaccagcacaataccatataccaacggcaatattcagcggatgttgcttgattgtcctctttttaacgcgtctactaaagaggaaattaatgaaatatcacaagagcgcaatattttttccagatatattattggtggtaattgttactattcttatttccatgaaatttaatttaaaacacagatatggtatttctatcattggcgactttagcatggacaattttgatgaattgaaaaaccctttaactcgtcctagacgtaagctaataccagatctttttagtgcatctctaatagtggcaatgttgggtttttttgaatctacgaccgcgtcgaaatctcttggaacaacttacaatcttaccgtttcctctaatagagaactagtagctttaggattcatgaatattgtcatctcattattcggtgctcttcccgcattcggcggatatggaagatccaagatcaacgccctatcaggagcacaaagcgtaatgtcgggagtgtttatgggtgtcatcaccctaatcacaatgaatttacttcttcaattcgtacattatattcctaattgtgttttatccgtcataacaaccatcatcggaattagtttattagaggaagtgccaggcgacataaagttccatttgcgatgtggtggctttagtgaactatttgtttttgctgttaccttctgcactacaatattttactcaatcgaagcaggaatatgcatcggatgtgtctattcaattataaatattataaagcattcagcaaagtcaagaatccaaattctggctagggtagcgggaacgtcgaactttacgaatcttgacgactacatgatgaacatgaaaaggaactctctggatgttgagggcacagaagaaatcgagggatgcatgattgttagaatacctgagcctctcacatttacaaacagcgaagatttaaaacagagacttgacagaatagagaggtacggttcgtctaagatacatcctggaaggaaatcacttcgctcgaaggattccataaaatatgtcattttcgatttaggtgggatgacctcaatagattcttcagccgcccaagtgctggaggaaattatcactagttacaagaggcgcaatgtctttatttaccttgtcaatgtatctataaatgacaaagtaagaaggcgattattcaaagcaggtgtagctgctagtgtggaaagagcgcaagcaaataacaacgaaaataatactagcaacacatttagtgatgcaggagagacatattctccgtacttcgatagcattgatgcggctctttatgaaattgagaaaatgaaaattaaagggaacaacgtcccgaacaatgattcggagagttttatgtccaatactttatttaattcaagtctagtgtaa

SEQ ID NO: 4746 - DNA, 2265 bp, Saccharomyces cerevisiae
atgactacacaactaaggtatgaaaataacgatgacgatgaaagagtagaatataatctctttaccaatagatccaccatgatggcaaattttgaagaatggatcaaaatggctacagataataaaatcaattcccgaaatagttggaatttcgcattgatcgactatttttatgacttggacgttttgaaagatggcgagaataacatcaattttcagaaagcatctgcaaccttggatgggtgtattaagatttactcttcgagagttgattcagtgacaacggaaacaggtaagttattgagcgggttggcacaaagaaagacgaatggggcatctaacggagatgacagtaacgggggaaatggtgaagggcttggaggtgacagtgacgaagcaaatatagagattgatcccttaactggtatgcctatatctaatgatcctgatgtgaataacactaggcggagagtgtacaacagagttttagaaacaacattggtggagttcgaaacgatcaagatgaaagagctagaccaggaattaataattgatccattattcaaaaaggccttggttgatttcgatgaaggtggcgccaagagtttattgttgaacacattaaacatagacaacactgcaagagtcattttcgatgcatcaattaaggatacacaaaacgtagggcaaggtaaacttcaaaggaaagaagaagaattaattgaaagagatagtttagtagatgacgaaaatgaacctagccagtcattgataagtactcgtaatgactcaaccgtaaatgattccgttattagtgcaccttccatggaagatgagattttatctcttggtatggattttataaaatttgatcaaattgcggtgtgtgaaatttcaggatcgattgagcaactaaggaacgttgtcgaagatattaatcaagcgaaagactttatcgaaaatgttaacaacagatttgataacttcttaactgaagaagaattgcaagcagctgtcccagataatgcagaagatgatagcgatggctttgatatgggcatgcaacaggagctgtgctatccagatgaaaatcatgacaatacatcacatgatgaacaagatgatgataatgtcaacagtaccacaggaagtatattcgaaaaagatttgatggcatactttgacgaaaatctaaatagaaactggagagggagagaacattggaaagtacgaaattttaagaaagcaaacttagtgaataaagaatccgacctgttggaagaaacgcgaactactataggagatactactgacaaaaacacaacggacgacaaatcgatggatacgaagaagaagcataaacaaaaaaaggttctggaaattgatttcttcaaaacggatgatagttttgaagacaaagtctttgcctcaaaaggaaggacaaagattgacatgccgattaagaacagaaagaacgacacacattatttactgccggatgacttccatttttccactgatagaataacaagattgttcattaaaccggggcagaaaatgagtctgttcagtcataggaagcataccagaggcgacgttagttcggggctttttgaaaaaagcacagtttctgccaaccattcaaataacgacattcctactattgcagatgagcacttttgggcggataattacgaaaggaaagaacaagaggaaaaagaaaaggagcagtctaaagaggttggtgatgtggtgggtggagcgctcgataatccgtttgaagatgacatggacggtgttgacttcaaccaagctttcgaaggaacagatgataacgaggaggccagtgtgaaacttgatttacaggatgacgaagatcataagttccccattcgagaaaataaagttacttattcaagagtttcgaaaaaagttgacgtaagaagattaaagaaaaacgtatggagatcgatcaacaatttgatacaagaacatgacagtaggaaaaatagagaacaaagctctaatgacagtgaaacccacacagaagatgaatcaacaaaggagctcaagttttctgatatcattcagggtataagtaaaatgtattcggatgatacactaaaggacatttcaacaagcttttgttttatatgccttctacacttagccaatgagcatgggttgcagataactcataccgaaaactataatgacttgatagtgaattatgaggatctagcgacaacacaggcagcgtcatag

SEQ ID NO: 4747 - DNA, 2265 bp, Saccharomyces cerevisiae
atgataaaaagatggttatctgtgaataggaaaaagtcacacccggagaagaacactcaaggtaatgacgaaattaatcggaaagcaactagcctgaagaaaacgaaaggttctggagatccctccatagcgaaatcaccaagtgctaagagtagtacatcaagcataccttctaatcttgcgagccatgaaagaagaagcaagtttagtagtcaaacggataaccttgcaggaaataaacattaccatgagcattaccataatatggcaagtacttcagatgaaagagagtacgattcctcgactacatatgaagatcgtgcgttcgatacagagtcctccatactatttactactattacagatttaatgccatatggggatggttccaataaagtgtttggttatgaaaattttgggaatacttgctactgcaactccgttctacaatgcctttataatatccccgaatttaggtgtaatgtgctgcgatatcctgaaagagtagccgcagtaaacagaatacgcaaaagtgatttgaagggttcaaaaataagggtattcactaatgaaagttttgaaacatctactaatagcggaaattctaatacggggtaccaaagcaatgataatgaagatgcacataaccaccaccaccttcagcagagtgatcaagataactcctcttcttctactcaagaaaaacagaataattttgaaagaaaaaggaactcgtttatgggttttggaaaagataaatcgaactataaagattctgcaaagaaagatgataacaatgagatggaacggcctcagcctgttcacacagttgtaatggcctctgatacattaacagagaagcttcacgaaggctgtaaaaaaattattgtgggaagaccgcttttaaagcaaagcgattccttatcaaaagcttcaactacagattgtcaagcaaattcgcattgccagtgtgattcacaaggcagtaggattacatcagtggatgatgatgtccttgttaaccctgagagctgtaacgatgctgtcaacaattctaataataataaagagaatacgtttccaacaagtgaacaaagaaaaaaagccgctttaattagaggccccgttcttaacgtagatcatttactttatccaaccgaggaagctacactttacaatggactaaaagatatatttgagtctattactgaaaacttgtcgctaaccggtatcgtttcacctacagagtttgtcaaaattttaaaaaaagaaaacgtcttgttcaacactatgatgcaacaagatgcccatgaatttttaaactttttattaaatgatttcagtgaatatattcaacgcaataatcccagaatgagattcggaccacaaaagacagacaacagcaacgacaactttataacggatttattcaaaggtacactgacgaataggatcaaatgtttaacttgtgacaatatcacctcaagggacgaaccatttttagactttccaatagaagtacagggtgatgaagagactgatatccagaagatgttaaaaagctatcatcagcgtgagatgttgaacggggttaacaaattttattgtaacaaatgttatggtttacaagaagcagaacgtatggtcggactgaagcaactgccccatattctgtcattgcacctaaaaagattcaagtattcagaggagcaaaagtcaaacatcaaactttttaacaaaatactctatccactaactttggatgtttcttccacttttaatacatcagtatataaaaaatatgaactaagcggcgtcgtcatccatatggggagcggtccacagcatggtcattacgtatgcatttgcaggaacgaaaagtttgggtggcttttgtatgatgacgaaacggtggaatccataaaagaagaaactgtgttacaattcacaggtcatccaggtgatcaaactacagcctacgttttattctataaagaaacacaggctgataagaccgaaaatcaaaatgaaaatatagacacttctagtcaagatcaaatgcagactgacaataacattgaacagttaataaaatgcgatgattggttaagggatcgtaaattgagggcagctgcaaatattgaacgcaaaaagaccttggggaatatacctgaagttaagactgcagaaaccaagacgccattaaatgataaaaaacgcaataagcaaaaaagaaaatcgagaatattgagcttcatcaaataa

SEQ ID NO: 4748 - DNA, 2265 bp, Saccharomyces cerevisiae
atggagtctctttttcctaacaaaggtgaaataatacgcgagttactgaaggatcctttaatattaaaaaatgacagcaaaaggtccaatggcagtgagttagaacttgattctagtgacctactacaacgcgaggcaattctagccaacgaactgaacatcctagataatttgaagacgtttttaaatctcataaaagaagttaaaactaatttgaacatactagaactagaaaactgctactattcgttgcagtcattgcgaaaaaagatgcgtaataatgctgcttatcttaagcaaagctttaatttccagcagtccatttctacctacgtcgacacactgcatttagaacttgtcagcacgttgtataaaattcttactaatggattttggaagattaccgagaatagcatccaatttacgcccacagtggaatggggtaaagacaaggttcatattgagtatgatacatttatggattttgtggcccaacagtattttcctaagggtagtttggacaatcaagcttggttcattttagatatgaccagtgccgactctcaagagcaggtaagagcaaaattgaatacaatcatgaaggagtatatgaacctttccaggattgtaagcatgatcaaaaattctatttttatatctggtaaagaaatctcatatgaaaacgaaaaaaacatacttgtcttttctaaatcctcttcgcatggccaacattgtgtgtctactgtattaacaagttttgaagcagtatgcgatttcatgttagacggattagcctttagagacagaaagaccttaagttatgagctaggtcccttgttcaatacggagtttaccaaatttgtgaaaaataatgcatcgataattttagaatcacttgattcaccgctaaaaaatctagtttctgtcataaataacaaactaactagactagttgccaaatcagaagttaccaattggacacattccggtaaagagattcaggatttgttaatgaacaaacaattatactacaatttattactagataaagttcttgaatcgcatattagtgagataagaagtatatttgaagatccaaaaaagagctggcaaaatttggaagtagttgagctcactactagcaatactaatacgatgagcgaaaaaattggaaaaaatgattcagatgtacagaacgaaaaagaactccataatgccgtatccaaagatgatgattggaattgggaagtagaggatgatgatgccgatgcatggggtgatgaaattgatgtaaatattgacgacgaggaagaaaaaacaaatcaagagaaggaaaaagaaccagaagaagaagaaaatgcctgggatgaagcctgggcaattgacgaaaatatagatgatgcttccctagaaaatggaaaggaacatttaaaagctcatgatgtaggatcacttgataaagaccacattgaagttacacagttaccaaaattgttcttggcaatttcacagaatttcaagagtagctttgcagatagccatgttgatgagcaatactttgcgtacaaatacaaccttttgcagacatcgtatatggccatgtgcacagctaatttttctcacaattggtgccaattatatgtggatatgagatatctaatagaacgagatgaaaagctgtatagaataaaagaattaacaaggaacctgctggaaactaaactgaacatgaaatatcgtattgtctgtcaactaatcaggcatcaattgaccgaatttcgtgagaacgagagaaatccatcgtgggacgccaccattgagaaactgctaccttatatcttgaaggaaattgttcgtccactgcagaaaataagaggtgaagaaggttcccgttacttgttgtctttcttaaactttttatataacgattgcgtgacaaaggaaatattaaaatggcagattatctctgaggtcaattccgaaaatttgggtgagctcgtatctttattagtgaacaacaccgatatacaattattagcgaaggaaccaagttacaaaaagatgagagaaaaattcgccactatgggcaagtttctaccattacatttaaaggagattatggagatgttttacaatggggatttttatctttttgcgacagacgaactaatccaatggatagagttattgtttgccgacactcccctgcgaaggaatgccattgatgatatttacgaaattagaggcactgctctagatgattaa

SEQ ID NO: 4749 - DNA, 2265 bp, Saccharomyces cerevisiae
atggcacatgaaaagtttagtatacctgagaacttcacattagcgcagtctttgcaattgctttactctgttgtcaaaaatcaatataaaaacctagcagacctaataatcaatagcaaaggtaataaggacacagtaacgtatgggaaaatccacaaaaacttagacactttactggtatacgtcaatgaaggtctacgaaaaattgaaaagacttataccttaaagaaagggttaggaaatcttgtagttgatcatcctgaattgaggagcatcattgaggatttccaaattcttggccaggatataaggatcgcacgtcgtaaagcagaaacgcttatggccgaaggaaacggtagtccctctttgtcatcctcctcttccgttttgggccttgggacaggaaatggtttgcgttttccaaaactttggagaatgggttccaaaagagataaattgaaagaagctgacgaaaaggaggctaaaatcaacaaacaggctgataatatcagacgtgctaggaaattagaagaagagaaaaagttaggagcaaaacttcagtatgagagggacttagaacttcaaagggaaaaattgatcgagttaaaggttaaagaaaaggtcgaatttgaagtggcccaaaagttggaggaggagagagttaagagagaggaagaagaacgcaaacatagagaacaagcggagaaaaaacgtatatcaaccctgaaacatgagaggaaaacaaattacaaatcaagggctagcctcgacaacttctcttccagtagcaaatcttctggaaagattgacaactccctaattaaaagaagatcacttgacgttgtacggacttcaggcgaaagagtacgaacgccagtaagaaaatcaatggaggcagcagaaataggtatggctgcgcagttagcctggtctcagtatcaaaacggggcaaatcattcaaaagtgagtaacaacggatcgcattcaaatgaacttcagatacgttataagccaacaccacctttgaaaaaaaggtatgactacaaaaagccaacagttaatcgaccgattataaaatcacctactcttaacaggcaaaacagcaagtcttcacggaatatacccacaaatagcaagctgaaggctagtaaatccaatactaacaaagtttctcgtaggaatgagcaaaatttggagcctagttcaccagtactcgtttcagcgacagcggtacctgctgaatccaaacccatgcgttctaaaagtggtacacccgataaggaaagctctgctagttcatccctcgattccagaaaggaggatatattaaaatcagtgcagggagtagatcgaaacgcttgtgaacagatacttaatgaaattcttgttacggatgaaaaagtttattgggaggatatcgcaggcttacggaatgcgaagaattctttgaaagaagcagtggtttacccatttctgcggcctgacttattcaaagggctaagagaacctgttagaggtatgcttttgttcggcccaccaggtacaggtaagacaatgattgctaaggcggttgcgacagagtccaattccacattttttagtgtaagtgcatcttctttgctatcgaaatacctcggtgaatctgagaagctggttagagcattgttttacatggccaaaaaattgtcaccctcaattattttcatagatgagattgactctatgttaacagctcgctctgataatgaaaatgagtcctcgaggagaattaaaacagaacttcttattcagtggtcctccctatctagtgctactgcacaatcggaagaccgaaataatacgcttgacagcagagtacttgtcttaggagcaacgaatttgccatgggcgattgatgatgcagcaagaagacgattttcacggaaactatacattcctttaccagattatgaaactagactatatcatttgaagagattaatggccaagcagaaaaatagcctgcaagatttagactatgaattaataacagaaatgaccgaggggttttctggttctgatcttacgtcattagccaaagaagcggcaatggaacctattagagatttaggagataagttgatgtttgcggattttgataaaatcagaggaattgaaataaaagattttcagaatgctctgttgacaataaaaaagagcgtgtcgtcagaatctctacaaaaatatgaggagtggtctagtaaattcggtagtaatggttcctga

SEQ ID NO: 4750 - DNA, 2268 bp, Saccharomyces cerevisiae
atgcgcagattactgaccggttgccttctttcatctgcacgtcccttgaaatcaagattgccattattgatgtcatcctcattaccttcctctgccggtaagaagcctaaacaagccactttggctagattcttcacttccatgaaaaataagccaacagaaggtactccttctcccaaaaaatcatccaaacatatgctggaagatagaatggataatgttagtggggaagaggaatacgcgaccaagaaattgaaacagacggctgttacacatactgtagcagctccaagctccatgggtagcaatttttcttctataccatcatccgctccctcttccggtgttgctgattcaccgcaacaatctcagaggttggtaggtgaagttgaagacgccttgagctcaaataataatgatcactattcgtctaatatcccctattctgaagtttgtgaggtttttaacaagattgaggccatatcttcccgtttagagattataagaatctgttctgatttctttattaagataatgaagcaatcgtctaagaacttaatacctacaacataccttttcatcaatagattgggccctgactacgaagcaggcttggaattaggccttggagaaaatcttcttatgaaaaccataagcgaaacttgcgggaaatccatgagccaaattaaacttaaatacaaggatattggggatttgggtgaaatagcaatgggtgcgagaaatgtccaacccactatgtttaagcccaaacccttgaccgtgggtgaggtcttcaaaaatcttagagctattgctaagactcagggcaaagattcacaattaaaaaagatgaagctgatcaagagaatgcttactgcttgcaaaggtatagaggctaagtttttgattagatccctagagtcaaaattgagaatcggtcttgctgaaaagactgtcttaatatccctatcgaaggctcttttgctccatgatgaaaatagggaggactctccagacaaagatgtccccatggatgtgttagaaagtgctcaacaaaagataagagacgcattttgtcaagtacccaactatgaaattgttataaactcatgcctggaacacggtattatgaatttagataaatattgtactctaagaccaggaattccattgaaacccatgttagccaagcctaccaaggcaattaatgaagtattggatagatttcaaggcgaaacttttacgtcagaatacaaatacgatggtgaaagggctcaggtgcatttactaaatgatggtacaatgaggatttattccagaaatggcgagaatatgactgagagatatccagaaattaacataacggattttatccaggatttggatactaccaaaaatttaattctagactgtgaggctgttgcttgggacaaagatcaggggaaaattttgcctttccaggtcttaagtacaaggaaacgtaaagacgtggagctgaatgatgttaaagttaaagtctgtctctttgcatttgatatactttgctacaacgatgaaaggctgattaataagtcactaaaggaaagaagagaatacttgacgaaggttacaaaagttgtcccgggagaattccaatacgcgactcagataacaacaaataaccttgatgaacttcaaaaattccttgatgagtccgttaatcactcatgcgaaggtttgatggtcaaaatgttggagggccctgaatcccattatgaaccaagtaaaaggtcaagaaactggttgaaattaaaaaaagattacttggagggggttggagattcattggatctctgcgtgttgggggcatattatggtagaggaaaaagaactggtacgtacggtgggttccttctaggatgttacaaccaagacacaggagaatttgaaacttgttgcaagatagggacaggattttcggacgaaatgttgcagcttttgcacgacaggttgaccccgacgatcattgatggaccaaaagccacgtttgttttcgattcgagtgctgagccagatgtatggttcgaacctacgactttgtttgaagttttgactgcagacctttccctatcgcctatttataaagcaggtagtgcaacttttgataaaggcgtatccttaagatttccaagatttttgcgtataagagaagacaagggcgtagaagatgcaacctcttctgaccagatcgtcgaattgtatgaaaaccaatcccacatgcaaaattag

SEQ ID NO: 4751 - DNA, 2268 bp, Saccharomyces cerevisiae
atgtctagcagagacgcctctttgactcctcttaaggcagtagtgatagacgaccctccattgagacaaaccccagaaccattcgatgaacagtcagcttacaatccccagtcgcccattgccattgattttggatcaagcaaactgagagcaggattcgttaaccatgctacccctacacatatttttccgaatgcattgaccaagtttagagacagaaagttaaacaaaaatttcacttttgtcggtaatgacaccttgttggatcaagctgtgcgttcgcaatcgagaagcccctttgacggaccatttgtaaccaattggaatctcactgaagaaatattggactacacttttcatcatttgggagtggtaccagataacggaattcctaatccaatattacttaccgaaagactggcaactgttcaatcacaacggacaaattggtaccagattttgtttgaaacttacaatgtaccaggcgttactttcggaatagacagtctgtttagtttttacaattataacccaagcggaaataaaacaggtttggtcatcagttgtggccatgaggacaccaatgtaattcccgtagttgatggtgcaggtatcttgacagatgcaaaaaggattaattggggaggacatcaagcagttgactacttgaatgatttgatggctttgaagtatccatattttccaacaaagatgtcttatttgcagtatgaaacgatgtataaagattattgctatgtttcgcgaaattatgatgaagatattgaaaaaatcctcaccttggagaaccttgatacaaatgatgtggtagtggaagccccttttacagaagtccttcaacctcaaaagacagaagaagaattacgaattcaagccgaaaaaagaaaggaaactgggaaacgcttgcaagaacaggcacgtttgaaaagaatggaaaaattggttcagaagcaggaagaatttgaatacttctcaaaagttagagaccaattaattgacgaacctaagaagaaagtactctcggttttgcaaaacgctggttttgatgacgaacgtgattttaaaaagtatcttcatagcctagaacaatcattaaaaaaagcccaaatggttgaagcagaagatgatagtcacctggatgaaatgaatgaagacaaaacagcccagaaatttgatttgcttgatattgcagacgaagatctaaatgaagatcaaatcaaggagaaaaggaagcaaagatttttgaaggccagtcaagacgccaggcaaaaggctaaagaagaaaaggaaagagtcgccaaggaagaagaagaaaaaaaattaaaagagcaacaatggcgtgaaactgacttaaatggttggataaaggacaaaagattgaaattaaacaaattaataaaaaggagaaaagaaaagttaaaactacgtgacgaaatgaaggacagaaaatctcaagtttcacagaacagaatgaaaaatctagcttcattggctgaggataatgtcaaacaaggggccaaacgtaatagacaccaagcgacaatagataatgatccaaatgacacttttggcgctaatgatgaagactggcttatttatactgatattactcaaaatcctgaggcttttgaagaagcattagagtacgagtacaaagacatcgtggaactggagagactacttttagaacacgatccaaactttactgaagaagatacgctggaagcacagtacgattggagaaattctatcctccacctgtttttaagaggacctagacctcatgatagcgaaaatatacatgaacaacatcaaatgcatttgaatgtagaacgtataagggtaccagaagtgatatttcaaccgacaatgggcggacaagaccaagccggtatttgcgaattatcagaaaccattttactaaagaagtttggttctcaaccaggaaaattgagtcaaacttccatagacatggtgaacaacgttcttattaccggcggtaatgctaaggtgccaggattgaaagaacgtattgtgaaggaattcactggattccttcctaccggtaccaatatcactgtaaatatgtcttcagatccttcattggatgcctggaagggtatggcagctctagcacgaaacgaagaacagtataggaaaacagttatcagtaagaaagaatacgaagagtacggtccagagtacatcaaagagcataagttagggaatacgaagtattttgaagactaa

SEQ ID NO: 4752 - DNA, 2271 bp, Saccharomyces cerevisiae
atgtataatagcagcaccaatcatcatgagggtgcacctacttcaggacatggctattatatgtcccaacaacaagaccaacagcatcaacaacaacaacaatacgccaacgaaatgaatccgtatcagcaaattcctagaccgcctgctgcaggatttagtagcaactacatgaaagagcaaggctctcatcaatcgttacaagagcatttacaacgtgagacaggtaaccttggcagcggttttacagacgttccagccctgaattatccagccacaccaccaccacataataattacgcagcttcaaatcagatgatcaataccccaccgccgtcgatgggtggtctttatagacataataataattcccagagcatggttcagaacggtaatgggagtgggaatgcacaattaccccaattatcaccgggccaatattctatagagtcagagtacaatcaaaatttaaatggcagttcttctagtagtccgttccaccaaccgcaaacgctacggagcaatgggtcatattcaagcgggttaaggagtgtgaaaagcttccagaggttacaacaagaacaggaaaatgtccaagttcagcaacaactttcccaagcacagcaacaaaattcccggcaacaacagcaacaacttcaataccagcagcagcaacaacaacaacaacaacagcaacatatgcaaatacaacaacaacaacagcagcaacaacagcagcagcaatcacaatctcccgttcagagcggctttaataatggtaccatatcaaactatatgtactttgaaagacgaccagatttgttgactaaaggaacgcaagataaagcagcagctgtaaagttgaagattgagaacttttaccaatcctctgttaaatacgccattgaaagaaatgaaagaagagtggagttagaaacagaactaacttctcataattggtcagaagaaaggaaatctaggcaattgagttctttgggtaaaaaagagtcacaatttttaaggctgcgtagaacgagattatcgttagaagatttccacactgtgaaagtcattggaaaaggggcatttggtgaagtcagactggttcagaagaaagacaccggaaaaatatatgcaatgaaaactttattaaaatccgaaatgtacaaaaaggaccaattagcacacgtcaaggctgaaagggatgttctggctggaagtgattctccatgggtggtttcgctatattactcattccaagatgctcaatacttatatttaatcatggaatttttgcccggtggtgatttgatgaccatgctaatcaggtggcaactatttacagaggatgttactagattttacatggctgagtgtattttggccatcgaaaccattcataaattaggattcattcacagagatattaaaccagataatattttgatcgatattagaggtcatataaaattatctgatttcgggttgtctacggggttccataaaactcacgactcaaactactataaaaagcttttgcaacaagatgaggcaactaatggtatttccaagccaggtacttacaatgcaaatacaaccgatactgcaaataaaaggcaaacaatggttgtggattctattagtctaacaatgtcaaacaggcaacaaattcagacatggagaaaatcacgtcgtttaatggcatattctaccgtaggtacaccagattatattgctcctgagatatttttataccaaggttatgggcaagagtgtgattggtggtcacttggagcaattatgtacgagtgtctgattggttggcctccattctgttccgaaactccacaggaaacgtacagaaaaatcatgaattttgagcaaactctacaatttcctgatgatattcatatctcttatgaagccgaagatctaatccgtcgactattaactcatgcagaccaaagacttggtagacatggtggtgcagatgaaataaaaagtcatccattttttcgcggtgttgattggaatacaatcagacaagtagaagcaccgtatataccaaagttgagctccatcaccgatactaggttcttcccaaccgatgagttggagaatgttccagattccccagctatggcacaagctgccaaacaaagggaacagatgacaaagcaaggtggaagtgcgccagtcaaggaagatttaccttttattggctacacttactccagatttgactatttgacaagaaaaaatgcgttgtag

SEQ ID NO: 4753 - DNA, 2274 bp, Saccharomyces cerevisiae
atgatgcgtggtttcaagcaaagattaataaagaagaccaccgggtcttcttcttcttcaagcagtaaaaagaaggacaaagagaaggaaaaagaaaaaagttccactacctcatccacatcaaagaagcccgcttcggctagtagctcttcccacgggactactcacagttctgccagcagtaccggatcaaagtctacaactgagaagggcaagcaatctggtagtgttccctcgcaagggaagcatcatagtagctctacatcaaaaacaaaaacagcgacgaccccttcttccagcagcagtagcagtagaagttcaagtgtcagtcgctccggttcaagctccacaaagaaaacaagttcaagaaaaggacaagaacagtccaaacaatcgcaacagccatcacaatctcaaaagcaaggatcttcttcatcatctgccgctataatgaaccccactccagtactcactgttactaaggacgacaaaagcacttctggtgaagatcatgcacatcctactttgctgggggcagtatccgctgttccatcatctcccatttcaaatgcttcaggtacagcagtttcttctgatgtagaaaatggtaatagtaataataacaatatgaatattaatactagtaatactcaggatgcaaaccacgcctcctcacaaagtatcgacattccgagatcatcacactcatttgagagactaccaacacccacaaaacttaaccctgacacagatttagagttaattaagactccccaacgtcattcttcatctagattcgagccatctagatatacgccattaacgaaattgccaaattttaatgaagtttctcctgaagaaagaatccctttgttcattgccaaagttgaccagtgtaacactatgtttgactttaatgatccaagttttgacattcaaggtaaagagattaaaagaagcaccttagatgagctaatagaattccttgtaacaaataggttcacttacacgaatgagatgtacgctcatgtggtgaacatgttcaaaatcaatctgtttagacctattccaccaccagtaaatccagttggtgacatttatgacccagatgaagatgaacctgttaacgaactagcctggcctcatatgcaagctgtttacgaattctttttaaggtttgtggaaagtcctgatttcaatcatcagattgctaaacaatatattgatcaggactttattttaaagttactggaattatttgatagcgaagatatcagagaaagagactgtttgaaaacgacactgcatagaatatatgggaagttcttatcattaagaagctttattcgtcggtcgatgaataatatttttttgcaatttatttatgagactgagaagtttaacggtgtggcagaattgttagaaattttgggttccataattaatggatttgcacttccattaaaggaagagcacaaggttttcttggtgaggatattgataccattacacaaggtccgttgtttatcattataccaccctcagttggcttactgtatcgttcaatttctcgaaaaagatcctttattaaccgaagaggtagttatgggcttactgcgttattggccaaaaataaattccacaaaagagataatgtttctaaatgaaatcgaggatatttttgaagtgatcgaaccgctggaatttattaaagtagaagttccgttatttgttcaattagctaagtgtatttcttctccacatttccaagtggcggaaaaggttttaagttattggaataatgaatatttcttaaacttatgtatcgaaaatgccgaagtcatcctacccattatatttcctgcattatatgaattaacttctcagttagagctagatacagcaaatggcgaagatagcatttcagacccttacatgcttgttgagcaagcaatcaattctggttcgtggaatagggcaattcatgctatggcattcaaggcattgaaaatttttctggaaacaaacccagtattgtacgaaaactgtaatgcattgtacttatcaagtgtaaaagaaactcaacagcgtaaggtgcaacgtgaagaaaattggagcaaacttgaagaatatgtaaaaaatctaaggattaacaatgataaggaccaatacacaatcaaaaacccagaattaagaaacagtttcaacacagcaagtgagaataacacattaaatgaagagaacgaaaatgattgtgacagcgagatacagtga

SEQ ID NO: 4754 - DNA, 2274 bp, Saccharomyces cerevisiae
atggctagtttagaagatcttattcctactgtcaacaagctgcaggatgttatgtacgactccgggatcgatacactcgatttgcccattttagctgttgttgggtcacaatcctccgggaaatcctcgatattggaaacgttagttggaagagattttttacctaggggtactggtattgtcacaagaagaccgttagttcttcaacttaataacatatctccaaattctcctctaatagaggaagatgataactcagttaatccacatgatgaagttacaaaaatatcaggattcgaagctggtacgaagcccttggagtataggggcaaggaaagaaatcatgcagatgagtggggggaattcctgcatataccaggaaaacggttttatgatttcgacgatatcaaaagagaaatcgaaaacgaaacagcgaggatagccggtaaggataagggcatcagtaagattccgattaatttgaaagtgttttcccctcatgttttgaatctaacgctagtagatttgcctgggattacaaaggttcctattggggaacaaccacctgatattgaaaagcaaatcaagaatttgatcctagactatatagccactccaaattgtttaatcttggccgtctctccagctaacgttgatcttgttaattctgaatccttaaagttggccagagaggtagaccctcagggcaaaaggactattggtgtcattaccaaattagatttgatggattctgggactaatgctctagatatcttgtctggaaaaatgtatcctctgaaattggggtttgttggtgtagtgaatcgctcgcaacaggatattcaattgaacaaaaccgttgaagaatcattggacaaagaagaggactatttcaggaaacatccagtctacagaactatttcaacaaagtgtggtacgcgttatttagctaaattgctaaaccagacattattaagccacattagagacaagcttccggatattaaaaccaagttaaataccctgatctctcaaaccgaacaagagctcgctagatacggtggcgtaggagctactactaatgaaagcagagctagccttgttcttcaactaatgaataagttttctacaaacttcatttcatctatagatggtacatcctccgacattaatacgaaggaactctgtggtggtgcccgtatttattacatttacaataatgtttttgggaattctttgaagtcgattgatccaacttctaatttatccgttcttgatgttagaacagcgattagaaattctactggtccccgtcctacattatttgtacctgagttggcttttgacctattggttaaacctcaaattaaacttttactagaaccatctcaacgttgcgtcgagttagtttacgaggagctgatgaaaatatgccataaatgtggctccgctgagctagctagatatcctaaattgaagagtatgttaatagaagttataagcgaactacttagagaaaggttacaacctactcgctcttacgttgaaagcttgattgacatacatcgagcctacatcaatactaatcatcctaattttttaagtgcaacagaagcaatggatgacatcatgaaaacgcgtagaaaacggaatcaagagttattgaaaagtaagttgtctcaacaggagaatggacaaaccaacggtattaatggtacttcatctatctcttcgaatatagatcaagattctgctaaaaacagtgactacgatgatgatggtatcgacgcagaatcgaagcaaacgaaggacaaatttttaaattatttctttggcaaggataaaaagggtcaacctgtgttcgatgcatcagacaagaaaagatccattgccggtgatggaaatattgaagattttagaaatttacaaatatcagatttttcactgggcgatatagatgaccttgaaaacgctgaacctccactgaccgagagagaagaattggagtgcgaattaattaaacgtctgattgtttcatactttgatattataagagaaatgattgaagatcaagtaccaaaggcagttatgtgtttactcgtcaattattgtaaggattctgttcaaaacagattggtaaccaaactctacaaagaaacactgtttgaagaacttttagttgaggatcaaactttagctcaagatagagaactatgtgtgaaatcactcggagtttataaaaaggctgcaacccttattagtaatattctgtaa

SEQ ID NO: 4755 - DNA, 2277 bp, Saccharomyces cerevisiae
atgacgccgaaagaatctggaaagcctatttcgtgtgcaatgaagaagttgaaaggcaagagatctaagattttggttttatctagagatgcgggcaccaacgaattgaagccaacgaaaggaagagcacatcgagcttgcatagcttgcagaaagaggaaagtacgatgtagtggtaatataccatgtagactttgccagactaatagttacgaatgcaaatatgatcgccccccacggaactcatcggtatttgatagggaagtaagcgatgatagttccttatatgcacagagagcttcccacgaacgggaagatagcaagggccctataagttccattgattacaaaaaggttgtagagacgatctttccacctgaaacactccgtcaaatacttgcttcttcttcttttaacagccagaattttttggacactattaaaacgtgtctacttcaaggacaattaaatgttaatcaggtaatacgtcaaagtctaccaaaagatacgccttggcacatgcaaacaagtgttccattaccacccagagagattgccttgaaatttattcaaaagacctgggattgtgcctgtgtgctatttaggttctatcacagacctactatcatttctatcttggactcgatatacgaagcagaaaaacatggcaagcaatatactccagaacaagtgaaaacacaacctttaatttattctgttttagcagtcggagcccttttttctaaggaagatctcagcaaggatagtaaagcaactagggaattttacactgatgaaggctacagatactttttagaggccaaaaactctttggacttttctaatattactgacatctattccattcaagctatatttatgatgacgatctttttgcaatgttcagcaaacttgaaggcttgctattcgttcattggtatcgctctgcgtgctgcgttaaaggaaggtttacacaggcggtcttccatagttggtcctactccgattcaggatgagacaaaaaaaaggctcttttggtctgtgtacaaactagatctgtacatgaattgtattcttggttttccaagcggtatcgacgaatctgatatcgaccaagagtttcctctagacgtcgacgatgaaaatatatctactattggaataaagtttcaagattggcgaacgataagttcctgtggaatgaataataagcatacaaagcttattttaatcatgtctcggatctacaagctaatgtactctttgagaagaaaaccattagaagaggattctaggacgcagattgtatcgttgaacgatcaattagataattggtatgcccaattaccagatattttgaaggttgacacaatacggtatcgtcaaacgcaaccacctctaactgtttccgcaaatgatactagttctccatacactaaacctaagaaattattatatctggacttccttctatccaaaatcgtactctataaaccattctaccactatatttctatagacccgttagatatcccagagttccaatttcaaattcacatggcggaaaactgtattgaagttgccaaaaaagttattcaattatcttatgaaatgattacgcaaaaccttttgagtggtagctactggttttccattcatacaatcttttttagtgttgcttgcctcaaattttatgtctaccaaacagaaaagggcctgatacgaaatgggaaggttgattcggatattcataacgctacgcagcttggcagtgaaatattatcacttttgaagggtgcttcaaatgcgagtaaacgtacttttgaagtattgaaccaattgttcaaagagtttaacgagaagacctctgtattatctgaacaacttttgaatatagttaaattgcaacggcaagaaagtagtggagctttagtgccccagttgcagacaaataataattttacgaagtgccaaggagaattacatcatggacagcagcatcaccaaactccagccacgagtcttcgttccattctgaatcttccacaaggggaagctgatctaaagtttcagaataccaataatgagagccatacaacgacagctgcacaagaagaatacttagataaacttctagcagaatttgaggaatttgactactcaattaacagagtattacctgatgtcatcgatttttcagcactaattggccaagattcttctgccaacaatcaaatattttcctcagaattcagctctgacccaacagtaaattga

SEQ ID NO: 4756 - DNA, 2277 bp, Saccharomyces cerevisiae
atgatcatcagagctccaataaggacaaaaaccaagtcgtttagaggcgatcaaatggattttaaattcccgtctaacgaaagtttaccaagaggaacgctagaagagtaccatttgaataatcatcatcttttaaatgatgtgtttgcagcagaaaatggagtttctcgcgatgaagacggaaactctcaaacattatcagactatacatccacttccaatacaaatacaaattccggttattcatcaaatggatactattcatttgctaacatttctgacaatactacgtcttcaccacgtattgtaatcaatcaaaatgaaaccgctagattaacttcctcagactcgaacaaaagtgacttttttgcttctcatgacttcccaggaaatgactctcttcattatagcagctcaaatgtagttaaaaaccagttacattcaatggaagctattccagagggaaacataactggctcaatctcaacggcattccagactatcccaacagcagataatgtttcctacgatatcgcgccgtcatcagcatcatcgttattaccaaggaaatcgacatctaaaagcgccattctgccgtcgacccaagaagccaaaccgatgaccaaattaaatatggaaaaggatataaaaactatcgaattaaacaatagcgtagtaccgaaacctaaaaaaaagctaaacagagttccgaccataagacgagttgaatcctcgaggttttccaattccaggtatagttcaagtgtcagcagtaaatcaagtagcagtcgttgttctctaaaacgatcaaaagctattagatgtaagggcggactcttatattatttcacctcattgggaatcaagataaagaaaaagttacggaaattacggctagttttaagaagaagactgttttcatataatgttcaaaaggtcccctccgccacgaattccaaaaccactaaatctaaagcaaacattaacaacaagtcaaaaaaaagagggacgaacctagtcaacaaaaacagcaactctactccgcgtcaaaaaaaatcgcagagatacgtctctaatttacaacggtcgatctcatcaaaatctttagtacctgtattggctccacaaaaaaagactaaacctttgacagttgatacgaaatttaaagcaaaccatccccaatctgaagattccaaagttggatcaaacaccccaaggagccctttggtaagctatactccatcattgagaagaacaaattcctctattagaagggctgcatccatcctaaccgcatctgccactatgacaccggcaaataataaaaactccttcatttctgtaccggataatgttagtcatgccgtcactcgcaacagcagcatgtactcgaggtcaagattggtaaggtcaaaaccatcgacggccctaaatgcaattgcaagacagccatcaattgtggtagaaaataaagttattccgttatccatgaatcgatattctattaaagaggaagacgaatatgtaattgatactagttctatgagagaattatctcccgttaatagcgtttgctcatctgattatgacagagaatcatctgaaagctactctaattatgcggatgcaatggagacaacggaagtagataataaggacagagttgaatgcaacaatgaaattcaaaatgtggatgcaaataatgaggaaacttcaaatgaagagagttacaatttgatgaaacattatttaagcaccgtaattgctcaaagaattatgctcagggtacaaattgctcgtatacaaaattataagagcaatgttgtttatatgaataaatcagcagaaacaaactcaactatctacgaagatcttgtcgattctctattaactgaatatgaggctgatggtagctcctcccaaatatttgatggcgttacagtaagggccgacgaggaagaagaagaagatgaagatgatgaagatgatgaagaagaagaagaagaaaatgatgatgaagaagatgaagaagatgaagaagatgatgaagatgatgaagaagaagaagaaaaaagaaaagaaggagaaggaagaaatttggcaaaagaggtagacgaattagcggaattaagtccgatgagaaaacaaagcgatttgagtattacgttaagatctccatttgctatgctaaatcctgcctactcaaacagcattatatcgctaccaacaggtgtggtcaagaggtcattgactcttcctgtcggtatgaaaatttaa

SEQ ID NO: 4757 - DNA, 2277 bp, Saccharomyces cerevisiae
atggaaatcgatggcaacactctggtgttcataatagtgatccttttcctatttttctcctcaccgggtggtgatggtgtgtcttctcaatatgagttcaatcaactccagagactcaagcagcagttccgaacagagcacaatacgttcgtcaatatgacatatacagatagttttcgaaatattaccgggcttaaactcagctaccaagacatgctgaataatcctctccaaaatgccacttacccactaccaggaaaagattatgatcgatggtttcccaatcaaaactacatggttttgcccaacgatgtcatagaggccataaatactgaagtctggaatacttcgaatgatgacgcttccaaccttttccctcccaatattacaagcaccctgttaggtaaaatcgaccttgtatcaaataacaagtacgaaaagataaggatgcctgtacccagattctatgagccggcaactgatttttcagaggatattcctcctgaaggtgagacgtactggtctgagtggccttcgtatggcgaacttcataatgtgagttttcagcatggcgaaatagctattcaaatttctcatatgagcaatcttcaggacaataataattacttaaggagaaatttcataaataagaaaaatgaccgttggaagttgttaaatcttcagattgatttctcagataaggctgaaaaggaaaagcattccatatactcgaaggctgtatatgacattcaacgtggtagaattctttctatttctcagagttctaaatttcattcattgttcgcccttcctcattacatgtccttccagaatgattataatgagaaaatatttaatgatgtcaaggaactcgttgatgaattttggaatttcacggattacacagatgtcatgaccatgaaagacgtacaggatgcttataataatgccaactttaaatgtgagtatttgatttttcttcagttggaaccatggaatcagtacacaagagatcagatcaagttaatagatgatgaattgaattggcccctggggcgtccggcaaatctgtctagtttaccgcccataaatgttgtctctggattactgtattctccagactgtggcgtacgattagggcttcataacgtaaagggtacacggtacgaattaaaaataatgtcgatcagaaaacatctattgttcggtattgcattatttgcagcccagatatacttattgcttactcagatgcatcatacaaataccccctccatggtcaacaaaatctcattctattgtttctcaatgataaacttagtcgatggttccttggccactttgtactttgtcgcagctagtgtcgttcccgaattgtacttacccctagttataagtgctttttcgtgctttatcttggcatctatttttgaaatacgctacttaatttcaatttacgcttcacaggttaacgaacagaatgttgggattatcaacctcctgcgtggtaacactggcacatatgatgagaataggccaagacccgcattcattcccgatgaagggtctatcggtggctcgttatatggtaggtttttctttatgctaatcattttcacgtttttaatattgagttcaacttcatggccccgtcagctaaggatggtatttgagtatatcctaatcttcatattaaactcatattggatccctcaaattttccgtaacgccgttaaaggtattccttcaagaagagaaagagcaagatctagcattggaggaaatagaagtcaaaacaaaatgccattattgtggagttttgtaattggtacaacaataattagaagcttgcccgttgtgtatgttttcacttactcctctaatgtgttcaggcaccataaagatgttcatttcgtcgtatttttatcattgtggctactgtttcaaattagtatactgtattctcaagatgtattgggatcgcgctggttcttgcctaagcacacaatacctgatggatattcgtatttcaagcccctttcaaacgagtatatatcggagcatggtggtggaactgctgaacataccgttgattgcgcgatatgtatgtctgatgttccaatttacatagaggaaattccagaaactcataaggtggatcagcactcttacatggtaacgccttgtaatcacgtatttcatacttcgtgtctagaaaactggatgaattataagttacaatgtcctgtgtgtaggtcaccattacctccgttgtag

SEQ ID NO: 4758 - DNA, 2277 bp, Saccharomyces cerevisiae
atggataacacgaccaatattaatacaaatgagcgctctagtaacacggattttagctcagctcccaatatcaaaggtttgaatagccatactcagttgcagtttgatgcggattctcgagttttcgtttcggatgtaatggctaagaactctaagcaattattgtacgcccatatttataactatttaatcaaaaacaattactggaactctgccgcaaaatttttaagcgaagctgaccttcctttatctagaataaacggatctgcttcgggtgggaaaactagcttgaacgccagcctgaagcagggattaatggatattgcatctaagggtgacattgttagtgaagatgggctattaccttcgaaaatgctgatggacgctaatgacacgtttttactggaatggtgggaaatttttcaatcattgttcaatggagacctagaatctgggtaccaacaggatcataatcctttaagagagagaataataccaattttgccagctaattctaaatctaatatgccttcccatttctctaatctcccaccaaatgtgattccaccaactcaaaatagttttccagtttcagaggagagttttaggcccaatggtgacggaagtaactttaatttaaacgatccaaccaatcgaaacgtctccgaaagatttctatcgagaacttccggtgtctacgacaaacagaatagcgctaattttgcacctgatactgctataaacagtgatattgctgggcagcagtacgcaactataaatctacataaacacttcaatgatttgcaatcaccagcacagccccagcaatcatctcaacagcagatccagcagcctcagcatcaaccccagcatcaaccgcaacagcaacagcaacagcaacaacaacaacaacaacagcaacagcaacagcaacagcaacagcagcaacagcaacagcaacagcaacaacatcaacagcagcaacagacaccgtatcctattgtcaacccacaaatggtccctcatattccatcggaaaattctcattcaaccggacttatgccttcagtgcctcctacaaatcaacaatttaatgcacaaacccaatcttcaatgttttcagaccagcagcgcttctttcaatatcaattacaccaccaaaatcaaggacaggcgccatcttttcagcaaagccaatctggcaggtttgatgacatgaacgctatgaaaatgttttttcagcagcaagcactacagcaaaattcactacagcaaaatcttggaaatcaaaattatcaatctaatacacgtaacaatactgcggaagaaactacgcccacaaatgacaataacgcaaatggcaatagtttattgcaagaacacatacgagcccgcttcaataagatgaaaacaattcctcaacaaatgaaaaatcaaagcactgtcgcaaatccggttgttagtgatataacatctcaacagcagtacatgcatatgatgatgcaaagaatggcggctaaccagcaattacaaaatagtgcctttcctccagacactaatcgtatagcgccagctaacaacactatgccattacaaccaggaaatatggggtctcctgtcattgaaaatccaggtatgaggcagactaatccatccggacaaaaccctatgatcaatatgcagcccttatatcaaaatgtttcttccgcaatgcatgcgttcgctccgcaacaacaatttcatctaccacaacattataaaaccaatacttcagtaccacaaaatgattctacctccgtctttcctttgcctaacaataacaataacaataacaacaacaacaataataataataataataatagtaataatagtaataataataataataataataataataataataatagtaataatacacccacagtatcacaaccatcatcaaaatgtacttctagctccagcacaactcctaatataactacaacaattcaacccaagcggaaacagagagtgggtaaaacaaagaccaaggaatcaagaaaagttgctgcagctcagaaagttatgaaatctaagaaactggaacaaaatggtgattcagctgctacaaacttcatcaatgtcactccaaaggacagtggcggtaagggtaccgtaaaagttcaaaacagtaactcgcagcaacaactaaatggctctttttctatggatacagaaacattcgacatatttaacattggtgacttttctcctgatctaatggatagctaa

SEQ ID NO: 4759 - DNA, 2277 bp, Saccharomyces cerevisiae
atggcggtaaatcctgagttagcaccgttcaccctctcgagaggaatccccagctttgatgatcaagctttgagcaccatcatacagcttcaggactgcattcagcaggctattcagcagttgaactacagtaccgcagagtttttggccgaactgctctatgctgaatgctccattctcgataaatcaagtgtttactggtccgatgcggtatatttatatgcactttcgctgtttctgaataaaagctaccacactgcgttccagatatccaaagaattcaaggagtatcatcttggtatcgcttacatattcgggcgttgtgctttacagctttcgcagggagttaacgaagctatcctcactcttctctcaataataaatgtattttcttcgaacagcagtaatacgcgcataaatatggtgttgaattctaatctcgtccatattcccgatttggccactttgaattgcctgttaggcaatctttatatgaaactggaccattctaaggagggagcattttatcattctgaagcattagccattaatccttacctttgggaatcttacgaagcgatttgtaaaatgagagctaccgtggatctcaagagggtttttttcgacattgcagggaaaaaaagtaatagtcataataataatgcagcttcatcgtttccgtctacatcactatcgcatttcgaacctcgttcacaacctagcttatattcaaaaacaaacaaaaacggcaataataatatcaataataatgttaatacactgtttcagtcgtctaattctcccccttctacatcggcatcttctttttcttccattcagcatttctcaaggtcacagcagcaacaagcgaacacatcaataaggacctgccagaacaaaaatactcaaactcctaaaaaccctgcaatcaacagtaagacgtcttctgcgctaccaaataacatttccatgaacttagtgtctccatcctccaaacagcctacaataagctcgttggccaaagtttataacagaaacaaacttttaacgactcctccatcgaaactgttaaataacgataggaaccaccaaaataacaataataataataataataataataataataataataataataataataataataataataataacattataaataaaacaactttcaaaactccaagaaacctatattcctcaacaggaaggttaacaacttccaagaaaaatccaaggtctttaataatcagtaactcaatactaacgagtgattattcaattacgctgcctgaaatcatgtataatttcgctttaatattaaggtcgtcatcacaatacaattcgttcaaggcaataagactgttcgagtctcaaatcccatctcatattaaagacacaatgccatggtgtctagtgcaattaggaaaacttcattttgagatcattaattatgatatgtccttaaagtatttcaatagattgaaagacctacaaccggcaagggtaaaagatatggaaattttttctactttgctgtggcatttgcatgacaaggttaaatcttcaaatttggcaaatgggctaatggatacaatgcctaataagcccgaaacatggtgttgtataggtaatttgctatcattgcaaaaggatcatgatgccgcaataaaagccttcgaaaaagctactcagttagacccaaattttgcatacgcgtatactttgcaaggtcatgaacattcttccaacgattcttcggattctgccaagacatgctatagaaaggcgctagcttgtgatcctcagcattacaatgcatattacggattgggtacgagcgctatgaaattaggtcaatatgaagaagcgttgttatattttgaaaaggcaaggtcaattaatcccgtcaatgttgtgttaatctgttgttgcggtggttctttagaaaagctgggctataaggaaaaggctctacaatattatgaactagcatgtcatttgcaaccgacttcctcgctatccaaatataagatgggccagttgctctattccatgacaagatataatgttgctttgcaaacttttgaagaattggtgaaactcgttcctgatgatgccacagcccattatttgctgggtcaaacatatagaatagttgggaggaaaaaagatgcaatcaaggagctaactgttgctatgaatttggatccaaagggtaaccaagttatcatcgatgaattacaaaaatgtcatatgcaagaataa

SEQ ID NO: 4760 - DNA, 2277 bp, Saccharomyces cerevisiae
atgtctgaactctctcaaatgacattgaagatcctttacacattggataatggatccaatggtagttatttagcccgctcaagggctccaaaacaggtaagagttgctaatattcctagtccattcccgacagattcgaatgagcaaacggagttgcgaattggcgccatccatttgaagactatactgcatgaaatatacttaaattcacctgaagtgttagaccatgacactttaaaagatggatatgattataacttgtattatcgtgacatatgtgaagtggatgagccattagtaagccttggtcttctttccgggcttcgaaaaaagtttcataagaatagcccctaccagtatacagaaaacaatattggtgaagaagaaagtgaagagagagatgaggtaactgaagaagagtatgaagatgaatcttttatagttactggaagggtatgctcgaatgtttccgctttactacgaagatcatatagcaacatctcgaataaaaagggaagggtcgtaaacaaccaaattccggaagaaactttggaggttaaactaagattcacaaaagttataaccaatttaaggacgtctggtaacaatactacaaattctcggatatcgtgtcttcaaatgccgtcttctttaccatcagcaacacttccgtttaccccaaaatcgcaatctcttttcaagacaaaccaaataaaaaattcaaggaatgcaaggaccacgataacaataaataatactaatagcgggactgtgggaagaagacagacgaatcctatgcctgctccaaaagctgtcagaactcagtctttacccatctggaatcttaaaccaaatatagcgaatactggtttcccaagaaattcaattgcgcacaaaatctacttagcagatagaaaaacagaagccaatcaacaaaacaaccagcatcaaaacatagcttacgaaataaatactttgcaaaacgataatactattcagaggaccaagatcgatgattcggtaagcaagaggttcgattttatgctcaacaaaagaaagtctacgaaaaaagtgtcacctggtatagcaacgatagcaaaaaaaccagcttcaataaacataaatccaaagcaaccgccgaagactagtggtgaaaaaaaagcaaatgataagcaaacgattgtcaaagttaagaattcgaattccaaaaattcggctaagtctacacaagcaggatgtaggcgatcatcagtgatagaacatttaaatgatcatgacgattcaattttaagtgacattctatcggaaccaggcattgaagggcagaaattgcagcaaaaacaaaaggggcgtaagatatctttaactagtgaaaatgataaagaaaatattccaccccaaagcataactagtaaagagaacaagcttgaaggtgacttggattttaacgctgagttccccatgagtgacttttcggatgtagtatttaaagatgagatgggatggttttccaatttcaattgcaatttttttgaatcaccaacttctgcaagtgcatcacaactcaatcagcaaaatttgaagccttctataacactcaacgatccaaacacctgtaacaccattgctctcgaaaatgaagatgtcagtgaattggaaacagcgcaaaataataaaatatctttgcctagcgatgttgacaaaacctccccaatagactcgttgtctatacctttaattgaacttacacattcaagctcgacaacaaacatgcagcgtatatccattaaagaaggatcgacactaaatataacagatagtaataatgccaccccatgtgataatgatataaaagatagaaaggcatctgtaatagattcggacaatacaaaacctcaggcagggcttataaatttctctactccagctgaccagccagcttctgataataatgttacagcttcgaaaaagcttactagcatgctggaaactcagcaaagtaagagatctcatgaagaagttttggatgaagaggaagaggaggaagccctcaaaaagcaaaaggcaataccgtcttcaccatgtgggatgttcaattatcatcaacccatggaattatctgaggacatagttgaagaagagcaaggacacaatatcggcgatgataatgaaagcgataagaccaacgatttattctcaacattcatccattcaggaataagagtaagtcaggtagtaacaagtcccatcggtgaatttcagtcaataaaacactga

SEQ ID NO: 4761 - DNA, 2277 bp, Saccharomyces cerevisiae
atgttcaagatacctggttttggaaaagctgctgcaaatcatactccaccagatatgacaaacatggatacccgtacacgccatttaaaggtgtcaaactgtccaaataactcctatgcactcgcaaacgtagctgctgtctcaccaaatgatttccctaataacatttatattattatcgataatttatttgttttcacaactagacactccaacgacattccaccgggaaccattggatttaacggtaaccagcgtacctggggtggttggtccctaaatcaagacgtgcaagcaaaagcatttgatttattcaagtattccggtaagcaatcgtatcttggttcaatagatatagatatctcattcagagctagaggtaaggcggtaagcacggtattcgatcaagatgagttagccaaacaatttgttcgttgctacgaatctcaaatattttctcccacccagtaccttatcatggagttccaaggccatttctttgacttaaaaattagaaatgtccaagcaatcgatttgggtgatattgaaccaacctccgctgttgcaactgggatagagacaaagggaattttgacaaaacaaacacaaattaattttttcaaaggaagagatggtttagttaatttgaaatcatcaaattcattaagaccaagatcaaatgctgtgatcagaccggatttcaagtttgaagatttgggtgtcggtggtttggataaagagtttactaaaattttcagaagagcgtttgcaagtcgaatctttcctccttcagttatagaaaaactgggtatttctcatgttaaaggtttgctattgtacggtcctccaggtactggtaagaccttaattgcaagaaagattggtacaatgctgaatgccaaagagcccaaaatcgtcaatggtccagaaattttgagtaagtacgttggttcttcagaagaaaacattcgtaatttatttaaggatgcagaagcagaatatagggccaagggtgaggaatcttccttacatattattattttcgatgagctggattctgttttcaagcagagaggttcaagaggtgatggtaccggtgtaggggacaatgtagttaatcaattgttagctaaaatggatggtgttgatcaattgaataatattttggttattggtatgaccaatcgtaaagatttaatagacagtgctcttttgcgtccaggtagatttgaagtccaagttgaaattcatttacccgatgaaaaaggaagactccaaattttcgacattcagacgaagaaaatgagggaaaataatatgatgagcgacgatgttaacttagctgagttagctgcgttaacaaaaaacttctctggtgctgagattgagggtttagtgaagagtgcaagttcttttgcaatcaacaaaaccgtcaacatcgggaaaggtgccacaaaacttaacactaaagatatagcaaaacttaaagtaacaagagaagactttttaaatgcactcaacgatgttactcccgcttttgggattagtgaagaagatttgaaaacatgtgtggaaggtggaatgatgctttattccgaacgagttaactcaatattgaagaacggagcccgttacgtccgccaagttcgcgagagtgataaatccaggttagtatctctattaatccacggccctgcagggtccggtaaaacagctttagccgctgaaattgctttaaaatctggattcccattcatcaggttaatttctcccaacgagttgtcaggcatgtcagaaagcgcaaaaattgcctatattgataacactttcagagatgcgtataaatctccactaaacattcttgttattgattcgttagagactctagttgattgggtaccaattggtccaagattctctaataacattttacaaatgctaaaggttgcattgaagcgtaaacccccacaagaccgtcgtttattgatcatgactactacatcagcttattcggtacttcaacaaatggatatcttgagttgcttcgacaatgagatagcagttccaaatatgaccaatttagatgaattgaacaacgtcatgatagaatcaaactttcttgacgatgctggtagagttaaagttattaatgaattatcaaggagctgtcctaacttcaatgtcggtattaaaaagaccttgaccaacattgaaaccgcaaggcacgatgaagatcccgtgaacgagcttgttgagttgatgacccaatccgcataa

SEQ ID NO: 4762 - DNA, 2280 bp, Saccharomyces cerevisiae
atgacagcgccattgtggccaaacaagaatgaaaaaaaccacacagttaaaagagcgttatcaacggatatgaccagcaatattttgagtagcacaaacgcgagctcaaacgaagaaaattctaggagttcttctgcagccaatgtacgctccggaacaggtgcaaatacacttactaatggcggcagtactagaaagagacttgcgtgcactaattgtagaaatagaaggaaaaaatgtgatttaggatttccctgtggtaactgttccaggttggaattggtttgtaatgttaatgacgaggacttaagaaagaagcggtacactaataaatatgtcaagtctttggagagccatattgctcaactggagaccaacttaaaaaacctagttcagaagatctaccctgacgatgagcaaatactgaaccgaatgatggtaggtgatgtattatcagctctaccagacagttcacaagtctcaatcaattatactgaccaaactccctctcttccaattcccgcaaccagaggtacattcattattgaaaacgataaggtcagtcaacctctatcgtcctttaaccaacaaacagagccatctactctaaactcgggtatcttcaacacccaaaaacaaaatttcgaagaatcccttgatgatcagttacttttacgaagatcgttaacaccgcaaggtgaaaaaaagaagaaaccgttggtaaaaggtagtctttatcctgaaggacctgtcagttacaaacggaagcaccccgtaaaatcggacagtttattgcctgtgtcttcgttaacagctgctacagacccatctactttttctgacggtataactgctggtaattccgtcctagttaatggtgaactgaaaaaacgtatatccgacttgaagaccaccgtaatagtaagaggactaaacgatgataatcccaactctatcaataacgatcccaggattttaaaatctctttccaatttctataagtggctgtatccaggttattttatttttgttcacagagaaagttttctttatggattcttcaatcactccaagaataactatgaagactcaagttactgttctgtcgaattgatatatgccatgtgcgctgtcggttcgaggcttacaccggatctacaagaatattcagaagtgtattatcaacgaagtaagaagactttattacagctcgtctttgatgagcaaagtacagcccgtatcaccaccgtccaagcgctattttgcttagccttttacgaactggggaagggtaataatcaattagggtggtacttctcgggcctggctatcagggtcggctacgacatgggatttcaactggaccctaaagtctggtacgttgatgataacaatctgcagctgacccaaagtgagttggaaataagatcaaggatttactggggttgctatatagcggatcattttatttgcctgatgttgggtagaacgtccacattaagcgttagtaactcaaccatgccagagtcggatgagctgccagaagtcaacggcaccgaagagttcagatttattggaagacatgttttacagatatccttgcctctgaaaaacttgataattctatcaaggcttgtacaaatcttcacctctaaaattttcatcgagtcggaagatatagcacgaaaactaaagtacttgaacactttcaattctcaggtttacaactggagacaatctctaccggaatttttgcaatggtcgaaaacactcatcgagaacgatgacgtatccacagaccccactatatcttacttctggtattgctactacatagtgcggctcacctttaacaagccatttatagaagactctcaagaatccgaaacggtagtcatagagatcatcgatgatttgaagactttgctggacaatttcgggaaaaaattcggaaactacacgaagggaaacctttaccaactttactcatgcctgttggccatcaactgtttgaagaagttgaaagagatacgttccagtgagcaagactcatggaatgcacaattggattttttcaatcacatcttctacacacaactatatcccgcatatgatctgccgaaaaagctgcaggaggatacggagctggaaacagaacaagaaaaccagatgttgaaccaagttggaaatataaactacacgcacgatttttcactctcccacgaaattgacgatcttatcagagaactgtttggggtgggcacacctcaaaaactctga

SEQ ID NO: 4763 - DNA, 2280 bp, Saccharomyces cerevisiae
atgagtaaagccaagggaacgggattttcatcaattgatactgaagatgaaaacttacgcgaacgttatgttaatcaaccaaaagctaatgcctccgatattcaagatgaacaattagattgctttgagcaactagaagaaaaacataggacaaaaaaaaatgaagaatacactgcgttgaaaattttaagggatgtcataggtccccttttattaactataacttcgttttatctaagattccaacatatagatcagaacaattatgttgtctgggatgaggctcattttgggaaattcggatcatactacatcaaacatgagtactaccacgatgtccaccctccacttggtaaaatgcttattgcattgagcgaatggatggcaggatttgacggtcaatttgacttttcctctaataatgcatatccggaaaacgtaaactttaaactaatgagacaatttaatgccacatttggagctctatgtacaccagtagctttctttacagccaaatggatggggttcaattattttactgtttatttgattgctacgatggtaacgttggaacattcatatattgtcctctcaaaattcatattgctagattcaatgctgctttttttctcgatgacgacttttgcctgtatgataaagttgtatacgttgagaaagcaacaaatgacgaaaaaatggtcgttatggatgttattaactggtttatctattggttgcgtttgttctgtgaaatgggttggtctttttatcacagttgtagtcggcctctacacatgtatagaactatttttgctctattgtgataaagaattgcctagaataaaatattacaaacattggcttatcagaatcattaatctgatagtaattccttttcttatctatctctattgcttcaaaattcactttgtgttgttgtacaaatctggcacgggggattctactacaaatacgttatttcagataaacttggagggaactcagattgaggcgggtcctcgtgatgtagcatttgggtcagagttaaccataaggtcgcatggtttaagcccgaatctgctgcattcacatattcaagtatacccagaaggctctggacagcgccaaatcactggatatggattcgcagactctaataatgtttggaagtttgaattttctaggtcttctggattggaactagatcagaacgggactttgaatggcaaaataatcccaataacggatggtgtggaagttcgtctcagccataaaaatacaggatcgaatcttcactcgcatgatgtaccttctcacgtctctagaggaaattatgaggtttcaggctatgggtcacaaagtgttggcgatgaaaaggatgattggatagtggagattgtgaaacaaatggattcaccaaatcccgtctattctaatgagaattcaactattttacatccagtttctactttcttcaggttgagacacaaagttttaggttgttacttggcttctactggattgacgtatccagcttggggatttaaacaagctgaaatcgtctgcaaagactcctggagtcgtagggacaaatcgacctggtggaatgtagaagatcactggaaccacaatttagaaaccgcagaagattacgttccaccaaaatccaatttttggaccgattttattctaactaattttgccatggcctcctctaataacgcgttagtgcctgatgaggataaatatgatagtttatcgtctgatgcatgggaatggccaaccttgcataaagggctaagaatgtgttcatgggcgggatatatcactcgatattacttgatgggatctcccttcaatacatggatttctactgtctccttaatcatcttcccatttattattctttttatattatatcgttggaggagacaaacgctttatctctcagacgatcaaatctggcaaataacgatacagggtatttttcctttcatttcctggatgacacattatctgccttttgcaatgatggggagagtgacgtatgtacatcactacgttcccgctttatattttgcaatgcttgttttcggatttgtgcttgatttcactttgacaagagtccattggatggtcaaatatcccatctatttgtcattgtttggcggatgtatatacatttataatttatttgctccaatatgtcagggtatgcatggtgataaagcggaatacttacctttgcagtggttatctacttgggatatcgcaccttag

SEQ ID NO: 4764 - DNA, 2280 bp, Saccharomyces cerevisiae
atgcctaatctattgtcgagaaacccattccatggtcatcataatgaccatcatcatgaccgtgaaaattcgtctaataacccgccacagttgatcagaagttctaaatctttcttaaacttcattggtagaaaacaaagtaatgactcactaagaagcgagaaatctacagattccatgaaatctaccacaaccactacaaattatactacaacaaaccttaataacaacacccatagccattctaatgcaaccagtatctcaacaaacaactacaataataactatgaaacaaaccaccaccataatatttctcatgggctccatgactatacttctcccgcctctccaaaacaaacccactccatggcagaattgaaaaggtttttcagaccttctgtaaataaaaaactatctatgtctcaacttcgttccaagaaacatagcacccattcccccccaccttcaaaatcaacttctacagttaatttaaataatcactatcgtgcccagcatcctcatggctttacagaccactatgctcatacccagtctgctataccgccaagtaccgattctatcctatctttgtccaataatattaatatatatcacgatgattgtattctggctcaaaaatacgggaaattgggtaagttattgggttccggtgccggtgggtccgttaaagttcttgtgagaccaactgatggtgctacttttgccgtcaaagaattcagaccaaggaaaccgaatgagagtgtgaaagaatatgccaagaagtgcaccgcagaattttgtattggttcgactttacatcacccaaatgttatcgaaactgttgacgttttctctgattctaaacaaaataaatactatgaagttatggagtactgtccgattgatttttttgctgttgttatgacaggcaagatgtctcgtggcgagatcaactgttgcttgaagcaattgactgaaggtgttaaatatttacattctatgggattggcacatagagatttgaaattggataattgtgtcatgacttcccagggtattttgaaattaattgattttggtagtgctgttgtgttcagatatccttttgaagatggcgtaacgatggctcatggaatcgtgggtagtgacccttacttagcgccggaagtgattacctccaccaaatcttatgatcctcagtgcgtcgatatatggtctattgggatcatatattgttgtatggtgcttaaaaggtttccatggaaagcccctagagattctgacgataattttagattatattgtatgccggatgatatagaacacgactatgttgaatctgccaggcatcacgaagagttactgaaggaaagaaaagaaaagcgtcaaaggtttttgaatcacagtgactgttccgccatcaatcagcaacaaccagctcatgaatcaaacttgaaaacagttcaaaatcaagttccaaatactccagcatctatacagggtaaaagcgataacaaaccagacattgtggaagaagaaaccgaagaaaataaagaagatgatagcaataatgataaagaaagcacgccagataatgacaaggaaagtaccatcgatattaaaataagcaaaaatgagaataaaagcacggtagtttcagctaacccaaagaaagtagatgccgatgccgacgctgattgcgatgctaatggtgactctaacggcagagtggattgcaaggctaacagtgactgcaatgacaaaacggattgtaatgctaacaatgactgcagcaatgaatcggattgtaacgctaaagttgatactaacgtcaacactgctgccaacgctaaccctgatatggttccccaaaacaatccacaacaacaacaacaacaacaacaacaacaacaacaacaacaacaacaacaacaacaacaacaccatcatcaccagcatcaaaatcaagacaaggcccatagtatcgcttccgataataaatcgagtcaacagcacagaggacctcaccataaaaaaattattcatggcccataccgtctattacgtctactaccacatgcttcaagacctatcatgtcccgtatactgcaagtagatccaaagaaaagagcaaccttagatgatatttttaatgatgaatggtttgccgccattgctgcctgtaccatggattcaaaaaataaagttattagagcgcctggccatcaccatacattggttagggaggaaaatgctcacttagagacctacaaggtttaa

SEQ ID NO: 4765 - DNA, 2280 bp, Saccharomyces cerevisiae
atgcctgcaccaaaactcacggagaaatttgcctcttccaagagcacacagaaaactacgaattacagttccatcgaggccaaaagcgtcaagacgtcggctgatcaggcatacatctaccaagagcctagcgctaccaagaagatactttactccatcgccacatggctgttgtacaacatcttccactgcttctttagagaaatcagaggccggggcagtttcaaggtaccgcaacagggaccggtgatctttgttgcggctccgcatgctaaccagttcgtcgaccctgtaatccttatgggcgaggtgaagaaatctgtcaacagacgtgtgtccttcttgattgcggagagctcattaaagcaaccccccatagggtttttggctagtttcttcatggccataggcgtggtaaggccgcaggataatttgaaaccggcagaaggtactatccgcgtagatccaacagactacaagagagttatcggccacgacacgcatttcttgactgattgtatgccaaagggtctcatcgggttacccaaatcaatgggatttggagaaatccagtccatagaaagtgacacgagtttgaccctaagaaaagagttcaaaatggccaaaccagagattaaaactgctttactcaccggcactacttataaatatgccgctaaagtcgaccaatcttgcgtttaccatagagtttttgagcatttggcccataacaactgcattgggatctttcctgaaggtgggtcccacgacagaacaaacttgttgcccctgaaagcaggtgtggcgattatggctcttggttgcatggataagcatcctgacgtcaatgttaagattgttccctgcggtatgaattatttccatccacataagttcaggtcgagagcggttgttgaattcggtgaccccattgaaataccgaaggaactagtcgccaagtaccacaacccggaaacgaacagagatgcagtgaaagaattattagataccatatcgaagggtttacaatccgttaccgttacatgttctgattatgaaactttgatggtggttcaaacgataagaagactatatatgacacaatttagcaccaagttaccgttgcccttgattgtggaaatgaacagaagaatggtcaaaggttacgaattctatagaaacgatcctaaaatagcggacttgaccaaagatataatggcatataatgccgccttgagacactataatcttcctgatcaccttgtggaggaggcaaaggtaaatttcgcaaaaaacctcggacttgttttttttagatccatcgggctctgcatcctcttttcgttagccatgccaggtatcattatgttctcacctgtcttcatattagccaagagaatttctcaagaaaaggcccgtaccgctttgtccaagtctacagttaaaataaaggctaacgatgtcattgccacgtggaaaatcttgattgggatgggatttgcgcccttgctttacatcttttggtccgttttaatcacttattacctcagacataaaccatggaataaaatatatgttttttccgggtcttacatctcgtgtgttatagtcacgtattccgccttaatcgtgggtgatattggtatggatggtttcaaatctttgagaccactggttttatctcttacatctccaaagggcttgcaaaagctacaaaaggatcgtagaaatctggcagaaagaataatcgaagttgtaaataactttggaagcgaattattccccgatttcgatagtgccgccctacgtgaagaattcgacgtcatcgatgaagaggaagaagatcgaaaaacctcagaattgaatcgcaggaaaatgctaagaaaacagaaaataaaaagacaagaaaaagattcgtcatcacctatcatcagccaacgtgacaaccacgatgcctatgaacaccataaccaagattccgatggcgtctcattggtcaatagtgacaattccctctctaacattccattattctcttctacttttcatcgtaagtcagagtcttccttagcttcgacatccgttgcaccttcttcttcctccgaatttgaggtagaaaacgaaatcttggaggaaaaaaatggattagcaagtaaaatcgcacaggccgtcttaaacaagagaattggtgaaaatactgccagggaagaggaagaggaagaagaagaggaagaagaagaagaggaagaagaagaagaagggaaagaaggagatgcgtag

SEQ ID NO: 4766 - DNA, 2280 bp, Saccharomyces cerevisiae
atggatgcttctgaggaagcaaaaagagtatcaatacaggttacatccctgtctacgcaattgatcgagagcgtggataaacagtcacacttagaagaacagcttaataaatccttaaaaacaatagccagccagaaggcagcaattgaaaactataatcagttgaaagaagattacaacactttaaaaagagaattgtcagacagagatgacgaagtgaaaagattgcgtgaagatatagccaaagaaaatgagcttcgaactaaagctgaagaggaagcggataaactaaataaagaagttgaggatctgactgcttccctctttgatgaggctaataatatggttgctgatgctagaaaggagaaatatgctatcgaaatcttaaataagagactcactgaacaactgcgtgaaaaggacacattactggatactttgaccctacagctcaagaatctgaaaaaagtgatgcatagtttagataatgaaagcacagtcacaaataattcgaacagatattccacaatattgagtgattcagcaacttcttctagcacttctttgaataaagttccaacttcatattctcttgcttcccaagatatttatagcggaattgtgtactcgccaagcatttcatctattcgttatgatataagcctttacaatgaatttctaaaatttgtcgctgcactaccccgttgtgaaaacataaaggcaacttcaaccgaatcaaagttaatacgaagattggtaaatgatgaaatccagcctatacttaagattgataatgcttcaggcatcggctggttggttaaaaaaaccctactttccttgattatagatggtttggtggtcgtggaacccctaagcggcgttaatgcaacctaccaaattggctacaactcaagtagccctgcaaagcaagccacttcgaatatgccaaaaatgttcaagtttcccttagattcacctccagttgcagtgcacgccgcatgttccttttgtggagaatctagagatgacattatcgaacacgcaaggatgtatatattgaaaacgttgcacaagactgacgacggtaaagaacaagttacgaatacgtatcccttgtgtcattggtgtttgctaaagttgcggcagacatgtgaaatctttgctttcctgagatcattgaaggtaggcgcatggcatttagaaaagctaacgacgcagaacattaccaaggaagatttggaaaaattctctgaagtaacgaagcataccaaaagagacggcagggtttcttctcaagacaaaaaaaccaaacgtttaagttttatggcaggacttggtatcaattcttcaacaaaaaataagccaaagatggagattttttcttctgaaacaaatgcaaagccaggacaacctaccactaatattcaaagagcatggctgcaattgtgtaaattgcgttgtatacttcattggactcatattggcatatgggcagtggatgattcaatttcttcaaaaattggaccgttagttgaggatgacagcgatgaggatcaaaacgatgctatatcggttcgcttgcaggacaaagctctttggaagcaggacgcaaaaagacctttttcttcatctagcgcagaagaaagtcaaaagagcgacgcttttgactttgaaagtggagatatggaaaatgaaattacgggtgaatcttcaagtgatgaatcctcttcagatgggtcttccacagataattcaaccgcagatagttcatcagaagatgaatcttctctagcagattctactacaagtagcgcagattctagttcaccagagagtatagacaacggtgaaggtgatgacacggtaacgaaagatgacaaaagtagcattaagtcggcaaataataatgaagaaaacagcgattgcggagataaaaaaggtcgttctataataaagaaaaaggctcctcaacgcaagatacaaaagaagaagttactccaagatttggatgatttagaagagcaatttagagaagaaagcgcaattgatcagactgaatttgaaaacgctgagtctaatgtaaaacaaaatatatcctcgaagagggcatcttctggagacgagaactctaagaaggataataatgaaaaaactttaaagacaaacttgacgataggcgacaaaacccaagaacaaataggggaaaatagtcctagtagcggattgcatgcgtcttcaagcaatgatgacaatttcgatgatgcccaggaacagcaataa

SEQ ID NO: 4767 - DNA, 2280 bp, Saccharomyces cerevisiae
atgggtgtctcacaaatatgggaatttttgaagccatatctgcaagattccagaattccgttgagaaagtttgtcatagactttaataaatcgcaaaaaagagctccaagaatcgcgattgacgcatatggatggctatttgagtgtggatttatccaaaatatagatataagcgccagatctagatcaagatcaaggagtcctacccgttctccgcgtgatagtgatatcgacagtagtcaagaatattatggtagcagaagttatacaactacaggaaaagctgtgataaacttcatatctcgattaaaagaactactgagtttaaacgtcgaattcttgcttgtatttgacggagttatgaaaccctctttcaaaaggaaatttaaccacgaacagaacgctactacttgtgatgatgagaaagagtactattcaagctgggaacagcatgttaagaatcatgaagtttatggcaattgtaaaggattgctagcgccatctgaccctgagttcatcagtcttgtacggaaattattagacttgatgaacatttcatatgtaatcgcatgtggggagggagaagcccagtgtgtttggctgcaagtttctggggctgtagatttcattttaagtaacgattcagatactctcgtatttgggggagaaaaaatcctgaaaaattactcgaaattctacgatgattttggcccaagttcaataacttcccacagtcccagtagacatcatgatagtaaagaatcttttgttactgttatagatctacccaaaattaataaagtagcagggaagaagtttgatcgcctgtctctcttatttttcagcgtgctattaggtgccgattacaatcgtggagtcaagggtttgggtaaaaacaaatctttgcagttggctcaatgcgaagatcctaacttttccatggaattttatgacattttcaaagatttcaatttagaagatttgacatcagaaagtctgaggaagtctcggtatagattgtttcaaaaaagattatatttatactgcaaggatcattctgtcgagctatttggaagaaattatcctgttttattgaatcaaggttcatttgaaggctggccatcaactgtcgcaatcatgcactattttcaccccattgtccaaccatattttgatgaagaagttctcagtgataaatacataaatatggctggaaacggacactacagaaacttaaatttcaatgaactgaaatattttttacaaagtttgaatttgcctcaaatttctagcttcgacaagtggtttcatgattctatgcacgagatgtttctattaagagaatttttatcaattgatgagtccgataatataggtaaaggtaatatgaggattaccgaagaaaaaattatgaacatagatggtggaaagttccaaataccatgttttaaaatacggtatacaacattcttgcctaatatacccatttcttctcaatctcctttgaagcgcagtaattctcccagtagaagcaagagtcccacacgacgtcagatggatataatggaacacccaaatagtctttggttacccaaatacttgatacctcaatcgcatccattagtaattcaatattatgagacacagcaacttatacagaaagaaaaagagaagaaaggtaaaaaatcgaataagtctcggctaccacagaagaataacttggatgagtttttaagaaagcatacttcgccgattaaaagtatcggaaaggtaggcgagtcgagaaaggaaatcctggaacctgtgagaaaaaggctttttgtagatacagacgaagatactagtctggaagaaataccggctcccacaagactgaccaccgtcgatgaacacagcgataatgacgatgattcgttgatttttgtagatgagattacaaacagccaaagcgttttagatagttcacccggtaaaagaattcgggatcttacacaggacgaacaggttgacgtttggaaggacgtaatagaaatatcaccaataaaaaagtcaagaactactaatgctgagaaaaatccgcctgagtctggtttaaaatcacgctcaagcatcacaatcaatgctcgccttcaaggtactaagatgttgcctccaaacttgactgctccaaggttagaaagagaacactcctctgtccttgaccaacttgtcacagacgcacaagatacagtcgaccggtttgtagcctgtgacagtgatagcagtagcactattgaatga

SEQ ID NO: 4768 - DNA, 2280 bp, Saccharomyces cerevisiae
atgtcctcgtcttcgtctaccgggtacagcaaaaacaatgccgcccacattaagcaagagaatacactgagacaaagagaatcgtcttccatcagcgtcagtgaggaactttcgagcgctgatgagagagacgcggaagatttctcgaaggaaaagcccgctgcacaaagctcactgttacgcctggaatccgttgtaatgccggtgatctttactgcattggcgttgtttaccaggatgtacaaaatcggcatcaacaaccatgttgtttgggatgaggcgcactttggtaaatttggttcttattacttgagacacgaattttaccacgatgtccatcctcccctaggaaaaatgctggtcgggttgtctggttatttggcaggctacaacggttcttgggacttcccttctggggaaatttacccagactatttggattatgttaaaatgagactgttcaacgcgtcattttccgcgctctgtgtgccattggcctacttcactgccaaagctattggattttctttaccaacagtttggctgatgaccgtgttggttttgtttgaaaactcgtatagtactttgggcaggttcattcttttggactccatgctacttttcttcactgtcgcatcgttctttagttttgttatgttccacaaccagaggtccaagccgttctctagaaagtggtggaaatggctgttgatcactggtatttctttgggttgcactatttccgtcaaaatggtgggtctatttatcatcactatggtcggtatctatactgtgattgacttatggacctttttggcagataaatccatgtcatggaaaacctatattaaccactggttggcaagaatatttggtcttattatcgtccccttctgcattttcctattgtgcttcaaaatacattttgacctattatcgcattctggtacaggtgatgctaacatgccatctcttttccaagcaagattagtgggttctgacgtcggacaaggcccccgtgacattgctctaggttcctccgttgtttccatcaaaaaccaagctcttggaggatctctattgcactcacatatacaaacttatccagatgggtccaaccaacaacaagtaacctgttatggttacaaagatgctaacaacgaatggtttttcaacagagaaagaggcttaccatcatggtcagaaaacgaaactgacatcgagtatttgaagccaggtacctcctatagattggtacacaaaagcacgggcagaaacttgcacacccacccagttgctgcaccagtgtcaaagacacaatgggaggtttctggttacggtgacaatgttgttggtgacaacaaagacaattgggttattgagatcatggaccaaagaggagatgaagaccctgagaagttgcacacattgaccacctctttccgtatcaagaacttggagatgggctgttacttggctcaaaccggtaacagtttgcccgaatggggtttcagacaacaagaggttgtctgcatgaaaaacccattcaagagggacaagaggacctggtggaacatcgagacccacgaaaatgaaaggttgccaccaagacccgaagattttcaatacccaaagaccaacttcttaaaagacttcattcatttaaatctagccatgatggccactaataacgctttggtgccagatccagacaaatttgattacttagcttcctcagcatggcaatggccaactttgaatgtgggtttgagactatgtggctggggtgatgataatccaaaatacttcctattgggtaccccagcttccacgtgggcttctagtgttgccgtcctcgcattcatggccacggtcgttatcttactgatcagatggcaaagacaatatgtggacctaagaaatccatctaactggaacgttttcttaatgggcgggttctacccactactagcttggggcctacactacatgccattcgttatcatgtctagagtcacctacgttcatcattacttgcctgccttgtattttgcactgatcattttggcgtactgtttcgacgccggtttgcaaaaatggtccagatctaagtgcggccgtatcatgcggttcgtcctatacgccggattcatggcacttgtaattggttgcttctggtacttctccccaatatcatttggtatggagggaccaagtagtaacttccgctacttaaactggttttccacttgggacattgccgacaagcaagaagcatga

SEQ ID NO: 4769 - DNA, 2283 bp, Saccharomyces cerevisiae
atgaagataacgtgtacagacttggtgtacgtcttcattttactcttcctaaacacgagttgtgtccaagccgttttttcagatgatgcatttatcactgattggcaactggctaacttaggtccttgggagaaagtcatccctgattctcgagaccgcaacagggttctcatcttatcgaaccctaccgaaacttcctgcttagtttcttcgtttaacgtttcttccggacagattcttttcagaaacgttttaccctttaccattgatgagattcaactggatagtaatgaccataacgcaatggtttgtgtgaactcttcaagcaaccattggcagaaatatgatttacacgattggtttttactagaggaaggcgtagataatgccccttctacgaccattttacctcaatcctcatatttaaacgatcaagtatctattaagaacaatgaactacatattctcgatgagcagtcaaaactggcagaatggaaattggagttacctcaagggttcaataaagtggaatattttcatcgtgaagatcccctggcgttagtgttgaacgttaatgatacccaatatatgggattctctgccaatggcacagaattgatccccgtttggcaaagagatgaatggttgactaacgtggtagactatgctgtattggacgtcttcgattctagggatgtggagttgaacaaagatatgaaagcggaacttgattcaaattcgctttggaatgcttactggcttagattgacaactaattggaatcgccttatcaacttattgaaagaaaaccaattctcaccaggacgtgtcttcactaaactcctagctctagacgctaaggataccacggtatcagatttgaagttcggattcgccaaaatcttaattgttttgacgcatgatggctttatcggcggccttgatatggtcaataagggccaacttatctggaaactcgatttagaaattgatcagggcgtcaaaatgttctggacggataaaaaccatgacgaacttgttgttttttcgcatgatgggcattatttgacaattgaagttactaaagatcaaccgattatcaaatcaagatcccccctatctgaaaggaaaactgttgattccgttattaggctgaatgaacatgatcaccagtatctgattaagtttgaggataaggatcatttactgttcaaattgaatcccggcaagaatacggatgtaccaatagttgccaacaaccattctagttcccacatattcgtcacagagcatgacacgaatggcatttatggctacataatcgaaaacgatacggtaaaacaaacttggaaaaaagccgtaaattcgaaagagaaaatggtggcatatagcaagagggaaacaacaaacctaaacactcttggtattacactaggtgacaaatcggttctttataaatatttgtaccccaacctagcggcttatctgatcgctaatgaagaacatcatacaatcacttttaacttaattgataccattacaggagaaatcctcattacccaagagcacaaggattctccggattttaggtttccaatggatattgttttcggtgaatattgggtcgtttattcctatttcagttctgaacctgttccagaacaaaagttagtagtggtggaattatatgagtcactaaccccagatgagcgtttgtctaactcaagcgacaatttttcttatgatccattgactggacacattaacaaacctcaatttcaaactaaacaattcatttttcccgagattatcaaaacaatgtccatttccaagacaacggatgatattaccacaaaggcaatcgttatggaattagaaaatggacaaatcacctacataccaaagcttttattgaatgcaagaggtaaaccagcagaagaaatggccaaggataagaaaaaagagtttatggctaccccatacacgccagttatcccaattaatgataatttcattatcactcatttcagaaatctattgccaggatccgattcgcagttgatctccatcccaaccaatctggaatccacaagcattatatgtgatctaggccttgatgtattttgtacaaggatcacaccttcgggccaatttgatttaatgagtcctactttcgaaaagggtaaattgcttattactatattcgtcttgttggtgatcacgtattttatccgtccttctgtttcaaacaagaagttgaaatcccaatggctaattaaatag

SEQ ID NO: 4770 - DNA, 2283 bp, Saccharomyces cerevisiae
atgctacttcattttgacattgtaattcaattactatcaagtcatacccttaaatcgcaccaagtagagccccccatggattttgaaacgtcgttcgaagaatttgtcgaagataaacgattcattgctctagaggtatctgataatgatgacgattgtgacactgatttgactgctgacacagctgacgagctggaaagctctgctatcttaaagatgagggagtctgatgcatctttaaatgttaccaccggcaataatacatcaaggaaaacgacttccaattccaaaaaacgatggtctctattatccaatcattctgctgtttcatcatctaaatctaagaaaagatggtctgtactttcttcaagctttaccagtgaatctcataaggacagggaatcgaggaacgttttgcaacaaaaaagaaaatccttgcagagttattcaagcttagatacggtagcatctaatagctctatctctgcttcttcttctttgaaaagatcgtccactggtctttccctcagacaattgtttaccaagataggcataaacgatgatatatcacaacctgggatcgggattccgcaaggtaaggaaaatctgcctccaactatgggcaaaaaaaattcatcaattgcttccactagttcggaaaacagacttaggacaccattgaagccgcttgttaatcattctaaaaggcccacttcacaaccacaacagcaacaaccactatataatgcatcattgtcctcgagaagatcgtcgatttcttccactgtctcttcttccagctcgtctaaatggagattctggaagagaaataagaaccagacacctgcattgttgcaaccagaccaccattctttaaaaacctttcctgcagtaaaccgtcgtgattccatgacgcccgttgaaccaagaaatatggtaaaacataagacatccttttcagatttccataagactatcttcagttcaaatacgtattctgaaagcagcgatacaatatcttccatggaaattactttgaaaaacaaagcttcttcctcaagtctatctttgaacgtgttgaagaaaaggaattcgcaatcaagtttgaagcacaaaagttcacatgcatccttacaaaaattcaaaagaaacaaaggaaagtcctccatgatagcaccatcgacagcaactaatagcagcaatgatgactcttgtagctacagttccaaaaattctacgttgagtcaccgaatatcgttacctgtaccggaccaagtttcccgtgataaaattcagaacaaattaagatattcgacctcattactctcattaaattctaaatcatctttaccgatgaacaaaaatgatcatgatgagacacttctaagacagattttactaaattgtgatataaagagaattttaaaccccgcaaaaggagatgtattgcctttaatcaacgatgtaaaccatttgtcatcaatacaattaacatcaaatgtttggcaaattggtgaagtaatctgtaaaaaagtttctctcggtactattgatgacattacatgggatagaaagttcttatctttgcaggaactggaaaaactcaaaatcatgcaacaaaaatttgatggcataccgcaactattgaaaagttttgttgttaaagaggcaaatggggggttgtatttgtacttactattcaaagatcacggtaccccaatttcgttaatctcactgaaaaactggaagcagattctaaagattttttggtcttgtgctggtataattcatgggttggaaaaaaatttgaaatttgaacatcgtaatcttactttggataatattttgatagatggtaatgggaatataacaattattgattttaaatgcagtagattgcaaactcctcaagatgatgttttatatctacggctagatcatccactcttttttctaaatgggaaagacaagagtaaaataaacgaataccagtatcaatttgagtttgaaatctatcaaagtatgcggatcttgttgaacatggacgcgtcagcttttgagcccatgacaaatttgtattggttatattacctgtcacgcgttttactaaagtttggtgacaggaagcttggtaagaatgatgcaaacagggataaaatggcaagggtgataaaccatttggaaatgaacttggcagttcataaaagaggggggcagttattcaaaagattggagacggaggacattaagaatactggagatttactaaaactttataaataa

SEQ ID NO: 4771 - DNA, 2283 bp, Saccharomyces cerevisiae
atggtagatgtgcaaaagagaaaaaagttgctagccaaagctgctgccagcgcttctattccggcaatcaaaggttctgttccgttggactcgtatgatataaaaatcattcaatataagaacgctctttacaagctgaatgaactgaataggctactaaacgttctggtaccgcatttgaagaagaaaagagacaatgacgagtcctacaaaattattcccctcgttaatttcatcttatcactttgtgagggtcctatatttaatgtaagccccgtattggctaagaggtaccatttgctctgtcgattccagctgataaagctaagcgaagtgcagcagagattatcaactaattttattgatgtagagggctggatgtttcccgaggaggtacccctagatcactataaatcgtgcatatacaataattctctacaatggaagattttaaattcgctgtcttgcattgctcaaaatgctataaaaatttataatgccaagttgagacagattttattggaaagggatgcgtacaaagctcggtcacttccatttgacacttcaataattgaagacttgttaaatccagttgaaatgacattgattctagatttagccgttttgattaatgatccagtaagggataagtccacccattccttttacaaattgcaatggcaagtgatggagaaactgaactcctgtgttcattcgaaaatcttccccattctaaggacatattacaaccaattgcagaaattttcggaaacaagacctacttcactgtcaaatttacagaaggatctaccacattgggaatggactctacacaggatatacactttccacttgcgggttttttctgtcttgtgtgttattatcagtttctctaggcaaattttcctaccgaataaacaacatttcttggacatcaagacaagattatccagcgaaaacgtgtaccattacgatttgataatttgtgagctgatggctttgctctctccagaatgtgatgatgtcacagctttattcgaactgcaggagaatttaaaattttggactcaaacggcgcgtaccgataacaattcctcaagaactcccattttccaccttcaacctggtttagttgtggaattgtttaataatcatatctgcaagattataccgaaattgaggtccattatgggattattatccaattggatggattgctggaaatatattgagaaaaattataaaaccttcgatgaaaccaatgacttgcgggagaatttgaaagaaaagctagaaagagataaggctctgtatttagaggttaaaaacgcgaaaagtaagctaaagaagaagccgtcaataacaaagctgccagcctcttcttctccatccccctcacccacatcttcagcaagcccatcaagacaggcctctttagagagcataagaacaagggcaagggcgcatttagcctcaaattcttctaggtctccctcagtatcgcctgtaaggaccactttcaacaataaaaacgcagaaacgaagaaaagcgtggtgtctccggagaaaagaaaactgatcaacggcagaaggcctagatcctcatctttgcaatcctatacaaacaaacaacaaacctcatatttgaattctacaagacatccgtcaatagctccaccttcaaagctcaacaatcaaaggtccaattctttgcagtcctcaaccatgacgttaaatcaaaaaatcgtccaagatacagtgcggcatttgatgaacaaaagtgcatctacacccaatccttctgcatcttcatcgttagcgccttcaccaaaagtatccagtataaacaacacctcctcaggaaaatcatcaagtaccctgattgccaatagtagtgatactttggctatagagacattaactctagatccggagtcaaactccagtgaattgtccatcaaaagggtgagatttgctggtgtaccgccaatgacagaggcagaaaatcctaaaccaacaaaggtgggttggtacaagaagccggctgtgctacattatccgccaatacctgcttcggcaatgatcaagccgctacagcataagtccaaatataacacgctgagacaagaagaagggtttacctttcgaaaaagtcttcgagatggattagagtgggaaaatggcgaatctggctccgaaactaccatgatgccgtttgggatcgaaatcaaagagtcgaccgggcatagaatagcttctaaaatcagaagcaaattgagataa

SEQ ID NO: 4772 - DNA, 2286 bp, Saccharomyces cerevisiae
atgaatttttccagcattttcaaatctatttcgaatttccagttcccatacaccatagaggaaactgcaatcactgaaaccgccctttggcaatgtttcgatggtacaaggaaggcagattccttgccagtaacagtttttaaggcaaaaagatctccagaaaatgaatctttaattttaaatgctgtacacaagagcaaaattttgaagattccaggactttgtacggtgctggagacatttgattccgacccccaatccacatttattgttaccgaacgagtagttccatttccttgggataatctaggctctttatctcaaaacaaatttggtgttgaattaggaatatcacaattattggcaactttaggatttttaaaaaactttgtccttggtacgctttctaaagattctgtttttatcaatattaagggagagtgggtactatttgggctagaactttgttcaagcaaagaaggattaagtgcgtttgaatttgccagtagagcgaggtcatattacaacataattggctcacagttgccctgtgaagatccgaatacaattgattcaatggggttaggattgttgataaagagccttatggctccttcttgtctgcccaaagattggattgtcaatgtaaatatgatttcagatggaaagataacaatcgaaaacttcagaaaaaggctagaaaatacagaaacttggcgttctaatcctttgataaacttttatcaagaattgagggagttgcatataaaggacccacagggaaaattggttgtgatgtcaaacttggaaaatttgtatttagagtcaagagagattttccgtaatttaacgcctggaatgatagaaaattttattattccagagctttgtgaaattataaaattattaatgacacaaagcatcagtagtgctgccagccctataggcatgaacttcaacgcatcacataaactagtaccattcttagcgattgttttagacctaacttctgaaacgaacacctttccagttggtttcaacgaccttatcacccaaagttttaaactgccagataggcaagtaagatttcttttactaatatacctacccaaattaataggtccattgagcaaatcagagatctccagtaggatatatccacattttatccaaggtctgaccgactctgatgccactcttagattacaaacactgaagacaattccatgcattgtgtcatgtttaacagagagacaactgaataatgagctactgaggtttctcgcaaaaacacaggttgattctgacgttgaaatccgaacatggacagtcatcataataagtaaaatctcaaccatattatcaacgtcagttggtaatcgctcgaatattttagctacggcgttcacaaaatctttgaaagatcctcaagtaaaaccaagattggctgctctttatgggcttgagaagtcgattgagctgtttgatgtgaacacaatcgccaacaaaattttaacagtcattgcccctggtttattagataaaagtcccatagtaagaggcagagccaaaatcctgttcgaagaatatctggaaaaattggaaaaagaagcccaacttattcaaacaaacgatagtactgcagattcggaagatgtgaaagatattgattttgagaattacggttgtgatgaagaggatatgaataaagaagacaatttgttagccgcacaatttttaaataatttacgtttaaattctccctcagcaacaacaccaagtaacattaccgagagcgaaattgattccgcccaggatggaagtggatgggacgacctcagcgataccgatggctttattacaaatggtaccacagaatccttcgatgaaacaacaaaccctgtaacaaccgcaagcaccccaaaattattcggaaaacctattaaaattaataaaagttggaatgatgagttgaatgatgatggctggattcaagatgaaagcggcccatcaaaggtgcctcaaaaacacacaaggccacaaaattcaacgttggcaaaatccatcgctcctagctcaaggctttctatcaagaagaagaaaacaacgatcctagcaccaagaaacattgctagtaactctactgttaccaccaaatcgtcactgtccaataaaactgcaagaagtaagcctataagtagtatccgcggctcggtaaccaagaaaggaaatgttgacggctgggatgatgatggggattcagactcctgggatacgaattggtga

SEQ ID NO: 4773 - DNA, 2286 bp, Saccharomyces cerevisiae
atgagtgtccagaaaatgatgtgggtgcctcgaaaaatggttggaggtagaataccctttttcacatgttcaaaagttttttcaggtttctcgagaaggtcttttcatgagagtccacttgctcgttctacatatgaagaagaaaaagttttggtggatgaaatcaaacaaaaacttactccagacgatattggaagatgtaataaattgcgtaacataggtatatctgctcatattgactccggaaaaactactttcactgaacgtgttctgtactatacaaaaagaatcaaagccattcatgaggttcgtggtagggataatgttggagccaagatggattctatggatcttgaaagggaaaagggtattactattcagtctgccgctacttactgctcttgggataaagagggcaaaaactatcatttcaacttgatcgacactccaggtcatattgatttcactatcgaagtggagcgtgctcttagagtactagacggtgcagttcttgttgtttgtgctgtttcaggtgttcaatcccaaactgtgaccgtggatcgtcaaatgcgtagatataatgttccaagagtaactttcatcaacaaaatggatcgtatgggttcagatcccttccgtgcaatagaacaacttaattcgaaactaaaaatacctgctgctgctgtacaaattcctatcggatcggaatcaagcttatctggtgtcgttgatttgattaatagagttgctatttacaacaagggtgataatggtgaaattatagaaaaagggccagtgcctgaaaatttgaagccattaatggaggaaaaaagacaacttttgatcgaaacacttgctgatgtggatgatgaaatggcagaaatgtttttggaagaaaaggagcctaccacgcaacaaattaaagatgctattcgcagatctacaattgctaggtcttttacaccagttttgatgggatccgcactggcaaatactggtattcagcccgttttggacgctattgtagactacttacctaatccctctgaagtgttgaatacagctctagatgtgagcaacaacgaagccaaggttaacttagttcctgcggtgcaacagccatttgttggattggcattcaaattggaagaaggcaaatatggtcaattgacttatgttcgcgtatatcaggggcgtttaagaaaaggtaattacattacaaatgtaaagactggtaaaaaagtgaaggttgcaagattggtcaggatgcattctagtgagatggaagatgttgatgaagttggctcaggtgaaatttgcgctacttttggtattgactgtgcttctggagatacattcactgatggtagcgttcaatactctatgtcatccatgtatgttccagatgctgttgtctcgttatcgattacgccaaattcaaaggacgcatcgaatttttcgaaggctttgaacagatttcaaaaggaagaccctacattcagagtgaagttcgatcctgaatctaaagaaacaattatttctgggatgggtgaattgcatctggagatttacgttgaaagaatgagacgtgaatataatgtggactgtgtcacgggtaaaccgcaggtttcctatagagaatctatcaccatcccggcagattttgattatacacataaaaaacaatctggtggcgctggtcaatatggtagagttatcggtaccttatctcccgtggatgacattaccaaaggcaacatattcgagaccgctattgttggtggccgtataccggacaagtatttggctgcatgtggtaagggttttgaagaagtatgtgaaaagggaccattgatcggtcatcgtgttttggatgttaaaatgctaatcaatgatggtgctattcatgccgtggattctaatgaattatcattcaaaacagctactatgtcagccttccgtgacgccttcctgagggcacagccggtgatcatggaacctatcatgaatgtttcagtaacatcgccaaacgagtttcaaggtaacgtcatcggtttattgaataaattacaagcagtaatacaggataccgaaaatggtcatgatgaatttacattaaaagcagaatgtgccttgagcacgatgttcggtttcgccacctcattaagagcctcgactcaaggtaaaggtgagttttcattagagtttagtcattacgctccaacagcgccccatgttcaaaaagaattgatatctgagttccaaaagaagcaagcgaagaaatag

SEQ ID NO: 4774 - DNA, 2286 bp, Saccharomyces cerevisiae
atgatgatgtggcaacgatatgcaaggggtgcgccacgctcattgacatcactctcatttggtaaagctagccgcatatcaacagtgaagccagtgcttcgctcgcgcatgccagttcaccagcgtttgcagacgttatctggtctggcaaccagaaacacaatacaccgttctacccaaatacgttccttccatatctcatggacaaggttaaatgaaaataggccaaacaaagagggtgagggcaagaacaatggtaataaagataataatagcaataaagaagatggcaaagacaaaagaaatgagtttggttcattatcagaatacttcagatctaaggaatttgctaatacgatgtttttgaccatcggattcacaattatatttactttgctcacaccttccagtaacaactcaggagacgactctaaccgcgtcttgactttccaggatttcaaaacaaaatacctggagaagggtcttgtgtccaagatttacgtcgttaataagtttctcgtagaggccgaattagtcaatacaaagcaagttgtatcgttcaccattggttcagtagatatttttgaggaacagatggaccagatccaggacctcttgaacattcctcctcgggatcgtatccccatcaaatacattgagagatcttctcccttcacatttttgttccccttcctgcccaccatcattctgcttggtggcctttacttcataaccagaaaaataaatagttcaccaccaaatgccaatggtggtggtggaggaggcctcggcggcatgtttaatgttggaaaatccagagcaaagctcttcaataaggaaacagacattaaaatttcatttaaaaatgttgccggttgtgatgaagctaaacaggaaatcatggaatttgttcactttttgaagaacccaggtaagtacactaaattgggtgccaagattccacgaggcgctattctttctggacccccaggtaccggtaagactctcttggccaaggccaccgcaggtgaggcgaacgtgcccttcttgtcagtatcaggttctgagttcgtcgaaatgttcgttggggtgggtgcttcacgtgtaagagacttgtttactcaagcaaggtctatggccccctcgattatctttatagatgaaattgacgctatcggtaaagaaagaggcaaaggcggcgctctcggtggcgctaacgatgaaagagaagctacgctgaatcaattattggtggaaatggacggattcactacttccgaccaagtcgtagtccttgcgggtacaaataggcccgatgtgttggataatgctttgatgagaccgggaaggttcgatagacatatccaaattgattctcctgatgtcaatggtaggcagcaaatatacctggttcacttgaaaagactgaatctggatccccttcttacagatgatatgaataatctttctgggaaattggctacgcttactccaggttttactggtgcagatatcgctaatgcttgtaatgaggctgcattaatcgctgccagacataatgacccatatatcactatccatcactttgagcaagccattgaaagagtcattgcgggactagagaagaaaacaagagtcctttctaaggaagaaaaaaggtcagtggcctatcatgaggcaggacatgccgtttgtggttggtttctaaaatatgcggatccacttctgaaagtaagcatcatcccgcgtggacaaggtgctttaggctatgcccagtacctaccaccggatcaatatttgatatctgaggagcaattcagacatagaatgatcatggctcttggtggccgtgtttctgaggagctacattttccatcggtgactagcggtgctcatgatgatttcaaaaaggttacacagatggcaaatgccatggttacatccctaggaatgtcacccaagattggctacctgtcgtttgatcagaatgatggaaacttcaaagttaacaaacccttcagtaataaaacggcaagaaccattgatttagaagttaaatctatagtagatgatgcacaccgagcttgtacagaattgctaaccaaaaatttggacaaagtcgatcttgtcgcaaaagaattgctacgtaaggaagcaattactagagaagacatgattagattattgggtccaaggccattcaaggaaaggaacgaggcttttgaaaaatatttggatccaaagagcaataccgaaccgcctgaggcacctgcagcaacaaattaa

SEQ ID NO: 4775 - DNA, 2286 bp, Saccharomyces cerevisiae
atggaacaccaagatagttcgccacctagattcaggaactctggctctaatagagtcactgtgtataacggtactaccctgcctacgatgcccaagagcgccacaccaacatcgagctcaacaacagttactacgcatttgcaaaatattaaggaggaggaaacaaacgatgacgaactcacccaagtggatcgttcatctcctcgtgttttggggaggatctcctctacgtcctcatcttcatccaatattgatttgcgcgataacttggacatgttacacgaaatagaaaaatcaaatactaatatttctttatcagctcctaatttgcatgaggaactgggcgttctcagcgataaaggtaacagtaaagaagaattggctttgttaccacctttacctcacacaggagaaatggaaatcactccacaatttgatatcaacgaggctatttttgaacgagatgacatcagccactcttcaaggctagaaccagatgacgtgttaacaaagttagcgaactctactcgagatgctacgggtgaagatcaggggtttgttgtcatgactcatggccacgatgcgtcgacaaacgacgattcgcaattaagcgctactattcttgacaatcagacgtcatttgatctttctaaagctctagagatgactagccattcaaatatttctaatattattaatagttccggttctgagggaagacgttcaaggacaccggtaagcaattccactctgaaaccaaatttatcatctcctgaaagcgcagaacgtgaagcaaacacgacttcgtcctcctctacgtcggatcacggggcaacaatgcaatatgatcccaagaaaataataactccaattcctgttttaccttcctctgtccgtgaacagcaacagaacaatgcacctttgagagaaagaagcagatctaattctagtgcactggcatctacactgagagatacgatcatttcaggactgcctcaaaatattaattctgtagaaagaaagttatcaaggaagagtaacaggagtaggaagaatacggtgacttttgaagatcgtcttcagaaattgccacccttaagcacccaaatttcgaaccagtacgccaaggtagcaccagctgagaacaatatcgccttacactttcataacttacctacaccagtatcaaacactcaaacgcctgttacgtttcagtctgaatccggactgacagggggagaaaagaaaatgccttttttgagaagagcatctagtgccctattaagaaagacatctgccaaaaattgctccaatttaaccagaacaaatacacctactttatcgacatcctcaacatttgagtcagatctaaatgctcggcagcccatgctaattcgacgatcttccactattgataataaactacctaggaggcagctttcgtgctcgaagctttattcgcgcctcaattcggacagcaagtttgcgaatagcagtcgagcttcggaggaggtcttagtgtccactccaaatgacacagaacacgtctacagaaagacatctctaggttctaagataaagagaggttttactagaatattgagcgacagtaataatagtaaggaaattctcactttatcacccaaatctatggtgactacggggcctacagaattgtcgttttcctctttatcaaccgtgggaggacatccgacaacgccagtctcaaaagaaaatgatcgagtttcaatagatggcgtgagtacatttaatcgagcatcaacatctcttccagaatcatcaacagacgacatctctccactacgcgaagaaggtaagattaatgttcctaaaagaacgtcaagtagaaagatactgtctaaaaattcaagcaaaaaaaatgtactgcctgaacagcaaacaaagccaagtgaaatatatctggataaagaagccttacaaagttttgttcccgtactctctgtcacagagggtactcatcgcatcaatcgctcgtcgttacaaacgcaatctaccatcggattatgcattaccaatttaagaaacaaagaaggcatgaagctcaatgccaaggaatacgtggaaatcctggctcagcagcaacgcaaggaagatgaaaggtatgctgttttggaaagaaaatttgcatcttgtagatggtgcagtgataaggacctgcagtatttgaaaaagaaacgaatttccatgaataagatatggtctgattatgtccgattttaccgtggaaagttgaacaacccatga

SEQ ID NO: 4776 - DNA, 2289 bp, Saccharomyces cerevisiae
atgcataaacctttaagatggctaataacgatagccttctacgtttcgaacgttatattaataggctattccctttctagtaatggctcaatatctgaattttatctgcattctgttgtacttattgaatgcttctctttactaggagtggttacctctgactgcttaacaccatctttgtcatacatttccagtaacatattccatatttccgatagagtatccggcatgactttattagcattggggaatgcacttcctgatattactagtacttaccagtcgatgaaatctggcgtgacttccttggccattggtgagttatttggtggcatattttttctgttaaccgttgtgattggactaatgggctgcgtagccactattcaatttcaacatgacaagtctattgaaacttacacagaagaaagctttgaccaaaatttatcgtatgatagaagcaattatatattggatgtcggaatattcacttttatgctcttagtttcgggcacttttctagcagatggaagactgtacttttgggagtgtattgtcatggttttaacctactgctgttgtgctgtctatttaataaaaagctacaaatatccctgcgaaatcaatgatgctttagaaagagaggtagaaataaaaaaaactgtacttgcaaataatcatatcactgttccaaatcgatttacattaacgactaccagtgacattacatccacagacgatggaataagatatgtaaggcctttgggggatacacagattgatgaggacaacgctattagtttagatccaactcgtttaccaagtaaatccctggataacatttcgagatttaatcaaggtatacctgaaagaagggatttaataagacgtagaatacggggatatttacggtcgcattatcatggctgggtaagaatgacgttacaagatcttttgaatatatgggagaagcagaatctttttaacaatacagtaaaatcgttgtctttaccctccgatgatactcatttatttactaaagcttctttagatgaagaagggaggcctttaataagaaaaaggatgaattcattacaacctaaggatttttacaaatatttgtccctacggaatggggaaaattcaaatgcgctggatactgcaatctctgctccccaaaacgagtatcaaacttactataatgaacccacaagtttgtttttgactgtgccacaaaaaaaaacctccaagaaatcattaagctgcgatcgcattccaaacttggtccggagtaataatattatattaaatgacgaggctacacgtacacaggaatctaccaatgccttgaacagcatatcagatgttatcgacaactctctcttacagtatgagagagatgatataattctcgatagaacactatctctctgttcaacaaagagtagaaccgcttggcatagtttccaactttacaattacttaacagatgtgtccttggaaattggtttctttgagttcttgtcattattagtcactacgccggtatcaataattctttatctttcaataccatcagagataagtcaaacagaccatgacttacccctttcatacctacagaatattcaattgattgcttcgccaataattctcaaccaactcatcacaaataacttttcattttggttgctcatcttatcgctggtgatagccatcttattatattttaaaactaggaccataccgaacaagttcaactctgatataatctttacagtagcatttttattgtcattggcctgtctttcgaaagctgtccacataattgtagtcacgttaacgcattggataaatgtgtttaatatatcggaaacaatactaggtttaaccatttttacatggggtaattcgattggtgatttagtgtcaaatattacattcgtcaaaataggtgttttagaaatcgcgataggagcttgttttggcagtccacttttatatttcttatttggcgtcggatttgatggaattatgataatgctaggcgacaaaactggaaaaatagtgagtggcagagatagtaatattttaatgcatcatattgattttaaagtggataaaaacttaatcaatactggagtcggaattctgatcgcgtttttgatatttacggttttgataccattaaacgactggaaaattgacaagaagattagtattgcacttcttacgttgtatatagttgtcacatgtattagtgtttttttagaagttcaccaagtgtaa

SEQ ID NO: 4777 - DNA, 2289 bp, Saccharomyces cerevisiae
atgtctgtgcccaaaaaacgtaaccatgggaagttaccaccttccactaaggacgtagacgatccttcgttgaagtacacgaaggccgcgcctaaatgtgaacaagttgctgaacattggctcttgcagccactaccggaaccggaatcacgttatagcttttgggtaacaattgttaccttattagcgtttgctgctagattttataagatctggtatccaaaagaagttgtttttgatgaggtacatttcgggaaatttgcatcgtattacttagaaaggtcttatttctttgacgttcatcccccttttgctaagatgatgattgccttcattggttggttatgtggctatgatggttcctttaagtttgatgagattgggtattcttatgaaactcatccagctccatatatcgcgtaccgttctttcaacgcgatattgggcacattgactgtaccaattatgttcaacactttgaaggaactgaatttcagggctattacatgtgcgtttgcatctctcttggttgcaatcgatactgcgcatgttacagaaactaggctgattttactggatgccatcttgattatttctattgctgctactatgtattgttacgttcgtttctacaagtgccaattgcgtcaaccttttacatggagttggtatatttggttacacgctactggtttgtctttatccttcgtgatttccacaaaatatgttggtgttatgacatattccgctattggttttgctgctgtggtcaacttatggcaattactggacatcaaggcgggtttgtccttgaggcagttcatgagacattttagtaaaaggctgaatggtttagttttgattccatttgtgatttacttgttttggttctgggttcatttcaccgttttgaatacttcaggtcctggcgacgcatttatgtctgctgaatttcaagaaacacttaaggactctcccttaagtgttgactctaaaaccgtcaattattttgatattatcactatcaaacatcaagatactgacgcattcttacattctcacttggcacgttacccacaacggtatgaagatggtcgtatctcatccgctggtcaacaagttactggttacacgcatcctgacttcaacaatcaatgggaagtgttaccaccccatggcagtgatgtcggtaaaggacaagctgttctattgaaccagcatataagattgagacatgtagccaccgatacctacttgttagcccatgatgtcgcctccccattttaccctaccaatgaagaaatcactacagtaactttagaagaaggtgatggggaattatatcctgaaacactttttgcattccaaccactgaaaaaatcagatgaaggtcacgttttaaagagtaaaacggtttctttccgtcttttccacgttgatacctccgtagctttgtggactcacaacgacgagttgttaccggattgggggttccaacaacaagaaattaatggtaacaaaaaagttattgatccttcaaataactgggttgttgatgaaattgttaacctggacgaggttcggaaggtatatattccgaaggttgttaagccattaccattcttgaagaaatggattgaaactcaaaaatctatgttcgaacataacaataaactatcatcagagcatccatttgcctctgaaccttacagttggcccggtagtttaagtggtgtttcgttctggaccaacggtgacgaaaagaagcaaatatatttcattggtaacatcattgggtggtggttccaagtcatatcattggctgtttttgttggcattatcgtggccgatttaattactagacatcgtggctattatgccctaaacaagatgaccagagaaaagctgtatggcccattgatgtttttcttcgtctcctggtgctgtcattattttccattctttttaatggcgcgtcaaaagtttttgcatcattacttaccagctcatttaatcgcgtgcttattctcaggagcactatgggaagtaattttcagtgattgcaaatcattggatttggagaaagacgaggatatttcaggtgcatcatatgaacggaaccctaaggtctacgttaaaccctataccgtcttcttggtgtgtgtctcctgtgctgttgcgtggttttttgtatacttttcaccactagtgtatggagatgtcagcttgtcaccatcggaagttgtttctagagagtggtttgacatagaattaaatttctccaagtaa

SEQ ID NO: 4778 - DNA, 2289 bp, Saccharomyces cerevisiae
atgttggcactccggagatttatattaaaccaaaggtctttgagatcgtgtaccataccgattctagtcggagccttgatcattattctcgtgctattccaactagttacccaccgaaatgatgcgcttatacgatcaagcaatgtaaacagtacaaacaagaaaacattgaaagatgcagatcctaaggttcttattgaagccttcggctctcctgaggtcgacccagtggatacaattccagtatcgccactagaattagttccattttatgaccagtctatagatactaaaaggagttctagttggctaatcaataagaagggctattataagcatttcaacgaattaagcttaactgatagatgtaaattttatttccggacactgtatacgctagacgatgaatggactaatagtgtgaagaaactggagtacagcataaatgataatgaaggagttgacgaaggtaaagatgcgaatggaaatccaatggatgagaaatccgagagattgtatcgccggaaatatgatatgttccaggcatttgagagaataagagcctatgatagatgttttatgcaggccaatccagttaatattcaagaaatttttccgaaaagtgataagatgtcgaaagagagggttcaatcaaaattaatcaaaaccttaaatgctactttccctaattatgatccagacaattttaagaaatacgatcaattcgaattcgagcacaaaatgtttccgtttataaataactttaccacagagacttttcatgagatggttccaaaaatcacatcaccttttggaaaagtattagagcaaggcttcttacccaagttcgatcataaaactggtaaagtgcaggagtatttcaaatatgaatacgatccatcaaaaaccttctgggccaattggagggatatgagcgccaaagtagccggtcgtggtattgtattgagtttaggttccaaccaatttccattagctgtcaaatttattgcttctttgagatttgaagggaatactttaccgatccaagtggtctatagaggcgatgagctgtcgcaagaactagtggacaaacttatatatgctgctagaagtcctgatttcaaaccagtagaaaataattacgataattctaccaatgttccacaagaaatttggttcctagatgtttctaataccatccaccctaagtggcgaggtgacttcggtagttataaaagtaaatggctagtggttctactcaatcttttgcaagaatttgtctttttagatattgatgctattagttatgaaaaaattgataactacttcaagaccactgaataccagaagacaggaactgtattttacagggaaagggcgctaagagaaaacgtgaatgaaagatgtattgctagatatgaaactctattgcctagaaaccttgaatctaaaaatttccaaaactcacttcttatcgatcctgatcatgctctcaacgaatgtgacaatactttaactacagaagagtacatattcaaagctttttttcatcatagaaggcagcaccagttagaagctggtttatttgctgtcgacaaatcaaaacacacgatccccctagtgcttgctgctatgattcatttggccaaaaatacagcccactgcacacatggtgataaagagaatttctggttagggttcttggccgcaggtcacacttatgcactgcagggagtgtattccggagctattggtgattatgtaaagaaaaccgacttgaacggaaagaggcaagaagctgcagtcgaaatatgttccgggcaaatagcacatatgtctactgataagaaaactttactttgggttaacggtggaggtaccttttgtaaacacgataatgctgctaaagatgattggaaaaaagatggcgactttaagaaattcaaagatcaattcaagacttttgaagaaatggaaaaatattattacataactccaatcagcagcaaatatgtcatcttacctgatccaaaatctgatgattggcatagggcctctgcaggtgcttgtggtggttatatatggtgtgccacacataaaaccctcctaaagccatatagttataaccacagaaccactcacggcgaattaataactctagatgaggagcagcgcctacatattgatgctgtcaacactgtttggtcacatgctaataaagataacaccagatcattcactgaagaagagatcaaggaattagaaaattctagacacgaacaaagctag

SEQ ID NO: 4779 - DNA, 2292 bp, Saccharomyces cerevisiae
atgaaaaattttcttccacgcacattgaaaaatatttacgaattatatttcaataacatctcagtacatagtatagtatctcgcaacacacagctcaaaaggtcaaagataattcaaatgactaccgagactttcgaagacattaagctagaggacatccctgttgacgacattgatttttccgacctggaagaacaatacaaggtcactgaagaattcaatttcgatcagtacatcgtcgttaatggtgccccagtcatcccatccgccaaagttcctgttttgaaaaaggctttgacttctttgttttccaaagctggtaaagttgttaacatggaatttccaattgatgaagccactggtaagacgaaaggttttctcttcgtggaatgtggctcaatgaacgatgctaaaaaaattatcaagagtttccacggtaaaagactggatttaaaacatcgtttgtttctttatactatgaaagatgttgaaagatataattctgacgactttgacaccgaattcagggagcctgatatgcctacattcgttccatctagttccttaaaatcctggttaatggacgacaaagtgagagatcagtttgtattacaagatgacgtgaagactagtgtgttctggaactctatgttcaatgaagaagattctttggtggaatctagagagaactggtctaccaattatgttagattctccccaaagggtacctatttgttttcttaccatcaacagggtgtaactgcatggggtggtccaaacttcgatcgtttgagaagattctatcatccagatgtaagaaactcttccgtctctccgaatgaaaagtacctggtcactttctccacggaaccaatcattgtagaagaagataacgaattctctccatttaccaagaaaaatgagggtcatcaattatgcatctgggacattgcttctggtctgttgatggcaactttcccagtgataaagagcccatatctgaaatggcctttagttagatggtcttataatgataaatattgtgctcgtatggttggagacagtttaatagttcacgatgctactaaaaacttcatgccattagaagctaaggctttgaagccttctggtattagagatttctcatttgctccagaaggtgttaaattacaaccattcagaaacggtgacgagccttctgttttattggcttattggactcctgagactaataattccgcttgtactgctaccattgctgaagttcctcgcggtagagtgctaaaaaccgttaacttagttcaagtctccaacgtaactctgcactggcaaaaccaagctgagttcctgtgcttcaatgtcgaacgtcacacaaagtctggtaagactcaattcagtaatctacaaatttgtaggttgactgaaagagatataccagttgaaaaggttgaattgaaagatagtgtctttgaattcggttgggaaccccacggaaatagatttgttacaatttctgttcatgaagtagctgatatgaattatgctatcccagcaaatacaatcagattttacgctccagaaactaaagaaaagactgacgtaattaaaagatggagcttggtcaaagaaattccaaaaacttttgccaacactgtttcttggtctccagcgggtagatttgtggttgtaggtgctttagtgggtccaaacatgcgtagatcagacctacaattttacgatatggactatccaggtgaaaagaatattaatgacaataatgatgtttcagcttctttgaaagatgttgctcatcctacctactctgcggctactaatatcacttgggatccatctggtagatacgttaccgcatggtcaagttctttgaaacacaaggtggagcatggttacaaaattttcaatattgctggtaacttagttaaagaagacatcattgctggcttcaagaactttgcctggagaccaaggccagcttccattttgtctaacgccgaaaggaaaaaggttaggaaaaacttgagggaatggtctgcccaattcgaagagcaagatgcaatggaagctgacaccgccatgagagatttgattctacaccaacgtgaattattgaagcaatggaccgaatatagagaaaaaattggccaagaaatggaaaaatctatgaatttcaaaatctttgacgttcaaccagaagatgccagcgatgactttaccaccatcgaagagatagttgaagaagttttggaagaaacaaaggaaaaggtcgaataa

SEQ ID NO: 4780 - DNA, 2292 bp, Saccharomyces cerevisiae
atgaaacggttgcaattgtttggtagatcaaaatatttctcgctggtctccagtgctgcgaaggaggaagaagaagaggaagagggctgtgctgatgccaaaagccttctacatagtacgagccatgatatcaaatcgagatcactacgcttcaacgataaatcgtccctcatgtgtttgccaacaaaagttctactgttaatactgcgaactttggacttcaatacattagtaacactatgccaagtcaattcgaggttctacaatttgattacgaatgagttccttttccaaaacgttattttggactcaaaactttcgttgttaaagttcaatgctttgatacactccgagttccacacgtcgaacattgtcacacacagcggtgattgtagcacacaatctagatcacaaaatgcaaggttcctcgtaagatccatcgaattcaaaaatcctcagtcccaagactcgttgttaaaatacagtaagttctataataagagtggccaagattctattattgctggatcttataaactcgattcgtatgataaagacgtaaaaaaactgaataacatcagactaaacgatgagactcccatcataacttcagaacgaatcaaactgcttgataaattggaaagcaactacttccattatacttatattgagctaatgcttgatattatagactatctaccgaacctgaccagagtgattctgagtgatgtggaaccgaattttaaaattcctttatggtactctgtattcaacgatggatctagagattttttcaagaaaataatcaagggccagcaatccatcacaaacgaagatttgaggactttccaactatccaaaaaatttgtcaaagaatacgaatccaagtattattctctgccaaggttgaaaatactggaaatcaaagctaataataaaagacaaagaacctttaatcgtcaacgccatcaccaaaagctcgtactaagaccgagtttattctgctgtttcggcataattaatgaacttaaactagaaaatgtaacgatagacaccgaatcgctagatactccaatggaattcttaccactatttctaaagaacgaagataatgaactgtacagtttacagtctcctatcactgcacttactttagattcatgtgatgtagttcctggaaatggaatattacgtttgtttcactcttactttaaaatggtcaaacatctatccttactgaagattaacagtaaattcgacttattgttatgcagttgtttcccatcgttatccaatctaacaattgattgtaatagcaaatgtttcactaacgaacaggtagtcggcgaatcatattatttccaacagcgaagtttggatacagaagatgattttgatgactgcaattccatgacagaaacattatttgaagcgccatcagattcgaagataattactcctccgccgacatcttcagttgtattgtccttaaatctgaactatatttctagaactacaggaaatgatgtttcaaataacccatcaccagacaataacaaaaagcccgccatgttaactgcggcacagctacaaaattttcaacgacaaagaatccctgaatttcattctttctaccattattaccgcttactttgggagagacttccaagtaaaaatatttctattaacgtaatcaatatcccctttaccaatgtgtatcctttatcccctctatcgttttgggaacatctagcaagaacaattactagtgttgatgagacagatgaggatgttggcgacgagaacgatcaagaaacattaatcggttacgaaaataattccataagagataacataccaaatgctaatgcagttccaaatttaagtacagtaatgagccctgaatcagacattcaccacacttactattggaacaactctgtaaggcgttgcctaagagatagtttaatcaaattgaagaaccgaaccatcgaatatagagatttagatgtggaggagttcttacaaaatgtgacattggaaaattttttcaatgatttccaagatccagagaattttaaagatattccaaatattaacctctggtgtttcctgagaaatttgtcaaaattcaaagctgtcaaaataagaatgctgagacatttttcattatgtacacctagaaccagatacgactgggaactattattgaagcccgtactgcgtgtaaatgttcccattgaagtcagagataaggacggattcgttctttattcttacgggcaaaaataa

SEQ ID NO: 4781 - DNA, 2292 bp, Saccharomyces cerevisiae
atgaacgatagccaaaactgcctacgacagagggaagaaaatagtcatctgaatcctggaaatgacttcggccaccaccagggtgcagaatgtacgataaatcataacaacatgccacaccgcaatgcatacacagaatctacgaatgacacggaagcaaagtccatagtgatgtgcgacgatcctaacgcataccaaatttcctacacaaataatgagccggcgggagatggagctatagaaaccacgtccattctactatcgcaaccgctgccgctgcgatcgaatgtgatgtctgtcttggtaggcatatttgttgccgtggggggcttcttgtttgggtatgacactggacttataaacagtatcacggatatgccgtatgttaaaacctacattgctccgaaccattcatatttcaccactagccaaatagccatactcgtatcattcctctccctaggaacatttttcggtgcgttaatcgctccctatatttcagattcatatggtaggaagccaacaattatgtttagtaccgctgttatcttttccatcggaaactcattacaggtggcatccggtggcttggtgctattaatcgtcggaagagtgatctcaggtatcgggatcgggataatctctgctgtggttcctctttatcaagctgaagctgcgcagaagaaccttagaggtgccatcatttccagttatcagtgggctatcactattgggttactcgtgtccagtgcagtatcgcaaggaactcattccaaaaatggcccgtcttcatatagaataccaattggtttgcagtacgtttggtcaagtattttagctgtgggcatgatattccttccagagagtccaagatattacgtcttgaaggatgaactcaataaagctgcaaaatcgttatcctttttaagaggcctcccgatcgaagatccaagactcttagaggagcttgttgaaataaaagccacttacgattatgaagcatcgttcggcccgtcaacacttttagattgtttcaaaacaagtgaaaatagacccaaacagattttacgaatatttactggtatcgccatacaagcttttcaacaggcatctggtatcaattttatattctactatggagttaattttttcaacaacacaggggtggacaactcttacttggtttcttttatcagctatgccgtcaacgtcgccttcagtataccgggtatgtatttagtggatcgaattggtagaagaccagtccttcttgctggaggtgtcataatggcaatagcaaatttagtcattgccatcgttggtgtttccgagggaaaaactgttgttgctagtaaaattatgattgcttttatatgccttttcattgctgcattttcggcgacatggggtggtgtcgtgtgggtggtatctgctgaactgtacccacttggtgtcagatcgaaatgtaccgccatatgcgctgccgcaaattggctagttaatttcacctgtgccctgattacaccttacattgttgatgtcggatcacacacttcttcaatggggcccaaaatattcttcatttggggcggcttaaatgtcgtggccgttatcgttgtttatttcgctgtttatgaaacgaggggattgactttggaagagattgacgagttatttagaaaggccccaaatagcgtcatttctagcaaatggaacaaaaaaataaggaaaaggtgcttagcctttcccatttcacaacaaatagagatgaaaactaatatcaagaacgctggaaagttggacaacaacaacagtccaattgtacaggatgacagccacaacataatcgatgtggatggattcttggagaaccaaatacagtccaatgatcatatgattgcggcggataaaggaagtggctcgttagtaaacatcatcgatactgcccccctaacatctacagagtttaaacccgtggaacatccgccagtaaattacgtcgacttggggaatggtttgggtctgaatacatacaatagaggtcctccttctatcatttctgactctactgatgagttctatgaggaaaatgactcttcttattacaataacaacactgaacgaaatggagctaacagcgtcaatacatatatggctcaactaatcaatagctcatctactacaagcaacgacacatcgttctctccatcacacaatagcaatgcaagaacgtcctctaattggacgagtgacctcgctagtaagcacagccaatacacttccccccaataa

SEQ ID NO: 4782 - DNA, 2292 bp, Saccharomyces cerevisiae
atgtcagaggaatttatcgcagtttctactttggctagaaacctggaaattgccaagggtaatgagtttcataccattttggcgactttaagatcaccagtttatatcaatgaacagctgctaaaatccgaattgagcttccttgttacaaaaatcctaaaacttatcagatcaggcaatgactttgatctttggaaaggatgtcacacctctgttgtgacttgcgcctataatccactggtcttatcgactcatggaggtcaattgcttgctgccatttattccagattggaacagaagacgggtttctattcttcggttatttcttcatcacatggaaagcagctattcaatacccttatttcttctgtagcgattatcattgatttaatgaagaataaacctacgttatcgagagaagcactggttcccaaattaaaggctatcattccaacgttaattacattgtctcaatacgagcccgaacttgttctaccagtactacagaggatattgaagagaaacactacaacatttaagccatttaccaacaaattccgcactgtgttaatcaatttaatcatatcagactatgcttctttaggcactaagacgcagaggcttgtttgcgaaaactttgcttatttgcatttgctgaaaattcaggttagtgatactagcgatgacgaaactcaagcacatcacaaaatatatgctgattctaattggagaacaggattaatgtccatcttatcacaattcaagcccataattcaattatgtggagaaatcttggattttgaacaagataatgagctgtataaactaattaaaagtttaccggttatcgatgaatccaataacaaagaagaatttttaccctcattgaaattagacttcaacgcacctttaactttatgggaaattccacaacgtttgtccttattggctgacatgcttgttgctttcatctctttaccaactccctttcccattcgagttccgctgggtggtattaattccctttgtgaagttttgttgggagttagtaacaaatatttaccgttaaaaaaagaattgcgtcatgataatgaactaaatggggtcatcaataccatcttacctcaaatacaatttcaaggcattaggttatgggaaattatggtttcaaaatatggcaaatgcggtttatcatttttcgaaggaatcctttcttccattgaacttttcattccattaaaaaagaaaagtaacaatgaaattgattttaatgttgttgggtctttaaaatttgagtttgctactgttttcagattggtaaatatgattttgtctcatttaggccaccaactgaacataatcagcgtcatatcccaattaatcgaagtggcgttgttcttatctcatgataaaacattgattgattctttattcaaaaatcgtaaaagcatcatgaaacaacagactaaaacaaaacaatcaaagaggagtaaaagtgccgaaggtgcattttctgatatttatacgcacccagagctatttgtgtgtaaaaattccatgaattggttcaatgaaatcaatgatttttttattactgcactaaataattggattttgccttcaactccacatattcaaattttgaaatatagtatcacgcaatctttaagattaaaggaaagatttggttatattccagaaagctttgttaatctcctgcgttgcgaggttcttcacccaggtagtgaacgtgtttcaattttaccgattgcaatatcactattaaagaatatcaatgatgatatgtttgaattactgtgtcatccaaaagtgccagtcggtatggtgtaccagttgcacaaacctttggacttaggcgaagacggggaagtaagggatgatatcaacaagaaggaggttgaaacgaacgaatcatcctcaaacgccaatactggcctggagactttaaaagcgttagaaaatttggaaaatgttacaatccctgaacccaaacacgaagtcccaaaggtcgtcgatgatactgccatattcaagaaaaggtcagtagaagaagtcattgaaagagagtctacatcttcacataagaaagtgaaattcgttgaagaaacaaccgtggataatggcgaagaattgattgtaaaaaaagctgtaagccaaactaaggaagaagagaagccaatggaggacagtgaagatgaagaacaggaggagtttgaaattcccgctatcgaattaagtgatgacgaagaggaggaggaagaagaagaataa

SEQ ID NO: 4783 - DNA, 2295 bp, Saccharomyces cerevisiae
atgaagccctttcaaggaataacattttgtccgactgcaataaataatgaaatcttagctaaaaaaatatcaaagaaaattattaagttaggaggtatattttctaaagatttgaccagacaagttaatgtccttgttgttgggtccaccaccaatacaaacaaatttaaatttgcggtgaagcatagattcgatatcatatttattgacattcaagccattgatgacatttatcagctctggctgtctggagaaaatatattgccggactctaatacggcaacaatgacaggatccacctatgagatgctgaagatactttaccggcgattttcgtttaaatatttgcataacttcaatatcttcattggcagaataaccgacactaacataacttccatcgattcattggttaggagtattaaaaagttagggtgttctagttataactatcaaaactttgtaatcaaagatacctcttcacacaatgatgacgatgatcaaggtcagaatgggcagatatccatttttgttacggatactttactaggagcaagagttaacgctgctattgaacaaaatatacctattgtacatttcaaatggattctcgattgccaaaaaagaagcgcactgttaccgtacgatccctattatcttttaccaaatattaaagacctgccctatgattcaatcggatcaaactcttgcgattgctgggataaaataaacaccacctttccaaccaatatcgatgcccaatcctctctgcagcggcagcaatcctccagtaccctgactccttcgctcccgaaaacatcatccctcttgaataaatttaaaccaaagggtgaaaaaatatgggacaaggcaatgtctctacagcagcatagtaagacaaatttttcagtactagggcagtcaccattatcgataaataacaaacaagaagatttaagtgataatagtactttgattttcaaaaattgtgcgtttatcattcatcatatttttcctggcaatcaccgttcaatactaaccaaaattgttgttcaaaatgggggtaaaattgagacgtcttacttgagcggcatttacgatcattcttattacatcattccaagtaataaagctcttgactccttcaatgatttacctgagattatagatgataatgatggtatagttacagaatttttcattgaacgctgcttgtattatcaaaaattactacacccaatagatttatggtcaaaacccttcctcagcacaatagagtttcaagtttcgtcttcttcaaagttattgcatcatgaattttcttcttccccttttctgaatgttactatcactggattctctggcgtagagctgttacatctgactaaagtattaaatcttctaaaaccaatgggcatcaattatgtagaatacctcaataaatccactgacattctgctaatcaacttagcagctttacccagtatcccgaaaacccatccgttatggtcgaatgaatttagcgatctttttactcagttttgcattaataacaataatgatgatcctggtgataataacagaaaagattttcaaaataattcaatcttgagaaattcgatgaaaaggaaaattgaatatatcaagaaattccactccataccggtagttactccagcatttatttttaaattattgtccgctgcatctggagaaaataatgaaatctttttaaacaatatcaagtggtgtattatctgcccaagaggacacaaggacgattttaaatgtaagataaaaaaaccatactataccagcattagttcagaaaaaaagtaccaaaacaatgatccaaaaatcgacaaaactattcttttgaaaagaaacaattcctcattatcggagcactctatgaaagataccaaaaacgaattattgcagaaaattagagaaactgattctggaagaaaaaagcgtagtgtctcatcgagtatcatggatgtttcttcagagagacaaatgccggatacgaaaaggatcaagttggagtcactgccaaaaaatttcgttcctaaacaaattaaacgaaccacgagttggggcacaataatgtcagaaaatgtgcctacagagcagccgactgcaatttctaatccagaagagatcccaagaactgaggaagtttcacatactcaagttacctatggctccattcaagataagaaacgtactgcctctttagaaaaacctatgagacgacagacaagaaatcagacaaaggaattagattcttga

SEQ ID NO: 4784 - DNA, 2295 bp, Saccharomyces cerevisiae
atgcctgccaaaatacacatttctgcagacggtcagttttgcgataaagatggcaacgagatccaattgcgtggtgtcaatttggatccgtcagttaaaatccctgcaaagccattcctatccacccacgctcccatagaaaatgacacgtttttcgaggatgctgataaagtcagtttcatcaatcaccccttagttcttgatgatatcgaacagcatatcatcagattgaaatcactgggttacaataccattcgtttacccttcacctgggaatctcttgaacatgctggtccaggacagtacgattttgactatatggattatatcgtcgaggtactaaccaggattaacagcgtacaacaaggtatgtacatttatttggaccctcaccaagacgtctggtctaggtttagcggtggatctggagcaccgctatggaccttatactgtgcagggtttcaacctgcaaacttcctggccaccgatgctgcaatcttacataattattatattgaccccaaaacgggcagggaagttggcaaagatgaagagtcctaccctaagatggtttggcctacaaactacttcaaactggcgtgtcaaacaatgtttacgttattctttggtgggaaacaatatgctcctaagtgcacaattaatggagaaaacatacaggattacttgcaaggaaggtttaatgatgcaatcatgacactgtgcgcaagaattaaagaaaaggctcctgagttgtttgagagcaactgcattattggattagagtctatgaacgagccaaactgtggttacattggtgaaacaaatctcgatgtgattccgaaagagagaaatttgaaattgggcaaaacgccaacggcatttcaaagctttatgctgggtgaaggtattgagtgcacaatagatcaatataaaaggacattttttggattttctaagggaaaaccgtgcacaatcaatcccaaaggcaaaaaagcttggctgagtgcagaggaaagagatgcgatagatgcgaagtataattgggaaaggaaccctgaatggaaaccagacacttgcatttggaaactccatggtgtttgggagattcagaatggtaaacgccctgttttactcaaaccaaattactttagccaacctgatgcaacggtatttataaacaatcattttgttgactattacactggaatttataacaagtttagggaattcgatcaagaattgtttattataatccaaccgccggtaatgaagccaccacccaatttacaaaattctaaaatattggacaataggacgatttgtgcatgtcatttttatgatggtatgacactaatgtataagacatggaataaacgaattggcatagacacctatggactagtaaacaaaaaatactcaaatcctgcctttgctgtagtgcttggcgaaaacaatatacggaaatgcattaggaagcaattatcagaaatgcaaaaggacgctaaatccatgcttggaaaaaaagtacctgtattcttcaccgaaattggtattccatttgacatggacgacaagaaagcatatattacaaatgactattcttcacagaccgctgcattggatgctcttggatttgcattagaaggaagtaatctttcgtacaccttatggtgttattgcagtattaattcacatatatggggtgacaattggaacaatgaagatttttcgatttggtccccggatgacaaaccactctatcacgatacccgagcaaaaactcctactcctgagccatctccagcctctactgtggcttcggtatccacttctacatctaaatcgggttcttcacaaccaccaagtttcataaaaccagataatcatttagatttggatagtccctcgtgcactttaaagagcgacttgtcagggttcagagctcttgatgctataatgagaccattccccatacaaattcacggaagatttgagtttgctgagtttaacttatgtaataaatcctaccttttgaaattagttggtaaaacgacacctgaacagataactgtccctacatatatttttataccacggcaccattttacaccaagccggttgtcaattcgttcatcatcaggtcattatacctataacactgactaccaggttcttgaatggtttcacgagcctggccatcagttcattgaaatttgcgcaaaatcgaagtcaaggcccaacacccctggaagtgacacttcgaatgacttaccagcggaatgcgttatcagctaa

SEQ ID NO: 4785 - DNA, 2295 bp, Saccharomyces cerevisiae
atggatgaacacgaggaagcagtcatcttcggtatctgccttgtggactttcatcacaaaagaggccctgaaatagaatactggtatggcttacctgagggcacccaaagtgcagaactatggccaaatttacccttccaggcccttcctgatggttctcactcgtttgaagaaacatttacttatttcacattactatatgatgaaagaagacaaaggagccctcccaacggggcaactgatctgagtgatgatagcatcaatgacaacacgactttgtttgccatatcttgctcgagacagataaagagtgatgaattggtcactaaagataaggatgtaacacgatctactgtacagaaggcaattgtagtcatctcaaggcaaccaatcttcggtcaaatcaaggacaaacttagtattgtgactaatgcttttttcttgcagcatgattttggggacaggaagataatccagtctttatacgaaaacctgaagtcgatttacacgcctgcatcattggtcagaaatgccgaaaatcgtctttatattgggttatgtctgagaaagatactacatgattttaagagaaacgctttagtcttattgaaagcaattatgcttgaaaaaaaaattatagtttacggcaacgacgtggaagctttgtgtaatttacagttcggtctgatcagcttaattccggacttgatgtcaaatttgcaggattctggcagtcctcagttgtttcaggatatttcgaaattaaatgttgtggactcgtttaaatcaagcaatcgagaatcagtgttgagattcttaggttttccattaccgattttcgaaaaaggtggactattttcaccctatactccactgcagcaaatgaatgacatacggtcagaacgtactttgttttttatgattggaagttccaacacattgcttgctgaacaaaaggaggaactgtgccacatatttgtcaatacagacaattccactgtagatattctggacaagactttgaaccccgtcctccaattgtcaagtcatgataaaaaatggattgaatctatatctggaattgtatcagacacatggaacgaaaatgatgatgaaactccaaaaaactctcaatttgaaggcagtgaggatttcattaggtggcaattcgaggactatttaacggggttactttccagtgttaaattaagtgattatttggacctgcataaagagaatgatcaagctttgaagactatacctgaggatatgctaaattccaatcccgttcatttattcaatttgaattgggttcagagttggaaagagactcaaaattttctgatattcaactcaagaacagatgatagattgttcgacttgtttcctccgaagcatatatataacggtgccgacactctgtctctattacagcaacgatttttggccacatttcataatttaaaaagaagctctagcaactcttcaagcaataaaaatggtcatcaaagcgaggaggatatcaaagaccaggaaagcatcgagtcaaaaaagtctgtttcccaaatttctgtaaatcctggaaagaatacagacaagccagcagccaacttatggaattcatggaaggaatatttcaataaaccaaagaatactgctaatgaagatgttactgaatccacagaagatctcaaaaacagaagtaaaacatcgaacgcgatacagaaagctatgatgggcttgggtttacattataaacctgatgcggagacagatcaacaaagtgaagaggtgggaaatagtgaggacaatgaagatgatgatactgatgaggactctgaggatgatgatgatgatggtggtgatgacgatgatagtgaggacgatgacgatgacgatgacggtgagggcgatgaaaatggcgatgacggtgagggcgatgaaaatggcgatgacggtgagggcgatgaaaatggcgataaggaagacagtcaagattttagcaatggttttacagacgttacgaacattaacactgatcatgataaagaaaatgaacagaattttgagggtaatgcagaaaattttaatgaggacgaaaccgttgcagataaagatattgaaggtggtcctgagagcaataaaaattccgacagtaaaactgatatttatgaaaacgatagaaatgttgaagactcatctaaaacgagaaatacagttaaaaaatccaatgaggagggcggtgcgaatgacgctgctataggtaattgtgtgcaggatgaggaaaaattatga

SEQ ID NO: 4786 - DNA, 2295 bp, Saccharomyces cerevisiae
atggtgaacgaattagagaatgtgccacgggcgtcgaccttgacgaatgaagagcaaacggttgatcctagcaataacgactcacaggaagatattagtctgggtgattctaacgaaattacttcgttggcatcattaaaggctatccgatcaggaaatgaagaggaaagcgggaacgagcaggtgaatcataatgatgaggccgaagaagatcctctgttaactcgctaccataccgcttgccaaagaggtgatctagcgactgtcaaagaaatgatacatggaaagttgctcgaagttaataacgacggtgactctacggaacatatcactggtttgcattgggcaagtattaataacagactttctgtagtggattttctagtttcacaaggcgctgatgtcaatgcaagggctggtgctttgcatgccacaccattacattgggctgcaaggtatgggtacgtgtacattgtcgattttttgcttaagcatggagctgatcccaccatgaccgatgaccaaggtttcaatctactacacttatctgtgaacagctcaaatataatgctagttctatacgttttattcaacgttgtcagcaaaggtcttttagatatagattgccgagacccaaagggcagaacttcactactatgggctgcttaccagggagattccctaactgtagcagaattgttgaaatttggtgccagcataaagatcgcagatacagaaggattcaccccactgcactggggcactgtaaaagggcaaccacatgtactaaaatacttgattcaagatggtgcagattttttccaaaaaacggataccggaaaagattgctttgctattgctcaagaaatgaacactgtgtactcacttagagaggctctaacacattctggattcgactaccatggttatcccattaaaaaatggttcaaaaaaagtcaacatgctaagctcgttacattcataacgccatttctatttctaggaatcgcatttgctcttttctctcatattaaccctttgtttgtaatcattgtcctttttttattggccattgccactaacaaaggcttgaacaaattcgttctgccgtcatatggacgaatgggtgtccacaacgttaccttgttaaggtcacctttgttatccggtgttttttttggcactttactttgggtgactatcgtttggtttttcaaagttatgcctcgaacattttctgatgaacaatatactaacatcctaatgctggtaatacttgtttctgtattttacctttttgggcagcttgttattatggacccaggatgtttgccagaagaaactgatcatgagaacgtgcgacaaacaatctcgaacttgctcgaaatcggtaaatttgatacgaagaacttttgtatcgaaacttggattagaaaacctctaagaagcaaattttcgcccttaaacaatgctgtggttgcaagatttgatcattactgcccttggatctttaatgatgtcggactcaaaaatcacaaagcatttatattttttattacattaatggaaagtggtattttcacatttcttgcactttgcctggaatattttgatgaacttgaagatgcacacgaagatacatcccagaaaaatggcaaatgtttcatcctaggcgcttcagatctctgttcgggattaatatatgatagatttgtctttctgatattattatgggctttactccaatctatttgggttgcaagtttgatcttcgtccaagcctttcaaatatgtaaaggaatgaccaatacagaattcaatgttttgatgaaagagagtaagtccattggccccgatgggttatctttcaatgaaaacttcaatactactccagaaggatttgcgccgtcgattgatccgggtgaggagagtaatgatactgtactagcaccagtcccaggctcaacgataaggaaaccacgcacttgttttggcgtttgttacgcggtgactggtatggatcagtggttagcggttataaaagaaaccattggcatcaaggatagcaccggacataatgtgtattcgattacatcaagaataccaacaaattacggttggaaaagaaatgttaaagacttttggcttacaagcgatataaatgcgcctttgtggaggcgaattttgtatcctccttcgggctctaaagctttgctcaacgggatagaagttgactattttaagctttacaaattgccaaataaggatgttgaacaaggaaatgatatggtatga

SEQ ID NO: 4787 - DNA, 2295 bp, Saccharomyces cerevisiae
atgtcaacaaactcattccatgattatgtggatttaaaatcgagaactaatacacgacagttttcagatgacgaagagttcactacgcctccaaaactaagcaatttcggatcagctttactttcccacacagaaaaaacttcagcatcagagatattatcaagtcataataatgacaagatcgcaaatcgattagaagaaatggacaggagttcatcaaggagtcaccccccaccgtcaatgggcaatttgacatccggtcatactagtacctcatcgcattcaaccttgttcggacgatatctgagaaataatcaccagactagcatgacgacgatgaacactagtgacatagagataaatgttggaaatagtcttgataagagttttgaaaggataaggaatttgcgacaaaatatgaaagaagatattacggcaaagtatgctgaaaggagaagtaagagatttttaatatccaataggacaacgaagctgggtcctgcaaagagagcgatgactttgacaaatatctttgatgaggatgtgcctaactctccaaaccagccaataaatgcaagggagacagtggaattaccacttgaggattctcaccaaacaaactttaaagaaacgaagagaaatacggattatgattcaattgattttggagatttgaatcctatccagtatattaaaaaacataatcttcccacaagtgaccttccactaatatctcaaatctactttgataaacaaagagaagaaaatagacaagcagcactccgaaaacatagttccagagaattgctttataaaagtaggtcttcttcctcttcactttctagtaacaacttattggcaaacaaggacaattctataacatccaataatggttctcaacccaggcgaaaagtttctactggatcatcttcatctaagtcatcgatcgaaataagaagagctctcaaggagaatattgatactagcaataacagcaatttcaacagcccaattcataaaatttataaaggaatttccagaaataaagattccgactccgaaaaaagagaagtactgcgaaacataagcataaatgcaaatcacgctgataatctccttcaacaagagaataagagactaaaacgatcattggatgatgcaataacgaatgagaatataaacagtaaaaatctagaagtattttaccatcgacctgctcccaaacctccagtcaccaagaaagttgaaattgttgaacctgcaaagtccgcttctttatcgaataatagaaatataattacagtaaatgactcccagtacgaaaaaatagaacttttgggtagaggtggatcctccagagtttacaaggtgaaaggatctggcaatagggtatacgcgctcaaaagggtgtcttttgacgcttttgacgattcaagtattgatggattcaaaggagaaatagaacttctggaaaaattgaaagaccaaaagcgtgtaatccaactactagattatgaaatgggggatggtttattgtatttgataatggaatgtggtgatcatgatttgtcacaaatccttaaccaaagaagcggcatgccactggattttaattttgttagattctatacaaaggaaatgttgctgtgcattaaagtagttcatgatgcgggcatagttcattcggatttaaaacctgcaaattttgttttagtgaaaggtatcttaaaaatcattgattttggtatagcaaacgcggtaccggaacatacggtgaatatatatcgtgaaactcaaattgggactccaaattatatggcaccagaagcactagttgctatgaattacacacaaaatagtgagaaccaacatgagggaaacaagtggaaagtggggagaccatctgatatgtggtcatgcggttgtattatatatcagatgatttacgggaaacccccatatggcagtttccaaggccaaaataggctgttggctattatgaatcctgatgtgaaaatcccatttcctgaacatactagcaataatgaaaagattccaaagtctgccattgaattaatgaaagcatgtctgtacaggaacccagacaaaagatggactgtggataaagtcctgagtagcactttccttcaaccttttatgatatccggatcgattatggaagaccttattaggaatgccgttagatatggctctgagaagcctcatatatcacaagatgatctcaatgatgtggtagacactgttttaaggaaatttgcagattacaaaatttag

SEQ ID NO: 4788 - DNA, 2298 bp, Saccharomyces cerevisiae
atgagttttttatgggggtctacaaagtccaagaaaggcaagaataaaaaggctgcaggttctcttccgtcaggtgttgttccacagcaacgtgtgaaaccaacacgtaaaaacgttcctatagattatccaagaactttggaaaaagtacatggtgaaagtttaatctttaggacgtcccttttaagtgaattggtgagcactggtaaatctggtattggtcctccagacttgattcattgtacagagttagataaatttcacgatgagaaaataggtgaattcttttacatcacggggatcgacgcctcgagcgtctctatgccaattgcatttttgaagctgataaaatggaatgatggtaagaaactaaaatcagcatctttgaagaacgacgacatcacaacctactgcactttcaatatctttcaaaaattggacattagattaagatatgaatctgaagatgtttatcaagttaatatcgttgactgtttaaatggcaacaatgaaataccgttgagtgatcttatttgggaagaaactttcgttagctgttgcataagaagcgtaattattaattcagattttgaaagaaaaatacctgggctagtggaattaccatttgtttttgagaacagatgcgcgagtgattataaaagggtgatagattcgttatgcaaatttttgccaagatttttagaatgtggttgggattctacaaagagcgtctatgcaacgatactgaataactacctaactgaatcattattagtatttctgtctataactccagaattcataacagactatgcgatccaggttttagacaacttgatgacgaatgacccgtcaaattctagatattacgctattgtaattatttctatcatggagcgaagtaatgaccgcgatgtagaaatgatcaaacggatacacgagatattagacctattactacccgtactgtatggattgccatccgatgaaccttacatttctgatttgatcaattgcatcaccgatgtattaagcatccaagcaaggtttctattgaacaataacgactatgaactttctttatccatttccacattggccacgaatttatcttctgataattttgaatcttggtatctgttatctaaaggctatattttttcacaacagtatgataaggcactgctctcaatcaattcgatgccctgtttagcggaatatgatatcgttaaacaagcccagattaacgcttttaagttttatatgaactactacaaggcaccactatgtcatagcagagaacactgtaccatgacatcacacgagttaaatcacctcatgaatattatgcattatgaaaatgagttggagttgaagacaataatatttggacgcactgtaatgcccaatgaatctaagtatggatgtattgaagagatatggaataaatcctgtcttgaattaggacctatttgtggaccacagagtgacaatctcataaactttgtatctcagcaggaggtaaatacagtaggagatatgctgttactaaaacgaagcaaagaaaccagacaagagagttggtttataaagcaagtacgtcttctgttgatggaattagtcgctagaatcggctggaacgccttacttcagctaagatctgacgttttcgttatggagagtaaattcaaaatgatagaatcttcggacaagctgtccacagaattacgccagaagaggctctgtcagagatggtttgatgctatgtttctggacgtttacgaagatttaagtattagcacttcatctcaagaaaataaggctacggcgaaatacagcgggttggaatgggaactacttggcttaactctgcttcgagtgagtgacttacccgatgcagtagcgtgtctacgaactagtattttggcaaggtttgaccctattagttgtcaccatctgttgaacttttatttaaccatggattttaatgatgagtttatgagaaggtttgacgtcgatatcattttagatctattagtgaaattgatctcctttcggatacgattctatgatagatttcagatattttcccttcaagtactaaggaaactagagggacagctgggctccgaaattattaagaataaaataattaattctccttacgggcaagctggcatcacttcggtgatagattatatgcttgaatgcctctctaaaaataggaatgaagcctgcctagcctatgaacgccctcttccagatcttccttccactatcaaacctctggcagactaa

SEQ ID NO: 4789 - DNA, 2301 bp, Saccharomyces cerevisiae
atgagtgaagaggaaacggtctcagccccagctccagcttctacaccggccccggctggaaccgatgtaggtagtggtggagcagcagctggaatagctaatgctggtgctgaaggcggcgacggtgccgaggatgttaagaaacatgggtcgaagatgctagtggggcccaggccgccacaaaatgcgatattcatccataagctataccagattctggaggacgaatcgctacacgacttgatatggtggaccccttcgggcttatccttcatgattaagcctgtggaacggtttagtaaggctttggctacatatttcaagcatactaatatcacgagctttgtaagacagttgaacatttacggctttcacaaggtgtcgcatgatcatagcagcaacgacgctaatagtggcgacgacgccaatactaatgatgacagcaatactcacgatgataatagtggcaacaaaaacagtagtggcgacgaaaataccggtggcggtgtccaagaaaaggagaaaagtaaccccactaaaatctgggaatttaagcatagttctggtattttcaagaaaggtgacattgagggactcaaacacattaagagaagagcttcttcccgtaataactcctcaattaacagtcgaaagaattctagtaatcaaaactacgatatagattccggtgcaagagtaagaccctcttcgattcaagacccgtccaccagttccaattcctttggtaatttcgttccgcaaattccgggcgccaataactctatccccgagtactttaataactctcatgtaacttacgaaaacgcaaaccatgccccgctggaatccaataacccggaaatgcaagagcaaaacagacctccgaactttcaagatgaaacactgaaacatttgaaagaaataaattttgatatggttaagattatagagtctatgcagcatttcatatctttgcaacacagtttttgttcacagagtttcaccttcaagaatgtgagcaagaaaaaatcggaaaatatcgtgaaggatcaccaaaagcaacttcaggcattcgaaagcgatatgttaactttcaaacagcacgtcatgtcgagggcccaccgtacaatagattctctttgtgctgtaaatgctgccgctaccgctgcctctgtcgcccctgcacccgcgcccacatccacatctgcatatgcacccaaatctcagtatgagatgatggttcctccagggaaccagtatgtcccgcagaaatcttcctcgaccacgaacatcccttcgagattcaacacggcttcagtgccgccctcgcaactttttgtacaataccaaccgcagtcgcaacaacatgtgacttatgcgaagcaaccggcacatgtaccaaactttatcaatcagccgatacccatccaacaactacctccacaatatgcagacacttttagcactccacaaatgatgcacaatccttttgcctcgaaaaataacaacaaaccgggcaacacgaagaggaccaatagtgttctcatggacccgctgactcccgcagcgagtgttggagttcagggtccactaaactatcctatcatgaatattaatccttctgtccgtgactacaacaagcctgtccctcaaaatatggctccgagtccaatatatcctattaatgaaccaacaacgagattgtattctcaaccaaaaatgagaagtctcgggtctacaagctctttgcccaacgatagaagaaacagtcctctgaagctgacaccgagatcatcgttgaatgaagatagtctgtatcccaaacctagaaactctctcaaatccagtatttcgggcacgtctttatcctcctcttttacactagttgccaacaatccagccccaattcggtactctcagcagggattgcttcgctcattaaacaaagctgctaattgtgctccagattcggtaactccattagactcgtctgtcttgacgggccctcctccaaaaaacatggacaatcttcctgctgtttcttcaaatttaataaactcccccatgaacgtcgagcacagctcaagcctatcacaagcagaacctgcaccacaaatagaactaccgcagccatctttgcccacaacgagcaccactaagaatactggcgaggctgacaatagtaagagaaaagggagcggtgtttattctttactgaatcaagaggatagcagcacgtccagtgctgatcctaaaactgaagataaggccgctccggcactcaaaaaggttaagatgtga

SEQ ID NO: 4790 - DNA, 2301 bp, Saccharomyces cerevisiae
atgcaactggaagccactcatcagaaagaaaaccacctgtctcctttggctagcttcatttttccagacttcagggcattgttcaacatagggtttaatttatattctaatataaactacaaagaagtagatattaatggatttgaaatttacattgtcgaacaatgggctgcccagagaaaaatatcaactctaatcacttcatatacgggcaacttacaagacaccatatctgcagtagaggttgctcttcccgaagatcctgaggaatggccatgttgtttgaagaaataccatgaagaattgttgaagttttctagtccaaaaaagactgccaaaggaactttatttgttacaaacctttcttctttcaaatctacgctaaacttattgcatgttgagtgtggtaatctaaagaaaatctggaaaaacttcaaaaccaactacgacctaaagagattacattgtggtggtcgttcagctcagctgttaaaaaagacacctagtgcctcaatagcgaagtttgcacagttatataaatttccgaattcagctttttctcatgaaataacgtcggatttccaacaaccttctcttcagaatgacaacagctcaataagtagcatagaaaatattcctgttaatcattgccctgtggtagaactaactaccctcgtgcaaatatcacttagttattttgcgctgtttgaatacaagaaggagagagatggtctcttatgcaatggaacgaaacaatcccttgaaaaatggtgggaaatatatgggaaacgataccacggcattgataagccgaagaatgaaacgatccttggtccgactacggtggcatcactacttagtcttgtattgacttgttacttcaaattaatggtagaagattgcatgtcagcaaaagatccgtttgatgaagaagagttttattctggtctttatgcatttcaaaagaaatacggcctatccaaaaacaataaacagacctccttagacgaactaacaattgataaattatttgaagtatcttccaagacttcaaacaaagatattttcaagtttaaaaaggttgtgaagtcaactgttcaagacatgactggcaaaggaaactttatgcatctatccaatgagatcctaacaactgatttagataccctggtaaagaatatacacggtggatcccttggtaagctctggaaagggagaagtgcttcgagaaaggaaacatgcatggtttgggaaagaaaaacctttctaagtttcaagtttgaacgtggagatccatccttacaattggaaaataatgagctgttttatggtacgagtgtgccaagtgaacagttaacgacttccaataaggaggacagtgatacgcaacccacaaagagaaatagtatatatgatattgccaatggctccaaatcatcgctatctatctcatccatgttctgtaattatgatgaaacccgttacaaaagtaccaacaaccttaatagagcctataggggggagtattttaggcgcaattcgatcccattttgtaacgatggtatacacgatactaaaaaaatatctgctgatcttaataagatagatggattgtatcgttgcaattcatattctgaggtacaaaacgcaatagagctgtggagcttgccattcgattcatcagtcatcagattagcaagagacttacttaagatacaaagtctaatgtcagttcaacgtcagctcgatgaaatacgtgacggatatctgggaaaaaattcacaaagatcataccagaatgatctgatgtttagacaaagcttgaacaaattgcaggaaatgtgtgagagatgtaagagaggttctaacgaatttcactgggaatatggtaacatgcaaaacaaacagcaaattttggagagtgagaaaaaagatatgaaatcactttcttcgaaactgaaatataacgttcgtatcctagatagacgtgtaagagatgttgaagccagcgtagatcattttgatcgcaagttagaggatgttagaaaaaagcttctggagcaaaataatagtaaagacatatctatggccttagaaagtccttgtgataaatttgaatttgacagttttatggactctatagtgcagtcccaacagactaaatatgaagggctgtgttttaaaattttagacaagaaaagtcttcgaaagttaaaaaaggaattctggaaatggagcacctggacattcgataccttcttatacaaaaataggcccaataaggagaaagatacactatga

SEQ ID NO: 4791 - DNA, 2301 bp, Saccharomyces cerevisiae
atgggaaataggtctttgacagaggcagaccacgccctgctgtccaagcccttggtaccgacatctgcggaacatacacaaacgcaagagtatcctcgtcctttcgtagatggcagcaattctcagagcgggtctgaactacaggcttctccacaaggtcagtttggagaaaaggcattgactagtactaatcgcttcattcccctggcaaatgatgacccgggtatgcagcacgagatgggtcttgatccctcaatgaggcgtagaagagaagaatgggcagaacgtggtgcggcaaaaatcgtcaaagatgttgtcgacccagctacgggggagttaactaagcatgttgtcaagatgggaataaaggacttcaagtttggagagcaactcggggatggatcatattctagtgttgttctggctaccgcccgtgattcgggcaagaaatatgcagtaaaagtgttgagtaaagaatatctgatccgtcaaaaaaaagttaaatacgtcacagtggagaaattggctttgcagaagctgaatggcaccaagggcatattcaagcttttcttcactttccaggacgaggcaagcttgtatttccttctagaatatgccccccacggtgatttcttgggcttgattaagaaatatggatctttaaacgagacatgtgcacgctattatgcgtcgcagatcatcgatgccgttgactccttgcataatatcggcattattcacagggatatcaagcccgaaaacatattgctcgacaaaaatatgaaagtgaagttgacggattttggtacagccaaaattttaccggaggaaccttcgaacaccgcagatggcaagccttatttcgatttgtatgctaagtcgaaatcatttgttggtaccgcagaatatgtttctcctgagctactgaatgataattatacagattcccgttgtgacatttgggcatttggttgcatattgtaccaaatgcttgcgggaaaaccgccttttaaagctgccaatgaatatttgacattccaaaaagtaatgaagattcaatatgcgtttactgcaggttttccgcaaatagtaaaagatttagttaaaaaactattagttagggatccaaatgatagattgaccataaagcagatcaaagcacacctctttttccatgaagtcaactttgaagatggttctgtttgggatgataatccaccggagatacagccatataaaataaatgcagaggcgatgaagcccctgcaaaaggtttctgaatctgataccactgtcaaaatggccaaccttcagctggctggtaatggacatgcagatactcccctgcaagcaccagcagcgacctctcaagagcattctgtgatcagtatgactgcagcaaccgccgcattcaataaagattatacaagtcaacccaaattggggagcaagtcaagcacatctgttagatctgcctccaacaacacagatcgcgaggtaattcaaaagaaggtttcaaaaaatcgcgcatctgtatcatctccttcaatttctactacatcacgggggaaagataatagaagtcgctcttctgacgccttctggtcacgctacttgcaaaatatggatgaacgtgtcttgttgatgaaggaggtagcgctttccacacgaaacttagaggactcacctgtaggtcttgagaacgtggctctggactacaagaaccctcttgatatcgagcctcctactgatagtgcaggcaaattttacaagaaaatgtttctaataacaaacctaggcagagcacttgtttttgtcaagagaagaagtctcagcatgtgggaagaacaggaatttgaattgcaattcgaactagagttgaatgacgttgagaagatacgctttataagtgatcaagtccttgaaattgacggttccaggacgattttcataggatgcaaagagagagcagttttaatgaaactatggaaattaatacataatggaatgaccgccaaacctaaagtagtatcgccgaagtcggaccataaaatgtttgataagttcattcttcaaaaaagacagaatacaaaaaaaaagaatcaagctcctcccgtacctcaatcgaataggctaataaatggtttaccggaccgttgcatcttaaagacacccgaagaaggcgcacttcacacaaaacgtcccacttcgttgcagacccgatcgtcatctaattactcaaaattgctggcaagatcgacacaaatgcggaaaaacatgacacggacagatgaaaaatga

SEQ ID NO: 4792 - DNA, 2304 bp, Saccharomyces cerevisiae
atgaatatcttcataaaagccctgagaagatatactataatgtctacgccgaagattgtgcagcccaaatggaaggttccaacgccacaagctaaagaaactgtgttgaagttgtacaacagtttaacaagatctaaggttgaattcattccgcaatctggcaatagaggtgtcacttggtactcttgcggtcctactgtttacgatgcctcccatatgggtcatgccagaaactatgtctctattgatatcaatagaagaattattcaagattattttggttacgacgtgcaatttgtgcaaaatgttactgatatcgacgataaaattattttgagagctagacaaaactatttatttgacaattttgtcaaagaaaatgataccaaattcaacgccactgttgttgacaaggtcaaaaccgcacttttccaatatatcaacaaaaattttactattcaaggcagcgagatcaaaactatcgaagaatttgaaacttggttatcgaatgctgatactgaaactttaaaattggagaatcctaaattccctatgcatgtcaccgcagttcaaaatgctattgaatcaatcactaagggcgattccatggacgcagaagttgcctttgaaaaagtcaaggacgttacggttcctctattggataaagaattgggctctaccattagcaatccagagattttccgccaacttccagcttactgggaacagaaattcaatgatgacatgttatcattaaacgtgctacctcccaccgttacaactcgtgtttctgagtacgttccagaaattattgactttgttcaaaaaattattgataatggttacgcatatgccacttccgacggttccgtgtactttgatactttaaaatttgacaaatccccaaatcatgactatgctaaatgccagccatggaataagggccagttagacttaattaatgatggtgaagggtccttaagcaactttgctgataacggaaaaaagtcgaataatgattttgctttatggaaggcttccaaggcaggtgaacctgagtgggaatcaccatggggtaagggtagaccaggatggcatattgaatgttctgtgatggccagtgatatcctaggctctaacatcgatattcattcaggtggcatcgatttggcctttcctcaccatgataacgaattggctcaatccgaggctcgcttcgacaatcaacagtggatcaactatttcttacatacgggccatttacatattgagggtcaaaaaatgtctaaatccttaaagaatttcattaccattcaagaagctttgaaaaaattctcaccgcgccaattaagattggcttttgcctcagtacaatggaacaatcaattggatttcaaggaatctttgatccatgaagtaaagtcatttgaaaactccatgaacaatttttttaagactattagagcattgaagaacgatgcagcttctgcaggtcatatctctaaaaagtttagtcccttagagaaagaattattggctgattttgttgaaagtgaatcgaaagtccattcggcgttctgtgataatttatccacacctgttgctttgaagacactgagcgaattagtgaccaagtcaaacacatacattaccactgcaggtgctgctttaaaaattgagcccttgattgctatctgtagctacatcaccaaaatcttaagaataattggatttccatcccgtcctgacaatttgggttgggcagcccaagctggctccaacgatggatccctaggctcattggaagacactgttatgccatatgttaagtgtttatccacatttagagatgatgtacgttccttagctatcaagaaagccgaacccaaggaattcttgcaattaacggataaaattagaaacgaagatttgctaaacttgaatgttgccttggatgataggaatggacaatctgccttgatcaaatttttgactaacgatgaaaaattggaaattgtcaagctaaacgaggagaaacatgccaacgaactagcaaagaaacaaaagaaattggaacagcagaaattaagagagcagaaggaaaacgagaggaagcagaaagctcaaattaaaccacaagatatgttcaaggatgtcacattgtacagtgcttgggacgagcaaggccttccaacaaaggacaaagacggtaatgatatcaccaagagtatgaccaagaagttgaagaagcaatgggaacaacaaaagaagctacatgaagagtactttggtgaagacaaatag

SEQ ID NO: 4793 - DNA, 2304 bp, Saccharomyces cerevisiae
atggcaaaaaggcatagtcattatcaaggaagcagacgtaggcatgcacgtggtagcaattccaagaaagctggcagggggaatgctaaaggcatacaaggcagaaagataaagaaaaaacctactcccactaacagttggcataactcttctataccactaggagaaggtgatcttgatgatgtaggcgccgacttcaacccaggaagagcattcatatcaccaaaaactatagaagactattattttggtcgcgatgccaagagccgttctatgaaaatgggtggtttaagaccaggtaatcgatatgattcttcaactgacctacaagcaggaagggcagcattccgcaaaagacctatgcaatttgtaaaagctaaggaagtttacgatccatcccacaatatgattcaaaaactgagagcaaagaacgaaacaaagaacagtgaagaaattgtcgaaagggaagcagacgtttttgaagaaccaggaaagatgacttctgatgttgaatatattaacaatgaagacagtgaaaacgaggatgatgatagtcagaattcaccctcgacggaccactcgctgtcttcgaatgaaagcaaagttgaagatggtgacctgttttttgtagatgaagaggctcagcaatcgccggatctaaccaaaataaaaagagtatgtatcgaggaaatcgcaaggccaagagaagttgcgatagagttcgatcctatcttaacaattggaaaggttgaacttagcgtttccgaaggtaacgaaagcaaggaaattagtgttgacgttccaaataagggtaataagacatatcatccatttgctggttacatttccaacgtattacatggtatgcatactagcgactcggacaatgatgaactagactacgaaatagaaacagagaataatagtgaacctttatacgaatcctcagcaagttctgaggttgatcaagggtttaattatgttggccaacgtcacaattcccgagctgacaacaatcttttaccaagccctagtccgcagttgacagaagatataaaatgtctttcaataaatggtaccaaaacattcgaaggcaataatgataatctgccatctcctgctagcgaagagttagaatttggattcaaagaagaagattttgtcataaatactaatgacatagtggtctccaatataagaatgggcggagtagacaattcatattatctacggtgttacagattactgggagattacgactttcattggattgaccaggacttactcacagacttcgttgtagacgagttaggtcttcctgaagatagattacctgcatatttgaattttattaaaaattctcttataccaaaaattgaaccagctgagccaacctactcagatattccgatttctgattcgagtgatgaaggtgacagctatgaaggcgacagctatgaagatgatgaagatatggcctcctcggttgtgcatagcgacattgaagagggtctggacgacctaattgcatacacattgaaacatgatacagaaagattcaaaacatttgaaaccaagtccttggaaactaagggtaaaggtaagaagaagaagctactcatcgatgacgccttagcgctggatacagaaacgttggagacgttacaaagtaagtttagtaaacgcatagaaaccaaagcaaagaaaagaaaagccaaagaagatttcattgatcaggagaatagaaattcgaacgatatgctcaagaaatacccatatggactccatattcaaaatattaaagatgaatttgagtcctttttgtctaggaacaatgatagactgactttccctccattagatcctcatggaaacaagaccgtaatgaaaattgcgaagcattataatatgaagagttcaaaaattgggaaagcaaatcatacgtcggttgttgtagaaaaaataaagaaaacgaaatggtcttctccgaattatagtctcattgaccaattgatgaggcagaggccagtattcatgagaatagatataagaagaccgagggaggaacaagctgctttcgaaagaactaaaacaatcagagggaaatttcatgttaaagaaggtgagattgttggtcaaaacgctccagagattggaaacgaaaatatcggtagaagaatgttggaaaagcttgggtggaaaagtggagagggccttggtattcaaggcaataaaggtataagtgaaccaatttttgccaaaattaaaaagaatagatcgggtttaagacacagtgaaagttaa

SEQ ID NO: 4794 - DNA, 2304 bp, Saccharomyces cerevisiae
atgggtagaagaagtagagcagctatgctcccaacaaatatcattcttttacagaatttggtaaagcgtgacccagagtcctatcaagaggagtttcttcaacaatatgcacattatgaatcgctaagggacatttttatgttaaatgggcttgctggaggtgattctgcagctgccactaatgggctcgatgtaggaaatggatcttctacaatggcaggtactaacggtaccaccatgagcacttcaacttcgcaacttattgaattggttggcttcgtatctcaagtctgctcatgttttcctcgtgaaactgcaaacttcccgtctgaattaaagcagcttttgctggaacaccataagtccttgccatttgaattgaaagaaaaaatcttaagttgtttgacgatgttaaggaataaggacgtcattactgctgaggaattaattcaaagcttatttcctttattggttgcttactcttcccatggtaattcactcggcgttaattcacacgccaaggaattgaggaaaatcatttatacaaatttaatttctttattaaaaagttgtaatactaatggtaaaaatcaaaaattgaacaaatctacgcaggccgtttgctttaatttgttagatcaaccagattcccagggaatctgggccacaaaattaaccagagaactttggagacgtggtatttgggatgattcaagaacagtagaaattatgacccaagcagcattacatcaggatgttaagattgtcatgtctggtgtgatgttttttttggatgctgacagagaacgtgaagaaaattttgaagaaaattccgaggatgaggatgggtttgatttagatgcattaaggcataagatgcaagtcaataaaaaaacgggtagacgtggtaagaagctggagaatgccataaaaactgtgaagaagaagaagaagaacggaccgggtgctcctcaagggtatttaaacttcagtgctatccaccttttgagagatccacaaggatttgccgaaaaattgtttaaggaacatctttcaggcaaaacgaaaaacaaatttgacatggaacaaaaaatatctttgatgcagctgttatcaaggttgattggtacccataagttaattgttttaggaatttatactttttttttaaagtacttaactccgaaacaaagagatgttacaagaattatgtccgcatgtgcccaagcatgtcatgatcttgtccctcctgaagttataaatgtcatggtgagaaagattgcagacgagtttgtatcagacggtgttgccaatgaagtcgctgctgcaggcattaataccattagagaaatatgctctcgtgcacctttggctatcgatgagattctactacaggatctggtagaatataaggggtctaaagctaaaggtgtcaatatggctgccaagtcattgatagcgttgtatagagacgtggcaccagaaatgctaaagaagaaggatcgtggtaagaatgccgccatggaagtacaagaagccaagaaaggaggtaaagattcaaaaagaccgcaatttggtgccgacaacagtgttcaagggattgctggtatcgaactgttagccaaatggaagaaagaacatggtgaagagagtgaaaatgaagacgctgatgccaactgggaagtagatgtcgatagcgaagaagacgatgtcgacggtgagtgggtcaccatggatagtgataaagaatatgacgttgatatggaagatagtgacgatgaaaaagacaatgctaagggcaaggaatcagattccgatttggaactaagcgatgatgacgatgaaaaagaagtgaaggatgagcaagaagatgcagatatagatcccgaagctgccttccgtgaaattgcttctacacgtattttaactccggcagatttcgctaaactacaagaattgcgtaatgaggaaagcgttgctaaaataatgggtatccacaaacaagacaagcgtgaagagttagttgatgcaagtacactaacaggccctatcaaatacaaacagtctcgtgaggaaagattacaaaaggtgttggaaggtcgtgaaggtagagacaaatttggtagtagacgcggtaagcgtgacaacatgcgttctactaccaacagagaaaaagaaagaaggaagaactttgttatgtctattcacaagagatctgttagaggtaaacaaaaaatgtcactacgagacaagcaaaaagtgttacgtgcacacatcaccaaacaaaagaagaaggggtattag

SEQ ID NO: 4795 - DNA, 2304 bp, Saccharomyces cerevisiae
atgggttccaaaagaagattctcgtccgaacacccggatccagttgagacctctattcctgagcaggccgccgagattgcggaagaattatccaaacagcatcctcttccatccgaagagccacttgtccatcatgatgctggtgaattcaagggcttgcaacgtcaccatacttcagcagaagaggcccaaaaacttgaagatggaaaaataaatccatttaccggtagggagtttacaccaaaatatgttgatatcctgaaaattagaagagaattgccagtacatgcccagagagatgagtttttaaaactttatcaaaataaccagattatggtttttgttggtgaaacaggttccggtaaaacgacacaaattcctcaattcgttttattcgatgagatgccacacttagagaacactcaagttgcatgtactcaacctcgtcgtgtcgcagcaatgtctgttgcacagagagttgctgaggaaatggatgtcaagttgggcgaagaagttggttattctatcagattcgaaaataaaacttctaataaaacgatattgaagtatatgactgatggtatgttgttgagagaggcaatggaagaccatgacttgtcgcgttattcatgtatcattctggatgaagcgcacgaacgtacactagctactgatattttgatgggtcttttgaagcaagtagtcaagaggagacctgatttgaagataattattatgtctgctactctggatgcagagaagttccaacgctacttcaacgatgctccattacttgccgttccgggcagaacatatccagttgagctatactatacaccggaatttcaaagggactatttagattctgccattcgtactgttttgcaaattcatgccactgaagaggctggcgatattttgttatttttaactggtgaagatgaaattgaagacgctgtcagaaagatttccttagaaggtgatcaattggttagagaagagggatgcggacctttatccgtatacccactgtatggttcattaccaccgcatcaacaacaaagaatattcgagcctgctccagagtcacataatggtagaccaggcaggaaagttgttatctccacgaacatcgctgaaacttctttaacaattgatggtattgtctacgtcgttgacccaggattttcaaagcaaaaagtttacaatccaagaattagagttgagtctttacttgtttcccctatctccaaggcttctgcccaacaaagagctggtcgtgctggtcgtacaaggcctggtaaatgtttcagattatacactgaagaggcattccaaaaggaactgatagagcaaagttacccagaaattttacgttccaatttatcctccaccgttctagaactaaaaaaattaggtattgatgacttggtccatttcgattttatggatccaccggctccggaaacaatgatgagagcccttgaagaactaaattatttggcatgtctggacgacgaaggtaacttaacacccctaggtagattggcatcccagtttcccttggatcctatgctagcggtgatgttaattgggtcctttgagttccaatgttctcaagaaatactaactatagtggccatgctatcggttccaaacgtgtttattcgcccaacaaaggacaagaagcgagcagatgatgccaagaatatctttgctcatccagacggtgatcatatcaccttactaaatgtatatcatgcgttcaaatcggatgaagcttatgaatatggtatccataagtggtgccgtgaccactatctaaattacaggtccctttccgctgctgataatatccgctcccaattagaaagattaatgaaccgttacaacctagaattaaacactacagactatgaaagccctaaatactttgacaacatcagaaaggctcttgcgtctgggtttttcatgcaagtagcaaaaaaaagatcgggagctaaaggatacatcacagttaaagataaccaagatgttctgatccatcctagtacggttcttggccacgacgcagaatgggtcatttacaatgaatttgtgctcacatcgaagaactacataagaactgtgacctcggtcaggcccgaatggctgattgaaatagcgcctgcatactacgacttaagcaatttccaaaaaggtgatgtcaaattatctttggaaaggatcaaggaaaaagttgatagattaaacgagttgaaacaaggtaaaaacaaaaagaagagtaagcactccaagaaatag

SEQ ID NO: 4796 - DNA, 2304 bp, Saccharomyces cerevisiae
atggttcaatctgctgtcttagggttcccaagaatcggtccaaacagagaattaaagaaggccactgaaggttactggaacggtaaaatcactgtcgatgaattattcaaggtcggtaaggatttgagaactcaaaactggaagttgcaaaaggaggctggtgttgatatcatcccatccaatgacttctccttttacgaccaagttttggatttgtctttgttgttcaatgtcattccagaccgttacactaagtacgatctatctccaatcgacactttgtttgctatgggtagaggtttacaaagaaaggccactgaaactgaaaaggctgtcgacgtcactgctttggaaatggttaaatggttcgactctaactaccattacgttagaccaactttctccaagaccactcaatttaagttgaacggccaaaagccagttgacgaatttttggaagccaaggagttaggtattcatactagacctgtcttgttgggtccagtttcttacttattcttgggtaaggctgacaaggattctctagatttggaaccattgtccctattggaacaattgttgcctctatacactgaaatcctatctaaattggcttctgctggtgccactgaagttcaaattgacgaacctgtcttagttttggacttgcctgccaacgcccaagccgccattaagaaggcttacacttacttcggtgaacaaagcaatctaccaaagattactttggctacttacttcggtaccgttgtccctaacttagacgccatcaagggcttgccagttgctgccttacacgttgactttgttagagctccagaacaatttgatgaagtcgttgccgccattggtaacaaacaaaccttgtccgttggtattgttgatggtagaaacatttggaagaatgatttcaagaagtcttccgctatcgttaacaaggctattgaaaagttgggtgctgacagagtcgttgttgccacttcttcttctctattgcacacaccagttgatttgaacaacgaaaccaagttggacgctgaaatcaagggctttttctctttcgccactcaaaaattggatgaagttgttgtgatcaccaagaacgtttccggtcaagacgttgctgctgccctagaagctaacgctaaatctgttgaatccagaggtaaatccaagtttatccacgatgctgccgttaaggccagagttgcctctatcgacgaaaaaatgtctactagagcagctccatttgaacaaagattgcctgaacaacaaaaagtcttcaacttgccattgttcccaacaacaactattggttccttccctcaaaccaaggacatcagaattaacagaaacaaattcaacaagggcaccatctctgctgaagaatatgaaaaattcatcaattctgaaattgaaaaggtcatcagattccaagaagaaattggtttggatgtcttagtccacggtgaaccagaaagaaacgatatggttcaatacttcggtgaacaaatcaacggttatgctttcactgttaacggttgggttcaatcttacggttccagatatgtcagaccaccaattattgttggtgacttgtccagaccaaaggctatgtccgtcaaggaatctgtttacgctcaatccatcacttctaagccagtaaagggtatgttgactggtccaattacctgtttgagatggtctttcccaagagacgatgtcgaccaaaaaactcaagctatgcaattagctttggctttgagagatgaagtcaatgatttggaagctgccggtatcaaggttatccaagttgatgaaccagctttaagagaaggtttaccattgagagaaggtactgagagatctgcttactacacctgggctgccgaagctttcagagttgctacttctggtgttgctaacaagactcaaatacactctcatttctgttactctgacttggatccaaaccatatcaaggctttggatgctgatgttgtttccatcgaattctctaagaaggacgatgctaactacattgctgaattcaaaaactatccaaaccacattggtctaggtttattcgatattcattctccaagaattccatcaaaggatgaatttatcgccaagatttcaaccatcttgaagagctacccagctgaaaagttctgggttaacccagattgtggtttgaagactagaggctgggaagaaactagattgtctttgactcatatggtcgaagccgccaagtacttccgtgaacaatacaagaattaa

SEQ ID NO: 4797 - DNA, 2307 bp, Saccharomyces cerevisiae
atggacttcgagactaatgaagacatcaacggggtccgtttcacctggaacgtgtttccctctactagaagcgacgctaacagcaacgtcgtccctgtgggctgtttgtacacacctttgaaggagtatgacgaattgaacgttgccccatacaatccagttgtgtgttccggtccacactgtaagtcgattctaaatccttactgtgtgattgatccgcgcaattcgtcctggagttgtcccatctgtaactccaggaaccatttacctccacagtacaccaacttgtcacaggagaatatgccgctagagttacagtccaccaccattgagtacatcaccaataagcccgttaccgttcctcccattttcttctttgttgtggatttgacttcggaaaccgagaacctcgattcgctaaaggagtctatcatcacttctttgtctctattacctcccaacgcgctgattgggttgatcacttacggaaacgttgttcaattgcacgatctgtccagcgaaactattgacaggtgcaacgtgttcagaggagacagggagtaccagctcgaagcgttgacggaaatgttgaccggccaaaagcctaccggccccggcggtgctgcatctcatctaccgaacgccatgaacaaagttacgcccttctctttgaataggttcttcctgcccttggaacaggtcgagttcaaactgaatcaattactggaaaatctgtctccagaccaatggtctgttccagcgggtcataggccattaagggccacaggttccgctttgaacattgcatctttgcttttacagggctgctataagaacatcccagcaagaatcattcttttcgcctccggtccaggcaccgtggccccaggtttgattgttaactcagagttaaaagatcccttaagatcccaccacgacatcgattctgatcacgcgcaacattacaagaaggcctgtaagttttacaaccagattgcacaaagagttgccgccaatggacacactgttgatatttttgccggttgttacgatcaaatcggtatgtctgaaatgaaacagttgaccgactctactggaggtgtgttgttgctaaccgatgccttctctaccgcgatttttaagcaatcatacttgagattgtttgccaaggatgaagaagggtatttgaagatggctttcaatggtaatatggcagtcaagacaagtaaagacttgaaggtacaaggtttgattgggcatgcttctgctgtaaagaagacagacgctaacaacatcagtgaatctgaaatcggtataggtgcaacgtccacctggaagatggcttccttatcgccttatcactcgtatgcgattttctttgaaattgcaaacactgcggctaattctaacccaatgatgtctgcccctggttcagcagatagacctcatctagcatatactcaattcatcactacttatcaacactcctctggtaccaaccgtatcagagtcaccacggtcgcaaaccagcttttgcccttcggtactcctgccattgcagcttctttcgatcaagaagctgctgccgttttgatggctcgtattgctgttcacaaggctgaaaccgatgatggtgcagatgttattagatggttagacagaactttgattaagctatgtcaaaagtacgccgactataataaagatgatcctcaatctttcaggttggctccaaatttctcactgtatcctcaatttacctattatttaagaagatcccaattcttaagtgtctttaacaattctccggatgaaactgcattttatagacatattttcacaagagaggatacgactaattctttaatcatgattcaaccaactctaacttctttctcaatggaggacgatccacaaccggtattattagactctatctccgtcaaacccaataccattctattattagatacatttttcttcatcttaatataccacggtgagcaaatcgctcaatggagaaaagccggttaccaagacgatccacagtacgcagatttcaaagctcttcttgaagagccaaaattagaagccgcagaattgttagtagataggttcccgctaccaagattcattgatactgaagccggtggttctcaagccagattcttgttatctaaattgaatccttccgataactatcaagacatggcgcgcggaggatctacaattgtcttaacagatgatgtttccttacaaaatttcatgactcacttacaacaagtagccgtctctggtcaggcatag

SEQ ID NO: 4798 - DNA, 2307 bp, Saccharomyces cerevisiae
atggggaagaaggatagacagcgcaagaaactgcgtgagtttgctaaattgaaaaacaggcagcgaaacttgagaaagagcgtgcaaacattgaagaatgaggttcaacgagaggctaaagtcccaagaacttcgaatcaaattgctttaggaaacgacaaaatcgaagagattaacgaaaatagtccattattatcagctcctagtaaacaagaggaggtatcaattccgaaagcggttgatattgataccattgatgcacagcctcttcacgaaggcccaaaaattgatgactcgccccaagatgaggtcaatagcattaaaggaaaacctgcggacaaggctaatgaagacgatcttaagccgccttcacaacatgaagcatgtggaaattcagctttgcaaagctctattacagattttagtgatagatcagtatcaccattgcaaagtattaccagctgcaatactccgatgagtgagcacgagctaccagtatcttcctcaaattcgtttgaaagagctgatgatatgcctgtagtgcaggcagataaccagacgtcaagtagtaaatctttgcacattgttgcaccatctcctgaagtaccagtcagcggagatgaaatcacttcatatggatatggctctataccccagagcatcggggatgtagagaacggattgaatcctccttatgtcgaaaatacatcatctgatgaacttgtacatgatctgacgagaagacggatattttcatcctgtatgtgtacttatttattctttattgcaatggacagttctataatcctagtaattgcgtccaaaattgcttcggagtttcatgagttatggagattatccttagtcatctcagcatacctattgagtaatgctattgggcaactggtatttttgaagctatctttaatatccagtgtaaaattgttgttgtgtattgctcaattcagttttatccttggtggctatttatcttggagttctgcccatttttggacgtttatctttgcccgttgtgtcacaggatttgggggcggttccttaatagcgctcaaaagtactattatgaatcggttttctcaaaagaacgacagtcggtactcattgagtgcctctatgataacatttgctatgggtgtggtaattgggccctttatgatgaacttgtttgattcttctcatggtagcgggtggagaaatgccttcttaataccagttcctttttgccttgtgaatgcctcgattatgctggcagatatgtattctgttaagagcactttatatggacgcccaacgcctacattatggaaaagattcaagaatactctattaagtcctgatttatacgaaatattgacacttacgctattcctactttgtttcgttcaagtgacctcattggatttaacagggttaaagaataatacgatgattcaagcgctactattttctgtaattatcgtttgtggcattttatttttcttgatagagacaagcgatacttacatgaactctgtaatttcaatgtccttacaaggtgacaagcgtttaatatggacaatgataggaatttcattttgctttgcagcattaatgtgcatcatcccattcggtacaacgtacttcatcattgttttaaatttaagcactttacaacttgcagagagattgtccccattctttttctccattgtactgggttactttagtgtttcttatttttggaagtcgaaaggacagaattttttgctaaaatttgttttaagcggagccaccctgttactatatgtggcacttatgggggtaagtttgaatttaccagtatggaagcaatatatatgtttgtctctgccatttttgggctcctctatgatattgaccttgctgtcaaatctttatcatgagtaccatgaacaaagaaagtcacctatcagtggttctatcgtatattgtttcggtgccgtgggggggacggttggtatttccttgggtggttatgtcttccacaaaacattaataaaacttatgcatgagaaggtgatgccatttagcaagcaaggttatcttaaaaaggaccttttgaaaattatcaagcacgctacggaatcttcagattgggtacacgaatcagccccaaagtttgtttttcaaactttgattgagtgttatttacaagcatgtcgaaacgtattcaaactctctacccttttttttacgattactgtcgtagcaatattcattttcaacagaatccattgtcgtagtcaaaattgtttgtcactatcttga

SEQ ID NO: 4799 - DNA, 2310 bp, Saccharomyces cerevisiae
atgactattgctgatgcttccaaagttaatcatgagttgtcttctgatgacgatgacgatgtgccattatctcaaactttaaaaaaaagaaaggtggcgtccatgaactctgcctctcttcaagacgaagcggaaccttatgatagtgatgaggcaatctctaagatttccaagaaaaagactaagaaaataaagaccgaaccagtgcaatcgtcgtcattaccatcgcctccagcaaagaaaagcgcgacatcaaagcctaaaaaaatcaagaaagaagatggtgatgtaaaggtaaaaacaactaaaaaggaagaacaggagaacgaaaaaaagaaacgagaagaagaagaagaggaggacaagaaagcgaaggaggaggaggaagaatataaatggtgggaaaaagaaaacgaagatgacaccataaaatgggtcacactgaagcataacggtgttatattccctccaccataccagcccttaccatctcacatcaaattatattacgatgggaagccagtagatttacctccgcaagctgaagaagtagccgggttctttgctgccctattagagagtgatcatgccaaaaatcctgttttccaaaagaacttcttcaatgatttcttgcaagtactgaaagaaagtggtggtcccctcaatggaattgagataaaggaattttctcgttgcgatttcaccaaaatgtttgattacttccagttacaaaaagaacagaaaaagcaactgacttcccaagaaaagaaacagattcgtttggaaagagaaaaattcgaggaagattataaattctgtgaattagatggcagaagggaacaagtagggaatttcaaggttgaacctcctgatctatttagaggtcgtggcgctcacccaaaaacaggcaaattgaagagaagagtgaatcctgaggatatcgttttaaatctaagtaaagacgcacccgttccgccagccccagaagggcacaagtggggtgaaatcagacacgacaataccgttcaatggttagccatgtggagagagaatattttcaactcattcaaatacgtcagattggcagcgaactcttcattgaagggtcaaagtgactacaagaagtttgaaaaggcgagacaattgaaatcctatatcgatgccatcagaagggattacacgagaaatttgaaaagcaaagttatgctagagcgccaaaaggccgtagccatttatttgatcgatgtattcgctttaagagccggtggtgaaaaatccgaagatgaagccgatactgtgggttgttgttcattgcgatatgagcatgttactttgaaacctccgaatactgttatctttgatttcttaggtaaggattctattagattttatcaagaggtagaagttgacaaacaagttttcaaaaatttgacaatttttaaaaggccgcccaaacagccaggacatcaactgtttgatcgtctagatccatctatactgaacaaatatctacaaaactacatgccgggattgactgctaaagttttccgtacatataatgcttccaaaacaatgcaagatcaactggatctaattccaaataaaggatctgtcgcagagaaaatattgaagtacaacgcagcaaatagaactgtagccatcctatgtaaccatcaaaggactgtcacgaaggggcatgcacaaacagtggaaaaggccaataatagaatacaagagttggaatggcaaaagattcgttgcaagagggccattttacaattggataaggatcttttaaagaaagagccaaaatatttcgaagaaatcgacgatttgacgaaagaagatgaagccaccattcacaagagaattattgatagagaaattgaaaaatatcagcgaaaatttgttagggagaacgataagaggaaatttgaaaaggaagaattattgccggaaagtcaattgaaggaatggttggagaaagtcgacgaaaagaaacaagaattcgaaaaggaattgaaaaccggtgaagtggaactgaaatcaagttggaattcagtcgaaaaaataaaagcacaagtagagaaattagaacagcgtatccaaactagttccattcagttgaaagataaagaggaaaactcccaggtttcactgggcacttccaaaatcaattatatagaccctagactttctgtggtattttgcaaaaagtatgatgttccgattgaaaagatttttacaaaaaccctaagagaaaaattcaaatgggccatagaatcggtagatgaaaattggaggttttaa

SEQ ID NO: 4800 - DNA, 2310 bp, Saccharomyces cerevisiae
atgtctctcagaataaaagcacttgatgcatcagtggttaacaaaattgctgcaggtgagatcataatatcccccgtaaatgctctcaaagaaatgatggagaattccatcgatgcgaatgctacaatgattgatattctagtcaaggaaggaggaattaaggtacttcaaataacagataacggatctggaattaataaagcagacctgccaatcttatgtgagcgattcacgacgtccaaattacaaaaattcgaagatttgagtcagattcaaacgtatggattccgaggagaagctttagccagtatctcacatgtggcaagagtcacagtaacgacaaaagttaaagaagacagatgtgcatggagagtttcatatgcagaaggtaagatgttggaaagccccaaacctgttgctggaaaagacggtaccacgatcctagttgaagacctttttttcaatattccttctagattaagggccttgaggtcccataatgatgaatactctaaaatattagatgttgtcgggcgatacgccattcattccaaggacattggcttttcttgtaaaaagttcggagactctaattattctttatcagttaaaccttcatataccgtccaggataggattaggactgtgttcaataaatctgtggcttcgaatttaattacttttcatatcagcaaagtagaagatttaaacctggaaagcgttgatggaaaggtgtgtaatttgaatttcatatccaaaaagtccatttcaccaatttttttcattaataatagactagtgacatgtgatcttctaagaagagctttgaacagcgtttactccaattatctgccaaagggcaacagaccttttatttatttgggaattgttatagatccggcggctgttgatgttaacgttcacccgacaaagagagaggttcgtttcctgagccaagatgagatcatagagaaaatcgccaatcaattgcacgccgaattatctgccattgatacttcacgtactttcaaggcttcttcaatttcaacaaacaagccagagtcattgataccatttaatgacaccatagaaagtgataggaataggaagagtctccgacaagcccaagtggtagagaattcatatacgacagccaatagtcaactaaggaaagcgaaaagacaagagaataaactagtcagaatagatgcttcacaagctaaaattacgtcatttttatcctcaagtcaacagttcaactttgaaggatcgtctacaaagcgacaactgagtgaacccaaggtaacaaatgtaagccactcccaagaggcagaaaagctgacactaaatgaaagcgaacaaccgcgtgatgccaatacaatcaatgataatgacttgaaggatcaacctaagaagaaacaaaagttgggggattataaagttccaagcattgccgatgacgaaaagaatgcactcccgatttcaaaagacgggtatattagagtacctaaggagcgagttaatgttaatcttacgagtatcaagaaattgcgtgaaaaagtagatgattcgatacatcgagaactaacagacatttttgcaaatttgaattacgttggggttgtagatgaggaaagaagattagccgctattcagcatgacttaaagctttttttaatagattacggatctgtgtgctatgagctattctatcagattggtttgacagacttcgcaaactttggtaagataaacctacagagtacaaatgtgtcagatgatatagttttgtataatctcctatcagaatttgacgagttaaatgacgatgcttccaaagaaaaaataattagtaaaatatgggacatgagcagtatgctaaatgagtactattccatagaattggtgaatgatggtctagataatgacttaaagtctgtgaagctaaaatctctaccactacttttaaaaggctacattccatctctggtcaagttaccattttttatatatcgcctgggtaaagaagttgattgggaggatgaacaagagtgtctagatggtattttaagagagattgcattactctatatacctgatatggttccgaaagtcgatacatctgatgcatcgttgtcagaagacgaaaaagcccagtttataaatagaaaggaacacatatcctcattactagaacacgttctcttcccttgtatcaaacgaaggttcctggcccctagacacattctcaaggatgtcgtggaaatagccaaccttccagatctatacaaagtttttgagaggtgttaa

SEQ ID NO: 4801 - DNA, 2313 bp, Saccharomyces cerevisiae
atggataacgttgtagatccgtggtatataaatccctcaggcttcgcgaaagacactcaagatgaggagtatgttcaacatcatgataatgtcaatcctaccatacccccacccgacaattatattttgaataatgaaaacgatgatggcctcgataacttgttaggtatggactactataacatcgatgacctgttgactcaagagttaagagatctggatattcctttagtgccttctcctaagacgggcgatggttcttctgataaaaagaatattgatagaacttggaaccttggtgatgaaaacaacaaagtctcccactatagcaaaaaatcaatgtcctcacacaagagaggtctaagtggcacagcgatatttggatttctcggccataataagacattgagtatttccagtttacagcaatccattctaaatatgtctaaagatccgcaacccatggaactcataaatgaattgggtaatcataatacggtaaaaaataacaatgatgactttgaccatataagggaaaatgatggtgaaaatagctatttgagccaagttttgttgaaacagcaggaggagttaagaattgctcttgaaaaacaaaaggaagtgaacgaaaaattggagaagcagttgagagacaatcaaatacagcaagaaaagttgcgtaaagtattagaagagcaagaagaggtggcgcagaagttggtttctggggctacaaattctaattccaaacctggatctccagtaatactaaagacacctgccatgcaaaacggtagaatgaaagataatgctataatcgtcacaacgaactctgcaaatggcggatatcaatttcctcctccgacgttaatatcgcctcggatgtcaaatacttcaataaatggttcaccatccaggaaataccataggcaacgatatccaaataaaagcccagaaagtaatggattgaaccttttttcctctaacagtggttatttgagagattctgaactgctttcattttctccacaaaattataatttaaacttggacggcttgacttataatgaccataataacaccagtgataaaaacaataatgataaaaaaaatagtactggtgataacatattccgtctgttcgaaaagacttccccgggtgggctaagtatctctccaaggataaatggaaatagtttgagatcgcccttcctcgtcggcacagataaaagcagggatgatcgatatgctgctggcacgttcacgcctagaacacagttgtcacctatccacaagaaaagggaatccgtagtttccacggtctcgacaatatcacaactgcaggatgacactgaacccatccacatgcgaaatacccagaacccaacattaagaaatgcaaacgctttagcgtcatcaagtgtactacctcctattcctggttccagcaataacactccaattaagaattctttgccacaaaaacatgtatttcaacatactcccgtcaaagctccaccaaagaacggaagtaacctagctccgcttctaaatgcaccggatttaacagatcatcagttagaaattaagacacccatacgaaataacagtcactgtgaagtggaaagctatccgcaagtaccacctgtcacacatgatattcacaaaagccccactttgcatagtacgtctcctttaccagatgaaataatacctaggactacgccaatgaaaataaccaagaaaccaactactctgcctccgggtaccattgaccagtacgtcaaggaactacccgacaaactattcgagtgcttataccctaactgtaacaaagtattcaagcgtagatacaacataaggtcgcatattcagacacatttgcaagatagaccgtattcatgcgactttcccggttgcaccaaggcgtttgttcgcaatcatgatttaataagacacaaaatctcccataatgccaagaaatacatctgcccatgcggaaagagatttaatagggaggatgctctaatggtgcatagaagtcggatgatttgcaccggcggtaagaaattagaacattcgatcaacaagaaacttacatctcccaaaaaaagcctgcttgacagcccgcatgacacaagtcccgtaaaagaaactatcgcccgggataaagatgggagcgtcctaatgaaaatggaggaacagctgcgagatgatatgcgcaaacatggattactggatccacccccatccacagcagcgcacgagcaaaactcgaaccgcaccctttcaaacgaaactgatgctctctga

SEQ ID NO: 4802 - DNA, 2313 bp, Saccharomyces cerevisiae
atggccaaaaaaaatagattgaacacaactcaaagaaagactttacgtcaaaaggaagatgagtacatcgaaaacttgaaaaccaaaattgatgagtatgaccctaagataaccaaggccaagtttttcaaagatctccccattagcgatcccacattaaaaggtttaagagaatcatcctttataaaacttactgagatccaagccgattctattcccgtgtccctgcaaggtcatgatgtattggcggccgcaaagacaggttccggtaagacattagcatttttagttccagtaattgaaaagctataccgcgaaaaatggaccgaattcgatgggttaggtgcccttatcatatctccaacaagagagttggctatgcaaatatatgaggttttgacgaaaataggtagtcacacttcattttcagctgggttagttatcggtggtaaagatgttaaattcgaactagaaaggatatcaaggattaacattcttatcggtacacctggtcgtattttacaacatttagatcaagccgtaggtctaaatacttccaatttgcagatgcttgttcttgacgaagctgatagatgtttagacatggggtttaaaaaaactctggatgccatcgtaagcacattgtcaccatctagacaaacacttttattttcagcgactcaatcacaatctgttgcagacttggctaggctttccttgacagattataaaaccgttggtacacatgatgtgatggatgggtcggttaacaaagaagcatctactccagaaactttgcaacaattctacattgaagttcctttggcagataaattggatatccttttcagttttataaaatcacatttaaaatgcaaaatgatcgttttcttatcaagttccaaacaagtgcattttgtctatgagacatttaggaagatgcagcctggtatttctttaatgcatttacacggtagacagaaacaacgtgctaggacagaaactttggacaaattcaatcgtgctcaacaggtgtgtctttttgctaccgatgtcgttgctagaggtattgactttcctgcagtcgattgggttgttcaagtggattgtccagaggacgttgatacatatatccacagagtcggtagatgtgctcgttacggtaaaaagggtaaatctttaatcatgttgactccacaagagcaggaagcgttcctaaaaagacttaacgctagaaagatcgaaccaggcaaacttaatataaaacagtcaaaaaagaaatccattaaaccacaattgcagtcattattattcaaggatccagaactaaaatatctaggacaaaaggcttttatatcgtacgtgagatctatatatgtgcaaaaggacaaacaagttttcaaattcgatgagttaccaacagaagaattcgcttattctcttggtttaccaggggccccaaaaatcaaaatgaagggtatgaagaccattgagcaggccaaagaaagaaagaatgctccaagacagctagctttcttatcaaaagcaaatgaagatggtgaagtaattgaagataagtcgaaacaaccaagaacaaaatatgataaaatgtttgaacgtaaaaatcaaaccatcttaagtgaacactatttgaatataacgaaggctcaagcacaagaagacgaggatgacgatttcatttctgtcaagcgtaaagatcatgaaataaatgaagctgagttaccagctctaactcttccaacttcaaggcgagcacagaagaaagcgctttcaaagaaggcatctctggcctccaagggtaacgctagcaaattaatatttgatgatgaaggcgaagcccatccagtttatgaacttgaagatgaagaagaatttcataagagaggtgatgcggaggtacaaaagacagaatttttaactaaagaatctgcagtaatggcagacattgacaatattgataagcaggtggctaaagaaaaaaaacaagagaagaagagaaaaagactagaagccatgagaagggaaatggaggctgctatggaagaagaaatttctggagatgaagaagaagggaagacagtagcatatttaggaacaggaaacttgagcgatgatatgagcgacggtgatatgcctgactcggaaggccacttgaaaaagaaagctagaactgttgactattcccacggccacaatccatccaattcagttgatgatgacattattgaagtggaagaaccacaaactttggaggatttggaatctttgacagctaaattaatccagggttaa

SEQ ID NO: 4803 - DNA, 2313 bp, Saccharomyces cerevisiae
atggctagcttgaaggtatttctcgcagtttacttgcttggcggtatcacatttttgcctttggtccttttcaccctctataaaatccatttattgtacagtaaccttaaatcggcatcgaagaaggagctagatcatgatacagcagacgaaattgatgagaaaaccagacttctggctcgcgatatagacccagagtttaaagcacgcaagctagaagagcaattaggtgtcaaagtttttaacaagggttggatcaccgtcactaagcaatattattatcattcttcagaagtggctgtaattttgaagaattctaataataataaagattcagacactgcacttcaagagcaaatcttgcaaagaacagacttgaagaaaaaacaaaggttttttgcagtattaagacatggaaatttgtttttgtataaagacgattctcaaaatgcaaatttggtccatgctatatctttacaaaacagatttatcaccatttggccccgtttcgatgaactgggtaaggaagaattgccagatgcctcgcttttcactaagagaacttgtattgctattttcaagaatgacctcgtttctatagactctaaaaaccataatgttatcctgccacacttcgacccacttaccagtgctgaatcgaataacggtgacatctctaccaatgacactacacatgaatatcaatcacaattccatagctcaaatcagttcttcttgtatttcgataataacatggacaaagaagattggtattatcagttgatcaatgcctctaaaaacagtaattccctctcaactggtttattggatcctaatgtttcagctaacgcagctcatttgaagactaaggatatgttacaattgattcaggatatcaactctactgaaaatcagttaactactaagtggctgaatgctcttcttgggagattatttctttctctgcaacaaactgatacgttgaataagtttattcatgagaaaatctgcaagaaattgaataaaataaaaaccccagggttcttggatgatttggttgttgaaaaggtcgacgtgggtgatagtgctccattattcacctctcctgagttattagaattgtctcctgagggttcgactaagattgctatcgacgttcaatacaggggaaacttgacaattattattgcgacaaaggcgagtattaacttgggatcacgtttcaaacaaagggaggtttctttgcagttgtccataaaaattaaagaattttccggtccacttttatttttaatcaaaccacctccatctaacagaatttggtatgcttttcgcaccgaacctataatggattttgaaattgagcccattgtcagttcaagtaaattatcatacaacgtcgttactaacgctataaagagtaagtttgccgaagccgtgaaggagtccctagttgtaccgtttatggatgatattgttttttatccaacacctaatgaagtatacagaggtggtatttgggaggagcaggatcctgaggcagcggcgagggctcgcactgctgcggcagcctcagatatgaataatactagtgctaaggaacacttagaagcacttcaagagggcggaatgaaaacccagagtcgaatcaaaaaagccttaaggccagagagaaagaaagaaaacctaaaagatcttgttgacgcatctggagtggcaacgaaaactacaacccagacaacagtcacaaccgcgactaatgatgatgtttccagttctgaaaattctaccaagtcaaggaaatacttcaagaattcaatcaagaaaatcggtagatggtataaggataatgttggtaattcgagtgacaccgaagatatggatgaaatagatgttcaagataagaaaaatgacgattcagcagatgagagagaatcagataatcctatccttacatccaatccaaaaatgatttctaataggagaccagtaccaagaaggccttcacaaccgttaaatacactatctccaaaactagaaggcaggaaggaaaaagacactgagaattttccagttccaccgtcggcttcaaatatgaatgcttcaaagatgtttgcgaacaaagaaaatagaaagttttctgtatcctcaaatgattctcagaattcgctcaaaaatggtgatccccatgtgaaagcttcaaaacttgaaagctctcaagcttttgttaagaagacctctcagaatcgttttaatgacggctttttcaagcaagatttagaatttgaagaacagcgagagcccaaactgtga

SEQ ID NO: 4804 - DNA, 2316 bp, Saccharomyces cerevisiae
atgataaaaatgtggaggttacagattgtactggtgccgccaagtgctcaagatattatcacatttctcgaagcacgcttgaatactccacaatcagtgtctcctatggtccagtataatgaagatataattacgcacaacaacagtatcaataactgtagcgacccctctcctacgagcccgtcttcgcaaaattctattcagtcgaatcgtagtagtgatttcattaactacctcccgaattgtaaaaagtttttacattttacggacggtgacaatacccttttacaactatctaatgaaattttaactaaatttgatagactttatccaaatttcaaagaatccattgaaatcgtatctctacaagataggcatggttgtgatttggactctgaatttataataaaagacgtatttgaaaatgatggtgtggttttggtaattttaaaagatgaattagactggagtagaaatcaacatatttcacttttacaattggcaagacagcggagacggcaggacaacaagccatccacaaaatccatcgttactgaaaagagaaaaaagatctctaaggaagacttatcttctatatcaaataaagatacaatgcatctaatagctaaaagctcgctcaagaataacttcattaataaatcaagagtatcaacgccgctaatgaacgaaattctaccgcttgcaagcaagtatgatgcactgaataaagaaaagtgtcccatgccacttacttccacagtagtggcatcaaatgtacacaaagacgtaaaagatcacgctcgtgctaaagagggagttgtaacgcaagggagtgataacaataaagaaaatataccttcatccactcaacaacagaaaaatgatggcgctaaaagggccgaatcaaaggatttagatcttttacgcaattcgtcagaagatgctgattatgaacccgcagatgaaaactcccctcaaatttcgtttgattcgattgataccgacttccaattgagcactacttctcatactaattctgatatgcatatacaatattctaacccctctagtggtgctcatagtcccaggaagagttccttagaaattaaagttcaaaacaaaaaaggtgatgatctgccattgaacgacaaagatataggtgagaattgtagaaggatagaagcattttcagatgaagaggattttaatgaaaccgataatgatcgtgcggattcgtttatcaacaattctaagaaggcatcgatgggatttcgggatatcaattccgacttggatagcgtttcattcaacagtgatattgaaaatgcagtacaaagtactcaaagtaccaaaaatgttgtttctcctcccttttttcctgaaaaagaattgaataatcggttacatcaaagtcaaggtaaggaagccctatttcgacttgttgagaaggagtttcctgataaatcattgggtgctgcgtcatctacttcgcatgcaaaagacgtaaaaatacaagaaactattcggaaactaaataggttcaagccaactggggaaactaaggtccaaaaaaggaatagtattacggaaccatattacggaaaatttggaataatgaagaaagataaacccaaatccataacttcaaaaggggtaagtctggaaacaaagcactttgatgatcccaataccattatttccggtgagaaattcgcaaaatttggtaaaataaaagtgaaacgaaaaactgatgatgttggatcgaaagttatagagtttaaaagaaaaagaaatatggggaatagatccctaaaagatatttttgccaatgctgggaaaccgccaaatgcagcttcgaccataaaagtagtcaaattaatgagagatcctgttgataatagtaaagacaaagtggaggcaacttctaatagtacggctcaggaacaagaacaagtctcacccaagttgccagttatgaattcaactcctggaaaaagaaaaaatggccaagcgataccgtccagtttagaaagaacaccgcagctcaagaaagtcaaggttaccaggtcgcattcttcaccttcttcttcttcttccatgtcacttgaatcttcattggatagctcttcctcagatgattcggatgatgattctgattcgaggaacgtgcaagttaaaaaaattaatttcaaaacaagtcatggaccagctggaaattctaatggaaaaccaatgctggatgtggatgacaatgaaataaatacaaagaagtaccaaacacctaaatatgttgaaagtgatgaagacgaccagtaa

SEQ ID NO: 4805 - DNA, 2316 bp, Saccharomyces cerevisiae
atgtctgtgcgaaacctcaccaataatcgtcattccaacagcgaaaatagtgtttccggaagcgaaaactccttttattcctcgaatgagcaatcaagacaaagctcatcattagaacctgcagatggtcagaacgttagggtgagcggtaatcctttccttggaagtgaagaatttgacgaagattataattcacccagtggagacgatgagcggcgtggggcaaatgaatattccagttcttcatccataaattataataacgatcctaacagcgatacttctcttctggctaatgaaaagaactcacccgagagaaatggtcaaagaatgtcagactataagggctattatgctaagactaacctaacttctgctaataacttaaacaatcataataacaataattataagaacattataagcagtagtaacgataatagttttgcatcacatttacagccgccggacagaaacttaccgtctcatccttcttcaaataatatgagtagcttttctaacaacagcttaattaagtctccaccaccttttgacagatatccgctagtaggaacgaggcatatttcagcggctcaatctcagtcgcagaaccttataaatgaaaagaaaagagcgaatatgactggctcatcttcttctgctcacgactcttcattatcatccaccaacttatacatgggcgaacaggatttttcgccctttggcggttatccagcttccttctttccgttaacgttggacgaaaaggaagacgatgactacattcataatccaaatgtcgaggaagaagcaaagttagatagaaggaggttcgttgacgacttcaaacacatggatagaagatctttcttggggcttctgggtattctatttttatttatggctggtatatttattttcattgtattacctgcaattacattttccggggtagtttatcatcatgaacatgttcatgcggcaaattcagcaggatcgtcgtcttctaatactacatccaagtcattgactgaatatcaatatcctcaacttgcggctataaggacaactttagttgatccagacacacctgacagtgcgaagacaagagtagcgaaagatggatctaaatggcagctggtgttttccgatgaatttaatgctgaaggtaggaccttttacgatggcgatgaccagttttggacagctcctgacatccactacgacgctacgaaagatcttgaatggtactcaccagatgccgttacaactacaaatggtaccttgacgttgagaatggatgcattcagaaaccatgacctttattacagatctggtatggtacagagctggaacaaactctgctttacagaaggtgcgttagaagtttccgcgaacctccctaattatggtcgagttacaggattatggcctggtatgtggaccatggggaacttgggcagaccaggttatttggcgagtactcaaggtgtttggccttattcatatgaagcatgtgacgctggtataacaccaaaccaaagttccccagatggtatttcttacttgccgggacaaaagttgagtgtttgtacttgtgataatgaggatcatccaaatcagggagttggaagaggcgcaccggaaatagatattttagaaggtgaagctgatacaattttgggtgttggtgttgcgtcacaatctctacaaattgctccatttgatatatggtacatgcccgattatgacttcatcgaagtttataatttcaccacaacaactatgaatacttacgctggtgggccttttcaacaagctgtctcagcaatatccactttaaatgtaacatggtatgaatttggggaggaagcaggttattttcaaaagtatgccattgaatatctcaatgatgacgacaacggatatattcgttggtttgtgggagagaaccctactttcacactatatgctacttctttacatcctagtggtaatattgactggaggagaataagtaaggagccaatgtcagcgattttaaacttaggtatttccaacaactgggcctatatcgactggcaatatatatttttcccggtgacaatgtcaatagattacgtccgattataccagccgaagggttctacgtccattacttgtgatcctgaggactacccgacatatgattatatccaaagccatctaaatgcatattataacgccaatttaactgattgggaacaggctggatatactttcccaaaaaatattctaacaggaggttgtagtagttcaaaattctcattatcctga

SEQ ID NO: 4806 - DNA, 2319 bp, Saccharomyces cerevisiae
atgcttcgcacgataatattgaaagccgggtccaatgcctccataccgtcaccttcccgccaaaataagttactcaggttcttcgccacagccggcgcagtctctaggaccagtccaggaagcattaagaagattttcgacgacaattcatattggagaaatattaatggtcaggatgctaataatagcaagatctcacaatatctttttaaaaaaaataaaaccggacttttcaagaacccttatttgacttctccagatggtttgcgtaagtttagccaggtttctttgcagcaagcacaagaacttctcgacaaaatgaggaatgattttagcgagagtggtaaattaacctatattatgaacctggacagattaagcgatacgctatgtcgagttattgatttgtgcgagtttattaggtcaacacatccagatgatgcatttgttagggcagcacaagattgccatgaacaaatgtttgaattcatgaatgtcttgaacactgatgtttccttatgtaacatactaaagtcggttttaaacaatccagaagtgtcttcgaagttaagcgcagaagaacttaaagttggtaaaatattattggatgattttgaaaagtcaggaatctatatgaatccagatgttagagaaaagtttatccagttatctcaggaaatcagtttagtaggtcaagaattcatcaaccatacagactatcctggttcaaattctgtgaagataccatgtaaagatctggataatagtaaagtgagtacatttctattgaagcaattaaataaagatgtaaaagggcaaaattataaagtacctacatttgggtatgcagcttatgcattattaaaaagttgtgaaaatgagatggtaagaaaaaagttgtggaccgctcttcacagttgttctgacaaacaggttaaaagattgagtcacttaatcaaactaagggcaatcttggctaatttaatgcacaaaacaagttacgcagagtatcaattggaaggtaaaatggcaaagaatccgaaagatgttcaagattttattttgacgttaatgaacaatactatagagaagacagcaaatgaattgaaatttatagctgaactcaaggccaaagatcttaagaagccgttgactacaaacacggacgaaatattgaagctcgtgagaccatgggatagggattactatactggcaaatatttccagctcaacccgtcaaactctcccaatgccaaagaaataagctattattttacattaggaaatgtcattcagggcttgtcagatttgtttcagcaaatatatggtattagattagagccagcaattactgatgagggagaaacatggtccccagacgtgagaagattgaatgtgatatctgaagaggaaggaatcatcggcataatttattgtgatttattcgaacgaaatggcaagacttcaaatccggctcatttcacagtttgttgctctaggcaaatatatcccagtgaaactgatttctcaaccatccaagtcggtgagaatccagacggtacctactttcaattacctgttatttctttggtgtgtaatttttctccaatactaatcgcttctaaaaaaagtctttgttttttgcagcttagtgaagttgaaacgctcttccatgaaatgggacatgcaatgcactcaatgttagggagaactcatatgcaaaacataagtggtacaagatgtgctactgattttgtagagttaccaagtatcctgatggagcacttcgctaaggatatacgaattctgacaaagattggcaaacattacgggactggagaaacaattcaggctgatatgttacagcgcttcatgaaaagcactaacttccttcaaaattgtgaaacatactctcaagcaaagatggctatgctggatcaatcatttcatgatgaaaaaatcatttctgatattgataactttgacgttgtggaaaactatcaagcactagaacgacgtttaaaggtcctagtggacgatcagagtaattggtgtggaagattcggccatttatttggatacggggcaacttattacagctacttatttgataggacgatagcttctaaaatctggtacgcccttttcgaggatgatccgtacagtcgaaaaaatggtgataaatttaaaaagcatttactaaaatggggagggctaaaagacccttggaaatgtatcgctgatgttttagaatgccccatgctagagaaaggcggtagcgatgcgatggaatttatagcacagtctcacaagtcttag

SEQ ID NO: 4807 - DNA, 2319 bp, Saccharomyces cerevisiae
atggatataaactcaaatgcctcagtaagccccagaccagatggtttaccgatgactgctggatataattctgcttctggaaaggtgcgaaatagtatcagatccataataaaccacccagaggatagtgcaagagccaaagagcgcagtgaaacgaacagtcctaagaataatggcaacaaaaaacctagaaagaaaagaaaaacatttagttgtgatacttgcaggagagtgaagacaaggtgcgattttgaacctttcattggaaaatgttacagatgtaacgttctgcagcttgattgctccttagccaggaataaagacaatgaaattttgaatactttacgtgaggatggtctactaaagaagatcaactcaattaatcacaaccttggttctttctctcatttgaatgcggactctcccaacgaaagccaaagtagttttgaaaagaatggaacggtcaattttgataattacatgatcgataaaaggctttcatctttagaagagcacataaaatctttacaccagaaaatggacttgataatcaccacagcaaagatgtcttataacagcgatatcaaaggccctggagatgatattcagaacgtggatttcagctcaaataagacgtacgatagtcgtctaacttcgggctcagagacgataaggaaaacaggggaatatagaaaagaaaatcttttcttaaatggatttaagttgaaggaatctcctttaaaattgctacatgatattgatgagaggctatttccatcgaaggctacatctaaagctgcgaagctagctggacagcaaaggccatatgctgttgcaagagtgaactttctccatttttatgagaataatcaggaattatgccataagcttgcaaaagaatttctggtgagatcccatttctggataattccaggtgggagaaaagagatagacgtggaatatgcccactcacacctatttattacaagtgtttttactattatcgctatgagttttgctgacaacgataaatacgctgcagaacaagaaatattgtatcctttagtggagagattactcactaatacgttaaccatgtttgaaaagttaacagcgtttgatattgaggctattttatattgctgtatgttccatatttcgcgaaaggcaaagagatataggcaactgaagtttaattctctggtactaagcaattttgcgctcaatagcttgttacatgtaatagatttttatcagataaaggatagggttttggtaaaagaagtgtataatcccgaagatctttatcatctaagaatactaaattcactaactgcctgctatttagaatattccattagttacggcgatattagggaacaggatgatatgcttaaagagtttaataaacttgtggcgaaatttcctcaggcgaattttggtgatgacattaaaatcagtgagataaatttaggtgacatcgtaaatggcatctttataaaccttaaaaattattttgcgcagtgtttggatgactttaacaatgacagatatggaggtaacgcagatacttttatctttgtttttccagagctaaattattggctgaaaaattgggaagagcttttagcaaaggatggcgcgggcgtgctattgttcacatttgatttttatcatatcatgatatgtcgcacttttatcacagaattttcttccacgctaaaaagcaaccaaaggtttttgaaactaattcttaatacgatgaaagaacattcattttcgctgttgaatgggtttttgagactaccgccaacgttaataaggggtgctccgatttttacttgtcatcaactagtctacgcctgtttaactctttgtgactatctttattggttcgattcttctgaacgtcaacgcgttttgagtctttgtacaaaagtgtactggcatttgagcactataggggaaaaaatgaatgaggctactgataacgttggaaaaatcataaaatctataattgatactagtaagactcgtattaattttggcagtttgtcaaaagagaatagtgataatgataaaatgtcgactaatgctaataactacacaggagcaggaaatctgcacgccgcgaaacccgctacttcgcctactaatgttggtactttgcacgagaacttgtccagtagtcacttcatgattcctgacgtcgaccaattcaattcctttgaagacttttttcaggatttttttgatagtttaaaaccaaattcccaaaaaatgtttaccagcgataagaagactgaacaaactacttaa

SEQ ID NO: 4808 - DNA, 2322 bp, Saccharomyces cerevisiae
atgggtaagaaaagggctcctcaaaaaggaaaaacggtcacaaagccacaggagataattgtagatgaatccaaattgaactggaaaccagtagatattccggacactttagatgactttggtggattttatggcttggaagaaattgacggagtggacgttaaagtcgtggatggtaaagtaactttcgtcaccaaaaaagattcaaaagtgttaaaagatagcaataaggaaaaagtcggagatgatcaggaatctgtggaaaatgaatcagggtcagattcggagtccgagctccttgaattcaagaacttggacgatattaaagaaggagagttgagtgcagcatcttattcatcatccgacgaggatgagcaaggtaatattgagagttcaaagttaaccgatcccagtgaggatgtggatgaggatgtggatgaggatgttttgaaagaaaacgtctttaacaaagacattaatatcgatgatatttctcctgtaaatttacctgaatggacgaatcttgcacctctctcaatgactattttgcagagcttgcagaatttaaattttctcagacctacagaaattcaaaaaaagtctattccagttattatgcaaggcgtagacgtcatggggaaagcctctacaggttcaggtaaaactttagcctatggtattccaattgtagagaaactgatcagtaacttctctcagaaaaacaagaaaccaatatcgttaatctttactcctacaagagaactggcgcatcaagtcacagaccacttaaaaaagatctgtgagcctgttctagcgaaatctcagtactcgatattatctttgacaggtggactctctatccaaaaacaacaacgtctattaaagtacgataatagtggccaaattgtcatcgcaacaccaggtagatttttggaactgttggaaaaagacaacactttaatcaaaagattctcgaaagtaaatacgctaatccttgatgaggctgataggctgttacaagacggtcatttcgacgagttcgaaaaaatcattaaacatttattagtagaaagaaggaaaaacagagaaaactccgagggcagtagcaaaatttggcaaactttgatcttttctgcaacattctccatcgacttgtttgataagctatcttcttcccgtcaagttaaggatagaaggtttaaaaacaacgaagatgagctaaatgccgtaatacaacacttaatgagcaaaattcacttcaactcaaagccggttataatagatacaaatcctgagtcaaaagtgagctctcaaatcaaagaatccttaattgaatgtcctccattagaacgtgacctatactgctattactttttaaccatgttcccaggtacaactttgatcttttgtaatgccattgactccgtgaagaaattgaccgtatacttaaataacctaggcatcccagcttttcaaattcattcttccatgacacaaaagaaccgtttgaaaagcttagaaaggttcaagcaacaaagcgctaaacagaaaacaataaatcattcgaatccggattccgttcaactctcaacagtattgattgcaagtgatgttgctgctagaggtttagatattccgggtgttcaacacgttattcattaccacttaccaagatctactgatatttatattcatagatcaggcagaactgcaagagcaggttctgaaggtgtctctgccatgatatgctcacctcaagaatctatgggcccattaagaaagttaagaaaaactctcgctacaaaaaatagtgtttcgacggatttgaactctagatcaactaacagaaaacccatcaagtggcaaaacactgtgcctttgttaccaattgaaaccgatatactttcacaactcagagaaagaagtagattagcaggcgaactggctgatcatgaaattgcttctaattccctaagaaaagatgacaattggttaaaaaaggctgctgatgaattaggtattgacgttgattccgacgaagacgatatatcaaagagtaattcggacactttcttactaaaaaataaaaataaaaaaatgcagaagactataaataaggacaaggtaaaagccatgagagctacgttgaacgaattgttatcagtgcctatacgtaaagatagaagacagaaatatttgacaggtgggctagtgaatttagctgataacttggtcaaaaaaagaggtcataattctatcattggtcatgaaaagacaaacgccttagaaactttgaagaaaaagaaaaagagaaataattaa

SEQ ID NO: 4809 - DNA, 2322 bp, Saccharomyces cerevisiae
atgttgaatggtcgtttaccacttttgcggctgggcatatgcagaaacatgctgtcccgtccccgactggctaaactgccatctataaggtttcggtctttggtcaccccttcttcatcgcagctcattcctctcagtcggttgtgtttaaggtcacctgcagttggaaaatcactaattttacaaagttttagatgtaattcatccaaaacagttccagaaacttctctgccttcagcctctcccatatctaaaggatcagcaaggtcggcacatgcaaaggagcaatctaaaactgatgactataaagatataataaggttatttatgttggcgaaacgggattggaaactgcttcttacagccatacttcttttaaccatatcatgttccataggcatgtctattcctaaagtcataggtattgtccttgacacacttaagacgtcatctggatcagatttttttgatttgaagataccgattttttctttgcctttatatgagtttctttccttttttactgttgctttactgattggttgtgctgctaattttggtagatttatattattgaggatactaagtgagcgtgttgttgcacgcctaagggcaaatgtcattaaaaaaacgcttcatcaagacgcagaattcttcgacaaccataaagttggggatttaatttctcgtttaggatctgatgcttatgttgtttcaagatcaatgacccagaaggtctcggatggggtcaaagccctaatttgtggggttgttggcgtggggatgatgtgttctttgtcacctcaactatcaatattgttactattcttcactccacctgttctttttagtgcctcagtgttcgggaagcaaattagaaacacctctaaagaccttcaagaagctactggtcaattgactagagtcgctgaagaacaactctctggtatcaagacggttcagtcgtttgttgctgaaggtaatgaattgtctaggtataacgttgcaattagagatatttttcaggtgggaaaaactgcggcatttacaaacgcaaagttttttactacaactagtctcttaggtgacctaagttttttaaccgtccttgcgtatggctcctatcttgttttacaatcacagctctccattggtgatctgactgcatttatgctgtacacagaatatacggggaatgcggtattcggcctttctaccttctattcggaaattatgcagggtgctggggccgcttccaggttgtttgaattaacagataggaaaccttccatttcaccgactgtgggacacaagtataaaccagatcgtggtgttatcgaatttaaagatgtttcatttagctaccctacaaggccttctgttcaaatattcaagaatttaaattttaaaattgcgccaggatcgagtgtttgtattgtgggcccttcaggtcgtggtaaatctacaattgcactcttactgctaagatattataatcccactactgggactattacgatagataaccaagatatctctaaattgaattgtaaatccctaagaaggcatattggtatcgttcagcaagagccggtactgatgtcaggtactattagggataatatcacttatgggttgacatataccccaacaaaggaagaaatcaggtcagtagcaaagcagtgcttttgccataactttatcacaaaatttccgaacacatacgatacggtaattggtcctcacggcaccttactaagtggaggacaaaagcagcgtattgcgattgcaagggctctaatcaaaaagccaactattttgattcttgatgaagctacatcagctttagatgttgaaagtgaaggagccattaactatacgtttggtcaactaatgaaatcaaaatcgatgactattgttagcatcgcgcacaggctaagtacgatcagaagatcagagaatgttattgtccttggccatgatggatcagtggtagaaatgggcaaattcaaagaattgtatgcgaatccaacaagtgctttatcgcaattacttaatgagaaagcggctcctgggccatctgaccaacaactgcaaatagagaaggtcatcgaaaaggaagatttgaatgagagtaaggagcatgatgaccagaaaaaggacgataatgacgataatgataataatcatgataacgacagcaataaccagtctccagagacgaaagacaataattcagatgatattgaaaaatctgtcgaacatctcctgaaagacgcggcaaaggaggctaatccaattaagatcacaccacaaccgtga

SEQ ID NO: 4810 - DNA, 2325 bp, Saccharomyces cerevisiae
atgcaaaaatccgttagagtgggcgactattttgacaatgatgacaatggtttgtggtcgtggtacttaacaaacctcagattaggcgattttgaagaacttataggcaatcaattaaaatacactctgttaaaaagatttctgaatagtcatttttatggtgataacaatatttcggccaggccaaacaagaagattttgttagtttccatcccagagaatgttcatgaagatatctccatattggaaatcttcctcaaagattactttcatctggaaaaattagaacacattcaaatctcaaaattaactcactcccactgctacaatcatgaaaatcattacctattgacggacaacctcaacaatttccaagaccctacctttttagaatttgcgagtacaagttggcaagttcaaaaaaattccaaggctttaaacaataacaatagaaattcaataccaccacccacaatatcttcatcaaaagcttcaaacgggaagctagaatcaaacgtttcggatgatcagtggtcaaatataaatacccagacttcaacagctacccgaactaatacgaatacgaggactttgacatctccggacacagttgatataaacgttacatccgtgaatagtcaaagcaataataatgatacgcctcaagataatgaaaacgaagttgatgaagaggatgccacaagttctatagtcctaaatttttctcattcgcgaacagtagattcaaagcctaatagactacccaaaatttttccatcatacactaatgaagactatacaccgtcacattccgagataatgtcaatagatagttttgctggcgaagacgtatcatccacatatcccggacaagacctgagtttaactactgccaggcgcgaggatgaaagtggtcaggatgaagttgaggatcattatagcagagtctcacatgatctaggtgacgagagtatcgatcaagcaagttatagcatggaaagttcggtcagctacactagctatagtagtagcagtaatagtagtagtgcccactacagtttaagcagtagcagccgaggtaatccaaaacgtgaaaacatcgatcacacgaatgccacctatgtctctgaattgtcaagtataacgagttctatagacaatttaactacttcgacaaccccagaggaggaggataatttaattcatcataactatgacgcccaagggtatggatcaggagaggacgatggagaagaggtttatgatgatgaagatctttcttcttccgattactcagtactatccattctaccgtcaatctcaatttgtgattctctagggtattttaggctagttttgcaatctatattaattcaggatccagacaccaaagaaatttttactgcgattagacagtcaaacaataaacctacaatggcaagcgttaccgatgattggttgctgtatgattccaatttttcaatgaataatttacaaattctaacacttcaagatttgctagatatcaagagatcatttccaaaaattttattttacacaatggttattgtgacaaactccggcaaacaggttgaagaagaattcaaaaatcccaattatgataatagggaaggaatatcaaaagagcaacctctagattctgagttatcattaactaacgacccgcaacaatatttcccgactgcatataataacggttacaacgactatattgacgatgaagacgatgaagacgatggtgacgatgcttctttatcagaacagtcaggcccacaaatgtacataccaactagaatggaatctaacgttactacagcacatcgttctattagaaccgtaaacagtatcggggaatgggcattcaatagacataattctgttacaaaaatcgataaaagtaatagtaacgagttggataactctaaaacaggtgaaagtacagttttatcaagtgaacctcatccaatgacacaactgtcgaactctaatacgacttcctcgaattttagccattctttgaagacaaaaaattctcacaaacctaattccaagggtaacaatgaaagtaattccaaaaatgagttgaaaaagataaagagttccatcaatgctatgagtgccgtggaaaggtccaaaagtttgcctttacctacattactaaagtctttaagcggcatagataaccctactcatgccactaacaaggatagaaagcgttggaaattccagatgaataggtttaagaatcataaaaacagtggttctgcaggtacggataaatctcagcgttgtgccatcatgtaa

SEQ ID NO: 4811 - DNA, 2328 bp, Saccharomyces cerevisiae
atgtcatttgatagaccggaaatatacagtgctcctgttttacaaggagaatctcctaacgacgatgataatactgaaatcataaagtcctttaagaatttcattttggagttcagacttgactcgcaatttatttacagagatcagttaaggaacaacatccttgtgaagaattattctttaacggttaacatggagcatttgatcggatataacgaagacatatataagaaactatcagacgaaccttcagatatcattccattattcgaaaccgcgatcacacaagtggctaaaaggataagtattctaagcagagctcaatctgctaataacaatgacaaagatccagaaaatactagtatggatactgattctctcttattgaactctttaccaacatttcaattaattttaaactccaatgcaaatcagattccattgagagatttggattctgaacacgtctccaagattgtccgtttatcaggtattataatatccacgtcagttttatcttcccgtgccacgtacctttctataatgtgcagaaattgcagacacacaacatcaataacaatcaacaatttcaattctatcacaggcaataccgtcagtttaccacgttcttgcttatctacgattgagagtgaatcttctatggcaaacgagtcgaatattggtgatgaatcgaccaagaaaaattgtggacctgatccatatattattatccatgagtcttcaaagtttattgatcaacagtttttaaaattacaggaaatcccagaactggttccagtaggtgagatgcctagaaacttaacaatgacttgtgaccgatacctaacaaacaaagttattcctggtacgagagtcactatagtaggtatttattccatctataattctaaaaatggtgccggatccggaaggagcgggggtggaaatggaggaagtggtgttgctattagaacaccttatatcaaaatattaggtattcagtccgatgtagaaacctcctctatttggaattcagtaactatgtttactgaggaggaagaagaggaatttctacagctaagtagaaacccgaagctttatgaaattttgaccaactctattgccccctctatttttggtaatgaagatataaaaaaagccattgtatgtttattgatgggtggttccaagaagatattacccgatggtatgaggttaagaggtgatatcaatgtactattattaggtgatccaggtaccgccaaatctcaactattgaaatttgtggagaaagtgtcacctattgcggtatatacatctggtaagggatcttctgcagctgggttaactgccagtgtacaaagagatccgatgacaagagaattttatttggaaggtggtgctatggtgcttgccgatggtggtgttgtatgcatcgatgaattcgataaaatgagagatgaagatagagtggccattcatgaagctatggagcagcaaacaatctccatcgcaaaagctggtatcactacagtgctaaattctagaactagtgttttagcggctgctaatccgatatacggccggtatgatgatttgaagtctcctggtgacaacattgatttccaaactactattttatcccgttttgatatgatttttattgttaaggatgaccataatgaagaacgtgatatttcaatagctaaccacgttattaatattcatacaggaaatgctaatgctatgcaaaaccaacaagaggaaaatggcagtgaaattagtattgaaaagatgaaacgttacattacgtattgtagattgaaatgtgcaccaagactttcaccgcaggccgctgaaaaactgtcatcgaacttcgtcaccattaggaagcaattattaatcaacgaattagagtcaacggaaaggtcgtctattccaattaccattcgtcaattagaagctattattagaataacagaatcattagccaagttagaattaagtcctattgcacaggagagacatgttgacgaagctattagattgtttcaagcttccacaatggacgcagcgtctcaggatccaattggcggcttaaatcaagcaagcggaacatctttgtcagaaatccgtcgttttgaacaagaactaaaaagaagattacctataggctggtctacttcttatcaaactttgaggagagaatttgtagatacacatagattttctcaattagcactggataaggccttatatgccctagagaagcatgaaacaattcaattgagacaccagggacagaatatttacagaagtggtgtatga

SEQ ID NO: 4812 - DNA, 2331 bp, Saccharomyces cerevisiae
atgagctcatcgctactttcagttttaaaagaaaagtcaagaagcctgaaaatacgaaacaaaccggtgaagatgaccagtcaggaaaggatgatagtgcatagatgcagatttgtggatttcactcctgccacaatcacatctctagcattttcacataaatcaaatataaataagttaactccgtccgatttgagattagctattggtagatctaatggtaacatagaaatctggaatcctagaaacaattggtttcaggaaatggttatcgaaggtggcaaagacagatcaattgaaggcctttgctggagcaacgttaacggcgagtctctaaggctattttctattggcggctcgactgtggtaacagaatgggatttagcaacaggtttaccattaagaaactatgattgcaattcaggtgtgatatggtctatttccatcaacgattcacaagacaagctgtctgtgggttgcgataatgggacggtggtcctcatagatatctctggcgggcctggtgtcttggaacacgatactattttgatgagacaagaagccagagtattgactttggcttggaaaaaggatgacttcgtgattggtggttgttctgatggtagaataaggatttggtctgcacaaaaaaatgacgaaaacatgggtcgtctattacacactatgaaggtcgacaaggccaaaaaagaatcaactctagtttggtcagttatatatttaccaagaactgatcagattgcctctggtgattctacaggctccattaaattctgggatttccagtttgccacgctaaaccagtcatttaaggcgcacgatgcagacgtactgtgtctaactaccgatactgataataattatgtttttagtgctggtgtggacagaaaaatctttcaattttctcaaaacactaacaaatctcaaaagaacaacagatgggtaaattcttctaataggttgcttcatggaaacgacattagagcaatatgtgcataccaatctaaaggtgcagattttctagtttcaggaggtgttgaaaaaacactagtcatcaactcacttacttctttttctaatggaaactacaggaagatgccaactgtcgaaccttattcaaagaatgttttagttaacaaagagcaacgccttgttgtttcatggagcgaatctactgttaagatatggacaatgggaaccgattctagtacagaacagaattataagctagtttgcaagttaactttaaaagatgaccagaatatctcaacttgttctttatcacctgatggacaagttttagtcgtagggaggccctctaccactaaagtttttcatttacagcccgtaggtaataaattgaaagtgactaaactagataatgacctattattgagaacttccacaaaattagtcaagttcatcgataattccaaaattgtcatatgctcttgcgaagatgatgtatttattgtggatctagaatctgaagaagatgaaaaaccgcaagaagttgaacttttggaggttacttcaactaagagcagtatcaaagttccctatattaacaggatcaaccatttggaagtagaccagaacattgcagtaatttctcgtggctgtggagtcgtagacatattagacttaaaagcaaggatttctaaaccacttgctcgtttgaataatttcatcaccgctgttcatatcaatacttctagaaaatctgtagtagtaattactgcagacaataagatttatgaattcaatatgaatttgaattcggaagccgagaatgaagatagcgaaagcgtattaactcaatggtcaaaaaacaatacggataacttaccaaaagaatggaagacattaaaagagaactgtgtagggatattttcagacatagaaaatagtagcagattatggttttggggggctacttggatatcaagaatagactttgatgttgacttccctataaataagagaagaaaacagaaaaaacgtacacacgaagggctaactatcacagatgaaagtaatttcatgaacgacgaggaagatgacgaagatgacgatattgatatggaaatcagcgaaaacttgaatgtattattaaaccaaggaaacaaaataaagtccacagatgtacaaagaaacgaagaaagctccggtcacttcttctttactgataaatataaacctttactgtttgttgacttaatttctagtaatgaattggcaataattgaaagaaatccattaacttttcactccaaacaaaaggcgtttattcaaccaaagttagtgttttga

SEQ ID NO: 4813 - DNA, 2331 bp, Saccharomyces cerevisiae
atggctgatagacctgctattcagttgatagatgaagagaaggaatttcatcaaagtgcattacaatattttcaacaatgtattggaaatcgtgatgttggtctagattaccatgtcatctcagttttcggttctcaatcgagtggtaaatcgactttacttaacgtcttgtttaacaccaactttgataccatggatgctcaggtgaaaaggcagcagactactaaaggcatttggttggctcacactaaacaggttaatacaactattgaaatcgataatgatcgtccagatatttttgtgctagatgttgagggctccgatggttcagaaagaggtgaagaccaagattttgagagaaaagccgctttatttgccattgcagtatctgaagttcttatagttaatatgtgggagcagcaaattgggctatatcaaggtaataatatggctttattaaaaacagtttttgaggtcaacctttccctatttggcaagaatgataatgaccacaaggtgctgttactttttgtaattagagatcatgtaggtgtgactccactctcgagtttgagtgattccgttacgagagaattggaaaaaatatggacagagttaagtaaacctgctggttgtgagggttctagcctgtatgattatttcgatttaaagtttgtcgggctagctcataagttgttgcaagaagacaaatttacccaggatgtcaagaaattaggtgattcgtttgtgatgaaaggtacggaaaactattatttcaaacctcaatatcaccataggttgccattagatggttggactatgtacgcagaaaattgttgggatcaaattgaacgtaacaaggatttagatcttccaactcagcaaattctggttgctagatttaaaactgaagaaatatctaatgaagctctagaagagttcatttcaaaatatgatgaatcgattgctcctttaaagggtaacttgggatctttaacatctcagctagtgaagctaaaagaagaatgtctgacaaaatatgatgaacaagcatcgcgctatgcaagaaacgtttatatggagaaacgagaagctttaaatacaaagctgaattcacatatttcaggtacaattaatgagttcttggaatcattaatggaaaagttatgggacgatttaaaattggaggtgtcttctagagacaaagctactacctcttttgtagaaagtgtggcggcaggtaagagtaagattgagaaagaatttaacgaatcaatggagaccttcaaaaagttagggctactaatatcaaacgaagagattacctgcaaattttccgacgatattgaagaaagaatcaagcaactacgtgatgctgaattgaaagcaaaaatcggtcgtattaaaaaaaatctggttcccgaattaaaggatcatgtgattcatttactatcacatccatccaaaaaggtttgggatgatataatgaacgattttgaatctactatcaaagacaatatatctgcgtatcaagtggaaaaagataaatatgattttaaaattggactttcagagagcgaaaacgcgaagatttacaaaaatattagaatattggcgtggagaaccttggataccacagtacatgactacctgaaaatagatacgattgttagtatattgagagacaggtttgaagatgtattcagatatgatgctgaaggttctccaagattgtggaaaacagaagaagagattgatggggcattccgtgttgcaaaagaacatgccctggaagtttttgaggttctttcacttgctgtaacctcagataacgttgaaattattcctgatgtaccaatggctgaagaggaaagcggcgaggacaacgaaatatatcgggacaacgaaggtgtgtttcattcccgtcgtttcgcacacatcttgactgaattgcaaaaggagaatgttttagatcaattccgcaggcagattaacattactgttctggattcgaaaaggtctatcatcactactagaacgcatattccaccttggatttacgttttgctagccgtattagggtggaacgaattcgtggctgtcataagaaaccccttatttgtaacccttaccttgatcttaggtgcaaccttttttgttattcataagttcggcctctggggccctgttgttaatgttgttcaaagtgcagttggtgaaacaagaactgcaataaaggataaactaaggcaatttgtcgttgaagatcatgaagtgaaggaatcttttgaaatgaaagatttctcaaaaaacgagcaaaaagaaaaatga

SEQ ID NO: 4814 - DNA, 2337 bp, Saccharomyces cerevisiae
atgaagttttatatagatgatttaccagtgctttttccataccccaagatatatccagagcagtataattatatgtgcgatattaaaaagactctggatgtaggtggaaatagtatcttggagatgccttcaggaacaggtaaaacggtctcattactatccctcacaattgcctaccagatgcactacccagaacatagaaagatcatatattgttctcgtactatgtctgaaattgaaaaagctttagtagagttagagaaccttatggattacagaactaaagaactaggctatcaagaggattttcgaggtcttggcttgacatcaagaaaaaatttgtgtttgcatcccgaagtgagtaaggaacgaaaaggtacagtagtcgatgaaaagtgccgtagaatgacaaatgggcaggcgaagagaaaattagaagaggatccagaggcaaatgtagaattgtgtgaataccatgagaatttgtacaatattgaagtagaggattatcttccaaaaggcgtattttcttttgaaaaacttttgaaatactgcgaagaaaaaacactttgtccatattttattgttcgtcgtatgatttctctttgtaacattattatttattcttaccattatctattagatcctaaaattgctgaaagagtttccaacgaggtttctaaagatagcattgtcatttttgatgaagcgcacaatattgataatgtgtgtatcgaatcgctgtcattagacttgacaacggatgcattgagaagagccacacgaggtgctaatgcgttagatgaacgtatttctgaggtcagaaaggttgactcacagaaattacaggatgaatacgaaaaactagttcaaggtctccattctgcagatattcttaccgaccaggaagagccatttgtggaaacacctgtattgccccaagatcttctaacagaagcaatcccgggaaatatacgaagagccgagcattttgtttcatttttgaaaagattgatagaatatctgaagaccagaatgaaagttcttcacgttatttcagaaacgccaaaatcatttctacagcatttaaaacagttaactttcatagaaaggaaacctcttcggttttgctcagaaaggctatcattacttgtaagaactttagaagttacagaggtagaagattttactgcattgaaagacatagcaacttttgctactcttatatcaacatatgaggaagggtttttactaattattgaaccgtatgaaatcgaaaatgctgcagttccgaatccgattatgagatttacttgcttagatgcatcgattgccatcaaaccagtctttgagagattttcttccgttattatcacttcagggaccatatcaccattagacatgtatccaagaatgttaaactttaaaactgttttacaaaaatcatatgccatgaccttagccaaaaaatcatttctaccaatgattattaccaagggttctgatcaagttgcaatttcttcaagatttgaaatcagaaacgatcctagtattgttcgtaattacggttctatgctagtagagtttgccaagatcacacctgatggaatggttgtttttttcccctcatatctatatatggaaagtattgtttcaatgtggcaaacaatgggtattcttgacgaagtttggaaacataaattaattttagttgagactcctgatgctcaagaaacttctttagccttagaaacctatagaaaggcttgctcaaatgggcgtggggcaattttgctttctgttgctagaggaaaggtatctgaaggtatcgattttgatcatcaatatggcagaactgtgctgatgataggtatcccgtttcaatacacagaatcgcgtattttgaaagctcgcctagaattcatgagggagaactatcgcatcagagaaaacgacttcttatctttcgatgcgatgagacatgcagctcaatgtctggggagagtactgagagggaaggacgactatggtgtaatggtactagcagaccgtaggttttcaagaaaaagaagccagttaccaaaatggattgctcaaggtttgtctgacgccgatttgaacctttcgactgacatggccatatccaataccaaacaattcttgagaacaatggcacaacccacagaccctaaagaccaagagggtgtatctgtttggagttatgaagatttaataaagcaccagaatagcagaaaagatcaaggtggatttattgaaaacgaaaacaaagaaggagaacaggatgaagatgaagatgaagatatagaaatgcagtga

SEQ ID NO: 4815 - DNA, 2337 bp, Saccharomyces cerevisiae
atgctgtctgcacgttctgccatcaagagacccattgttcgtggtcttgcgacagtctccaacttgactagagattcaaaagtcaaccaaaacttattagaagatcattcttttattaactacaagcagaatgtggaaacgctggatatcgtaagaaaaagattaaacaggccatttacctacgcggaaaagattttgtacggtcacttggatgaccctcatggtcaagatattcagagaggtgtttcatacctaaaattaagaccagatcgtgttgcctgtcaagatgctactgctcaaatggctattttacaatttatgtccgctggtttaccacaggttgctaagccagtcactgtccactgtgaccatttgattcaagcacaagttggtggtgaaaaagatttgaagagagctatagatctaaacaaggaagtttatgatttcttggcctctgccactgcgaaatataacatgggtttctggaagccaggttccggtatcattcaccaaattgttctggaaaactacgctttcccaggtgctttgatcattggtactgactcccatacaccaaatgctggtggtttaggtcaattggctattggtgttggtggtgctgatgccgttgatgttatggcaggtcgtccatgggaattgaaggctccaaagatcttaggtgttaagttgactggtaagatgaacggttggacttctccaaaggatattattttgaaattggctggtatcacaactgtcaaaggtggtactggtaaaattgttgaatatttcggtgatggtgttgacaccttctccgctactggtatgggtaccatttgtaatatgggtgctgaaatcggtgctaccacatctgttttcccattcaacaaatctatgattgaatatttggaagcaactggtcgtggtaagatcgctgactttgctaaattataccacaaggacctattatctgctgataaggatgctgaatacgatgaggtcgtcgaaattgacttgaacactctggaaccatacatcaatgggccatttacccccgatttggctactccagtttctaagatgaaggaagttgctgttgctaataactggccattggatgtcagagtcggtttgatcggttcttgtaccaattcctcttatgaagatatgtctcgttcagcatccattgtcaaggatgctgctgctcatggtttgaaatccaagaccattttcactgttactccaggttctgaacaaatcagagccactattgaacgtgatggccaattagaaaccttcaaagaatttggtggtatcgttttggcaaacgcctgtggcccatgtattggtcaatgggatcgtagagatatcaagaaaggtgacaagaatactatcgtttcctcttacaacagaaatttcacttctagaaatgatggtaacccacaaactcatgcttttgttgcatctccagaattagtaactgcgttcgccattgcgggtgatttgagattcaaccctctaacagacaaattaaaggacaaggatggtaatgagttcatgttgaaaccaccacatggtgatggtttgcctcaaagaggttatgatgctggtgagaacacttaccaagctccacctgcagaccgtagcaccgttgaagttaaagtttctccaacttcagaccgtctacaactgttgaaaccattcaaaccttgggatggtaaggatgctaaagacatgccaatcttgattaaggccgtcggtaagacaactactgatcatatttctatggctggtccatggttgaaatacagaggtcatttagaaaacatttctaataactatatgattggtgctattaatgctgaaaacaagaaggctaactgtgttaaaaatgtatatactggtgaatacaaaggtgttccagacactgctagagattacagagaccaaggtatcaagtgggttgttattggtgatgaaaactttggtgaaggttcctctcgtgaacacgctgctttggaaccaagattcttgggcggtttcgctatcatcacaaagtctttcgctcgtatccatgaaactaacttgaaaaaacaaggtctattgccattgaacttcaagaacccagctgactatgacaagatcaaccctgatgacagaatcgatattctgggtctagctgaattggctccaggtaagcctgtaacaatgagagttcatccaaagaatggtaagccatgggatgctgtgttgacccatactttcaacgatgagcaaattgaatggttcaaatatggttctgccttaaataaaattaaggccgatgagaagaaataa

SEQ ID NO: 4816 - DNA, 2340 bp, Saccharomyces cerevisiae
atgccaacaacttatgtgccaataaatcaaccaattggggatggtgaagatgtcattgacaccaatcgattcaccaatattccagaaacgcaaaattttgaccaatttgttacaattgataagattgctgaggaaaatagaccactgtctgtagactcggacagggagttccttaattcaaaatatcgacattaccgagaggttatatgggaccgtgcaaaaacatttatcacattaagctctacggccatagttattggatgtattgctggtttcctacaagtcttcacggaaactctggttaactggaaaacaggtcattgtcagaggaactggctacttaataaatccttctgttgtaacggcgtggttaatgaggttacctctacaagcaatttactactgaaaagacaagagtttgaatgcgaggcacaagggctttggattgcctggaagggacatgtgtccccttttataattttcatgcttttgtcagtcttatttgctctaattagtacactgttagtcaaatatgttgctcctatggctactggttcaggaatctcagagattaaggtatgggtatcaggttttgaatacaataaggaatttttgggtttcttaacattagtcattaaaagtgttgcccttcctttggctatttcttcgggattaagcgtaggtaaagaagggccctcagttcattatgcaacctgttgtgggtacttactcacaaaatggctactaagagatactttgacgtattcatcgcaatatgagtatatcacagcagctagtggagcaggtgttgcggttgcttttggtgctcctattggtggtgtcctttttggtttggaagagattgcttctgcgaataggtttaactcctctaccttatggaaatcctattatgtcgccctagtcgcaataactactttgaagtacattgatccatttaggaatggcagagttattttattcaatgtaacatatgatagagactggaaggtacaagagattccgatctttatagccttaggaatctttggtggtttatatggaaaatatattagtaagtggaacatcaactttattcactttcgcaaaatgtacctgtcctcatggccagttcaagaagtgctttttttggcgacgcttactgctttgatttcttacttcaatgagttcttgaaattagacatgacagaaagtatgggtatattgtttcatgaatgtgtcaagaacgataacacctcaacttttagtcataggttatgtcagttggatgaaaatacgcacgcttttgagttcttaaaaatttttacttccctatgctttgccactgttatcagggccttgttggtggtggtatcatatggcgccagagttcctgccggaatctttgttccttcaatggcggttggggccacatttggacgggcagtaagtctactggtagagagatttataagtggcccttctgttattactcctggtgcctacgccttcctgggagcagccgctaccttgagcgggataactaacttgactttaactgtggtggtaataatgttcgagctaacaggcgccttcatgtatatcataccccttatgattgtagtggcaataacaaggataattttaagcacgtctggtatttctggcggtattgctgatcaaatgatcatggttaatggattcccatatttggaagacgagcaagacgaggaagaggaggaaaccttagaaaaatacactgcagagcagctcatgtcctccaaattaattactattaatgaaaccatttacctttccgagcttgaatctttgttgtacgactcagcgtctgaatattctgtgcatggttttccaataactaaggatgaggataagtttgagaaggaaaaaagatgtattggctatgttttaaaaaggcacttagccagtaaaatcatgatgcaaagcgtaaatagcaccaaagctcaaacgacactggtatacttcaataagtctaacgaagagttgggacatcgtgaaaactgcatcggatttaaggatattatgaatgaatctccaatctcggtgaagaaggcggtgccagtaacattgttattccgtatgtttaaagagctaggttgtaagactatcatcgtagaggaaagtggaattttaaaggggttggtcactgctaaagatattttgaggttcaaaagaattaagtatcgagaagttcacggtgcgaaatttacatataatgaagcacttgatagaagatgttggtcagttatccatttcataatcaaaaggtttaccactaatcgaaatggtaacgttatatga

SEQ ID NO: 4817 - DNA, 2340 bp, Saccharomyces cerevisiae
atggagcgaacaaatacaacaacattcaaatttttttcattgggaggaagtaacgaagttggacgatcatgtcatatattgcaatataaaggtaaaacagtgatgctcgacgcaggaattcatccggcatatcaaggattagcttcattacctttttacgatgaatttgatctttccaaagtcgatatcttactgatatcacatttccatttagaccatgccgcttcacttccgtatgtgatgcaacggactaactttcaaggcagagttttcatgacacatccaaccaaagccatttacagatggctactgcgagattttgtaagagttactagtataggttcttcatcctcctctatggggactaaagacgaaggtctattctcagatgaggatttagttgattctttcgataaaattgaaacggtggactatcattctactgttgacgtcaatggtatcaaatttacggcattccatgcaggccatgtattgggtgcagcgatgtttcaaatagagattgctggccttagggtgttattcacaggtgactattcgagagaagtagatcgtcacttaaattctgctgaggtgcctccactttcatccaacgtattaattgtggaatctacctttggtaccgctactcacgagccccgtttaaatagagaaaggaagctaacccaactaatccattccacagtgatgagaggaggccgtgttctactgcctgtttttgctttagggagagctcaagaaatcatgcttatactggatgagtactggtctcaacatgctgatgaactcggtggtggacaagtcccaatattttatgcatcaaatttggcaaaaaaatgtatgagcgtttttcaaacctatgtaaatatgatgaatgatgacattagaaaaaaatttagagactctcagactaatcccttcatattcaaaaatatatcttatcttagaaacttggaggatttccaagattttggtcccagtgtgatgttggcctcaccaggtatgctgcaaagtgggttatcaagagatttacttgaaaggtggtgccctgaagataaaaatctagtactaatcaccggttactccatcgaaggaacaatggcgaaatttattatgcttgagccagatacaataccttccataaataatccggaaataaccattccaagacgttgtcaagttgaagaaatctcctttgccgcacacgttgacttccaggaaaatttagaatttattgaaaagattagtgcgccaaatatcatccttgttcatggagaagccaatcccatgggccgtttgaaatctgcattgttatccaatttcgcgtctttaaagggtacagataatgaagtccatgtttttaatcctagaaactgtgttgaagtagatcttgaatttcaaggtgtcaaggttgcaaaagctgtgggaaatattgtgaacgaaatatataaagaagaaaacgtagagataaaggaagaaattgcggctaaaattgaacctataaaggaagaaaacgaagacaacttggattctcaagcagaaaaaggtttggttgatgaagaggaacacaaagacatagtcgtttctgggattctagtttcagatgacaaaaatttcgaattagacttcctttctttgtctgatttaagagagcaccatcccgatctttctacaacgatattaagagagcgccagtcagttcgtgtaaattgtaaaaaggagctaatttactggcacattttacaaatgtttggagaggctgaagttcttcaagatgatgatagagtaacaaatcaagaaccaaaggttaaagaagagtcaaaagacaatctgaccaatacaggtaaattgattctacagataatgggtgatattaagttaactattgttaatactctagccgttgtggaatggactcaagatttaatgaatgacactgtagcagactccattattgctatacttatgaatgtggattcagctcccgccagtgtcaagctttcgagtcattcttgtgatgatcatgatcataacaatgtgcagtctaatgcacaaggtaagattgatgaagttgagagggtgaagcaaatctcaaggttgtttaaagaacagtttggtgactgttttactttatttctcaataaagatgaatatgcaagtaataaagaggaaactataactggagtggttaccataggtaaaagcactgctaagattgacttcaacaatatgaaaattttagaatgtaattcaaatcctttgaaaggtagggtggaaagcctcttaaatattggtggtaatttggtcacaccgctatgttaa

SEQ ID NO: 4818 - DNA, 2340 bp, Saccharomyces cerevisiae
atggggtcgtttcccttagctgagtttccattacgtgatatccctgttccttatagctaccgtgtgtctggcggtatagcttcctcaggtagtgttactgcgcttgttactgccgctggcactcatcgaaactcgtccacggctaagacagttgagacagaagacggcgaagaagatatcgatgagtatcagaggaaaagagcagctggttctggcgaatccactcctgaacgcagtgatttcaaaagggtaaaacatgataatcacaaaaccctccatccagttaacttacagaacaccggtgcagcgtctgtggataatgacggtctgcacaatttaacagatatatccaacgatgcagaaaaacttttgatgtctgtggatgatggttctgccgcaccttctacattgagtgtaaacatgggagtggcatctcataatgttgctgctcccactaccgtcaatgcggcaacaataactggcagtgatgttagtaacaatgttaatagtgctactattaacaatcctatggaggaaggagcgctgccgttatcacccactgcttcctctccaggtaccacaactcctttagctaaaactacgaaaactatcaacaacaataataatatcgccgatttgatagaatccaaagattctataatctcccctgaatacctttctgatgagattttcagcgcaataaacaataatctccctcacgcatacttcaaaaatttattatttagattagttgccaacatggataggagtgaactatccgacttggggactttaatcaaggataatttaaagagggacctaataacgtctttgccttttgaaataagtttgaaaattttcaattatttgcaattcgaggatattataaattcccttggggtctcccaaaattggaacaaaataattagaaaatctacatcgttgtggaaaaaacttctgatatcggaaaattttgtgagcccaaagggttttaattctctcaatctcaaactctcccaaaaatacccaaaactctcacaacaagatcgccttagattatcttttctggagaatatattcattttaaaaaattggtacaatcccaagtttgtaccacaaaggaccacgttaagaggccatatgacgagtgttattacgtgcttgcaatttgaagataattatgtcattacgggggctgatgacaaaatgatcagagtttatgattcgataaacaagaaatttcttctacaactatcaggtcatgatggtggggtttgggcattgaagtatgcccatggcggtattttagtcagcggttctacagacagaacggtgcgagtttgggatattaagaaaggttgttgtacccatgtgtttaaaggtcataactctacggtgaggtgcctagatatagtagaatataaaaatatcaagtacattgttactggttcgagagataacactttgcacgtttggaaattgcccaaggagtcctccgttcctgatcatggggaagaacatgattatccattagtctttcatacccctgaggagaacccatattttgttggtgttttaagaggacatatggcatctgtaagaactgtctcaggccacggtaatattgtcgttagtggctcctatgataatacactgattgtgtgggatgttgcgcaaatgaaatgtttgtatattttaagtggacatacggatcgtatttattcgacaatctacgatcatgaaagaaaaaggtgcatctctgccagtatggataccactattagaatttgggatttggaaaatatatggaataatggagaatgttcctacgcaacaaattcagcatcgccatgcgccaaaatacttggtgctatgtacactttgcagggtcatacagctttggtcggtttattaagattatccgacaaatttttggtcagtgccgctgcagacggttcaataaggggttgggacgcaaacgactactctagaaaattttcctaccatcataccaatttgagtgcaattaccacattttatgtatcggataatattttggtgagtggatcggaaaatcagttcaacatctataatctacggagtgggaaattggtccacgcaaatattctaaaagatgctgatcagatttggtcggttaattttaagggcaaaacacttgttgcagcagttgaaaaagatggacagagctttttagaaattctggatttcagcaaagcttcaaaaattaactacgttagcaatcccgtaaactcctcgtcgtcgtctttggaatccatttctacttctttgggtctaacgaggacaactataataccatga

SEQ ID NO: 4819 - DNA, 2340 bp, Saccharomyces cerevisiae
atggtttacactccatccaagggtccaagaactctttacgataaggtttttgatgcacatgttgtccatcaagatgaaaatggttcctttttgttgtatatcgacagacacttggttcatgaagtcacctctccacaagctttcgaaggcctagaaaatgccggcagaaaggtcagaagagttgattgtactctagctactgtagatcataatattccaactgaatcaagaaagaatttcaaatcactagacacatttatcaagcaaactgattcgcgtttacaagtcaaaactttagagaataatgttaaacagttcggcgttccatatttcggtatgagtgatgccagacaaggtatcgtccacaccatcggtcccgaagaaggtttcactttaccaggtaccactgttgtttgtggtgactctcatacctctactcacggtgcctttggttcgctggcctttggtattggtacttctgaagttgaacacgtcttggccactcaaacaattatccaagctaaatcgaaaaacatgagaattactgttaatggtaagctatcacctggtatcacatctaaagatttgattttgtatattattggtctgataggtactgcaggtggtactggttgcgttattgaattcgcaggtgaagccattgaagctctttctatggaagcacgtatgtccatgtgtaacatggccatcgaagctggtgcaagagcaggtatgattaaaccagacgaaactactttccaatacaccaaaggcagacctttggctccaaaaggtgccgaatgggaaaaggctgttgcctactggaaaactttgaaaacagacgaaggtgccaaatttgaccacgaaatcaacattgaagctgtcgacgtgattccaactattacatggggtacttctcctcaagatgccttaccaattactggttccgtaccagatccaaaaaatgttacagacccaataaagaaatctggtatggaaagagccttagcctatatgggtttggaacctaacacaccgctaaagagcatcaaagtagataaagtctttattggatcttgtaccaatggccgtattgaagatttaagaagtgctgcagctgtagttaggggtcaaaaattggctagtaacatcaaattagctatggttgttccgggatctggtttggtcaaaaaacaagccgaagcagaaggtttggacaagattttccaagaagctggttttgaatggagagaagctggttgttcaatatgtttaggtatgaaccctgatattttggatgcctatgaacgttgtgcttctacttccaacagaaatttcgaaggtcgtcaaggtgccttgtctcgtacacatctaatgtccccagccatggcggctgctgcaggtatcgcaggtcacttcgtagatattagagaattcgaatataaggatcaagaccaaagtagtccaaaggttgaggtcacttccgaagatgaaaaagagcttgaaagtgctgcttacgatcacgctgaacctgtccaacccgaagacgctccccaagatattgccaatgatgaattaaaagatattccagtgaagtcagatgatacacctgctaaacctagctcttccggcatgaagccatttttgactttggaaggtattagcgcaccattagataaggccaatgttgatacagacgctattatcccaaagcaatttttaaagacaattaagagaacgggtttgaaaaaagggttgttttatgaatggcgtttccgtaaagacgatcaaggtaaggatcaagaaaccgattttgtattaaatgttgaaccttggagggaagctgaaatattggttgttactggtgacaatttcggatgtggttcttccagagaacacgcaccatgggctctaaaagactttggtataaaatccatcattgcaccttcttacggtgatattttctacaacaactctttcaagaacggcttattacctattagattggatcaacaaataatcattgacaaattgatccctattgctaataagggtggtaagctctgcgtcgatttaccaaatcaaaaaattttggattccgatggcaatgtgctcgttgatcattttgaaatagaacctttcagaaagcactgcctagttaacggtcttgatgatattggtattacattgcaaaaggaagaatacatttccagatacgaagctttgagaagagagaaatactcattcttggaaggtggatcaaaattattaaaatttgacaacgttccaaaaagaaaagctgttacaactactttcgataaagtccaccaggattggtag

SEQ ID NO: 4820 - DNA, 2340 bp, Saccharomyces cerevisiae
atgtcagtcttgcgatcacaacctccttcagttgtaccgctacatctgacaacatccaccagtcgcaaaacagaacaggaaccatcgctattgcactctgcaataattgagcgacatcaagaccgttcggtgccgaattcgaattcgaatccggattcgaaccatcgaataaaaaaggatcgcaataatcacactagctaccattcttcatcgaattcggagtcaaacatggaaagtcctcgcttgtcagatggtgagtcttccactccgacctctattgaagagttaaacccaacaataaataattcgaggctggtgaagagaaactactcaatatcaattgatcctttgcatgacaacagcaataataatacggatgatgatcatccaaacaccataacttctccccgaccaaatagcactagtaacaaggaaatgcagaaatatagttttcccgaaggtaaggagtcgaagaaaataacaacaccctcgttaaactcgaataattgtttggatttggacaattccagtcttgttcacacagattcgtatatacaagacttaaatgacgatcatattttactaaacaagcgcgtttcgaggcgatcttccagaatatcggcagtaacagcaacttccacgacaattaagcaaagaagaaatactcaggattcaaacctgcccaatattccctttcacgcttccaagcattctcaaattctacctatggatgattcagatgtaataaaattggccaatggagataccagcatgaaaccaaattctgctactaaaattagtcactcaatgacttctttgcctcttcacccacttccacaaccttctcaaaagtcaaagcaatatcatatgatatccaaatcaaccacttctttgccgccagagaatgaccactactatcaacacagtcgtggcaccaaccataatcacgctgctaatgctgctgctgttaataataatactactactactaccgctgctacgggtctgaaaagatcagagtctgcaacggcagaaattaagaagatgagacaatctttgctgcataaaagagaaatgaaaaggaaaagaaaaacatttttggtggatgacgatcgtgttttgatcggtaataaagtcagtgaaggccatgtcaactttattatagcttataacatgctaactggtattcgtgtcgcagtgtcacgttgttctggcataatgaaacctttaactccggcagactttagatttacgaagaagcttgcctttgattatcacggaaatgaattgaccccttcttctcagtatgcatttaagtttaaggactactgtcccgaagtctttagggaacttcgtgcattattcggcttagaccctgctgattatttggtttcgttaacttccaagtacattttgagtgagttgaactcgccaggtaaaagtggttcatttttttattattcgagagattacaaatatattatcaagaccatacatcattctgagcatattcatctgagaaagcacatacaagaatactataaccatgtaagagacaatccaaacactttgatttgtcaattttatggtttgcatagagtgaaaatgcctatatcgtttcaaaataaaattaagcatcggaaaatttacttcctagtcatgaataacttatttccaccacacttagacattcacattacttatgatttaaaaggttccacatggggccgttttaccaatttggataaagaaaggttggcgaaagatagatcatataggcctgtgatgaaagatttaaattggcttgaagaaggtcagaaaattaaattcggtccattgaagaagaagacttttttgacacagctgaaaaaagatgtggaattgcttgctaaattgaatacaatggactattccttgttaattggcattcatgacatcaataaagctaaagaagacgacttacaattggcggatacggcatctattgaggagcaaccacagactcaaggacccataagaaccggtaccggaacggtagtacgacatttttttagagagtttgaaggtggaattcgagcatctgatcaattcaacaatgatgtggatttgatttattacgtggggataatcgatttcttgactaattactcagttatgaagaaattagaaacgttttggagaagtctacgccatgataccaagttggtgagtgccatacctccaagagactacgccaataggttttacgaattcatagaagattctgtagatcctctgccccagaaaaaaactcaatcgtcgtatagagacgaccctaaccagaaaaattataaagactga

SEQ ID NO: 4821 - DNA, 2340 bp, Saccharomyces cerevisiae
atgtgttacagtaggcaagccattcctccacctgttcctaatagacctggcggtactaccaatagaggacctcctcccttaccacctcgcgcaaatgttcagccaccagtttgttcttctgagaactccagtaaacctcgagaaaatagggtggcaggtgaatcactgcgcacaccaagcagttctaaccctttagctgacagccaggtgaatagtgacaatatttttcaatcacctgtcctttctaacttaaaagctcctccttccgtcttcaacaaagttcaacacccggtaccaaagccgaatattgatgatcaatctgttgatccattggagacaaacaagttctacacaaacatgttattagacgataatacacaacctatatggacacatccttattcaatttggttttctcgtgatccagaattgtttggtttggccgccaatcatactttagcgtctcaaagggtttttgatacaactacaaatcctcccagattctacttcaatcccacaaatataaaatcatttgtattcaaggccagggaatttgtctcttcaaatgatatcaagcttgaattccgggatatgaaacatatgtccatgtgcttactaatgtctttgagtagttcccagtttatagaattcccgctggttcaggggatgggctttgtcacggctatttaccacgatttgggttttgaattaagaagcgccgttggtttcaggagcttagagcgcataagcgtgaatgaaagatatggtaaatataatatacaacttgagaataataggaattggatactttatttgacctcacctgattactcttttccacaagattttcaaatttcattactcgacagcaatacaataatatcatctcataaaatcaatggtcttatctgtcaattatctgcagactccgtccccagtattgacatggcagcgggctgttatccagtatactgtgacctatcagggcaaactgttgatgaacatttcacaaattacagatttaactatacggttgcaggctactcgcagtctggaactactctaatgtatgctttaccacatcataaagcggcattcacaccagaaatgcaggaacgtgaaattgcctcaagcctggattccacagttaaaggcttaatgactggttatctcacaaacagttttgatatgcaggttcaagtacctcaagaattgggctttgaacctgtcgcgttatctttgaataagaaggcagattacagtcaagaaaagctatctaaaattcgggaagctgctgttcaagaagttcaattgagtgaccctcaacaagaatcaaacatagattctatgtatttctctggtaagatacttgcaaagtatgcgtggattctttatgtgacacattacatccttcatgatgaaaatttaacaaaagaattattatctaaactgactattgcaatggagagattcatcagcaatcagcaagtcttacctttaaattacgacgttagttggaaaggcataatttcatcaggctcttctagccaagactttggtaactcttattataatgatcatcattttcattactcttatcatgtcataacggctgccattatctctttagtcgattctgatttaagtggagttactaacaactcctggttagaaaataatagagattgggttgagtgcttaattagagattactctggtgttgacaacgatgatccgtacttccctcaatttaggtcatttgattggtttaatggccattcatgggccaaaggactatttccaagtggtgacggtaaagatgaagaatctacttcagaagatgtcaattcttgctatgcgataaaattgtgggggttggtaactggaaattctaagttaactgacatagcgaacttacaactcggcatcatgagaaatgttttccagagctacttcctatacgaaagcaataatactgtccaaccgaaagaatttattggtaataaagttagtggtattttattcgaaaataaaattgatcacgccacgtattttggcatggagcctcaatacattcatatgattcacgccattcctataacatcagcatcttcatgggtcagaacaccaaattttgtcaaagaggagtgggaagaaaaaatgcagccgataattgatcaagtgaatgacggttggaaaggaataatcatgttaaatatggctctgcttgatccaaaattttcgtacgactttttcagccaacctgatttcaacagaaatttcctagacaatgggcaaagcttaacttggtctttagcttattcaggtgctttttcttag

SEQ ID NO: 4822 - DNA, 2343 bp, Saccharomyces cerevisiae
atggctcctaaatctagttcttccggttccaaaaagaaatcatcggcaagttctaatagtgctgatgcaaaagcatccaaatttaaattgcctgctgaatttattaccagaccacatccttctaaagatcatggcaaggaaacatgcacagcatatattcatcctaacgtattatcctcgcttgagataaatccgggatcattttgtactgtcggtaagataggcgaaaatggtattttagtaatagctagagcgggtgatgaagaagtacatcctgttaatgttatcaccctttccacaactatacgatctgttgggaaccttatccttggtgatcgtctagaattaaagaaagcccaggtgcaaccaccttatgccactaaggttaccgtggggtccttacaaggatataatattttggaatgtatggaggaaaaagtaattcaaaagctactggatgatagtggcgttataatgcctggaatgatttttcaaaacttaaaaacaaaagcaggtgatgaaagcattgatgtcgtaattacagatgcgagcgatgattcgcttcccgacgtcagccaactagatcttaacatggacgatatgtacggtggattagataacctgttttatctatctccaccttttatattcagaaaaggctccacacatataactttttcgaaagaaacccaggcaaatcgtaaatacaatcttccggagcccttatcctatgcagcagtgggcggcttagacaaggagattgaatcactgaaaagtgctattgaaatacctcttcatcaaccgacgctatttagtagctttggtgtttctccccctcgaggtatacttcttcacggacccccaggtactggtaaaactatgcttttgagagttgtagcaaatacgtccaacgcacacgtcctaaccattaatggcccctcaatcgtctccaaatatcttggtgaaacggaagcggcattaagagatatttttaatgaagcaaggaagtaccagccttccattattttcattgacgaaattgattcaatagcaccaaatagagcaaacgatgactccggtgaagttgagagcagagtcgtggctacattgcttaccctaatggatggcatgggcgctgcaggtaaagtggtggtaattgctgctacaaacaggcctaattctgtcgaccctgctctcaggagacctggcaggtttgaccaagaagtagaaattggtataccagacgttgatgccagatttgacattttaactaagcaattctcaagaatgtcctcggatcgtcacgtattagattctgaagcgatcaagtacattgcttctaaaacgcatggctatgttggtgctgatttaactgctctctgcagagaatcagttatgaagacgatacaacgaggactaggaacagacgccaatattgacaagttttccctaaaagttacattgaaagatgtggagagcgccatggttgatatcagacccagcgcaatgagagaaatcttcttagaaatgccaaaagtttattggtctgacattggcggccaagaagagcttaaaacaaagatgaaagaaatgatacagttgcctttggaggcttcggagacttttgccaggctgggaatttctgcaccaaaaggtgtattactttacgggccgccaggttgctccaagacattaaccgcaaaagctctcgctacagaatcgggtatcaacttcttagctgtgaaagggcctgaaatttttaacaagtatgtaggggaatccgaaagagctataagagaaattttccgcaaagcacgctctgcagctccaagtattatcttctttgatgaaatcgatgcattatctcctgatagagacgggagttccacctctgcagctaatcacgtgctcacatctttactcaatgagattgatggtgttgaagagttaaagggtgtagttattgtagcggcgacgaatagacctgatgaaatagatgctgctcttctaaggcctggtaggttagatagacacatttacgttggccctccagacgtaaacgcccgcttggaaatcttaaagaagtgcacaaagaaatttaatacagaagagtctggagtcgatcttcatgaattggcagaccgtacagaaggttattccggagctgaagttgtgctgctttgtcaagaagcgggcttggctgccataatggaagatttagatgtcgcaaaagtggaattacgtcattttgagaaagcttttaaaggaattgctaggggcattactccagaaatgctctcttattatgaagagtttgctctaagaagcggttcatcttcgtaa

SEQ ID NO: 4823 - DNA, 2343 bp, Saccharomyces cerevisiae
atggtagattttttaccaaaagtaacggaaataaatcctccatccgaaggtaatgatggtgaagataacataaagccactttcaagtggttcagagcagcggccgttgaaagaagaggggcaacaaggtggtagaagacatcaccggcggttgtcctctatgcatgagtattttgacccgttttccaacgcagaggtctattatggaccaataacagatccaagaaaacagtcaaaaattcatagactaaatagaaccagaactatgagtgttttcaataaagtttctgacttcaaaaacggaatgaaggattataccctgaaaaggaggggttctgaagacgacagcttcctcagcagccaaggtaaccgtagattttatattgataatgtggatctcgctttagatgagctgctcgctagtgaggacacagacaagaatcaccaaattaccatagaagacactgggcccaaagttattaaagtcgggacggccaattccaacggtttcaaacatgtaaatgttaggggaacatatatgctttctaacttgttgcaggaactaaccattgcaaaaagtttcggacgacaccaaatatttttggatgaggcgcgtataaatgaaaaccctgttgatagattatcaagattgataacgactcaattttggacgagtttaacgagaagagttgatctttataatattgcagaaattgctagagactcaaaaatagatacgccaggcgctaaaaatccaagaatttatgttccatataactgcccagagcagtacgaattttacattcaggcatctcaaatgaacccgtccttaaaacttgaagtggagtacttaccaaaagatattacagcagagtatgttaaatcattaaatgatacaccgggtttgttagccctggctatggaagaacacgttaatccatctactggtgaaaggtccctagttggttatccttatgcggtacctggcggtagattcaatgaattgtatggctgggattcatatttaatggcactgggactcatagaaagtaataaggttgatgttgcaagaggtatggtggagcattttatattcgaaattgatcactatagtaaaattttgaatgctaataggagttattatctttgcagatctcagccaccattcctaaccgatatggctctgctcgtatttgaaaagataggaggtaagaataatccaaacgctattcagttgttaaaacgcgcgttcagagctgctattaaagaatataaagaggtgtggatgtcgagccctaggttagattctctgacagggctgtcttgttatcattctgatggtattggtatccctccggaaactgaaccagatcattttgatactatattattaccgtatgctgaaaagtacaatgttactctggaaaagcttaggtacctttataacgaaggcatgattaaagaacccaaactggatgcattttttttacatgatcgtgccgtgagagagtcaggacatgacacgacttataggtttgaaggtgtatgtgcatatttagcgacaattgatctaaactccttgctctataaatatgagaaagatattgctttcgtcattaaggagtattttggtaatgaatataaagatgagaatgatggaacggtaaccgattctgaacactgggaggagctagctgaactgaggaaaacaaggattaataagtatatgtgggacgaagattcagggtttttcttctattataacacgaaactgaaatgcagaacgtcttatgagtctgcaacgactttttggagtttgtgggctggtcttgcaactgaagagcaagcaaaaatcacagtagaaaaagctcttcctcagttagaaatgctcggcggactagttgcatgcacagaaaaatcaagaggtcctatttctattgatagaccgatcaggcaatgggattatccttttggttgggcgccgcaccaaatattagcctggaaaggtttatctgcatatggttatcaacaagtagctacaagattggcttataggtggctgtacatgattacaaaatcatttgttgattataacggaatggtggtagaaaaatatgatgtgacaagagggactgatccgcatcgcgttgatgcggaatatggtaatcaaggtgctgattttaagggcgtcgctacagaaggctttggttgggtgaacacaagttatttgctcggattgaaatatatgaataatcatgcaagaagggctctcgctgcttgtagtccaccattgccatttttcaatagtttgaaaccctctgagaaaaaattgtattacctataa

SEQ ID NO: 4824 - DNA, 2346 bp, Saccharomyces cerevisiae
atgaatattgcagaagaaccatcagatgaagtaatatctagtggccccgaggatacagatatctgcagccagcagacatcagcgagcgcagaagctggagaccaatcaataaaaattgaaaggaaaacttccactggtcttcaactggaacaattggccaacacaaatttattaaccataagaataaaatggcagttacaagaagaagaagatgatcactgcaactctagaataaccgatcaaataatggacacaatacagcactacaaaggtatctccgttaacaactctgatacagaaacatatgaatttcttccggatacaaggaggttacaggttctcgaacaaaataaagacatctatctttacgagcatggaagtcaagagtatgagaaatcttacaaagataacgaagaggaagatgattggagatacgataccgttttgcaagcacaattcaagtaccccaagtcattagaaaatgcatgtacagatatctcggaattactcaagagcgaacctattggtcagcatattgataaatggtctatcggtgtgaacaagcatgcactaacctatcctggaaatatttttgtcgggggaatagcaaagagcctttctattggtgaactaagtttcttattttcaaaatatggaccaattttatcaatgaaattgatatatgataaaacgaaaggcgaacctaacggatacgggttcatctcctaccccttgggttctcaagcttcactttgcatcaaggaacttaatggaaggacggtaaatggctccacactatttatcaactatcacgttgagcgaaaggagagagaaagaatccattgggaccatgtcaaagaaaacaacaatgatgataatttcaggtgtctctttataggcaacttgccttatcacaatcctgaaaaagtagagactttgattacacctaaagaagtcatagaagtaatcaagaaggagttatcaaaaaagtttccggactttgatatcatttcatattactttccgaagagaagtaatacaagaagcagtagttcagtaagtttcaatgaggaggggtcagtagaatcaaacaaatcttccaataatactaatggaaatgcccaagatgaagatatgttgaagggttatggtttcatcaagcttatcaaccatgaacaagcactagcagccatcgagaccttcaatgggttcatgtggcatggaaacaggctcgttgttaataaggcggttcaacataaagtttacaacaaccacaatagccatgacaggcacccttccatcagtaaccacaatgatatggaggttttggaatttgcaaataacccaatgtatgattacaataattatacatatgatagatattacttcaacaataataaaaacgggaacagcaacgatacctccaatgtacggtattttgattctgtaagatcaacccctgtggcagagaaaatggatctgttctatcctcaaagggaatctttcagtgaaggtcgtggtcaacgtgtgcctagattcatgggcaacaagtttgacatgtaccagtacccatcaacttcttacagcttacctataccaatgagtaatcagcaagaatcaaacctatatgtcaagcacatccctctttcttggacagatgaagatttatatgatttctacaaatctttcggtgaaataatcagcgttaaggtcattactgttgggggtagtaagaacaagtatcgtcaacaatcgaatgatagctcatcagataatgatctgccagtgggatcatcaagaggttatggttttgtttcttttgaaagcccattagatgctgctaaggcaattttgaatacagacgggtatcaagtgagcaaagatcaagtgttatctgtttctttcgctcagaaacgtggtaatttatcttcaagtgatgatgatgatcaatcccaaactgataactcatcaaagttccaaaattttcagccacataatgattatcataaggcttatccaacaaagtataataagaaatttatcaatgccttgatgactcagaaccaatcgcaacagcaagtctcgagggaaaattatttcataccactgcagtaccctaataccaacacaaagcccgtgaacagttacaacttaataagtgcaaaccaaaataacgctaactggatgatgccaatgttcccatcatttgggtttattccacaggtgccgccagtgccctatataatacctccgcagaatcctgcagcaaatcatattcctataatggcaaacggtagtaatgaagaggaagaattttctagtggtgattattctatggactactag

SEQ ID NO: 4825 - DNA, 2346 bp, Saccharomyces cerevisiae
atggcagaagcagtactagaaaacgttaacgttcctgcagtcgtttcaaaagatgagtgtatttattgctttgaatccccttataatgaaccattggccctcaatgcatcacctaaacattcattgaatatatgcttaaactgtttccaagctacgtgcaacagacatgttccactccatatccgagtcacagaatatgcttgcgataccatacattccaattatttaactattgctaaagtggagaaacctaagcaagaaaatgtagaagaaaataataacaacaaaaaaataaagctacaggtaattgagacgtcagaagacgacacccacaacactatttggagtttacaaaggttcaatggtgaaaatgttcccaggaccgtactttcgaagtcgacagactctgacatttcttctacggccttggagaagattgaaaagatattaaaggcgaagtcacaagacttcgaggataagaagaactcctgggtgttagaaatcagcacctgtccacatacagaaaactttcaaattccatctaagcccgaaaatactgtgaatttaaaccaatgctcttcctgtgatttgactcaaaatctctggttatgcctacattgtggtaatatcggatgtggcagggaacaaatcgggattgatggtcactcgcatgctttggatcattatcggagtaataataatcacccattagctatcaaattagggtctttaagctcttcaacctatgatctgtattgttacgcatgtgacgacgaaactagatttccagataatgttaatttaggcagtgcactacaaatatacggaattaacatacaagaaaagattgcggatgaaaagactctagttcaattacaagtggaacagaacgaaaattggcaatttagaatggtcgattctagcggtaaagaatttgaaaaattatccgctagtaagaattatggctgtggtctgatcaatttgggtaattcctgttacttaaattcggttatacaaagcttggtgaatggtggcgtcccgaattggtccttggattttctaggaagtaaatttccactggatgttgtatatccggacaataatttaaagtgccaatggatcaagctactcaatgccatgaaatgtgaacccgaactatatccaaatggtatcaaacctactactttcaagaaatgcattgggcaaaatcatcaggaattcagttccaatagacaacaggatgcgatggaatttctaaccttccttttagacttgttagacaagaaatttttttcaagtagttcttcaggtattccaaatcccaacgatttagttagatttatgatggaggataggctccaatgtaacatttgcgggaaggttaaatattcttatgaacccacagaggctatacagattcccttagaggagaatgatgaacctcaagatatgttagagagaatcaaggcgtattttgaagggcagacgattgaatttaaatgtgctaattgtaaggaaaaggttaccgcaaataaaaaacctggtttcaaatctcttcctcaaacacttattttgaacccaataaggattagattacagaactggattcctgttaagacaagtaatgagctttctttaccaggtttaatagacagggatgatatgctagatgtttcgtcttatttatcacaaggatttgatcctcaaactgaaaacttattgcctgatgaggacgaaaaccgtagctcttttacgccaaaccaatgcagtatttctcaattaattgaaatgggctttactcaaaatgctagcgtgcgcgccctatttaacaccggaaaccaagacgctgagagcgctatgaattggctattccagcatatggatgaccctgatttaaatgatccctttgtcccgcctcctaatgtccccaagaaagataagagagaagtggatgaggtatcattgacttcaatgttatccatgggactaaatcccaacttatgtcgtaaagccttgatactcaacaacggagatgttaatcgtagtgttgaatgggtatttaacaacatggatgatgatggaacatttcccgaacctgaagtgccaaatgaagaacagcaacaaaaaaaggatcttggatattcgaccgctaaaccgtacgctttaactgcagttatttgtcataagggaaattctgtccattctggtcactatgttgtttttattcgtaaactagtggcagacaaatggaagtgggttctttataacgatgagaaactagttgctgccgacagcattgaagatatgaaaaaaaatggttatatttatttctatacaagatgctaa

SEQ ID NO: 4826 - DNA, 2349 bp, Saccharomyces cerevisiae
atgaacattttgaagaagtttatggagtctggtaacaagccagagctcatcacgataccttctgggcagtttaatcttttgaggtctaagaattcccctaaagctgctttagaatgtatttacaacaatgcaactttaagcgtacgtaaaataggcaaatttgattatgagttggcggtttatagggtagaggacgatagtgaaggaggcacgggagatgaggctgagaattttgaagacgacaccatcagtgttttatccacacagtctaaaaagaaagaagaggagtggagcgttgaaatatcggataaaatcatgtttcacaaaacatgggataaacaaggaaacgtggcgcttgtgtgggagaacttaagaggtgatgaacaagatgaaaaggttcaatttgttgttgccgctgatgtgtcgttttctgatgttgaacagtttatccaaactgtttaccgatgccaattcgaagtaaggaataaaaaatcctctctcactgcctcagcagatgacttaaaggaaatagagcatagatcaaccaggctctttgttcaagatgatgatgacgagttagattcaagctcagatgactttcaagatgctaaagacacctcttttgagcacgagaaggaaagtgaaatattggaaagaactccttctccattgaaaaaagttccagaaggggaatattgttgtttagtgatgtctagcctatacatgtatgatccaattcaagaaaaatttattctgcaggagcccgtggtaaaggtagcaattattgatacaggcaagtacgaattttggctagcgatagaaggtaaagataatcgtcttgggactcaggtcgccccaaatatcaatcctacctttgaattagctaccgatgcctttcttttcaactatacgctacaaaacattacattgtcttatatgttaaaatttaaggacttagataagtgtattcaattcaggtttgcttgggttaaatgtttatggatgactttgaacaaagaaacgtggaccgacgttcctgaaaaggagaaagattatattttagattcatcatccgtgccattggaaaagcaatttgatgacattttacacatagatgacagatcaaatgaggaaagagataaagaatcaagcgaaagtgaaaatgatagcgaagatgaggatgacgaaaacgatcactccaaaagaatcatttcatctgaagcctttgaagaacctaggcgtgcgacttccaaaggtaatagttcattgactgtcgcctttaggaacaacaggtcatatgttacaagagataacagaattggtgtgttcaaaacggatgatgaagacgattctctagaatttgtagctgccataaagaatatttctaatttaggtggtaaaagcattgatcctcataagccaatgttgtatatggaagatcgtaatttaattttgactgatggcgaaaatgagaacaaactttataagatggatatagaaagaggaaaggtgattgaagaatggtctactggtgacaagaatgttgttcaatatggtccaaccaaaaaattcgatcaaatgacgcctgaacaaacaattgttggcgtttcacagaaaggtgtctttaaaattgatcctagaattaacggaaaaaataaaatagccgtcgatgaatcaaaagattacgtgggtaaatataactttagctctattggaacaacagagagtggttatattgctattgggtcagaaaaaggtgacataaaactatatgataggctcggtattagggcaaaaactgctataccttcactaggccaagcaatcaagtttattactacctctgctgacggtaaatggttattggcgacttgcgagagtactctgcttcttatggatttgaaaattaaggatggaaaaaatgctggcaacattggatttctgaagtcgttcccagccagtgaaaatgttaaaacatatgtattaaaaatacgaccagaacattcggcatcaatcttaacgtacacaaaaaaaccaatccgatttacgaaggcttattttaataccggtataggccagcaagaacaaactattgttacatcgacgggtccttatgcgatttcttggtcattaaagggcattttaaatcaagatggtagtaataattatccttacagaatccgtaggtacaatgctgatgttgttgctgataattttgaatttggttcagacaaaaaggttatcgttgccttgaaagacgatgtctctctatcgaaagtgaaatcctttaaacagccaagcaaaggagtcttgatgccaagtgcttccctccaagatttttatggctaa

SEQ ID NO: 4827 - DNA, 2349 bp, Saccharomyces cerevisiae
atgacatcatatatcgaaaggctcaagtcggcagcatcgtatcttgatacagttccagatgagcatcatgatttcagaaaacccaccgccaaggttgtaacgacgcaactgactattgctacttcactaggtatttttgctttgctttcgttctcaattctactaaaaaagtggcctagattatacgcaagcagacgatataaagatgacgggaaccttcgcttaccgtcctggaatcagtcaagtttattcggctggttaacagtgttgtataagatacgggacgaacagattctggaatatgcaggtttagatgcgtatgtgtttttgagttttttcaaaatgtgcatcaaattactttctattttttgtttcttctctgtgtgcgttatatctccagtaagatatcattttactggaaaaattgatgacggcaacgatgatgatgacagtgaaagttctttaatacatctggtaaaaagaattgtggagggaagtggcgatggtgacaatcattcagctcccgaacgtacaaatgtgtacctctggatgtatgttctcttcacatatttcttcaccttcatagcaattaaaatggcagttgcggaaacaaagcacgtcgtaagtactaggcaagcttatcttgggaagcaaaatacgattactgatagaacgataaggctctcaggcatcccgatagagcttcgtgattcggaagccttaaagaccagaattgaacaattaaaaatcggcaccgtttcatcaatcactatttgtcgagagtggggtcctttgaacaagctatttcattgtcggaagaaaatactcaaaaacctggaattaaaatattcagaatgtccaagggagctccgtactcgacaaccatattcggagaactatcatttattgggaaacgagcaatcaggcgcagttacacatggagaaaatgttccatcaagcaataataatgacgaggatactatactatattctcaaatttctcttggagagagaccaaaaatgaaaattggatatcgtggtatctttgggaaggaagtagatgccatagagtacctggagcagcaattaaaatttattgatgctgaaattattgaagcgaggaaacaacactactccgcaacacctacggcattcgttacgatggattctgttgctaatgcgcaaatggcagctcaggcggtattagatcctagagtacattacttcataaccagattggctcctgcacctcacgatatcaagtgggatcatgtttgtctttctagaaaggaccggttaacaaaagtttattctactaccgtatttataggcctttcaagtttgtttttagtcattcctgtatcatacttagccacattgctaaatttgaaaacactttcgaaattctggccaagcgtagggcagctactaaaagatcaccagtgggccgctaacattgtaacggggctattaccaacctatctcttcacattgcttaactttggaatcccctatttttacgagtatttgacttcttatcaaggattggtatcatacagcgaagaggaaatctcacttgtttcaaaaaatttcttttatatttttgtcaaccttttcttagttttcacattggcaggtacagcatctaattactgggcgtacctcagcgataccaccaaaattgcttatcaacttgctacatctgtgaaggagttctccttattctatgtcgatttgattatattgcaaggtattggtatgttcccgtttaagttgttattagttggtagtttgatcggctttcctctagtgaaaatcaaggctaagacacctaggcaacggaatgaactttacaatccaccgatatttaactttggactacaattaccacagccaattctgattttgattataacgttgatctacagtgtaatgagcacgaaaattttgacttcagggctggcgtactttattattgggttttacgtctataaatatcaattgatttttgccacagatcatttgccccattctacaggaaaagtatggccattaatttttagaagaatcatcgttggattgctattgtttcaattaacaatgacaggaacactggcaggattcgaaggaggatgggttttgtcatcttgccttttcccgcttccagtagtgacattatgtttcctatatgatttcgagaagaactatttgccgttgtcaaaatatatcgcattgagttcaattcgcgagtacgaaagagacaattctacggtgaattctgccaatgaggaagagtcgtatgcatacccttacgctgtgagtgaattagagggtccgatgttggattga

SEQ ID NO: 4828 - DNA, 2349 bp, Saccharomyces cerevisiae
atgcagttgtctatgcggatgatgttcacaccaaaacatcagaaactggtcaatcaatgttatcctacgggaaggaccacagataagaagcctaaatcttcggaaacttcatatttgctatattacgttaactcgaggcgtagtaaattggagaaagttagcacttacctgattaagcgttccacttccgacttgaaccatcggcgcatagggaacatagccgttacattggatttaatgaacaaaattgtgttgcattgtaaggagaatttgaatgtatttgttaaagattttttgtacattatgaacaaagttctttccaacaacaattttaacaatgatgtatctgttgttgaattaatagaactggcatttagtagtatatgccagaacttggacgacgtcttgtgtaacggtgacatggaattcgtccagttataccagaactttgttgatcttttttttaaaatagttactgaaagaattcataatgatgacatgcttctgaaatgctgtattgatatatcaaacacaaatagtgtttcaagcaacccacaactaaaccactttgtttccaagtctgttgcctatactatttcaaagttccaagagagaaatccgaaatttaaaactttgtcgctggaagcagctctggagagcaatttaggaaaaaggctaagtcgaacacaaactcgtacaattgggttagataaggccgccgaagataatcatgacctttcagtaaaagcattgcaatcctattttaacacaactgagacagacaaattgaatttgtctattcgtactctgttgcgctgtctgcaaagtacacctaataaggaactgctagagtttgtatgcaatggtatacctgttcagttacgatatattgttatacttcttttggtcagacaactaagcgacaaggataaaaatgtaaatccaattgtttccttgaaattgatgtcgtcattacttgtttcagatgtcagtatagtggggttgagtgttcttgatataatgagaaagcttttaaatttccagttgaaaaatgcaactaataaagaagttgtggcacagtcttgtatcaccatgacagaccttaaccataaaacttattacgctgaacagacctcagatatgttatatgaactactattgaaattgaaaagtgacaccgtcaaggatgttgaaaagaatgcagttgtggaagatattgatttcctcgttgaacatattacgcagccaagtatcagtttggaattattcatcgacttggcgcattacatgaaaaaccacattatatgtttatttaacattgttgaaactgaggttccaagcagcattctcttttcaaaactgtactcattattacgtgaactggattcacatggtgtgcaaaaagaaatgatggaagagatctttgacaagtatggaaaaatggcactattatccggtttgaattattttctagagaacgtttctgagcctgagtatacctattattcgtaccatttacaagcagctaactttttaaaactcaatgactacaagtcacaaactgagtacaaaatgcaaactagaactttgtttaccaaggaagatttattgtcatactattctgatactggatcaaataaatacagcaagaagggggcgcagattttattgtctcgtgataatcaaatttctacttctgatttactgtcggactctcaagttcgtactacacctctggagtacaagaatgtccctaatgctattttttcaaatgggaaagcagtgtatgataacaacgattttgcggccaagcaaaataaattcgacaacagcatagatgacaatatagaagaagctaacgatactgtaatttctgatgctaatgcaaaaggtagtatctataggtttgttgctgaggacgcaagatcatggaaaacaatgagagccaccgcaccaaaagttagcgatttgaaaaaaactatgaatgaaaagaatattccaaataatatgaaaagagatggctcttttcggggttctcaatcagtgaaatctcgtgtcactaatatcacatttttattaaatgaattgaaaactttttcagatgacgcgaataaaatcaaagatcctgatgaggagaatattgttggcttggataaaatcgacgttgctagatcaaattctctgcgacttgcaccaatatctagtctttctgatcgcagtagcattggaaatagaaaatcctttttgcaaaaaacagcaactggtgaaaatcaaaacgatgactttaaagacgcaaatgaagatttacattctttaagttcaagaggtaaaattttctcctccacttga

SEQ ID NO: 4829 - DNA, 2352 bp, Saccharomyces cerevisiae
atgatcttcctaaacaccttcgcaaggtgccttttaacgtgtttcgtactgtgcagcggtacagcacgttcctctgacacaaacgacactactccggcgtctgcaaagcatttgcagaccacttctttattgacgtgtatggacaattcgcaattaacggcatcattctttgatgtgaaattttaccccgataataatactgttatctttgatattgacgctacgacgacgcttaatgggaacgtcactgtgaaggctgagctgcttacttacggactgaaagtcctggataagacttttgatttatgttccttgggccaagtatcgctttgccccctaagtgctgggcgtattgatgtcatgtccacacaggtgatcgaatcatccattaccaagcaatttcccggcattgcttacaccattccagatttggacgcacaagtacgtgtggtggcatacgctcagaatgacacggaattcgaaactccgctggcttgtgtccaggctatcttgagtaacgggaagacagtgcaaacaaagtatgcggcctggcccattgccgctatctcaggtgtcggtgtacttacctcagggtttgtgtctgtgatcggttactcagccactgctgctcacattgcgtccaactccatctcattgttcatatacttccaaaatctagctatcactgcaatgatgggtgtctcaagggttccacccattgctgccgcgtggacgcagaatttccaatggtccatgggtatcatcaatacaaacttcatgcaaaagatttttgattggtacgtacaggccactaatggtgtctcaaatgttgtggtagctaacaaggacgtcttgtccattagtgtgcaaaaacgtgctatctctatggcatcgtctagtgattacaattttgacaccattttagacgattcgaatctgtacaccacttctgagaaggatccaagcaattactcagccaagattctcgtgttaagaggtatagaaagagttgcttatttggctaatattgagctatctaatttctttttgaccggtattgtgttttttctattcttcctatttgtagttgtcgtctctttgattttctttaaggcgctattggaagttcttacaagagcaagaatattgaaagagacttccaatttcttccaatataggaagaactgggggagtattatcaaaggcacccttttcagattatctatcatcgccttccctcaagtttctcttctggcgatttgggaatttactcaggtcaactctccagcgattgttgttgatgcggtagtaatattactgatcatcacgggacttctggtttatggaactataagggttttcatcaagggaagagagtctctcagattatacaagaatcctgcgtacctactttacagtgatacctacttcttgaacaagtttgggttcttatacgttcaattcaaagcagataagttttggtggcttttacccttattaagttatgcgttcttaagatccctgtttgttgccgttttacaaaaccaaggtaaggctcaagcaatgatcatctttgtcattgaactagcttacttcgtttgtctctgttggataagaccatatttggacaagagaactaatgttttcaatattgctattcatttggtgaatttgatcaatgcatttttctttttgtttttcagtaatttgttcaagcaaccagcagtggtttcgtcagtgatggcggttattctgttcgttttgaacgcggtgtttgctctattcctattattgttcactattgtcacctgtacactggcattactacacagaaacccagatgtccgttaccaaccaatgaaagatgaccgtgtgtcattcattcctaagattcaaaatgatttcgatggcaaaaacaaaaatgattctgaactgtttgaattgagaaaagctgttatggacaccaatgaaaatgaggaagaaaaaatgttccgtgacgacactttcggcaagaacctgaatgcaaacacaaatacagcaagactctttgatgatgagactagttcatcctcttttaagcaaaattcctctcccttcgatgcctcggaagtaacggagcaacctgtgcaaccaacctccgctgtcatgggtacgggtggcagcttcttgtctccacagtaccaacgtgcgtcatctgcttctcgtactaatctagcgccgaataatacaagcacctccagtttaatgaagcctgaatcaagtctctacctggggaattccaataaatcatattcgcattttaacaacaacggcagcaacgaaaacgcccgcaacaacaacccatatttgtaa

SEQ ID NO: 4830 - DNA, 2352 bp, Saccharomyces cerevisiae
atggtgaatactaggggctacactactcttccgaatgttgaagaaccagcaaataactcacaagatgagctaaactcgcaggactttgagcaagctataggaatgccatcagaacccccggtatatgtggaagagatggggatggaagaaccgcaggctccggaagcctttagtgagaaagtccagcgatttcgtatgtgttttgaaaataacgtggtgattccagtaaagaaaaatgtagtggatccgctagcacaaatgatttccctggcctctgagaaattcgatttgttcttaagtaaaataggtaatgttatggtaatgaggagaatattttacatcatgatgatgtctatcattgcagcgttgattattgcgagtgataggttaccgaatggaaaagctcgaggttcaaatggatcattctcggaccatgatctccttttacagtatgctcggaaatcgatagacctttcaaagatagaaagagatttagagtatattagtagtatgccccacatgtcaggaacaagtggtgatgccgctattagacattatattaaagagtcgttcgacaaaaatggtataaggctagctggggaagaggagttcatggcgtattcgaattacccaggaaatgtctcacttcgtgtatattcaaaggatgatacagaagggtttgatattcccttaaatgaggagaactttaacccaatgagccataatggtcaattgaacaacataccggtgatttatgctaataaagcatcgttggacgatatggcttctatgcaagatcaagggcttttaaacggtgactttattttactagtgcattacggagattatgttttccaacaaatgttgactgctcaagaatatggtgcgaaagcaattatctttatttctgagccttatcaagacaacaaagacgtgatacaaatgaagtcagttgcgttgccgcagtatggtactggtgatgcacttacgcctgaatgggaaggatcaataagagatcctatcgatgctacggaagccaagtgcctacccaaaattccatccataccgatatctgccaatcaaggagataaaatactagctatattatcagacactggcgtaaagttttctaataatttattcagtgggtcgcttaacgattgtcgacttgacctactagtgcaaacagcaattagggaacgccacccggttcacgatatagttggtaaaattgaaggatcggaacaagcgggcagggcaattgttattgctgcaccgaggaactctgctagttatggcactatgtatccttcttttggaaccgtcgttttgctgtctctgatccaattatatcaagaaatggtttacaaatttgactggaagcctctaagaaatatatatttcatttcctttgggggctctgaatttaatgaagcgggagccacggagctgatggaaaagagaacagaggcattgaagagtgaaatatacaccattatcgacgtcggccaaatcggtatatgggatgatagtaacaatttagagatacaatgtcatccgctactagtagatctttttcaaaaaaacatgacaagccgtaaatttaacgttaaagtggataatgttcaccagttcggcgactggacgccgtatctagcgcaagggattccagttgcgatcatttcatctccaggagtcatgaatagagaacatccgatctacacagtagaagacaaattcgatttcatcaaagataaactaagagacaaaaagaagggagaggtactttctgagataatgctatatcttgtcgaaaaatcactcgagctcattgacgatccattcatcccattcagcatatcgaactacgtagatttcctttcaactacgttaaaagacctccaaaaagaatgtcctgatacggtaaactttgacgaagtctttttgggcacaacattgtgggaaaacactaaactgcagttcgaaaaatggaaaagcgaatggacagagcttatgtatggagccggtacatatatagaacccactatcattgccattaatcgttggtcatggaactacctactttccctaataggcgttacccaatgtttggaggaagggttaatggatagaaccttttacaagaacgttatcttcgggccaaaactctgggtcgacaaaggtgacccacttcgttcatggacgttccctgaaatcagggacactattgcaatcaaggactggagctctgtgcaggttcaagctaacacactcggcacaattttacaaaatacagcacgctattttcttgagaataaaaaccttcatggaataaacacgaacgaattttag

SEQ ID NO: 4831 - DNA, 2358 bp, Saccharomyces cerevisiae
atgcccatcggtaacccaatcaatacgaatgatatcaagtccaaccgcatgcgccaggaatcaaatatgagtgccgtgagcaatagcgaaagtactattggccagtccacccaacagcagcagcaacaacaacaatatctcggccagagcgttcaacctctgatgcccgtatcctaccaatacgtagttcctgaacagtggccgtacccgcaatattatcagcagccgcaatcccagtctcaacagcaactgcaatcccagcctcagatgtatcaagttcaagaatcctttcagagtagcggttctgactcaaatgcttccaatccaccttccacgtctgtaggtgttccttccaacgctactgcaactgcgttaccgaatggttctgcaatcaccaccaaaaaaagcaataacagtactaatatcagtaacaatgtaccatactactattattttccccaaatgcaagcccaacaatcaatggcatattcgtatccacaagcgtattattattatcctgcaaacggcgatggaaccactaacggtgcaacaccatctgtaaccagtaatcaagtccaaaaccccaatttggaaaaaacctactcaacctttgaacaacagcaacaacaccagcagcaacaacaattacaagctcaaacgtatccggcccaaccaccaaagataggtaatgcattttcaaagttcagtaaatctggaccaccttctgattcgtccagtggctctatgtctcccaattctaatcgcactagtcgcaatagtaatagtatctcgtccttagctcagcagcctccaatgtcaaactatccacaaccttccacctaccaataccccggttttcacaagacttcgtcaattccaaactcgcattctccaattcctccaagatcattaacaacgccaactcaaggtccaaccagccaaaatggacctttaagctacaatcttccgcaagtgggtttgctaccgcctcagcaacaacaacaggtgagcccgttgtatgatggaaattctataactccaccagttaaaccctctactgatcaagaaacttatttaactgcaaataggcacggagtgtcagatcaacagtatgactcaatggctaaaaccatgaattctttccaaacaactaccataaggcacccgatgcccttaatcgccactaccaatgccacaggcagtaacaccagcggcacttcggcaagtataataaggccaagagtaacaacaacaatgtgggaggatgaaaaaacgctatgttatcaggtagaagctaacggtatttcagtggtaagaagagcagataatgatatggttaatggtaccaaacttctgaatgtaactaagatgacaagaggtagaagagatggtattctaaaagcggaaaaaatcaggcatgtggtgaagattggttccatgcatttgaagggtgtctggataccgtttgagcgtgccctagcaatagcacaaagagaaaaaattgctgactatctttatcccttgttcatcagggatattcagagcgtattgaaacaaaataatccaagcaatgatagcagtagtagtagcagtagcactggtattaaatccatcagtccgcgtacctattatcaacctattaacaactatcaaaatcctaatggtccttcaaatatatctgctgctcagctgacatactcctcaatgaatttgaacaacaaaattatacccaataattctataccagctgtaagtacaatcgctgcgggtgaaaagcccttgaaaaaatgcacaatgcctaactctaaccaactagaaggacatactataactaacctacagaccctttcggcaacaatgccgatgaaacaacaactgatgggcaacatagcttcacccttatcgtatccacgcaacgccacaatgaattcggcaagtacattaggcattacacctgcagattcaaagcctttgacaccttctccaactacaacaaacacaaatcaatcatctgaatcaaatgtgggaagtatccatacaggaatcacccttccaagagtggaatctgaatcggcatcacattccaaatggtctaaggaagcagacagtgggaatactgtaccagataatcaaacattaaaggagccacgatctagtcaattaccaatctccgcattgacttcgacggatactgacaaaataaaaacaagtacaagcgatgaagcaacacaaccgaacgaacctagtgaagcagaacctgtcaaggagtcagagtcatccaaatcacaagttgatggagctggcgatgtctccaacgaagaaattgctgctgatgatacaaaaaaacaagaaaaatag

SEQ ID NO: 4832 - DNA, 2358 bp, Saccharomyces cerevisiae
atgtcatctgcaaagacatttactaagcatatctcgtttgatgatctggcaccttccttaattgatgaccaagctaccattattaaaaatgacagtcaccatgttggcttgaataatcattttttacatatacctccacaatttaatcctgtttacaaaaatactttgaccggtagccatggctctaatgaccttgccactgacgaaagcttggactcacccgaagacgaagaagcttcttcgccactacaactaggaactccaacgtctacaacatctggagttcctcacttctatactcaggtattttctcctgcagcacatgatccctccaaaagctatttgagatcgcccagcgttgaaagaagtagaagtgagtctccaatgttcaggtcaagaagaaggacttcagtgaggttgcctccccctccaaaagtatccgtgctaaaaaaatctcgaaaagctgctgatgaacagggccctattgatgatattgatattggtgatttggattttgagctggaaagaaaaatgaccaaaatgaccgaaagaaacactcaaaaaaattctggatcaaggaaaggctatacgcaagctgcatttgccaatcttaatgaagttgaagatagaattgagaccaagtcaatggtagatttatccgaaagcgaaaatatggagagctcaaagaaaaggtccaagtcgtttgccgggatgacagacgaagaattagccaaattagaggaattttatataagtaaaggaagatcgaacaagactaaaatagatcaatttgattttggtgagcaagttccagtctatttgaacacaacagagtcaaaaacggattcaagcaacgtgacggaccctttagcagcaatttatccatcaaggcctacaattgttcacaatgcaatttcaatgacaattgatcatccagactatgaaaattatatttccaatacaaaagaaaagctcaattgcaaagacaaagatgacgatgtagatttaagagttgtttcgtgttatatatcaggtaggagatatacttggtcatctgtggactggtatgttgaaaatttgacaagaaatggtgatcatttagtcataattactacaattcctgagtttgaagcaaagattgatactctagcatataaggagaaaagaaggcaccgcttagaaaggatgactagcaatactagtgaaagcatgactaccgcgtcacatagccttataggcccggatctctctagtcctttatcaacgggaataagaatagaagctattcataatgaggctaagcaaacttgtagcgatattttaaattactacgcgagaagattggcaactaaaatagttaggattagtattgagatggtaaaagaaaattcaacaagatcagccataatatctgcgacctctctgtataggccaagtttgcaagtaatcagcaccgttagtgccaacattcaaatcaagtttagaaatggaaaagtgaaactaccattttttttaatgaaacactttgcaatgccagcatttgttgtcccattcgaattcatcaagcctgagcttttaataaaacctagagtggataaagatgaacaggacaacagcgatgatttgaaaacggaagtgagaaaaaaggaacgattgcaatggctaagtgcattaatcaggagaactttggaaaaccctttcacaaaacataaagtggttgattcggatgatgaagaaagcgatagtgatgagtcagtaacctctgtaaatgagtacttcccaatctcacctgaaaaaaaggaagaaatggaattcttcgataagatgggatatgttagaccaaaaccgtcgagacaagtactattggatgataacactcttatgaagtacgacagttctggccgaaagctaactcctatagaatcgagaaattcgaggcgcagctcaaagcggagttcaagaatacaattcaacaataacggcatttataaagtaaagtccatggttgatgacatttacaaccacgaaactgcctctacgcctcatatcaagacagcactaaaatgggacaatgaggatccgaaaatgaagttcacttcacatccaatgagaaaaacaaaatccgcagggctatcacccagaacatcctccacttcatcttcttcaggacagagaaaagcgcatcaccaccaccatcaccacaaccacgtttcaaggacgaaaactaccgaaagcaccaaatcaggcaacagcaaaaaggacagttcctcatcctcaacaaacgaccatcaatttaaaaggtctgaaaagaagaaaaaaagtaaatttggctcgatcttcaaaaaagttttcggatga

SEQ ID NO: 4833 - DNA, 2358 bp, Saccharomyces cerevisiae
atgtcatctgcagagatggaacaattgttacaggccaagacactggccatgcacaacaatccaacggagatgctgcccaaggtgctcgaaactacggcatccatgtaccacaacggtaatctcagcaagctgaagttgcctttggccaagttttttacacagttagttctagacgtggtgtcgatggactctccaattgcgaatactgagagaccgtttattgctgctcaatatctgccactacttcttgctatggcgcaatccaccgcggacgtactagtgtacaagaatatcgtgcttattatgtgcgcttcatacccgctggtgttggatctggttgctaagacatcaaaccaggaaatgtttgatcagttgtgtatgctgaagaagttcgtgctctcgcactggagaactgcatatcctttgcgtgccaccgttgacgatgaaacggatgtcgaacaatggctggcgcagattgaccaaaatatcggcgtgaaattagcgaccatcaagttcatatctgaggtcgtgctgtcgcaaactaaatcacccagcggcaacgagattaattcatctaccatcccggataaccaccctgtgttgaacaaaccggctttggagagcgaggctaagaggcttcttgatatgttgctaaactacctaattgaggaacagtacatggtctcgtccgttttcattggtatcatcaattctttatccttcgtcatcaaaagaaggccgcagacaacaataagaattctttccgggctgttgcgtttcaacgtcgacgccaagtttcccctagagggcaagtctgacttgaactacaaactatccaagagatttgttgaaagggcgtacaagaactttgtgcaatttgggctaaaaaatcaaatcattacaaaatccctctcatccggatcagggtcatcgatctactccaagctgaccaagatttctcaaactttacacgttattggcgaagagaccaagagcaagggaattttgaacttcgacccttccaagggcaatagcaagaaaacgttgtccaggcaggacaaactaaaatacatctcactatggaaaaggcaattatccgcgttattgtctactctaggggtgtccacaaagacccccacgcctgtgtccgcacctgcaacgggctcttcaaccgaaaacatgcttgatcaactgaagatattgcaaaaatacaccctcaacaaggcttcacaccagggcaatacttttttcaacaactcacccaaaccaatcagcaacacctactcatctgtgtactcattgatgaacagttcgaactccaaccaggatgtgacccagctacccaatgacatacttatcaagctgtccacagaggccatcttgcaaatggacagcacgaaactgatcaccggattgtctatcgttgcttcgaggtacacggatttaatgaatacgtacatcaattctgtaccgtcctcgtcatcatcaaagaggaaatccgacgatgatgacgacggcaacgacaatgaagaagttggaaacgatggcccaacggctaatagcaagaaaatcaaaatggaaacagaaccactagcggaggaaccagaggagcccgaagacgatgaccgaatgcagaagatgcttcaagaagaggaaagcgcccaagaaatctcaggagatgccaacaaatcaacttctgccattaaggagatcgcacccccctttgaacctgactcattgacgcaggatgaaaaactaaagtacctctcaaagctgaccaagaaactgtttgaattatccggtcgccaggatactacccgggccaaatcttcgtcttcctcctccatattactggacgatgacgactcctcgtcatggttacacgtcttaatcagattggttacgagaggaatcgaagcacaagaggccagtgacctgattcgtgaagaactgcttggcttcttcatccaggatttcgagcaacgtgtcagtctgatcattgaatggctcaatgaagaatggttcttccaaacctcgctgcatcaagatccctctaactacaaaaaatggtccttaagagttctcgagtctctgggtccattccttgaaaacaaacacagacgattcttcatcagacttatgagcgaactgcccagtcttcaaagcgatcatcttgaggcactgaagcctatctgcctggatccggcaagaagttcccttggtttccaaacgctaaagtttctcattatgtttagacccccagtgcaggacactgttcgcgacctgctgcatcagctaaagcaagaagatgaaggcttacacaagcagtgcgattcactgcttgacaggctaaaatga

SEQ ID NO: 4834 - DNA, 2358 bp, Saccharomyces cerevisiae
atgtctgttaaagagcataacgaagaagatattattggtgatgaattacagaattcgaggcaactctccattgattgcgactcagttaaaatttcactaaggaacacatattggaccaaagactatacaacaggtatcaaattattcataaaacatatgaagagagaaaatgatttgctgattaaagacatcaaattttacaatgattttgtcaacaaattttggaaaccaacattgaacaatttacaaaaaatggaagcaaccaattcaatgaatagcaggctgctggaagtgatgagcaaacagtttaatataatatcaacagagcaagttgaaagagattgtaaaattccattgcaagaactaagagatcttaatgagagcttccttcgtgaggcagaaaacgatttgtcatctcgttattcagcttacattaaggatttagtcgcagctaaagaggcactaattggatgtgagaaaagagttcagtctatatataaattgaaaaaagccaatacgccagtggaaaattcttcctctgtttttgataatggaaaggatagtgcaccgttaaccaggttgaacttcgtatgcgagtttccttacactttagacgagaggttaaaatttgaggattgcgaccaatttatgtcatttttgcaaaccttgaagggaaaagtcatcctggagaaaagtgtcttttccgttccaggattgtcaaatcaaagtttccaaggcaggtcattgatcaaagaattgaaaaaacttgaacccagactaaacctgtccttatttaatatcgataggataggtaacgaattcatccaactgggtataatacaagaatattccctgagtttttactctagcaaagtttctcagtttgaccaggaaaaatactattactggaacagtgaagtccttgctacgcaagagagtaatggtaatgctggaaacagaaaaaaaaaatcgtatggtgagttaacacactccgacaatgaacacgaagaaaagtccaacgtttcatctatcaaaacatctatatccgattggatccgcaaagttagtcaacatgataatgatgattgcgatgcagcgggaagtacagatatgaataaaaatgagtggaagagtttaaaacagcaacttgaatcatcacaagatatttttttctccaagtgttgccagttggaatattctaaagtgcagttggaaaaaaccatttatgattattgtaaaaattactctaaaatggaggacggaatcaaacgagctctagaatcatcaaacatgatgtttcaacaaaaatgtgaaaaatttactgactcacctgtgtgttctctacaagaagcacaactgccacaggaaactgccaatgcggatgtaagagggtttttcctcagggataatggcataccctttcgcaggtggaatatcctagaagcgagtgatccagtcgacgcttgcaaagaaatctccataaaaagcgaaaagtttttctgtggtagtgaaataaataatgaactggctgctcttgatacgttaggggcaataaagattatactgcggcagattgaaaaggaaccaaatgctaataaagtcatacaaagttggcacagggatattgattttgtaagggtttctaatttgaaaagagacttattgggggaattcaaaggatcgaaaactaccgaaaatacaaactctataatcactgctcatttttttgaaaactcgcacagctatgtcactaatgatctcgtcggactgataaaattatggctgttagagctacccgacagcctaataccttcaaaccactacgatgacttaattaaggccgaaaaatcgctaacatccctatgtgaacagtttccgacgagctccttaaggtttctacaagaactagcaaaccattttcaattgatcaatagcaaatactcacttccgccgcaaacaatacaagatttgtttagagacaacagtgacatagacataccattggcccatcacttcgtaagaagaacaggcttacagaaccctatcgacatcaaaatcttgtcaccaacattatctacatttttcatcaacgaaagaactgtagaaactttgcaaacgttgatcgcaaacaggatcacgacggcaactactgcgacactcactgaaccgccgacgataattataaaggatacaacggcacctatacactctacccctaagccaccgccaaacgacaaggatggccatttcatacctcggccattcaagactagttctactccgacaaccccagagagacctaaacgtaagagtggtttattccttcccatcaacgtcaacgatgtcccttctacataa

SEQ ID NO: 4835 - DNA, 2361 bp, Saccharomyces cerevisiae
atgagtaagcggggtagtttacaggatagagcttccccatcggaggaaactgtaaagaaggcgcagaagagacggaaaccaataaagtcatgcgctttttgtaggaaaaggaaattacgttgcgaccagcagaagccaatgtgctcaacttgtaagacgaggggtcgttctggttgcctgtatacagagaaattcacccacaaaatagaaacaaaagagttatttggcagtactccgaacattgaactgttgaaaaggattgaggatttagagaaaagactagatgacaaagagttgacggagaaggatgtagcgcttagtacgagcccatttaggaacccttacgctaatttttactatttacaatgtaaaggctcgggaagaagaatagtatatggtcctacatctttgagaacgcatctctcaaacgatgataatcggtttgtaaacacgtataatcagctctggtccaaagtgaaaatcgagagaaacagatggaaggctaggcataaatggacaatgaagccagaaactcaactcctagagggaccgccgttagaaaagacaggctctgacatcttgcaacaggtttgtaacgttttgccatcttttgaacaatcgtcaaagattataacagactttttcaatactgaactggaaactaatgaagttagtgaagtattagataaaaccaaaataataaacgatttcacttcctcgtttcttccaagtgacgaactgttacccaacggtgaaaggcggattgaaaagttattaccatcgacaaagaaaaactattataagattggagttattttgatgatactgtgtattcgccatttctacaaaaatactccggaagagatagagaaatttctcatcatgctgacgggactgtcaacagctaaagtatatttcattgaacgcgctcaatttctcttattgaaatactatcatcgagaactaatttgggcgtgtggagacgattcgcatatgattagtctagttgacttattatgcagcacggcaattatgctgggtttacacttgaatataagagaaatatacaaaaatcaagaaaatattgtggggagtatggaaagtttggaaaatttgtgggtttggattatattatcagatttcaatgtttctttaaatattgggagatgtttggcgattaactcatcctattttcaagtcgatgaatgcgagaatggtgagaggttgcctaaaaatacaaacaattattcatcgacggtttttttcgatcagtcaaattcctgcatgggcaagcttaaaaggtttttaagattagctcgaccaatgctagatcaaatttatgatagaagcgcatttccagacttagccgaaaattgtaaaaaactaagaaactttgtagagactgaattccacccaatatcatattacactgacagtgagttaatatctaaagttcctttgtgcgagattaaagtgcttgcgcaggttttgaatttgttgttgacgttttattccttgaggtatttgatttacaaggaaaaaagcgttgttttagagaacaacatcctgcaaaccattttggtctctttttcccttgtcatcaatacgaccatactgtgttttaacctagatgagaagcattttcctgagttttttgatcataattgcgttcatttaccgccatttatggccttgtctttagtatacacaaatttcctttttcctagggcctctactggcttttgtgcgtttttgtatcataagttaactctttttgagaagggctattatctatcatccaacatcaaagatcaagaagtcacagattgggatttgtcaaccttgaatatcccgttggataaagctatgaacttacttactgctttcaaaatacattcagatatatttgctaaatggtctaatgataacaacaagcagttaagaattattatggctcgctcttatacatttgttatcaacatcgccctggaaagcatatatagagctgttttggaaaaagtaatcaaatatagaaccgaggtcgaaaacacatggttacaacaactccaagacgaattgaatgggtcctattcgctcactgacaatgtaaatactccaatcgatcccagtttaagtgacctgggcgtcacaagcgccagtccattggcgggaaattctccaggattacccccggaggaagtgcgaaataacagcgaaaacgcttcgcataacaatgaaactgggccaattgagactgaactggcacagacaatatccaacgaattttggacggcgtacaaccttggctgggaggaactaatgagtcagccagattataaatatttatttgatacgcagtag

SEQ ID NO: 4836 - DNA, 2364 bp, Saccharomyces cerevisiae
atgctgtccgatacaattgacacaaagcaacaacagcaacagcttcatgtcctgttcatagactcttatgattcattcacctacaatgtagtgagactaattgaacaacaaactgatatctcaccgggagtcaacgccgtgcacgtgacgacggtacatagtgatacgttccaatctatggatcagctattgccacttttgccgctttttgatgctatcgttgttggcccaggacctgggaatcccaacaatggtgcacaagatatgggtataatatctgagcttttcgagaatgccaatggaaagttagatgaagttccaatattgggtatatgtcttgggttccaagcaatgtgcttggctcaaggtgctgatgtcagtgagctaaatactatcaagcatgggcaagtgtatgaaatgcatttaaacgatgcagccagagcttgtggccttttttctggttatcccgatacgttcaaatctacgaggtaccattcattgcatgtcaatgccgaaggcattgacacccttttgcccttatgcacaaccgaagatgagaacggtattcttttgatgagtgctcaaacgaaaaataagccatggtttggcgtacagtaccacccggagtcatgttgttcagaattgggggggctgttagtcagtaactttctcaagttgagtttcataaataacgtgaagacaggaaggtgggaaaagaagaaacttaatggagagttttccgatatcctatctcgattggataggactattgatagagaccccatatacaaggtaaaagagaaatatccgaagggcgaggacacaacttacgttaagcagttcgaggtctctgaagacccgaaattgacatttgaaatttgcaacatcatacgagaagaaaaatttgtcatgtcatcttctgtgattagtgaaaatacgggtgaatggtctatcattgctttaccaaactccgcatcccaggtattcactcattatggagctatgaaaaagactacagttcattattggcaagatagtgaaattagttacaccttgttgaaaaagtgtctagatggtcaagattcggatttgcctggctcccttgaggtaatacatgaagataaatcccaattttggatcactttgggtaaatttatggagaataaaataatcgataaccacagagaaataccttttattggaggtcttgttggcattttaggttatgaaataggtcagtacattgcatgcggccgttgcaatgatgatgagaattcccttgttcccgacgccaaactagtttttatcaacaatagtatagtcattaatcacaagcaagggaagctttattgtatttctctggataatacatttccagtggcattagaacaatcattaagggacagttttgttagaaagaagaatattaagcaatccctgtcctggcccaagtatcttccagaggagatagacttcattataactatgcccgataaacttgactacgctaaggcgtttaagaaatgtcaggattatatgcataagggtgattcttatgaaatgtgtctcacaacgcaaaccaaagttgtaccatctgcggtgatagaaccctggaggattttccagaccttggtacaaagaaacccggctccattttcaagtttttttgagtttaaagacattattccccgccaagatgaaacgcctccagttttgtgcttcttaagtacttctccagaaaggtttttgaagtgggatgcagacacatgcgagctacgtcccatcaagggaactgtgaaaaaaggaccgcaaatgaacttggcaaaagccacacgaatcctgaagacaccaaaagaatttggtgagaacttaatgattttggacttaatcagaaatgacctttacgagttggttcctgacgttcgggtggaggagttcatgtccgtgcaagaatatgccaccgtttaccaactcgttagcgtcgtaaaggcacatggattgacctctgccagtaagaagacgagatattcaggcattgatgtccttaaacactcgcttcctccgggatctatgacgggagcccccaagaagattactgtgcaattattgcaggacaagatagaaagcaagctaaacaaacatgtcaatggtggagcacgtggtgtttacagcggtgtcacgggatattggtctgtgaattccaacggagattggtctgttaacattagatgtatgtattcctacaacggcggaaccagctggcaactcggtgcagggggggccataacagtcttaagcacactagatggcgaactagaggaaatgtacaacaagttggagagcaacttacaaattttcatgtag

SEQ ID NO: 4837 - DNA, 2364 bp, Saccharomyces cerevisiae
atggattctccatccaattctatccagaatttgcagcaagaagcccagggcagctcttccgcacagcttgctgaccatgatcatgatcgcgtatcaatggctatgcccttacaaaccgatcaaagtgttagtgtttcacaatcttctgataatttaaggagatcaagacgtgttcctaagccaagaacgagcatttatgatgaatacgaggaagagttaaaggaaagggcgaataaacccaagaggaagagacctgctcctcctaagaaaaaggcaccttccacacagaactctaaatcaaatgataaagtagagaaaaagaagactacctcaattgctaaggatggcaaacctacactgaagactaatgacaaaaaagtggcgccgaaacctaaaccagcccatgaacaagtagaacccgctttgatccctagcaattggacttctgtaatacccttgcttacttctgatttcaagaaccagtatagtgtcatctctaggttaaaaaatccgaacatgaagcctgtgccatatgctggagatatcattaagctgatggcgttcataaataagtttagttcttttttccattctgacctacaaaatttatcattccaagattttgaggtcggtttagatttgtatcccggcgatcctaatggaagcgcagctggtatagtgaagggtcctgaagacacctccttattgctatatcctgattttatggccatcaaggatatcgtctattgccaagacaaaatgaatttactgttcctatccttgttagatttaacatttactgaaaattttgatggtaaaagtgccaagaagaaaggtccattaacaacctgggagaatctaaaatcgtcctccaagaaagtattttccaatcctctttatcggttaagacttgtagctcgcgaatgggggtatccacgagaatggcgtcaacaactccccagtgaccaagatatctccaaacctaaaactgctctttttgaacaagatgaacaaacaccagtggtggatcccagtcatccagaaattttaacgccaaatatatatacctggaatgctaatgaaccactcccattggaatcaaatcctttgtataatcgagaaatggacaagaatggaattttggcgctcaaaccaatggatcgcgttgttttattgagggcgttaactgactggtgcgcttcccattcatctgctattcatgacgagatatacaaattaactcatggtaaaaaagatcccgtttttggcatccaaacacaacaagtgcctaggtatacaattgaaggggtagataataccataaatcagtttaaaaaactctgctcactaattcaatcaagatatgaaatcagaagtaagaaaaaacattttgttaaacaactaaaagagggtaaaaaaccagatttatcaaggaagctagaaatactgaaggaaattaaagcggaattgaagaacgctgtaaaatccgaaaaggatgaacttttgttctcactgtacgacaagtgggtcccattgtttgaaggcgaattacctgatcaaccattagccaatcctttttcggaaagactttataaattgcgattacaagagttcttccttggtagagttccccatataggtgatttttatatgccaagattacacagttatggggactcactcgaaatgagcaccttcactgatttgagaaatctacaagcattgctatcgaaattcaaaaataatgaatacaacgcttttacactgtttgaaaatgatggacaatcgatgagtgcccaattcaaattgttttaccatgacacaccatcgttggcgcatgatgttgcacgaggcagaaatacatcggggaaggtttattggtatgaattatgccacgattcagcaacactgctggagttcttggagttcttggactataaaattgttaaacctcaagatgagaaaaaggagggaaatgaaaaagaaaaagaagcactgaataatgaagcgcacatattggagcagaaatctaccactgataataatccctccataaatacaaacccgctaccaaaagacgcaaaatataacactgcgagaaagaagttacagatattaaaggaatttttatctgattactatttcattcttcgtcagtttgaacaaatgaaagtgcaatttgcagacatgaagccaggcaagagacagttgagaaggatacagcgacagactgtaaactataatacggaatatgatagcgaggaatatgtcgatgatgaagaagacgacgaagctgatatttatgatgacaacgacaatgattcttcttttgatgatggtagagttaaaaggcagcgcacttag

SEQ ID NO: 4838 - DNA, 2364 bp, Saccharomyces cerevisiae
atgtttgatggctttagcaacaataaaggtaaacgaaggtctttttttcggtttggttctgaaagtaaaaacaatgactctgaaaaatccgttagaaagccatcggtgccctctacaataaagaaatcaacaaatatcgcacgaacttcgacggctgaaacttctgcccctgatataccgccaagaagtccaaataggaatgctcatagcaggagccattctatccaggcaccattacaaaaggaaacattaaagaatactaatccatttttgaatgctgaggataccttaggagattctcttgaattaacacagtccaaggaagcgtcaggaaacgatcacaaaggaattgaatatttacaagaaaacaacatcattgggcagagaaccaaccccttcacaacaagcgcaaattcaaatgcacatttctccaagataaaacgttcgaggcctccaccaccgcctatggacatgaagtcaataacaacgtcaataagcaacaatactactaaggaagaaatagagagtaataatgattctgagcgggatagtattgcaatctcatccacccacaatcaacataggcggcagcgttcagaagcagaaaagttggtagatgatattgaaaattacattaatgaacacaaggtaagttccggtagctcactatccctagacacgtctgaaaactcagatactaaagcatcgcaagataagttgccagtagatgtcatggaagctcccattttgagaaatgtcagcgcggagagttccttaagctacgtaaaaccacttattgtggataatgaagaagtaaataaagcaagtaacggaaatttagtacaatcagatcatctaaaagaattttcttcgaatctggatgatggggatgataaattttcctttagtacatcggctagtggtaaatccaccaaaagccttcagcaagtttctaaagacgaatctagtggttttaaagctgcacattttgattttgcatataaatcaaatgagcaccttgggagtgatggaagtattgcaagcgccagaaagcctctgcggataactaatgagattgatagcggttcttccaacgaggatgatgatgatggtcttcaggaaaaaggttttgtggatagtgaaagtaaagcatttataaattacgcaagtgatcaaggctcatctataaaaaatgacgtctcaacacaagagcctgagttaccaagtcatcgtagaatatttagggtggttaatgaagatcgccctagtttctatttaaatagtgtaaacgatacgggcagtctaaccgacaagcattcttttgacactgcatcatctggtgagtatgatgccaagtcaaacttctctagccagtcaggactttctatatcaaaaggctctaaatcaactgttttggctgctcttgactcaaacggaaacacaaaatcatcaaataaaacatccgagttaaacagtttaaactccatttcagaaagtttagtgccggctgctcactcgttcaatgaacacacagttactatccctgcaacggtggatttaccaaatccggtacatgatgccccaagcgaaagatctgtcaaatgttcaccgttaacatctgtcgtatcgaacaaatcggaaaagtccgtgcctttggtttctagttacgtagaagaactgcgactaaagtattacaagacttctaactttttacaagcgcctcctaacttgccggttgctctaaaacaaaaaaataatttgattcaacccaagaatattaaggtcaagttgaggacaagttctaagcaaattggtatcaagcatggtaaagttaaacagaaattactggcgttggagacaagaaatgaagaatcagatggaaccgctacagggctgaaaaataaaatcaatgttgaccacacaaaggaattccataaattgttagggaaggaaaatgaaactggctctatttcaaaaaaagaaggcactgacgcagaacaagccgaagactacctcaaggacatacccggtgatgaagcatataacagtgatgatataatggcgcctttacgagaaaaaagagggcaaaacggttctgttgattccgtgtcaagatctaacacggtagtcagctactacacaaggtctcagaacagaatgagaagtggaacactggataatgattacgtgaacagacaaaagcttcctacacatatctctcttcaagattatcgtgatgctaatgctagaagtaatatatcgcgtcaggactctgtctccacaacgaactctgatgtggtagacctcagctattctctggggcatggcttgcgtgtggcaaaccctgattcagacccagaatga

SEQ ID NO: 4839 - DNA, 2367 bp, Saccharomyces cerevisiae
atgaagatggccgtggatgaccctacgtatggcaccccaaagattaaaagaactgcttctagcagtagtagtattgaaacgacagtaacaaagttgctgatgtccaccaagcacctcctccaggtcttaacacaatggtctaaggggacaacctctggaagattagtatctgatgcatacgttcagttgggcaatgacttcaaagtcgtatcgaaattcttcatgcatgcgaaagttgacatgtcagatgttggtgatgtgccaatggctttaagacgtgtattggaagtgacattgagggaaccaccatctgatgaaactttaaataaacatctgccaaaaatcagagagattatagtgacacttttagacaaactaaaggttaaacaagcaattttgaagaatatgcagcaagagcatcggataagtgtaaaatcacatcatcaacaaaacccttcctttactagtaacctttcattgggtagtgaagggacccgtgaggggactccattaagtagcagaaaaagcagtattgtacgtgatcagaggcaaagcgattcagtcgaaaacagctatggggaaaaagtgaattctacttctacgggaacaccctctgctcagtcagcagaggcaacattgacaaaaccaagaactaatattaaacaaaaccttaaatctaacaatgctccaaacgcatctgatgatgatgatgcactttcacaattgaagaagggaactaatttacaaaggagagcctcaaagagatactctgcctaccatatggctaaattgacaaatcagtctacaacagaagctgctgcggctgccggcctcatgacaactccttcaccctcgatgttgcatctagaggaaaccgtaagaaagtcaaagttatacggaaataacaacaatgatgatgatagaaacattaattcagctgaaaataagggtaaaagcattgacgatgtatcaaaggcgagtccattggcgaaaacgccattgcctattgagaatgttcgtgcatctccacgaagattatcaagcgttgttacaacttcgccagataaagccatgaatggaacttgtccagtatttttaaggataggagacaaaacaaagaagtgtcatgtgcaactgcctactacaaaaaacgcattaaggctcctatttattgagcgctttgcgtattctcctggagcaaattccttcccagacatatatattatggatcctcaatatggagtattctatgaattagaggaactaaatcttctcgatattaaagaagggtttgttatcgagctaaagctcgaagagaatccaaataatacgatcaaggaattcattgacacagttaagatggagatatcgaatagtcagaatgatataataagacatttaaaagaaatgagttttggttctgcaattagcggcaagcaaacggaagttttaccacaacctggccttgaagctaacaaacacgatcttgtggggcaaaacaaaaaagatgatgataaaacgatcaaagatattcagtacgaattggggaaaataaaacaagtgcataatattaataggtcaaatattaatgagactattttcaacattttacgaaaggtcgataactttaagtctttatcattttctgccaaaaactcttccaacagaatgtacatggaaaaatcacagaccgaactcggtgatttatccgatactctgctaagtaaagtagatgatttgcaagatgtaatcgaaattatgaggaaagacgttgctgagcgtaggtctcagcccgctaaaaagaagctagaaaccgtatccaaggatttagaaaatgcccaagcagatgtacttaaactacaggagtttattgatactgaaaaaccacattggaaaaaaacttgggaagctgagctcgataaggtctgtgaagaacaacagtttctcacgttgcaggaagagttgattttagatttgaaggaagacttgggtaaggcattagaaactttcgatcttattaagttatgttgtgaagaacaagaaaaaaacccttcgagatcaaaaagtaatcctattttgcctattatgagaccgggcacatttaatcaggtaagggagcaagttatggtggccgtccaatctttaaaccctgaccacgatagtagggtcgaagctattgacaaggctgagaagatgtgggagatggaaagaaaacttaaagctagtaatgaatttgatgatgaactggaaaattttgtgggtaattcaaacctgaaaaaatcgggaggctttgaagaagtagaaaggataagaaagcagaaggatgaagcaaatttgagagcatattttgggccggggtttacttaa

SEQ ID NO: 4840 - DNA, 2367 bp, Saccharomyces cerevisiae
atggcaggtcattcacacaggtcatcattaaaaaacggacacaaatcttacaaatccaaacatgcttctaaaggtgctttgaaaagattatacaaggggaaagtggaaaaagaacccgtgggcactggcaaaccagacaaacaagtttcaaaattgcaacgtaaaaacaaggcaaaacaattaagggcccaaaggatcttggattccattgaaaacaggaaattattcgaaggaaaaaatggcgctgccaaaatcattactattgttccgttagtgaatgatttagacccattggacattctttacaagctattaaagtgtgcagatgatgaaggaatcatggtgcaggaagtagactcaaaacgtatatttaatgttcatataaagaagtttaaaagcaatcttaaaatcataattccagacatgaccaattttttgaacattttagattgcgctaaagtagcagactttgttgtgtttgggctcagtggtgtccaagaagtcgatgaagaatttggtgagcagatcatccgtgcgttagaactacaaggtattgcttcatatatcggtgtcataagcaacctctcagcagtccatgaaaaggagaaattccaattggatgtcaagcaatccttagaaagttatttcaagcactttttcccaagtgaagaacgtgtttataatttggaaaaaaactcagacgctttaaacgtcttgagaacattgtgccagaggctaccaagatcaatcaattggagagacaatagaggttacgtagtcgctgactttgttgatttcgttgaaacctctcccgattctggtgacctggtaattgaggggaccgtccgtggtattggcttcaacgccaatagactggtccatattcctgattttggtgacttccaactgaataagatagaaaaaatcagtgaatcttcgcagaaaaggaaaataataaaggaaaaagctacagatagtctgagcttagagctggatttacaaacagttttcgaaagtaatatgaatagagatactttggacgaatatgccccagaaggcacggaagattggtcagattatgacgaggattttgagtacgacggtttgacaaccgcgagatacgacgaccatggcttcttgccagggagggaacaaacatcaaaaaaggcggcagttcctaagggaacttctgactatcaagcgaagtggtacttggatgacgtcattgacgcaaatgaggaagaagaggcagaacagaccaatggaaaggatgagacaatgatggaaattgatgatgaaatgatggtggagcaagacaatgaagaggtagcaggcgacgaagaatatgacatagaggataatgaaggatttgaagagctttcacccgaagaagaagaacgtcaactgagggaatttagagatatggaaaaggaggacagagagttccccgatgagatcgaactagagcccagtgaatctgccatcgaacgtttgaaaaggtatagaggtttgaaaaacttatacaactgtgattggcaagttgatgaaaaggacccatcatcaccagcggaatggaaacgtctattaaggattggcaattacaaaaacactaaaaacagaatcataaaggaaaccaagaatgaagcacaggccattgcaggtgatcgtattaggatgttcatcaggtttcctaagtttctgcttgaaaagattcaagatcctaaacaactattatttgctgtctacggattactacttcatgaacacaaaaatgcggtagtcaacttctctctacaaagatgggaacaatatgacaaacctgtgccttctcaggagcctatcgtagtacaatacggtgttagaagatacactattcaacctctattttctcaaggctctaacagtcctaataatgttcacaagtatgaaaggtttctgcatccagatacagtatcagttgccacatgtattgctcccgtagatttcacccagtcacctgcaatttttttcaagccatcaccaacagatgccaaaaatattgaattgattggtcacggtacattcctgaatgcagaccattcaagaatattagcaaagagagccattttgaccggtcatccattcagattccacaaaactgtggttactgtacgttacatgtttttcagaccagaagatgtggaatggttcaagtctatcccactgttcaccaaatcaggtaggtcaggtttcattaaagaaagtttgggtacgcatggttatttcaaggctacatttgatggtaaattatctgcgcaggatgttgttgctatgtccttgtacaaacgtatgtggcccatgccttcgttaccttggaatggtatgtaa

SEQ ID NO: 4841 - DNA, 2367 bp, Saccharomyces cerevisiae
atggtggaatgtatcactcccgaagccatttttataggtgctaacaagcaaactcaggttagcgatatacacaaagttaaaaaaatcgtcgcatttggcgcaggtaaaactattgcattatgggaccccattgaaccaaataataaaggtgtttatgcaactttgaaaggccacgaagctgaagtgacttgtgtcagatttgtcccagattcagattttatggtatctgcatctgaggatcatcatgttaagatctggaaatttactgattactcacatttacaatgtattcaaaccattcaacattactcgaagacgattgtggcattaagcgctttaccaagtcttatttcagtcggttgtgctgatggtactatcagcatatggagacaaaatattcaaaatgatgagtttggtcttgctcatgaattcaccataaaaaagggattcttctatccactgtgtttatcactgtcaaaagttgaagaaaaaaagtatttacttgccattgggggtactaatgtgaacgtttttatcgcatctttcattttaagtgattctggcattgagaagtgtcgagtggttgcagaattggaaggtcatgaagactgggtcaagtcattggctttccgtcaccaggaaactccgggtgattatttgttatgctctggctctcaggaccgttatattagattgtggagaattaggattaacgatttaatcgatgactctgaagaagattcaaagaaattaacattattgagcaataaacaatataaatttcaaattgatgatgaattgagagtaggcataaattttgaagccttaattatgggccatgatgattggatttcatcccttcagtggcacgaaagtcgcttacaactactagctgctactgctgatacttcattgatggtatgggaacctgatgagacttcaggcatttgggtgtgcagtctacggttaggagaaatgtcctcaaaaggtgcctcaactgcaacgggttcctctggaggtttttggtcctgtctatggtttactcatgagagaatggatttctttttgaccaatggtaagactgggtcctggaggatgtgggctacaaaggataatattatttgcgatcaaaggttgggcatatccggtgccacgaaggatgtgacggacattgcttggtctcctagcggcgagtacctattggctacttctctggatcagaccactagactctttgctccatggatttatgatgccagcgggagaaaaagggaaatagctacctggcatgaattttctaggccacaaatacatggttatgatatgatttgtgttgagacagtgacggataccagatttgtaagtggtggtgatgaaaaaatcttgagatcatttgacctacctaaaggggtggcaggaatgttacaaaagtttgttggtattcaatttgaggaaaaaagtgaaatgccagactctgctaccgttcctgtgttaggtttgtctaataaagctggtgaggatgacgcaaatgaagatgatgaagaggaggaaggtggtaataaagaaacaccagatatcactgatccattgtccttgctagaatgtccacctatggaagaccaattgcaaagacacttgttatggcctgaagtggaaaagctttacggacatggttttgaaataacgtgtcttgatatttctccggatcagaaattaattgcttctgcttgtagatcaaataatgttcagaatgcagttattagaatattcagcacagaaaattggttagaaataaagcctgcattaccgttccacagtctaacgataacaagattaaaattctctaaagatggaaaatttttattgagtgtttgtagagacagaaaatgggcgctttgggaaagaaatatggaagataatacttttgaattgagattcaaaaatgaaaaaccacacacaaggattatatgggatgcagactgggcaccattagagtttggtaatgtttttgtcaccgcgtccagggataaaactgtcaaagtatggaggcaccaaaaggagccagctgatgactacgttctggaagcatcaattaaacacactaaagctgtcactgctatttccatacatgacagcatgataagagagaaaattttgatatcggtgggtcttgaaaacggtgagatttatttatacagttatactttgggaaagtttgagttaataacgcagctaaacgaggatataacaccagcagacaaaattacaagattgaggtggtcacatttaaagagaaacggtaaattatttttaggtgtaggaagtagtgatttgtccacccgtatatactcattagcatatgaatag

SEQ ID NO: 4842 - DNA, 2370 bp, Saccharomyces cerevisiae
atgccactgtgtgagaaagggaatgatccaatcgatagctctactattgatagcctctgcgctgcatttgacaagactttgaaatccacccctgatgtccaaaaatacaatgatgctataaatacaattttccagctaaggcaaaaatctgaatctgggaaaatgccggctgatttaacgaatagtgaagcccttaaagatcgtcagaaaatcgaagaaatattgaccaggtcttaccaagaccattctgagtcccgcgtacatttatctaaacttatacagaatgatattcccttcgcactcaatttatttgaaatattatcaagatcatccatccacgttttcgttggttgcttttccaataaagacgcaacaattgcattgttaaatgagctgcaaattaggatacactatggcgaggacacccacgtcacgtatttactgagcataattctacaactattgaataagttcaagtacaatttcaaggaggtgcgatttttagtgaaggaacttattttgcgcataagcgaagatgaagtaaaatcgatgatgcttataatttttgctgaattacaatcaagcttccaaaaagactttgataaagcagtggtcgatttcatgagtagcttaattgtggaggcagaaatagacgttggaaatgatccattgtccatcatagtcaaaaccctatcagaattatatccttcattgacaacactttgttctgaaatatttttgaccaaaggactaagtaagctttttaagaagagagtattcgaagagcaggatttacagtttacaaaagaactgctgcggttattatcttccgcgtgtattgatgagaccatgagaacgtatattacagaaaattaccttcaactattggaaagatcactaaacgtggaagatgtacaaatatattctgcattggtgttagttaagacatggtctttcacaaaattaacgtgtataaacttgaagcaactgtccgaaatctttataaacgctatttcaagacgtatcatgccaaaaattgaaaatgtcaatgaaagtgcggttaagctcgaggaggttcctaaagttgaaatgtccgttgaagcgctggcatatttaagtctaaaggcctcggttaagattatgattaggagtaacgagagctttactgaaattctattaactatgattaaaagccagaaaatgacgcactgtttatatggtctcttagttatcatggcaaatttgtccactttaccagaggaatccaatggtagttcacagtctatcaatgacttaaaaaattacgcagatttgaagggcccaggcgcagacaaggtaggcgcagagaaagaatcaaaggaagatattcttttgtttaacgaaaagtacatattaaggaccgagctgatttcctttttgaagagggaaatgcacaatttgagccccaattgtaaacaacaagtggttagggttatatataacataacccgctcgaaaaacttcattcctcaatgcatttcacaaggtggtacaactatcatcttagaatatttggccaataagcaggacataggggagccaatacggattctagggtgtcgggcattaacaagaatgctaatattcactaatccgggtttgatatttaaaaaatactctgcattaaacgctatccccttcttgttcgaattgttgccaaggtctacgccagtggatgacaatccgttacataacgacgaacaaataaagctgacagacaattacgaggcactattagctctgacgaacttggcatcatcggagacctctgatggtgaagaagtttgcaagcatatcgtatctacaaaagtatattggtccacgattgagaatctgatgctagacgaaaacgttcctttgcaaagatcaacattagagctcataagtaatatgatgagtcatccattaacgattgctgctaagttctttaacttggaaaatcctcagagtttgagaaattttaatatattggtgaaacttcttcagttatccgacgttgagtctcaacgagcagtggctgctatctttgctaacattgccaccacgattccattgatagctaaggaactgttaaccaagaaagaactaatcgaaaatgctattcaggtatttgcggatcaaattgatgacattgagttaagacaaaggttacttatgcttttttttggattattcgaagtgataccggataatggcactaacgaggtgtatccgttgctgcaagaaaatcaaaaattaaaggatgctttaaatatgtctttaaagagaggcgattcaggaccagagttttcagcggcaattcccgttatccttgctaaaattaaagtctaa

SEQ ID NO: 4843 - DNA, 2370 bp, Saccharomyces cerevisiae
atgctatcttcagctaataggttttatataaagaggcatttggcaacacatgccaatatgttcccctctgtatctaaaaattttcaaacaaaagtgccaccttatgcaaaacttttgaccaacctagacaagattaaacaaataacaaacaatgctccattgacactagcagaaaaaattttatactcgcatctttgcgatcctgaagaatcgattacttcttctgatctgtccaccatccgtggtaataaatacttgaagctaaacccagaccgtgtagctatgcaggacgcttctgcccaaatggcgcttctacaattcatgaccaccggtctaaatcaaacatctgtcccagcatccatacattgtgatcatttaattgtaggtaaggacggtgaaactaaagatttaccctcttccatagctaccaaccaagaagttttcgatttcttggagagttgcgcaaagagatatggaattcaattctggggcccaggttctggtatcattcaccagattgttttggaaaatttctcagctccaggtctaatgatgctaggtactgattcccatacaccaaatgcaggcggtctgggagctattgccatcggggttggtggtgcggatgcagttgatgccctcacaggcactccatgggaattaaaagcaccaaaaattttaggtgttaaattgaccggaaagttaaacggatggtccactcctaaagatgtaatcacaaagctcgctggtttactaactgtcagaggtggtactggttatatcgtcgagtacttcggcgaaggtgtatccactctatcttgcacaggtatggcaaccatctgtaatatgggagctgaaatcggtgctacaacgtcaactttcccttaccaagaagctcacaagcgttatttgcaagcaactaatagagcagaggtcgctgaagcagctgatgttgctttaaacaagtttaacttcttaagagccgacaaagatgctcaatacgataaagttattgaaattgacttatccgcaattgaacctcacgttaatggtccatttacaccagacctttcaaccccaatatctcaatatgccgaaaaaagtttgaaggaaaactggccccaaaaagttagcgctggtttgattggatcatgtaccaattcatcttatcaagacatgagtcgtgttgtcgacttggtcaagcaagcttccaaagccggcttgaaaccacgtatccccttctttgtcacccctggttcagaacaaattagagctaccttggaaagagatggaatcatcgatattttccaagaaaatggtgccaaagttttagcaaatgcatgcggcccttgtatcggacaatggaatagggaagatgtctcgaaaacatcaaaagaaacgaacactatttttacatcattcaatagaaatttcagagctagaaacgatggtaataggaatacaatgaatttcttaacatccccagaaatagtaacagcgatgagttattctggagatgctcagttcaatccgctaactgactcaattaaattgccaaatgggaaggatttcaaattccaaccaccaaagggtgatgagttaccaaaaagaggatttgaacacggtagagacaaattttatcctgaaatggatccaaagccagatagcaatgtagagattaaggtagaccctaattctgatcgtttgcaattattagagccattcaaaccttggaacgggaaggaattgaagacaaacgtgcttttgaaagttgaaggtaaatgtacaacagatcatatttccgctgcgggcgtctggttgaaatataaaggccatctagaaaacatttcttacaatacattgattggtgcacaaaacaaagaaaccggtgaagtcaacaaggcttatgaccttgacggaactgaatatgatattcctggtttgatgatgaaatggaaatcagacggtagaccatggaccgtgatagcggaacataactatggtgaaggttccgcaagagagcatgctgctttgtcaccaagatttttaggcggagagattcttttagttaagtcttttgcaagaattcatgagacaaacttgaagaaacaaggtgtgttgccattgacttttgccaacgaatctgactatgataaaatatcaagcggagatgttttagaaacgttgaacctagttgacatgattgctaaggatggtaataacggtggtgaaattgatgttaaaattactaaaccaaacggtgaatcgttcaccatcaaggcaaaacatactatgtctaaagatcaaatcgattttttcaaagctggttcagcaatcaattatattggtaatatacgaagaaacgaataa

SEQ ID NO: 4844 - DNA, 2373 bp, Saccharomyces cerevisiae
atgaatcattggttagcatttttgaataagcctgaatccctaaaggaacaaaactcggattgcgaccagcagggggagatgagacatgttactgatggcactttaactaagtctccagaaagtaaaccttttcgagagcggcgttcacaaacttggatagactctgaagtacctacgtccactgaaaaatctaatgtgcaggaaagtatttcttctgatattatatcaaaactgtcgaataggcgttcccgaagaaaccgctcagagagttgggcaggttcagaagcctcttcaccttctggtaacattagtacattggaaaatgctacggaaaaaaatactttaaaatcgcctaataaatttctacaaaggggtggtttaccaactgtaggaataggctcgcaggctctgtcacctgcaggaaagcccagtacattaggaaatgtaagccctggtaaatttaccacatacaaagtacacaatagtattgaagtgaatagattttcttctacacctacaaagctcctcacgaatccccacaaagtcgcagcaatctcaaatgatgagcattatgttgtaagcaatgagagtctggaggagaatatagaggttgcgcatctagagaacgtatttcgctcatctaaaactccagatgaagaacagtccgaatatatgaaattaggagaaattaggctatcttcttcatcatatggaggaagtatttctaaagaaaatagtttacccaaggtattagatgagctccagtcccaaaatgaagagatcaaagcactaagacaaaaactagaagagaaggatgacaggattcaagaactagaagaacttaatagcatgaatgatgctaaacttcaaagaatagaagacttgcagaaggaattccacaacgaaagaaaagctgcatcaaaaaggctcaacattgttcaggaccggtttcgcaaagaaattaaaaaaattagagaagaaaaaattacagactttcaaaacaaaaacgctagcaagaaggagaagaatgaagtgactagtgccaaaactaaatgtaaagctttttctcaaagaaatattttagtttcggaactatacaggaagcaaaaacaaatcctaaacttgcagcaagaaaatgataaatttctaaaagatattaacgaatcgaataactctatagtaaaattaagatctgaagttgaaatactgaaaagcaatttgcaactttctcaagatgaaaataaaaaattacatgataatggttcgttttacgagaaaaggttaaatgatgtttacagctatatgcaaaatctttctctttttgagaaagaccttggtaaattcatactagaagaaatgaaatgtggccattccccttcgatgtttcaaaacggttttgccaagctttatccggattttcaagatatcaaaaatcttgaaaatatggagcaatacaaacaattaaaaggaaagatagaacttttggaaaagaatgaccgtatacgtcttgaaaaaatcatttctgtctttaaattgattaatgaaagattacattttatgcaacagcagcacagtcacaaaataaaatatcttcaaaaagaggcgttaacaaaagaacaacaatttcgtttggaaaaaaggagatggcatgatatcctgaacctcaaggaagaaaactttcaaaaactgaagagcgagttaaaagaaaaattaatactaagtgaaaaaattcagaaaaatgccgaagataaattgaacgattacatgaatgaacaccaggaaattgttgagaaacttcagaatcaggctttgattgcttcaagatggagcactcaaattcaagagtcagaaaacacacataagaaaattactgacgagttagctggaaaacaaagtgaaatattaaaactcgaagaaacaattctatcactaaaagaagatgtattccaagagaagctgaatttaaaaaaactatatggtgatccttctaccgaacttaattttgaaactgttggaaaatcttttccacatataacgaaggaaaagtacgactccttgggtcttgatattctgacagaccttacctatgtgcaatcgcaaaatctaatcaaaaatttattaattgtgttggatatcccattaaaaaccttcttaaaaattgtaccaacaattgtcattcaacttagatgtgagcttacacttctcacaaaatttgctaatgatttgaaccttaaggtttttggtaaacagttagatttcaaaagtagaagaaaggtcgcaatgaatgagtttttgaacaatcatgatattgctgaagtaaagcatcctcttgagtatgatttgcaagcgttgtttaaatatttcttttcttag

SEQ ID NO: 4845 - DNA, 2373 bp, Saccharomyces cerevisiae
atgcaagaagggggctttatccgtagaaggcgtacgagaagtacgaaaaaaagtgttaattataatgaactaagcgatgacgatacagctgtgaaaaactcaaaaactctgcagctgaaagggaacagcgaaaacgtaaatgacagccaagatgaagaataccgtgatgatgctacgctcgtgaaatcacccgacgacgatgacaaagattttatcatagacctaacaggttcagataaagagcggaccgccaccgatgagaatactcatgcgatcaagaatgataatgacgagataatagaaatcaaggaggaacgtgatgtttcggatgacgacgaaccgttaacaaagaaaaggaagacaactgctaggaagaagaagaaaaaaacgagcaccaagaaaaagtcaccgaaggtaaccccatatgaaagaaacactttgcgattatatgagcatcatcctgaactaaggaatgttttcacggatttgaaaaatgcacctccctatgtcccccaaagatccaagcagccggatggtatgaccatcaaactgctacctttccagttagaaggtcttcattggctaatatctcaagaggagagcatttatgcgggcggtgttttggcagacgaaatgggtatgggtaagaccatccaaactattgccctattaatgaacgatttgactaagtctccgtctttagttgttgcccctaccgtggcgctgatgcagtggaaaaacgaaatagaacaacatacaaagggacaactgaaaatatacatttatcacggtgcttccagaaccacggatatcaaagatttgcaaggctacgatgttgtactaaccacttacgcagtgctggaatcggtattcagaaagcaaaactacgggtttagaaggaaaaatggacttttcaagcagccttccgtattgcataatattgacttttatagagttattctggatgaggcacacaatatcaaggatagacaaagcaatactgctagggctgtaaacaacttaaaaacgcaaaagcgatggtgcctgtcgggtactccgctgcaaaatagaattggtgagatgtattctttgatcagattcttaaatatcaatcctttcacaaagtacttttgtaccaagtgtgattgcgcttcgaaggactggaaatttacggatcgcatgcattgtgaccattgtagtcacgtcattatgcaacacacgaatttcttcaaccatttcatgttgaagaacattcagaaatttggtgtggaaggtcctggtttagagtcttttaataacattcagacattattgaaaaacatcatgctgcgaagaactaaagtggaaagagcggatgacttgggtctaccgcccagaattgttaccgtgaggagagacttcttcaatgaagaggaaaaagatctttacagaagtttatacacagattctaaaaggaagtataattcctttgttgaggagggtgttgttctaaacaattatgcaaacattttcaccctaatcacaagaatgaggcaactggcagatcatcctgatttagttttgaaaagattaaacaattttcctggcgatgatatcggcgtcgtgatctgccaattatgtaacgatgaagctgaggagcccattgaatctaaatgtcaccataagttctgtcgtttatgcatcaaagaatatgtggaatctttcatggaaaacaacaataaacttacttgtcctgtttgtcatatcgggctaagtatcgatttgtctcaacctgctttggaagtggaccttgattccttcaaaaagcaaagtattgttagccgtctaaacatgagtggcaagtggcaatcatcaacgaaaatcgaagcacttgtggaagaactatacaaactgagaagcaacaagagaacgattaaatccattgtgttttcccagtttaccagtatgctggatctggtagagtggagattgaaaagagctggatttcaaacagtgaagcttcagggtagtatgtcaccgacgcaaagagatgaaaccatcaagtatttcatgaacaacattcaatgcgaggttttcttggtcagtttaaaggcgggcggtgttgctttgaatctttgtgaagcttcgcaagtattcattttagacccatggtggaaccctagtgttgaatggcaaagtggtgatagagttcatagaattggtcagtatcgacctgtgaagatcacaaggttttgcattgaggatagtatagaagcaagaatcattgaattacaggaaaaaaaggcaaatatgattcatgctacaataaaccaagatgaagctgccattagcagactaacgccagctgatttacagttcttattcaataactaa

SEQ ID NO: 4846 - DNA, 2373 bp, Saccharomyces cerevisiae
atgtcttcattaactcgattgctacaggaaaaacgaaaaaatgaaacttcgaactcatcaccgagaacttctgctgatacgttgaccacgacgcccgagtcacaatcgcttgaccttcactctaggaataagagtagtagtcatattggtagcgtgagtaatagcagcagtagtgatcgtaatagggctaacgtgccagttcctggcagtgtcacaactgttactcaaatatactcagaggaagattcatcatcaacagccggttcctctctcgacgataggaatcagttttcctccagcttccttaatgcaaactttgctcacactgcatcattctacggcacaagtgcacaaagtagagatagatttggatccttaataaacgatcaaggtactgcaggactttcctcacatggtggttcttttgctgcacagaacagaatcacaagtagattatctaccacgtcacatacttcaggaagggccattccttctttatcatcaagtataccttactccgtgccaaattctaacaaagataacaatagctcgaatagcaacagctcctctttgtcttcttcgtggctcgaaacatatgcaggcggtatgcccaataatatttctgcaatcgattcaaatgttatatcctccccaaaagtagatagcgtggaaccacgttttgttatctccaaacaaaaactccaaaaagcatcgatggatagtaataatgcaaatgccactcaatcaagatctatatcccgttcaggttcattctcttcacagcttgggaattttttcttttccaaaaactcaaaagaatcttcaaattctaactctgcaggcatgtctttttctgccaattccaatggtccttctccaaacattaagaatcccaatgttaccaatggttcgacgcctatcccgaagcctatccgcgcaagacaaagcagcatatattctgcatcaagacagccaactggttcctatactgataacttttacggttccccctcatctgtacatgaccacttacctccaagtcaaagtgttccaaggtcacaacattcttccatcggtgatttaaagaggttcttcaaaaaaagttctaacagtaacctttcctcgaatagtaacaacgtgatcccgaacggatcacctctttctagcggaattgccgttccgtcacactctcattcatcgtctcattttgccgcagggaataactcatattccactagttataacggaaatggagatactatttattctcatagtcacggcggttcaggaattccgttctcaaaaaggtacatcaaaaccggtgccgatttaggcgctggagcaggaggttctgtcaaattagctcaaagaatttcagataacaaaatatttgcagtgaaggagtttagaactaaatttgaaaatgaatccaaaagagattatgtcaagaaaattacatcagaatactgtattggtacaactttgaatcatcccaatatcattgaaacaattgaaatcgtgtatgaaaatgatagaattctccaagttatggaatattgtgaatacgatttatttgctattgtaatgagtaataaaatgtcctatgaagagatttgttgttgcttcaaacaaatacttactggtgtacaatatttgcatagtatcggcttagctcatagagatctaaagctagataattgtgttataaacgaaaaaggtattgtaaaattaatcgattttggtgctgctgtggtattttcatatccattctcaaaaaatcttgtggaagcaagtggaattgttggaagtgatccatatttagcacctgaagtctgtatatttgcgaagtatgacccacgtcccgtagatatttggtcttctgcaatcatttttgcatgtatgatactgaagaaatttccatggaaaattccgaaattaagggacaattcattcaaactattttgttccggacgtgattgcgactccttaagtagcttggttacaagaactcctgatccaccttcctacgatgaatcgcactcaacagaaaagaaaaaacccgaaagctcttccaataatgtatcagatcctaataatgttaatatcgggccacaaagattgttgcactcattaccagaagagactcagcatattgttggacgtatgattgatttggcgcccgcatgcagaggaaatatcgaagaaatcatggaagatccttggatccgtagcattgatatgtgccacttggttgaagatggattatcgttcaaagtggttagaggagaagaccatcatcacacacaagtggatcaaagtgaagcacatattgcaggcctagaaaagaaaaagaaaaagcaaaataatcaataa

SEQ ID NO: 4847 - DNA, 2373 bp, Saccharomyces cerevisiae
atgttcgaatctgtcaatttggatgaaaattctccagaggatagagaactggctaaggttttgtccccaccgggtagttatctttctccagcttcactagacagtggttcatcgttcacaaatagtgggacttcaactagttgctttgaaccaaaaaacaatctaccctccttatcgtttttaaatgctagagcgggatctttaggtggcatttttaatcataaacagatgacctcgccgtcaaattcgaatataggaggcgaaaatgtagaatcgaccacaagtagtaatgacggcagtaatgaaaatgcaggtcatcccactacttcagagcaagatcaaaatgcagatcaccccactatttcacaggcagatgataatggacactcatcgttgacccctaatcctgctgtaacttcaactgttacggataagaagggaaatacagtaaaacggaagtactccagaaatgggtgctccgagtgtaagagacgaagaatgaaatgtgatgaaactaaaccgacttgttggcagtgcgcaagattgaatcgtcagtgcgtttacgttttaaacccaaaaaataagaaaagaagaacctcaaatgctcaaagagtaaaagaatttaggaagcacagtactagcctcgataatgatcataataatgctcgcaagcgtcagcattcgtcatgcaaggctgagaagaagaaaaaagtacgacaaaatttaagtgaagacaccacggaccctaaaccgattacagataacggcaagaatgtacctttggatgaaatagaatccctagagattccaaatttggaccttaccaccacaatgaatggatatgacgttaatttactaatgcagaacttgaatgatatggttaatatgaaacttcatgactcttacttattgaatgaagaactgaaaggattagatttgcccgatttggacatacctgaacttttgcccgcttcgaatgtgaacagtagcgtaccaatatcctttctggtgaataatgtaataactttcaacacaaaactaagctcgttcaaactaggtggaatccacgataagtatctaaagatattttactacgattgcttagattctattgcgccctttttccaaaatcaagggaacccgttaagagatatcttactttcatttgcgaaaaacgaggcctatcttttatcttccatattagctacgggagcatctatagcatatagaaagtctaataacttggaagatgaacgaaactattgtgcttatttgtcacattgcctgagcctgttgggtgaacaattcaagaatgagtcaaacgttttaaataggatagagcctatcatcctgacggtcatcatgcttgcatgggattgtatttattcaatgaattctcaatggaggtctcacttaaaaggtgtaactgacctttttaaaaaaatcaatgccgggaattcctccaaagtacttaacgttgcaaaatgttggtttaaagttatggaaacattcgccagtataagtacggtatttggcggatctttaattgataataatgaccttgatgcaatttttgatccatatgattaccaatatgttgactcgttaaaatttttaaatattatgactccactaaatgagtttaatcttttaagaggacataaagaagatttcgatcttgttattaaagaagttttcaaatcactcaatacaattaggtcaactgaaaaaaattacttttctaaagaagaaggtttgttcactaagaaattagactatctgcttttatcatcccaaacttcgtccgaaaagtccaaagaccagatatcatatttcaatacgcagaaaattctagtggaaattgacaagcaattagattacgaatttattgacaaatctggaattataccctcagacaatcagtcacaccctagaattagtaatattcatgataatgccatcgatatggtgacattaaagaacggtgaagaagttgccatcagctggtatgatatttctcatcagacacaagttttatctttcttattaattgtattattaaaacttttaggtatgccaaaagagtcaagtaccattcaacaagtggtcaagaaaatcatgtctttcttcaaattcttagacagtgactcgccgccacaaaattcaaggacttgttatagtaattttgctgtattgattgcaggtttgaatgcaatggacgaggaaacaagagcgattgttaaaagatattataaaatcaatggtggaaaatttcaaaagctcacagaacataatcttaacagactggaaaaggtctggtatggtaaaaatcaaaattacaggttagaagaacaagacgttttaacatggtag

SEQ ID NO: 4848 - DNA, 2376 bp, Saccharomyces cerevisiae
atgaaaaggcacgtgtctttatctgatatattgacaggaaataagagaaaagtgagaagacaagatgctctacagattaccatcgatgacgaaaatgatactgaatcaggcacttttgacgccagaacagccaaacatgacgattcttcagtaatatttttaaaccactctgttgtgaagccaattgaagctgtttctactaatcacaaatctgcaaaggagtttttgatgacgaaacgcacaaaagaaaaatgcgatgacgacgatgatgatcttattgtaatcagtgataagagtcccaaaagtgagactaattgtagcaaaattgcactttcgcaggagcatgaagatgatatttctataatttccacatcgagaatcaaatcatcgcttcttaatgaaagagcatcaaagattaaaaacttccttaaacatgagacaaccgacacgttcaaaagattaaatagcatctctaaactaaatgaaatagagccaccattaccattacatcaatcgattttcccagtaggtgacaaagagctgtcagatcggagtgttgatatcccgcttcctttccgcacaataccgccattaaatcataattttcttcctagtgactatgaatcgttgaaagacaagaattcagcatcttgtattcctgttcgctatcaagcaccggtattacttggcacaaatattaaaagaaatacaactctcacatggccgcagctattcaagcctgtcactttaaaacaagtattaattgaacccaaattgaaacttcgaatcaaaaattggattgaaacatcctttcatacgctagaaaagcctaccttgaggaaccgtctattgaacagaataaatcccaataaacaacagggatctggtgatgagcttgccaacttcattgtacctgatctcgaagaagacgaaaacttgcgtccagatttctacagaaatggcgaagcaaatagcagcttgagcgaatttgttccactaatgatattacacggaaattcaataggcaagaaaacgctgatacagacaatcatgagagagattgctggcgacgataattcttaccagatatatgaagttaattcaaacatgaacaggagcaaaaaagatttgcttgatatcctactagattttaccaccacacactatgtcaaagattcctcaaaaaggaaaagtgactacgggcttgttttatttaatgatgttgatgttttatttaaagaacatgataggggatattgggcaatgatcagcaagctttgtgaattttcacgaaggcccctcgtattgacttgtaaggatttgtcactagttcctagtgaacttattgccttggcaagtgaacaaaactctttgtttcatactaagaaaattagtacatccacagtctatgcgtttctaacaaaatatttaaagtcccttgaaatcgaagtttgtgacgactggcttcgcgatgttgtaaaacaaaataatgcggatattaggaagtgcttgatgcacttgcagttttggtgcgttgatactgaggctgatttgatttcatccaagaacagactaccggtcctaacatcaactcttggttcaagcgttaaagatatatcgcaattaactgatctactctccataaatgatgttattggtcaagcaacgctcaatcgttccatggttagacaagaaatagattctaccacaatgaccccagaaaaagttaatactttccaggatcaaaatctggatgatgaaatgaaactaaaatttgattacgtgatagattataaattgcatttaaatgaccccaatagacaaccgttattaccgtttgaattgaatatttaccaacacatccaagaacaattggaagctcggtattcctatgttagagaagcaaaccataggcttgataacgaataccttgttaacaggttcaaaaaaatgacagaatctacattaaattttttggcgtcaagaataccgaagtatgaccatcttcagtcggcaagaaggacgagaaattcgaagaaaatttctgatattttgaaccaattcaaaggaatttataatgatgaaactctgaacgaaaatgccgagattgatctgctgagcgccacaactcaacaaattaaagcggagatcaatcccttcgtttttgaaatcgctaaaagtgacgccaatgtcaagaatgaaaacaaacaaatatttgagttgcatagtgaaaatgtatcagaaagacgatacaaagatttggtctatcagttgtcacaagagggtgtcttgaaaaacgtatggttcaacgctgatccgagcatagtcgtgagaaaatgggagcatttgcactcaggcttttcaaagaacaaataa

SEQ ID NO: 4849 - DNA, 2376 bp, Saccharomyces cerevisiae
atggtagcgacatcttcaaagaggacgttggatccgaaggaggaacatttgcctgctgacaaaacatccactaattcaagcaacactataatatctgagttggcaacacaagagaaatccagctctagtggtactacactaaaattaatagctcttaatatcaagtccatatcagatgaagatgtgggatatatccaaaatgttgaaagactgtctttaaggaaaaatcacttaacatccttaccagcgagtttcaagaggttatcaaggctgcaatatctggatttgcataataacaattttaaagaaatcccatatattttgacacaatgccctcaattagagatcttggatctgtcctccaatgagattgaagcattgccagatgaaatatcatcgttttggcaagataatattcgtgtattatcattgaaagacaacaacgttactagcatacgtaatttgaaatcgatcacaaaattaaacaagctgagcatcttggatttagaggataataaaatacccaaagaagagcttgaccaagtacagagttatactccatttcatacgggcatccccaaagaagaatattgggcaattgcgatatcacgatatctaaaagatcatcctaacctacctactccagaacctaaaatatctagagcagcgaaaagaatgggattcataaatacgaacttgtctaatggagcaatgaatgaaaacaatataatttcacttgccccaagtgcaaatacaactataagtgcatctactgcaatggtctcatctaatcaaacctctgcaacatctttcagtggtacagtcaatgcagaatcagaacaaagtggggcagtgaatggtacggaactatacaatcacaccaaatataatgactacttcaagaggttgtcgattttaccagaagagtcaatgagtaacgggcatcaaaaaatatcgcatgcagagttggttgtttcctgtcggaagctcctatttagttttacagaatgccaacaagctatcagaaaaatcgcctctttctgtaaagagaaggccgtagcggttaatgtagtatcattattatactctgtcagatcacatactgataatctggtggaggtcttgcagcaaacagagaacgaagacgaatcgcatgatcaggcgttaatcaagctgtgcctcactatcatcacaaattttaaacaaattataacattgttgagaaaaaattttgagatttttttcaaagaagacgatctatgcttcataaggatgttttatatgacattaatgtgtgcttatatggaaatgtataatgcatggtcttttatcaaagaagatgatcaagtgtccggttctgcaagtaaggcacccaagaaacattctttttcgaggcacgagacatcgtccagtagtatcacaagcggtggaggacccgcagcaagtacgaccagtacacattgtagcggaaacataaaattactgccgaaaacaaggagcacaagaacaccatctgcatctgcattgctttcaaatagtaatattctgacgggtgataccactgctgttcctcttttatcaccaaatctaaatggtgcacacacccatggtccaattttgggacaccaaaatgcaataagcaatggaagttctcaaacgaacatgaatgaagtaaaaactactagcgatactattccaaggcaacagctgcttcagcacaataaatccatcagcgattcgaaaaaagagtcacaggcgcatgaacctaaacagcatccggttatgacttcttcaataattaacgcatcaaatagtaataacgtctcgaatgttaatataaccccaccaccgatgaatggtggtggtgccgcgaacagtagtgctaatgtagtggagacaaatattgacattcaactgtatcaaacgttgtccacagtagttaaaatggtgagcgttgtatataaccagttaacttcagagatatccaagatagccattgctagcaccatgggaaagcaaattttgacggactcgctagcacctaaaattcgtgatttgacggaaacatgtcgtcaagcgatggatttatccaaacaattgaatgaaaggttaaatgtattaataccgaacgattcaaattcagagaagtatctgacatctttggagaagctgaaaacgtgggagataatgaattcgttcttaaaagtaataatatcaattctggctaatactaaaatcgtaatgagcgacgtgcctaatttgaatgagctgagacctaacctagccaacttggcgaagattaccaaggatgtcactgtgatattggacttgagttcatacaaggctgtatcagtaagcgccaactctccggagtaa

SEQ ID NO: 4850 - DNA, 2379 bp, Saccharomyces cerevisiae
atggacttgaatcaaagaaaggaaaaaaagggccagcatgttggatgctgtggctccaggacagacctgtctgctgacacagtggaactgatagaaagaatggacagattggctgaaaatcaggcgacagcttccatgtcgatcgttgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcatcaacgtcaggactagtgcgactaccactgccagcatcaacgtcaggactagtgcgactaccactgaaagtaccaactccaacactaatgctactaccactgaaagtaccaactccagcactaatgctactaccactgccagcatcaacgtcaggactagtgcgactaccactgaaagtaccaactccagcactaatgctactaccactgccagcatcaacgtcaggactagtgcgactaccactgaaagtaccaactccagcactaatgctactaccactgccagcatcaacgtcaggactagtgcgactaccactgaaagtaccaactccaacactaatgccagtaccaatgcgactaccaactccagcactaatgctactaccactgccagcaccaacgtcaggactagtgctactaccaatgcgactaccaactccagcactaatgctactaccactgccagcaccaacgtcaggactagtgctactaccactgccagcaccaacgtcaggactagtgctactaccactgccagcatcaacgtcaggactagtgctactaccactgaaagtatcaactctagcactaatgctactaccactgaaagtaccaactccaacactagtgctactaccaccgaaagtaccgactccaacactaatgctactaccactgctagcatcaacgtcaggactagtgcgactaccactgaaagtaccaactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttcctagagagaaagaaactgaaagcacaatttcccaatacttccgagaatatgaatgtcttacagtttcttggatttcggtctgacgaaattaaacatcttttcctctatggtattgacatatacttctgcccagagggagtattcacacaatacggattatgcaagggctgtcaaaagatgttcgggctctgtgtctgttgggctggccagaaagtatcgtatcggaggatagcttgggaagcactagctgtggagagaatgctgcgaaatgatgaggaatacaaagaatacttggaagacatcgagccatatcatggggaccctgtaggatatttgaaatattttagcgtaaaaaggagagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggagatgtggttgttaccacattggcttgatttggcaaacgttgaagttctcgctgcagataacacgagggtaccactgtacatgctgatggtagcggttcacaaagagctggatagcgatgatgttccagacggtagatttgatataatattactatgtagagattcgagcagagaagttggagagtga

SEQ ID NO: 4851 - DNA, 2379 bp, Saccharomyces cerevisiae
atgaccactcaagaatcgatcaaacctttggtagatagaatcctatcaaatcccctgcagttcaatgctgcaatgatctctaacaaatcgaataataatgatacttccgccgcgccggaaaatagctcgtatattgtgataggaaaacagcataataacaatagtaatagcacagctattgctgcaacggccgaatccaagcaaataaaagaaaataacttgatagacaggccaaacggaaagaaaaccaacactgttcctaaatctatggctgaagctttattgttgtatacttctaaaaatgataaagatgctgcagatgctactggtgccaagaagtcagcggagctttctacggagctttctacggagcctccttcctcttcttcggaagatgacaaagtaggaaaagaggaagaggaagagggtgaaatatttcatgaggcaagagactatgtagaaccccgaaaagctagtttgaaggaacgcgacaacgcagataagggcgatggtgaagacatcggcgaagacatcggtgaagacatcggtgaagacatcggtgaagacattggtgaagacattggtgaaaacttgggttctccattagcaaccattgatgattcatctaatgagaatgaaaaggaaaaaagaaaggaactgtctacaagcattagcagtgatgacgaaatagaagacgacgaggatgaggatgacatggattatgattctagtgctatggaaaaagagctccctgaagaagaggagaacgattccagctccaaaatttctgaaggcgaaaaaaagagtttatatcaagatttaatggaaaatagtacagtggaagtaaatcggtacgaaccagtaaacaacaccaaagaaaatggaaacaggaatccaaagggagaggaggaggaagaagaggaagaagagctgaaacataaatctaggtcaatcacccctccggttacaatatcaaatctatcaaacttttaccaattcaatgaaaatatcaatgatcgtggttctttaaactctactagaattgttaaaaattggggcgacaaattcaccaatttgaagcctcgtggccttttgaatcatggtgttacttgttacacaaatgctgctgtacaggctatgttacacattccttcgatacaacattatctttttgatatactaatggggaaatacgatagcaccatctcaaaaaattccgtttcctatactttagctgaaacaagtaaaaaaatgtggttaccggtctcaaaaaaccctagaaagaacgtttcagcttcctacattaatccaaaacatttgatttccagattggatgacattaattgtatgatgagcgaatggcagcaggaagattcacatgagtacttcatgtctctgatgtcaagattacaggaagattctgttcccaagggtcataaacttatagaatcgataatatatgacatattcggtggtcttttaaagcagatcgttacttgcaaatcttgtggcagtatatctaaaacagaacaaccattttacgatttatcgttgcacttgaaagggaagaaaaaacttgatccaaattctgacctgtcgagtgatagcattaacggcacttcagccaccacttctaccactacctccaatgctgccacaaaaccatctctttcatcctcttcatctgtcaatttaaacaatggctcaccatttgccgctgccagtgatttaagttcagccaaccgcagattttctattgaaaaatcaattaaagatttcttcaatcccgaattaatcaaggttgacaaggagcaaaagggttacgtttgtgagaagtgtcacaagaccacgaacgccgtgaagcatagttcaatattaagggctcctgaaactttacttgtgcatctgaaaaaattcagattcaatggcacgtcctcatcaaaaatgaagcaagctgtttcttatcctatgtttttagatttgacggaatattgtgagagtaaagagctacctgtcaaataccaactattaagcgtggtggttcatgagggccgctccctttcttcaggtcactacattgcccactgcaagcaaccagacggtagctgggccacttacgacgacgagtatattaatataatatctgaaagggacgttttaaaggaacccaacgcatattatctcctatacacgaggctaactccaaaatcggttccattgccattggcgaaatctgccatggccactggtaatgttacctctaaatccaaacaggaacaggctgttaacgaaccaaataaccgcccattgaagattaatagcaagaaaaataacagaaaaaaatggaaaaaaaataaaaaaaggaagttcaccaaatga

SEQ ID NO: 4852 - DNA, 2382 bp, Saccharomyces cerevisiae
atgcaagtactagtgacgctctggtgtctaatatgcacatgcctggtactaccagtggccgccaagaaaaggacactgacagcgagttcactggtcacgtgcatggagaactcacagctttcagccaatagtttcgatgtgtcgttttctccagacgatcgatcgctacattacgatctggatatgaccacgcagatcgactcttacatctacgcttatgtggacgtgtatgcctacgggttcaagattattacggagaacttcgacgtgtgttcaatgggttggaagcagttttgccctgtgcacccaggtaacatacaaatcgactccattgaatacattgcccagaagtacgtgaaaatgattccgggaattgcctaccaagtgcccgatattgatgcgtacgtaagattgaacatttataacaacgtaagtgaaaatttggcttgtatccaggttttcttttccaatgggaaaactgtatcacaaattggggttaaatgggtgacagctgttatcgccggtattggtttattaacttccgctgtcttgtccaccttcgggaactccacagcagcatctcacatttctgcaaacaccatgtcactgttcttatatttccaatctgtcgctgtggtcgcaatgcaacatgtagacagtgttccacccattgctgctgcctggtctgaaaaccttgcctggtcgatgggcttgatccgtattacatttatgcagaaaatcttccgttggtatgtagaggcgactggaggctccgcatctctatatttgaccgcgacaacaatgtcagtgctcactcaacgaggtctggattaccttaaaaatacttcggtttacaagagggcggaaaatgtcttgtacggtaactcaaacactttaatctttcgaggaattaaaagaatgggataccgtatgaagattgaaaatacggccatcgtttgtactgggttcacattctttgtgctgtgcggttattttttggccgggtttatcatggcctgcaaatacagtatcgagttatgtataagatgtggttggatgcggagtgataggttttaccaatttaggaaaaactggaggtcagttctgaaaggatcgttgttaagatacatctatattgggttcacgcaactgacaattttaagtttttgggagttcactgaacgggattccgccggtgttattgttattgcatgcctattcattgtattgtcatgcgggttgatggcgtgggctgcgtacagaaccatttttttcgcaagtaaatctgtggaaatgtacaataacccagctgctttattgtatggtgatgagtacgtcttaaacaagtacgggtttttctacaccatgttcaacgcaaaacattattggtggaatgctcttttaacgacgtatattcttgtaaaagctttatttgtcggattcgcacaggcatcaggtaaaacgcaagcattggctattttcattattgacttggcgtattttgttgccatcatccgttataaaccatatttggaccgtccaacgaatattgtcaacatttttatttgcactgtcaccttggtcaactctttccttttcatgtttttctcaaacttgtttaaccaaaagtatgctgtctctgccatcatgggctgggtgtttttcattatgaatgctgcgttttctttgcttctactgttgatgattctggcctttaccacaatcattctgttttctaagaatcctgactccaggttcaagccagcaaaggatgacagagcatctttccaaaagcatgctattcctcatgaaggtgccttgaataagtcagtggccaacgaattaatggccctaggtaatgtggcaaaggatcataccgaaaattgggaatacgaactgaagagtcaagaaggtaaaagtgaagataatcttttcggagttgaatacgatgacgagaaaacaggaactaattcagagaatgctgaaagtagcagtaaggaaaccacccgtccaaccttttctgaaaaggttttacgttcattatcaatcaaaaggaataagagtaaactgggcagtttcaagcgcagcgctccggataagataacacaacaagaggtttctcctgaccgcgccagctcttcgcctaacagcaagtcataccccggtgtctcgcacaccaggcaagaatctgaagcgaataatgggctaatcaatgcatatgaagatgagcaattcagtctgatggaaccaagcatactggaagacgctgctagttccacccaaatgcatgctatgccagcccgagatttgagcttgagcagtgttgcaaacgcccaagatgttactaaaaaagcaaacatcctggatcctgattatttgtaa

SEQ ID NO: 4853 - DNA, 2382 bp, Saccharomyces cerevisiae
atggtaatacaaactgctactacgttatcgccagctaaggcgagaccttctttccctcataacgatttgattaaaagtatgtcagacagccttataagtcgccccactcaccctccgattaggaaattaaagtcatccttgaaaatatcacaccctgaacctatttcaagatcaaagtcagaaattttctgcacatcacctgagaaaaatgtacgttttgctattgaattaacaactgttaagagatttgataaaaacgcggagccaagttctatctcaaatgaaaactcacccacattatcccctgttgatagcaataccgctgctgatgacgtccagcttttcaacaatgaggactgctggttcaatgattcttcgttggtcacaaacttgctgaaaaatgaaaagaagtttcgttatatgaattccttaaacaacatgttcaagttggacctttatgattcagaagatgaggatgatattgacgagcacatcaatagccaggccgagtatgggtatacctataattctttatctacccgaggaaaaacttctgaaaataaatctgctacctcttcactggctactcaggcaacaaatatatgtgattggaaacttcactgcacagacttggttcccttcaagatagcccctccactatttaccaaaacattatcggcctccgatttgcaaggtcagctcacaaagtacttaaatggccaaaatgtaaaactgcattctctcactcaattaggcgatgattcaagcaaaattacaggtctagtgtacgtcaaaaacttgagttttgaaaagtatttggaaattaaatttacgttcaactcttggagagatattcattacgttaccgccaactttaatagaacgataaattcgaatgttgatgagtttaaatttacaattgatttgaatagtttgaagtacattttactcatcaaaagaatcattactatggaaaagaatacaagcagctgtccactcaacattgaattatgctgcaggtatgacgttaataatgaaacatattatgataataataatggtaaaaattatcaccttttcatgactaccttcaagaagggcggtgaaacgaaggaaaagattccagttgtcgtcgagcctgcttctcaaacagatgcagccatgtcgccgaaggaaatgaaagcaaggttcgtctcctcgaatcccactctttcaaggtttttacctcaatcaagaaagttcagcgaggatacagattactataatacatctccattgaaacatctttatcataatgatacgacaagctgggttaagcccaagagattgaacgttgttttagataaacttgaaaatgctacccctcctcctccttcttctgctttggctaacgacaccgccagaactggtaaaataactaaagataagaacaatgtgctcgccccaccaacggccagtaatagtattgacctaccaatattaggatctcaacatcaatcactatattctggttcatcgtcatattcttcatcatcttcctccatttcctcttcattatcctttgcttcttcaaacaattcctccacaaattcttcttccgcctcttgtagtttcccacttactgagctcgataattttgattatgcgaacctatatgaacctaatgataccttcacaacggccaatttgtttaatcattcattaaattccctaatgccggagatttctactccatcattcttcggaggctttagaaatgagaatactattaataacaacgatagtaaaaatttggttacctctttggaggattcatatgaggacaaacaaagtgttattacagatactactatggacgaaaataataaaacttcgactatcaacaattccacagacacgttaatcaaaccctcaaaagaaaatggaacagttaaggagaataaatcatctgcaaacagcaccagtgcaccatcttcatctcagaaccgggccagtacaatactaaacgatcattcgaatgggaagagtgatctcaaatatgtcaactatcaatcattattggattcccattgtttctacaatcatccctcgtcgccgaatcttcaatctacttcattctcgagcgcagctcctttctcgggaatttcccaagcttctgatatttttgactatgaaaacgaagatagtgatagtaatcagattgcgggagaaatagacaataattcgtttcctcctcacttttacttagatgaggatgataaatctgcatgtctcagtgatgacgctttgattgatcatcacagaaataccaacccatttataaatactttcagttcatctccacccatcctttcccaagaggttgatcgatggcgactttga

SEQ ID NO: 4854 - DNA, 2385 bp, Saccharomyces cerevisiae
atggcagcaaaaagaggattagccaaacaaaaatctagggtaaccaaggcctgtgatagatgccataggaaaaagattaagtgcaacagtaagaagccatgttttgggtgtattgggtctcaatcaaaatgtacgtatagaaatcaatttcgtgaaccgattgaggcttttttcaattatactggtagtctcagtaatgatttggataatgctaagtgcagcatagcaaaattgaaggcacagttacctccaagcgcaccggcctctttacagaaaggcctagcaaacatttgcactgagcttgaaaaaatacaacctcagctttacctcaatctggacagtaaggaaattagctcgtatggtggcctgaaatcgatagaaacagaaattatcgggaaacagtcaaaatctttgaataggttctccaacgcttttgaaagcaatactgcacaaaatgtcagtatgtactttggggtctattcaccgttgctatattttgcctctacgggtattagctggataactaaaaaattgatttcatgttcgaatgatagggagacgagagaaactatctatttatttttgaagtttcttgacgctagctctgctagccatgctggtcctaaagtaacttcgatatctcctttagagtattattcaaagctaaacggactttcatgtgggaacgacgtacttattcaacacattatgtcaaatatatcgaatgaaatcaaaggaaatacaaacattaaccaaacaatcaaattcaataaaccaacagactggtttatgtacggagtacaattgatggaacagcaccacaaggcgttggatcgtaaaagttccaaaaaattacttcctttgaaatattttcttgagcaagatgagttgattttttgtctctgtcttgaatattttgaaagatccctattttcgacaatgtacgacttgactattttaaagggcttagtctcgttgatgaaacacagatattggatagacgatccttttgtgctgggaagaattatttccacgatgtccaggcgaagtttggatgctggtttgaatcgttgggaatattatattggtcaggatgaggacactgccgaagaatatcgtaagttatggtgggactgctactggtgggatagatggtattcattggtcaccggtaagcagccattgataccacatgaaatgacttcgtgtctctttcccaaggatgtggttggattaggggtagatgattcgatggactgttttactttaataaacttggtggagctcgacccaagtaagtttgatatttgtatctctttcggctatattctattaacgaaaattattacagcggtattctctggtttgctttataatcgacactttacagactacagattatttgcaactcctaacgctaaagacctaaatggaaccgcacgacagcttatggtagagttttcaaaaatatgtaaaatttttcagtgcatacaagacaaactaatccctttcctcaaacaatattctgaaaatagtaatgtatttgaactatacacccatttcggatttgcaaaggtttgttgttttcagggaatggagagtttaattttaaggatacaaaatcttctacaagaaagagagagaattgaacttgattcctgcgtaaaggacatcaggcttcaaacctttgaagcatctgtagatattttgacggatgttctcaagcacgaagatacgttctatattttccgttgttcgtggttcatatatgccatcttgatgaatattaccttgaattttatcgagacccctagaaggaactcgatatgttatttatccttgatgtgccgcatgatagcctcatataatgacttatttgtgagctctggcaatgttaatttcaagggcaacaacgccttctctaaaaagttggaaaatggaacagcggtttctttcatcctaacacgcatctgctgtcagatgtacacacgttcacagaaaatggctaaggaatcgctgttttgtgaattgaaaaaatatggccaggcttgctcagatgctggtcaagctgcgttggacattgaatgtatctggtacaggaatattataggcgaacacaaagaatcaagcttccgtaaagaaattctcagcattcttgatagggaaatgggtgatttggtgaataatagagttattggcgtacagggaaaaaatcaagaaggtgcttgttatgagaagttgtcacccagcagcaccagtgtttcagttggcatggacttttgtagcctcgaaaattttgtgactgcagaatctctaccagaccttctcaatctattttgggaggacactgaatttggtattactaaagaaaacctcggagagtaa

SEQ ID NO: 4855 - DNA, 2388 bp, Saccharomyces cerevisiae
atgagtgatgaaggtgctgataaaagtctagatactaacacagaatttattatacaaacacgatctaggaggtctaatgccggtaataaattacaaaaactattggagcaggagctaagagatatagaatctaccaaaagacaaatttcttcctataagaatggtaatgatgatgaagaagatgaaatagggctgttgtttcaggaagatgaagatgatgaagatttcgaaatgatggcaaaagatgacgatgatgaaggggaagaaaaagaagatgagactcaaagtataaggaaagagccctctcaggcttcaagtgagcaagcagccgatgacttaatgttcagcagtagcgaatctgaggactccagcaacgagaatgatgaagatgcagaggaaaaggaaatacgaagacaagaactactttcaagaaagaaaagaaacaagagattacagaagggtcccgttgtaatcaaaaaacaaaaacctaagcctaagtcaggagaagctataccaagatcgcaccatacccatgaacaattaaacgcagagacgttactattaaatacaaggagaacttctaaaagatcatcggtaatggaaaacacgatgaaagtttatgagaaattgtctaaagctgaaaaaaagagaaaaattatacaagaaagaataaggaaacacaaggagcaggagtctcagcatatgctgacacaagaagagaggctacggattgccaaggagactgagaagctgaatattttgtcactggataagttcaaggaacaagaagtttggaaaaaggagaatcgtctagctttgcagaaaagacaaaagcagaaattccagccaaatgagactatactgcaatttttatctactgcttggctaatgacgccagcgatggagttagaagatcgtaaatattggcaggaacaattgaataaacgtgataagaagaagaaaaaatatccgaggaagccaaagaagaatttaaatctcggaaaacaggacgcatcagatgataaaaagcgggagagtgaagaatcgataaagaacgatggcgacgtgaattctttgggtgagaattcttcatctgtacacaaccagaaaaggattgaggaaacttctactaacgatacagttgaaggagaatcgagtccagatgcagcggtgagtagagtaaattcagacgaattaaagccaacagcattacctgatgttacattggacgcaattgcaaacaagcagagtaccgttgatgaagctcccaacagccaaccacaaaagaatataataactaatgagcaaaaaattaccaatgtaggcgaaccgatacaaaatttacataatgaagaaattaaagatgaaatggtaagtgctctcgagagcagggaaaatacttttgaaaactcatcacctgctgcccaagtggtctcacaaagggataattctgcaacacctacaccatcaaactccactggcactgaagatactatattgatctctccggatacggatataaaaggagagcctgaaccttgtctgaaaaccgaaggcatcgagaacttatctcataatgtaccacaagagaccaaaagcaatactgatgtttctttcttgaaacaagtaacgtttaccgaccatccgcaagtggccataatcgatactgaagagtcaccctcaaaaaaagatacagctaatgttgatgaatcttccgcggaaaactctttatcaacacagacctacgaagggcctgagcaattaacctcaaggaactttgttacactttatgattttcctaatgctcctccaaatctaaaagattttaacacaaacttatttggtgatcgatggtcatacacaaatgggttatccgccactcagcgtccacaagatatgaaaactgttttccactccattttaccatcacctcctcagtcttcagtaccgtctcctaccgtagatatatcacttgatctgtcagctctggcaaatttcccatcttttggggaatacgataagaaaatagtccatcaaatcaacacagagataaataaggatttggaaatcaaaattaaaacacagcctccaacgggtgtcttcttagccaatggtataagaaaaaaatgtttaatcacaaataaagaatgtcagtactttgatccaaggactggtgtgccttattctgatgtggaagcttataaaattattcagcggattcaagatcctatttctaaggaggagggaaggtcagatatcaagcgtgatgaaacgacaaatgaggatagtgacgatcaagtgagattcaagtggtttgggttcaaaaacggcggtatttaccttgatttaagtcaaagacctgcaaaaggtgttcctgaaggattttaa

SEQ ID NO: 4856 - DNA, 2391 bp, Saccharomyces cerevisiae
atgacgaaactaatcgctccttcagaaatcgtgggcggagtgcccgtcttcaaacccacatacgagcaattcgaagatttctatgcatactgcaaggccataaacaaatatggcatgaaaagtggtgttgtgaaagtaatcccacctaaagaatggaaagacaaattagatctgccttattctgcggaaacgctccaaaagatcaagattaaatcacctattcagcagcatatttctggtaataaaggtctttttatggtgcagaacgtggagaaaaacaagacctataacattatacagtggaaagatctttctaaggactatgtgcctccggaggatcctaaagcaagacgtaattctaggaaaggctccgtttccaaatccacgaagttgaaactgaaaaattttgaatcgtcttttaatattgatgattttgaacagttcaggacggagtatacaatagatttatctgacttccaaaatacggagagattaaagttcttggaagagtattattggaaaacgctaaattttactacgcctatgtacggcgcagatacaccaggatcaatctttcctgaagggctgaacgtttggaatgttgccaaactaccgaacatcttggaccatatggaaacaaaggttcctggggtgaatgactcctatctatacgctggtctatggaaggcttctttttcttggcacttggaagatcaggacctgtattccataaattatattcatttcggtgccccaaaacagtggtattcgataccgcaagaggataggttcaaattctacaaattcatgcaggagcaatttcccgaagaagccaaaaattgtcctgaatttttaagacataaaatgtttttggcttcgcccaaactgctgcaggaaaatggcatacgatgcaatgaaattgtccaccatgaaggcgaattcatgatcacttatccctatggttaccatgcagggttcaattatggatataacttggcagaatccgtcaactttgctttggaggagtggctaccgattgggaagaaagctggaaaatgccactgcatttcagactcagtggaaatagatgttaagaaactcgctaaatcttggagggacaataataaagagtcgaaaggaacgccacccctcaatcaattacccaatcctgccatgcccttacttcacaggccaactttaaaagaaatggaaagcagctcgcttagatctacaagcccagatgtgggtcatttttcaaactttaaatccaagagctctggtgtttcttctcccttattatcacgtatgaaagattattccaacattgtcgagcccacactagaagatccaactttgaaattaaaaagaatctcttcttttcaagaacagcccttaaacaaacttttgaaaagagaaacttcgcaaacggcgatgctcacagatcacgaagacaacatagtggccatgagccttacttcaatggcaaacagtgcggcgtcttctccgaggttgccactgtcaagattgaattcatctaatgaactctcaaatgcccaaccattgcttgacatgacaaacaatactcttgccttcccgcgacctaatggaccatctggattgaaccctttattatatatctctaacaagaatattagcgggatatctcactcggctccacattctccagtgaatccaaatatatcgctgataaaacgagttaagtctcccaacattgtaacattaaatatatccagggaatcgtcaagaagccctatagctctgaattacgaggcaagacaacaacattcgcaacaacattcattctccacaccatcaaccgtgtcaaatctctctacttctgtgctcgggccactgagtgacacaaacgacataaaaacaccgcaccctgaaagaccaaatcacaagacagcaaatagaatactcaaaaaggaatctcctgtcgagacatcaaaatcaaatcttatactttcaaaggttgcatccactcgccaagaggattcttttacaagccgaaatgacgatctggacaaagaacaaggctcttctccattaaactctaagtttgcgcccgaagaaatcgtgttatcaggtaagaacaagatttatatttgtaaggaatgccaaagaaagttctcttctggtcaccatcttacaagacacaaaaaatccgtccactctggtgagaaacctcattcttgtcccaaatgtggcaaaagatttaaaaggagagatcacgttctgcagcacttgaataagaaaataccgtgtatttcaaacgaaacaacagtagatgctccaataatgaaccctacagtgcaaccgcaggacgggaaagcggccattaatcaacagagtacacctttaaactga

SEQ ID NO: 4857 - DNA, 2391 bp, Saccharomyces cerevisiae
atggatttgttagcggccagcgtagaaagtacgttgaaaaatctgcaagataagagaaactttctttcggaacaaagagagcactatatagatatcagaagccgactggttagatttatcaatgacaatgatgatggcgaagaagaaggcgaaggccaagggatggtgtttggtgatatcataatttctacgagtaagatatatctaagtctaggctatgagtattacgttgaaaagaccaaagaggaggccatcacgtttgttgatgataaattaaaactaatggaggacgccattgagcaatttaacctgaagatcgaagaggctaaaaagaccttagacaacttgaatcacatggaggacggaaatggaattgaagaagacgaagcgaacaacgacgaagattttctgccctctatggagattagagaagaactagatgacgagggaaatgtcataagtagttccgttacccctacaacaaagcaaccatcacaatcgaattccaaaaaagaacagacacctgcagtcggtccaaaggagaaaggattagcaaaggagaagaaatcaaagtcattcgaagaaaacttgaaaggaaagttattgaaaaggaacgatgaagtaaagaaaaaagtgcagccatctaaagtagatacagaaaacgtgtatacatttgccgacttggtccaacagatggaccaacaagatgaattggaggacggctatattgaaactgatgaaataaattatgattatgatgcgttcgaaaactccaatttcaaagtcaatgataactatgaagaggatgacgaggacgaagatgaagaagagtatctaaatcattctattatacctggctttgaagcgcagtcctcatttttacaacaaattcaacgcctacgcgcacaaaagcaatcccaagatcatgagagggaagaaggtgacgttaataaatcattaaaacctattttgaaaaagtcttcttttgctgagaattcagacaaaaagcagaaaaagaaacaagtcgggtttgcatcttctctagaaattcacgaagtcgaaaacttgaaagaagagaacaagaggcagatgcaatcctttgcggtgcccatgtatgaaacccaggaaagcacaggtatcgctaataaaatgacatcggatgagtttgatggtgatttatttgctaagatgttgggtgtccaagaggccgatgaagtgcatgaaaaatataaagaggaactgataaatcaagagagacttgaaggggaagcaagcaggtcgaatagaagaactagggtgtccagattccggaaggatagagcttctaaaaaagaaaatacgttatcaactttcaaacaggaaacgacaaggtcagtggagaacgaggtagtggaaaaagagcctgttgtgggggatattatagaaaaagaacctgttgtgggggatgttatagaaaaagaacctgttgtgggggatgttatagaaaaagagcctgctgtcaccgatatagtggaaagggagcctgctgtcaacgatatagtggaaaggaagcctgttgtgggggatattatagaaaaagaacctactatcaacgatatagtggaaaaagaaccggaaattaacagcaagagcgagtttgagactccttttaaaaagaaaaagctaaaatcactgcaaaaaccaagatcatcgaaatcaatgaaaaaaaaatttgatcccaaaattctcgaaaatataagtgatgacgattatgatgatgatgacgatggtaataagaaacttttgtccaacaaaagtaaaaataacactgatgagcaagataaatttccttcaaaaatccaagaggtgtctaggtcgatggctaagacgggcgccacagtagggagtgagccggttagaattacaaatgtcgattatcacgccctaggtggaaacttggatgatatggtcaaggcatattcattggggttatatgacgacgatttagaggaagatccaggaaccatagtggaaaagctcgaggatttcaaagaatacaataagcaggtggagttgctgcgtgacgaaattcgagactttcaactagaaaacaagccagtgacgatggaggaggaggaaaatgatggcaatgttatgaatgatatcattgagcatgaatttcctgaaagttacacaaatgacgaggacgaagtagcactacatccgggccggctacaggaagaggttgctatagagtacagacggttgaaagaagctaccgcgtcgaaatggcaatcatcatcacccgccgcacacactgaaggcgaattggagcctattgataagttcgggaacccggtcaagacaagtcgtttccgctctcaacggctccatatggacagtaaaccataa

SEQ ID NO: 4858 - DNA, 2391 bp, Saccharomyces cerevisiae
atggtttgctgcttatgggtgcttctagcattgttgcttcatctcgatcatgtagcatgcgaagacgatgcgtactcattcacttctaaagaacttaaggcttacaagcaggaagtgaaggagctgttttatttcggcttcgacaattatttagagcatgggtatccatatgatgaggtaaaacccatttcatgcgttcctaagaagagaaactttgaagatcctactgatcaaggcaccaacgatatattgggcaattttacaatcactttaatagattctttaaccactattgctatactggaagaccggccgcagtttttgaaagctgttcgacttgttgaaaggacatttcctgatggcaatttcgatattgattccacaatacaagtttttgaaattactatacgtgttatcggatcactactatcatcacatctttatgctacggatcccacaaaggcagtgtatttaggggacgattatgatggctcactgttacgtctcgcccagaatatggcagataggctcttacctgcatatttaacgtctaccggattacctatgccacggagaaacatcaaacgaaaatgggatgtctctgaatttccagaatttttggagacagagaataatgtggccgctatggcgtctcccatgttcgaattcactattttatcttacttgacaggcgatcccaagtatgagaaagttaccagatacgcatttgataaaacatggtctcttagaactggtttggatttgctacccatgtcctttcaccccgaaaaactaacaccatatacgcccatgactggaatcggcgcctccatcgactcccttttcgaatacgctttgaaaggtgctattttatttgatgattcagaattaatggaagtttggaacgtagcatacgaggcattaaagactaactgtaaaaacgattggttttttgctaatgtaatggctgacacagggcatttgtttgttccctggattgattctttgagtgcttttttctccggtttacaggtgcttgctggtgatttggatgatgccatagcgaaccatttaatgtttttaaaaatgtggaacacctttggcggtattcctgaaaggtggaactttagtcctccggagtttcccccactatctccattagagcgatcgggagctgttgctttggataatatcctccccttagaatggtacccattaagaccggaattttttgagtcaacctatttcttatatagagctacaaaagacccgttttacttaaatattggggtacatctgctaaaagacctcaagcaacgatttaagtctaactgcggatttgcaggtttccaaaatgtaatcacgggcgaactgcaagatagaatggaaacatttgtgttgagtgaaactttgaaatacctgtatttattatttgatgaagagaacgaattacataacagcgctagtgacgtaattttcagtacagaagcccatccaatgtggttgccccaagaagtgaggtccaactataaacgtaacgctaaatttaacaactctgtctactcgtcgcacttggaaatttgccagaaaaaggacagggaacaagctggagagaacacattgagccaaagaattgtggggttcgccaaatcgatctttcataaaggtccaccagacgaagaggctactgatccaattatagactataccattgatactgaacttcccggtacatgctctataaagcctcatcatgtaattggtgacgaattttggtattctccaatgttgagcaattttgacagattattcgagattgactcccggttcgctgccacgctaattaaaccttcacacatgcataactataatgcaattgaactagaacctggattttataacaggtggtccaatccgcaatttagcacgtgcctgatcccacccaccaccgaaattttcgaactactattcgaccttcctggatatcatcagttgaatccattaatgttagaaaacaaaactattacatttgaaacctttggaggtaggtcaaggttgaagatcgaaaaattgcaaatctaccaaattgattactatggagacttaatcactgcatcgacattccaagacgtctcccgcaaggatattttctcgaatgcatgcgatgcagtggcaagcttgtattctcccacttatctttacagagtagtagccatcaacggacgcatattgcctcgccatggaagtgtacaaatcaagaaacatagtcctgtgctcacttccaatggcacaagagaggaagacgaattcaaaatggatggcatcgggattaatgaccattcccaactcatgttagaatgcacgcccatcatcaacttatttattgtatga

SEQ ID NO: 4859 - DNA, 2391 bp, Saccharomyces cerevisiae
atgtccgacaagatacaggaggagatattaggactagtaagcaggtccaacttcaaacaatgctatgcaaaactggggcaattgcaaaaacaatttcccaatgcgttgtacttcaagattttggaaacctatgttaaattcaagcagtcacctggtaagttcgattacaataaactgctagaagaaccatatgggctgaaagggacaacgattacgggcgacacgcgttccttggagtttttgcacaacttcttcgtagagttagggaaatacgacgaagcattgcacgtgtatgaaagaggaaatttcaaattccctagctacgaattgtcttatcactggtttatgaaagcattggaagattccaattataaccaaatgagcaaagcatctctacagctagctaaatacagtgacagtggaaacctgcctaaaagagcatattatttttggaatgcaatctcgattttagccgtatcaaggtttcaggaaaacactctttcagatcccaagaaaattttgctctccaggctagcgcgccagtctttgttagacttgaaaccatttcaaaatgttcaagagattatagtttattgtttggtgttggatgaactattccctcaatctagagaaatctcggaagagattgttgcgattacctttgccaattttgatacttcagtaaacttgtatttgaaaaactttatcttgaagcataccaagttattgaattctccacaaaaactttttgaagtttgttcaaaacttattgaaaagggccttgatgattatgaattgatcacaaacttgattgatgctgcctacaaactttctaaatctaaagacgaagtcaaacaatggattgatgaaaatttgggagactcaaggaatactcgattggcgcgcttgaaacttgatataatgtacaccgattcggtttcggaatcatctttgtcgtactatttatcaaagtaccataacaaaccttgttgttcaatcgatttgaatcattacagcggccacattaacatagatatgcttaagagcattatgtctaagtacgatccagaggataaggatttgattcatcattgtaatattctagaattgggacttattggaagcgactcaatcaataactataacaagtttaaggggaccctggaaaaaaaatcggtaacggattattcctcctgttctacattcttattagaaatagtcaaggacaagtgcaagaaaactaatcctgaattgaaagacgtgcttttgtgtataacgatattggaaaattaccaagccaaggaccctcataacttcgatactatgtgctggctgattgttttatacatgtacctgggtttagttcccgatgcttatttccatttcataaacctaaagattaaaaacgttcaaacagattccctagattacatgatattctcgagattttctactttgttcccgaataaacagagcgatttttactccaagacattccatgaacataataatttatacgatacatcactggctaatttaccaagatatattcaggtggcattcgaaagaaattcatatagcaaaatactaggaatgctcgagatgagggataaactaatgaaatcctatacaagatggaccaaaactttagaaaacttacagttctcacgtttatgcaacgacaagcgcggccacctactacaaaaattacacgaagattggagatctttagaaatgacgcaaagtgtatcattttctgacaatagagacttttccatattagatgaaaattttgcccaatttcttaaccgtggtaaaattttggaatatgctaacttgaatgaagaatcaatttttctaactttgataagagaacttattattgaagctttgccaaatggggagaaaacggaacaaataagtgcgctcttaaaaaaacttccatcaattaaccttgaagagttgttgaataataatttaactgaagtggagtcagcgtcatttctgatttttttcgaaatttacgaaaataacggtaaaaatctacatgatttaatttctaggttgatgaaagtcccaataaatgcaaaacaaaactggatggtatcccatacttaccttactaaaatggcaaccttaaaaacactagacagtttgaagagaatcaaagataaagaaattcaaaaactaatcaaaaactccctcaaggagttgaggagttgttgcgatgatgtatttaaaggttattctaaagctttagtacaagcatatgaagaattaaaaaaagatgaatgtggcaacttgttaaaagaacttgatgttaaagctgaaaatgtcaagaacattaaaaattcattactaggcatccaaaaaagtgtaagaaatttatga

SEQ ID NO: 4860 - DNA, 2391 bp, Saccharomyces cerevisiae
atgtccttctttgggttagaaaatagcggtaatgcgcgggatggtcctctggactttgaagagagttacaagggctatggcgagcacgaacttgaggagaacgactatttgaacgacgaaacatttggtgataatgttcaggttggtaccgactttgattttggaaatcctcacagcagcggcagcagcggcaacgcaattggtggtaatggcgtcggtgccacggctagatcatatgttgcagctactgcagaaggaattagcggccctaggaccgatggaacggcagcagcaggacctctagacctgaagccaatggaatctttgtggtctactgcaccacctccagcaatggcgccttcaccccaaagtacaatggctccggctcctgctccgcagcaaatggcccccctacagccaatcttgtcgatgcaagacttggaaagacaacaacgtcaaatgcagcaacagtttatgaatttccacgccatgggtcatccacagggtctcccacagggtccgcctcagcagcaatttccaatgcagcctgcgtcgggtcaaccaggtccctcacaatttgcgcctccacctccacctcctggcgttaatgtgaatatgaatcaaatgccaatgggtcctgtacaagttccagttcaagcttcgccttcacccatcggtatgtccaacactccttctccaggccctgtggttggcgcaactaaaatgcctctgcaaagtggacgcagatcgaagagagatttgtcgcctgaagagcaaagacgtttgcagattcgtcatgccaaagtggagaaaatcttgaaatactcaggtttaatgactcctcgtgataaggacttcatcaccagatatcagttgtctcaaattgtcactgaggacccttacaatgaggatttctacttccaggtctacaagattatccaaagaggcggtatcacgtccgaatccaacaaaggtttgattgctagggcgtatttggaacattctggacacagactcggtggtcgctataagagaaccgatattgccctacagagaatgcaaagtcaagtagaaaaggctgtcactgtggctaaggaaagaccttctaagttgaaggatcaacaagcggctgctggtaactctagccaggataataagcaagcaaacacggttctgggcaaaatctcttccactttgaacagcaagaatccaagaagacaactgcagatccccagacaacagccttctgaccccgatgcgctaaaagacgtcactgactctctgaccaacgtggacttggcctcttcagggtcctcctctacgggctcttctgccgctgctgttgcttctaagcaaagaagaagatcttcatacgcgttcaacaacggtaatggtgccacaaatttgaacaaatctgggggcaaaaaattcattcttgagttaattgaaacagtttatgaagagattttagacttggaagctaacttgaggaatggccagcaaactgacagcactgcaatgtgggaggcccttcacatcgacgacagttcatatgacgtaaaccctttcatttcgatgctatcatttgataaaggtatcaagattatgcctagaatttttaatttcttggataagcagcaaaaattgaaaatcctgcaaaaaatcttcaatgaattatcacacttgcaaatcatcatattgagttcctacaagactacaccaaaaccaactttgacacaattgaagaaagtcgatctgttccaaatgatcatattaaagatcattgtctcgtttttgtctaataactccaattttatcgaaattatgggtctgttgctacagttaatcagaaacaacaacgtttcgttcttgaccacctccaaaattggtctaaatttgatcaccattttgatttctcgtgccgcattaatcaagcaagattcatcaagatctaatattctttcctctcctgaaatctccacatggaatgagatttatgataaattattcacttcattggaaagtaagattcagctgattttccctccaagggaatataacgaccacatcatgcgtttacaaaatgacaagtttatggatgaagcatacatttggcagttcctagctagtttagcactaagtggaaagctaaaccaccagagaatcattattgatgaagtacgtgatgaaatctttgccactattaacgaggcggagaccttacaaaagaaagagaaagaattgagtgtattacctcagaggtctcaagaattagacacagagttaaaatctattatttataataaagagaaactataccaagatttgaatttgttcctaaacgttatggggttggtgtatcgcgatggtgaaatatcagaactaaagtaa

SEQ ID NO: 4861 - DNA, 2394 bp, Saccharomyces cerevisiae
atggtacagaacaatgaatcggtttttttcgttgaatgcgactcttataaggagagcccttccacttcaccaatacgcttggacgacctggatggaaatgacgctgtgtcggatcagggtttagctttcgacggggacgtaggaattacatcacaagctcgagtaagaaatcctcgagctcaaatcttcgaggatagtaatactgacgtagtattgcatttggatgatcttgatatggtcccactaaatacgaagttcgatatgcagatggagatgggttcacccatggcgatgccggcagaaacgccacctcctgtcgaacctttaaaaacaaaagatctagcatattcatccttggctcaccttcctagctatttctttgagcaaacacatttccgcatagaccgcaaatgcctgttggaaatgtctaagttaaggcgaaattatctaactataagtaaacaagatgctttgtcatgtccgcagcttcattcaagagtggctgggggttatcttaaacctgtaaaagaaaaattatttggaatacgtcactttcttgatctagaggaaagtaatactgtaaacctcctccaggatggtaattatatgacggaattgttcaacagtcagattaatatccccacttttaaagaatttagggaagattttgaatggtgcttgaaaattataagagatagaagcctatcaaggtttagcgaaaaaagattacaatatcttgtaaataagtttccagtttttcaacacctacattccaaggaagaaatgagacagagcaaaaaggtgccacacaaggatttttacaactgtagaaagattgatctgaatcttctgttaagcggctgtttctcacagtggcaattgactgagtttatttggaccaagttgagaaaagaaccggacagggttatccatcaagcttttaatggtagtcatataaccttgagccaattattcaaagtgaatttcgaggagaccggtcagttcttcaatgggttgaaaattattgacgattcatttttggagtggtataaagttatttatctcgcaaaatatcatttggttaacgatgaaatggaaatacacacaggctcacacggtaagcagcttcgatactatttgattgcgaaaacatttttggagtttgataactatattaatggtgaatacttagcggaactactgaaaacgtttttaataaaaccgcaagaggagtcgaaatatcagttatgtcaactctccgtggacttccaattttatctgcattacgataattccgatgtggacaattggtggatggtctttgccaattggctgaaccactataatatattttctaacaatattcgctggaatattcgcatttctagaatttatccagaactgtatcatactggcaaggtgaagaattttcaggagtatttaaatctaatcttcaaaccacttttcaatgccgaaaattatctacacaagtcattaggacctattcttttgaaatttctttctcaagtatcttcgattgatctatgtattcaagatacggacaactatatttggaaaaacttcacagcagttagttgcttgccaaaagattggacatctggcggtgataatccaaccatttcacaatatatgtattacgtctacgtcaacctaacaaaattgaaccatatccgccaagcccttcatcaaaataccttcactttgagaagttcatgttctcccacctcaatgaatcgaacttcacagtttagtaatacactgaacttcacagaacatacggaagctattttaaacaatttcttgctcgcctgtggagggtttctaaatgcagaaaatctctggaatgcaccaccatcactggtgtatcttttctatctaagtcaaattcccatggttgtggcgcctttgaattccatagtagattcaaagcctacaatgctgcaagaacaagccccgacggggcttgtcctagagccctcaaagccttataagaagaaccctttcatgaagttttttgaaatggggttcaagatatcgctgagctcagaatctatcctctacaacaattcgtatacgaaagaacccattatagaagagtatagtgtagcggctagtatataccgtttacattcagcagatttatgcgaacttctaagaaacagtgtcataaccagtggattttcaagtaccctaaagaacaaatggctcggcgtttccttagccagccatgactacttcgtggaaaacactgggtttgtagacaagtggtatgattgtaaaccaaatacaagtttagagcataacgttccgatcatcagacgtcaatatcgcagtagcactctcgcaggggagtggcgactcataattgcgtga

SEQ ID NO: 4862 - DNA, 2397 bp, Saccharomyces cerevisiae
atgaaaaaccctagcttcgactgggaaagattgaaagacgtattttatagaagcagagccattggcgaattaaaatggccaactcagtacgaggagttcaaatgtgccttgtcattaactgttatcgcggttgaaattcaagactttatacaagtatacaattattttgggcagctgttaggcaagataaatttgcaaagaattcatgaggatataataaagtttgagttcgataaagacgagaagctgatattggtcacgaaaagctccatcaaaattgtgaaaggttggtcgccactgacgatagaaagtgtcccattacaggacccaaccattgatactatctgggactatcacaatggaatcatgttgttagcaaaatctcgtgatatatacaagttaaacggaaatgaatgggaacttctttacgagaacaaagataaaaaatataatttattgacaaaaaaccactggagttgcaatgatgactccatcattttactggatgttgatcatgtatatcaagtaagcacctcgaacggggcactattgaagttaatcacagattcgtcgtggcacaaggtaacgatctcatctagaggatttatttgcctttataatatgaaggacaataaactgcagattttcagagatccagcaagaatactaatggaacacaacttggattctacaccagatgatatatgttggtgtggcaatgataccgttgcttgttctttcgaggacgaaatcaaattatacggcccagatggtttgtatgtaacattttggtacccttttactgtaactaacctaagggcagaggttgatgggttgaaggttattaccactgaaaagatttactttctatccagggtacaacctcagacttctaatatatttagaattggctcaaccgagcctggtgcaatgcttgttgactcatttagtttactggaggatcatgcacccaaagcaattgaaatattaaagaattttgtcttagagaagggtgtactggactgtattgctgctgcaatagacgaatttgaacctaaactacagaagatgttgttgaacgctgcatcttatggaaaagcttctttgcagtacaagtcatttgacgctagtatatttgtgaatgcgtgtaatacgataaaattattaaactgcttcagaagttttggtatttttttgactgtggaggaatacaggtgtatttctttgaaaggtgtcattgataggctgttgaagtatcacagatattatgagtgcatacagatatgcaaattggccaatgaacgatttctgttaggatacgtgtttactgagtgggcaaaggataaaatcaagggtagtcctgacatggaagatgatgagttactagacaaaatcaaatctcgactaagtgttatagatatgacggatacattacaaatggtagcagttgcgaaagttgcatatcttgaaggaaggttccagttatcccgtaatttagctttattagagaaaaacgaagaagctagaattgagcaactgtataatcttgatgatgatagtatagcgctaaaggagtgtatcaaagtacaaaattacagtctgacaatttcattactgattgcactttccaaaaagctgacaaactctcaactgacgaagcttttgatcattgatatgttcaacaatcccttatatctctattatatgagaatggataaagcatacttgtacgatttttaccgccaaactgaccgatttattgacttggctcacgtattactgcagcagggaaaagaacagcaatctttacacagctttttaccgcaaattaaggacctttatagccaagttcaaaacagtgaagtggtcaacaatacaatagaacaacttcaaagacaggaaaagttgtggatataccaagaatcattaggcaaaagatttgctatatcattcactaatatgactttagatcaaacgctttcgaagttaatagaaacagggcaagataaacaggtgaaagaaatagttaaaaagttcaaaataagcgaaaaaaagctgtatcacctgaaatgtaaaacgttagtcgaagctaagaagtttgacgaactactacagtttgctcagtcgcggaaatcaccaattggttacatgcctttctacacatacttaaaaagcagaggccatatggataaagctagtccttatgttaatatgatacctggcctttcgtatcaggaaaagaaaaagctttatgtggagtgcaggggttttcgtgatgcaattcaactagcaggaaaggaaaaagacattccaggcttaaaggagatatataatattataccacctaatgagccggaattaaaggcattagcaaatgaaactatgagcaggatatag

SEQ ID NO: 4863 - DNA, 2397 bp, Saccharomyces cerevisiae
atgtcacagaagcaaagtacgaatcagaatcaaaatggcacgcatcagccacaaccagtaaagaatcaacgaactaataatgctgctggcgccaattccggccagcagccacagcaacagagtcaaggccagtctcaacagcaggggaggtccaatggtccgttttcggcgtcagacttgaatagaattgtcctagagtacctgaataaaaagggataccaccgtacagaggccatgctgagagccgagagtggacgtacactaacacctcaaaacaaacaatcaccagcaaatactaaaacaggtaaatttcctgaacaatcatcaattcctccgaaccccgggaagacagctaaacccataagcaatccaactaatttgtcatccaagagagatgcagaaggtggtatagtatctagcgggcgactagaagggctcaacgcacctgaaaattatatacgtgcatattcaatgttgaaaaactgggtagattcgtcgctggaaatttacaagccggaactaagctacatcatgtacccaatattcatttatttatttttaaatttggtggccaaaaatcctgtttacgcccgtcgtttctttgatagattttctcccgattttaaggacttccatggctcagaaattaatagacttttcagtgtcaattctatagatcacatcaaggaaaatgaggtcgcaagtgctttccaatctcacaagtacagaattactatgtctaaaaccactttaaatcttctcttatattttttgaatgaaaatgagagtattggaggttcattaataattagtgtaataaatcagcacctagatccaaatattgtagaatcagtaaccgcaagggaaaaattggctgatggaataaaagttctcagtgatagtgaaaacggaaatggtaaacaaaatttagaaatgaattctgttcctgtcaagctgggacctttcccaaaagacgaggagtttgttaaggagattgaaactgaattgaaaattaaggatgatcaagagaaacaactaaatcaacaaactgcaggtgacaattacagtggagccaacaatagaaccttattgcaagaatataaagctatgaataacgaaaaatttaaggataatactggcgacgatgataaagacaaaattaaagataaaatcgccaaagatgaggaaaaaaaagagagcgaattgaaggtggatggtgaaaaaaaagacagcaatttatcttcgccagcacgtgatattttacctttaccaccaaagacggcactagatttgaagttggagattcagaaggtcaaggaatctcgtgatgccatcaaactagataatttacagttggccttaccaagcgtgtgcatgtatacattccaaaacacaaataaagacatgtcatgtttagatttcagtgatgattgtaggatagcggctgctggctttcaagacagttatatcaagatctggtcactcgacggctcatcacttaataatcctaacatcgcgttaaataacaacgacaaggatgaagacccaacgtgtaaaactttggtggggcacagtggtacagtatattcaacaagtttcagtccggataataagtatttactttctggttctgaagataaaaccgtcaggctatggtccatggatactcacaccgcgctagtaagctataagggccataatcaccctgtgtgggatgttagtttctccccgctaggccattatttcgccactgcatcgcacgaccaaaccgcaaggttatggtcatgcgatcacatatatccattaagaatatttgcaggacatttaaatgatgttgattgtgtgtcatttcatccgaacggttgctatgtgtttacgggatccagcgataagacgtgtcgaatgtgggacgtttctacaggcgactcggttaggttatttcttggacatactgcgcccgtcatttctattgctgtttgtccagatggtaggtggttgtccactggtagcgaagatggtattattaatgtatgggatattggtaccggcaaaaggttgaaacaaatgcgtggccatggtaagaatgccatttattccttatcatatagcaaagagggaaacgtacttattagtggaggtgccgatcatacagtccgtgtatgggatttgaaaaaggccactactgagccaagcgcagaaccagatgagccattcattggatacttgggtgacgttactgcatctataaaccaagatataaaagaatatggtcgcagaagaacagtaatacctacaagcgatttagtagcgtcgttctacaccaaaaagacgcctgtttttaaggtcaagttcagcagaagcaatttagcccttgcaggaggtgctttcaggccataa

SEQ ID NO: 4864 - DNA, 2400 bp, Saccharomyces cerevisiae
atgagtaccatttatagggagagcgactcgttggagtcggagccctcgccaacgccaacaaccattcctatccagatcaatatggaagaggaaaagaaagatgctttcgttaagaatattgacgaggacgtcaataatctcactgcgactactgatgaggaggaccgcgatccggaaagccaaaaattcgacaggcattccatacaggaggaaggtctcgtttggaagggcgaccctacatacttgcccaattctccatatcctgaagtgagatcggcggtgtccatcgaggatgaccccaccatccgcctcaaccactggagaacgtggttcttgaccacggtgtttgtggtagttttcgccggtgttaatcaatttttttccctgagatatccatcgctagagatcaacttccttgttgcacaagttgtttgctacccaattggtaggatactggctctcttgcccgactggaagtgttctaaagtgccatttttcgatttaaacccgggcccatttaccaaaaaggaacacgccgtggtcacaattgccgtggcgcttacttcctctactgcatacgctatgtacattttgaacgcccagggaagcttttacaacatgaaacttaatgtcggatatcagttcttgttggtttggacatctcaaatgattggttatggtgctgcaggtcttaccagaagatgggtcgtcaaccctgcaagctctatctggcctcagactttaatttcagtgtccttgtttgattcgttgcactcgagaaaagttgaaaagacagtcgcaaatggttggacgatgccccgttacaggttcttcttaatcgtccttatcggatcgttcatctggtattgggtacctggattcctctttaccggtctgtcctatttcaacgttatcctatgggggtcgaagacaagacacaatttcatcgctaacacaatctttggtactcaaagtggtctcggtgcgttgccaattacatttgactacacccaggtttcccaagccatgtccggctctgttttcgccacaccattctacgtctccgccaacacctatgcatcagtgttgatattcttcgtcatagtgctgccatgtctttattttacgaatacctggtatgccaaatacatgcccgtcatttcaggttctacttatgacaacactcaaaacaaatacaacgtaacaaagattcttaacgaggattattccattaatcttgagaaatataaggaatactcaccggtattcgttccattttcctatcttttgtcgtatgctttaaattttgccgctgttatcgccgtttttgtccactgcatcttataccacggtaaagatattgtcgccaagtttaaagaccgtaaaaatggtggcactgacattcacatgagaatctactccaagaactataaggattgtcccgattggtggtatttacttttgcagattgtcatgatcggtttaggatttgtagcagtgtgctgtttcgatactaagttcccagcttgggcatttgttattgcaatattaatttcccttgtaaatttcatcccgcaaggtatcttggaagcaatgactaaccaacacgtaggtttgaatattatcacagaattgatctgcggttatatgctgcctttaagaccaatggcaaacttattattcaagctatacggatttattgtcatgagacaaggcttgaatttgagtagagatttgaaattagccatgtacatgaaggtttcccctcgtttgatctttgccgttcaaatctatgccactatcatatcaggcatggttaacgttggtgtccaggaatggatgatgcataatatcgatggcttatgtaccaccgatcaaccaaatggcttcacttgtgctaatggtcgcacggttttcaatgcttccattatctggtctttgccaaagtatcttttctcatcagggcgcatttataatccgctgatgtggttcttcttgattggtttgctattcccactagccgtttatgctgttcaatggaaattccctaaatttaaatttgctaagcacattcatactcctgtatttttcacaggcccaggtaatattccaccaagcacaccttataactactcattattttttgcaatgtcattctgcctaaacttgataagaaaaagatggagagcttggttcaataagtacaatttcgtcatgggggccggtgttgaagcaggtgtggcaatctccgtcgtcatcatcttcttgtgtgtacagtacccaggtggtaagctcagctggtggggaaacaacgtttggaaaagaacgtatgataatgattataaaaaattttataccttaaagaaaggtgagacatttggttatgataaatggtggtaa

SEQ ID NO: 4865 - DNA, 2400 bp, Saccharomyces cerevisiae
atgagttataaagtgaatagttcgtatccagattcaattcctcccacggaacaaccgtacatggcaagccagtataaacaagatttgcagagtaatattgcaatggcaacgaatagtgaacagcagcgacaacaacagcagcagcagcaacagcagcaacagcagtggataaatcaacctacggcggaaaattcggatttgaaggaaaaaatgaactgcaagaatacgctcaatgagtacatatttgactttcttacgaagtcgtctttgaaaaacactgcagcagcctttgctcaagatgcgcacctagatagagacaaaggccaaaacccagtcgacggacccaaatctaaagaaaacaatggtaaccagaatacgttctcgaaggtagtagatacacctcaaggctttttgtatgaatggtagcaaatattctgggacatctttaataccagttcttccagaggtggctcagagttcgctcagcaatattatcaactagttcttcaagaacaaaggcaggaacaaatatatagaagcttggctgttcatgcggcaaggctacaacacgatgcagaacgaagaggggaatatagtaacgaggacatagaccccatgcacttggctgctatgatgctaggaaatcctatggcacctgcggttcaaatgcgcaatgttaatatgaaccctataccaattcctatggttggtaaccctatcgttaataatttttccattccaccatacaataatgcaaaccccacgactggtgcaactgctgttgctcccacagcgccgccttccggcgattttacaaatgtagggccaacccagaatcggagtcaaaacgttactggctggccagtctataattatccaatgcaacccactacggaaaatccagtgggaaacccgtgtaacaataataccacaaataatacaactaataacaaatctccagtgaaccaacctaaaagtttaaaaactatgcattcaacagataaaccaaataatgtcccgacgtcaaaatctacaagaagtagatctgcaacctcaaaagcgaagggtaaagttaaagccggtctagtggctaagagacgaagaaaaaataataccgctacagtttccgcgggatcgacgaacgcttgttcgccaaatattaccacaccaggctcaacaacaagtgaacccgctatggtaggttcaagagtaaataagactccaagatcagatattgctactaacttccgcaatcaagcaataatatttggcgaggaagatatttattctaattccaaatctagcccatcgttggatggagcatcaccttccgctttagcttctaaacagcccacaaaggtaaggaaaaatacaaaaaaggcatccacctcagcttttccagtagagtctacgaataaactcggtggcaacagcgtggtgacaggtaaaaagcgcagtccccctaacactagagtgtcgaggaggaaatccactccttctgttattctgaatgctgatgccactaaggatgagaataatatgttaagaacattctcgaatactattgctccgaatattcattccgctccgcccactaaaactgcgaattctctcccttttccaggtataaatttgggaagtttcaacaagccggctgtatccagtccattatcttcagtgacagagagttgcttcgatccagaaagtggcaagattgccggaaagaatggacccaagcgagcagtaaactcaaaagtttcggcatcatccccattaagcatagcaacacctcggtctggtgacgctcagaagcaaagaagttctaaggtaccaggaaacgtggttataaagccgccacatgggttttcaaccaccaatttgaatattactttaaagaactctaaaataatcacttcacagaataatacagtatcccaagaattgccgaatgggggaaacatactggaggcgcaagtaggcaatgattcaagaagtagtaaaggcaatcgtaacacattatctactccagaggaaaaaaagccgagtagtaataatcaaggatatgattttgacgccctcaaaaattcaagttctttgttgtttcctaatcaagcttatgcttctaacaatagaacaccaaacgagaattcaaatgttgctgatgaaacctctgcatctacaaatagtggcgataatgataacacattaattcagccctcatccaatgtgggtacaactttgggtcctcagcaaaccagtactaatgaaaatcagaatgtacactctcagaacttgaagtttgggaatattggtatggttgaagaccaaggaccggattacgatctcaatttactggatacaaatgaaaatgatttcaattttattaattgggaaggctga

SEQ ID NO: 4866 - DNA, 2400 bp, Saccharomyces cerevisiae
atggttcatcgaggaaggactttgaagtcagacactgatgtaacatctcttaatgcgtcaacagtatcacaccagtcaaagccatttagacagttttcgactaggtcgagagcaaagagtaacgcaagcttcaaaggtttgcgtagagttttaacacatgatggcaccctggataatgattattttaataagcacaacgtttctcagaaatgcaagagttctgatgcacttttcagaaagcgaacgattagtgggttgaatatgacagctttaacaagagtaaagtccaatcaaggaaaaagatcagcatcctttcatagtccggtgcataatacgctgctcagtccaaagaacagcagtcattctaatactggaactgctggtttcggcctgaaaccacgaagaagtaaaagtacccaatctgttctgagtcttcgagatgcgcaagaatctaaaaagagtgaatctactactgacgaggaggtggaatgtttttcggaagacaacattgaagatggaaaggtgaataatgataaagtaatagccgagcatgttatgcctgaagaaaaaaagaatgtgcagcaattaaatcagaatgaattacaatccccggattcaatagatgaacaagaagaagataaatcaggtactgatggaaaggaaaatcatagagctgtatccttaccattacctcatttatcttccaataactatttcggagaatcaagccattctatagaacatcagaaagatggagaaacatctccaagctcaattgaaacaaaactgaatgcaacaagtgtaatcaatgaagaggggcaatcaaaggtgacgaaggaagctgatattgatgacttgtccagccattctcaaaatttgagggcctcattggttaaagcgggcgataatatatcagaagcaccatatgataaagaaaaaaaaattcttgatgttggtaataccttagctgcacataaaagtaatcaaaaaccaagtcattcagatgaacagtttgatcaggaagatcacattgatgcccctaggagtaattcatcaagaaaaagcgactcgagctttatgtctcttaggagacaaagttctaaacaacacaaattattaaacgaagaagaagatctaatcaagcctgatgatatttcttccgctggtaccaaggatattgaagggcatagcttactggaaaattatgcgcctaatatgattctctcccagtcgactggagttgaacgtagatttgaaaattcatcatccatccaaaattcgcttgggaatgaaattcatgactcgggtgagcatatggcttcaggtgatacttttaatgaactggatgatggcaaattgcgcaagagcaagaaaaatggtggaagatctcaacttggccaaaatataccgaactctcagtctactttccccaccattgctaacatcggtagtaaagataataatgtaccacagcacaacttttcgacctccatatcgagtttaaccaataatttgaggagagctgctcctgaaagcttccatggttcaagaatgaataatatttttcacaagaaaggtaatcagaatctacttctgagatccaacgatctcaacaaaaattctgcagccccggcctctccattgtccaacgaacatattacatctagtacgaactccggtagcgatgcaaacagacaatccaactcaggtgccaaatttaatagcttcgcccagttccttaaatcagatgggattgatgcagaatcaagaacacaaagaaaattatggttgcagagggagaattctattatggacttaagttcacaaaatgacggtagtgactctatctttatggcaggaaacattgatgcgaaaagggagtttgagagaatatcccatgaatactctaatgtaaaaagattttacaacccattagatgaagcattgttgagagtacaacctataataacgggaaatgcaaataatatcaggaaaaaaagccataacgatgctcagtcaatcgcacattctagcagtgatacagatcataaggatgaggacgatttgctctttactaactatgacaaaaaatttgatgatctttatccacatcttgcaagtgcaaagattcaggcagtgttgtccggtatatggaaaagcgaaagttacttatttaacaaggatgttaatccaatcaacaagaataggacaacgagtacaaaccacagcgttggccacactgcttcacagaatgcacgtaacttgctgaggggcccgatgggttccagcacgactttgcaccaccaacgcgtcattaactctctgcagccgactacgagggcagtgaatcgcaggatggaaaatgtgggctacatgcatacacagccacaacaaaggtga

SEQ ID NO: 4867 - DNA, 2400 bp, Saccharomyces cerevisiae
atggttttgccgattctaccgttaattgatgatctggcctcatggaatagtaagaaggaatacgtttcacttgttggtcaggtacttttggatggctcgagcctgagtaatgaagagattctccagttctccaaagaggaagaagttccattggtggctttgtccttgccaagtggtaaattcagcgatgatgaaatcattgccttcttgaacaacggagtttcttctctgttcattgctagccaagatgctaaaacagccgaacacttggttgaacaattgaatgtaccaaaggagcgtgttgttgtggaagagaacggtgttttctccaatcaattcatggtaaaacaaaaattctcgcaagataaaattgtgtccataaagaaattaagcaaggatatgttgaccaaagaagtgcttggtgaagtacgtacagaccgtcctgacggtttatataccaccctagttgtcgaccaatatgagcgttgtctagggttggtgtattcttcgaagaaatctatagcaaaggccatcgatttgggtcgtggcgtttattattctcgttctaggaatgaaatctggatcaagggtgaaacttctggcaatggccaaaagcttttacaaatctctactgactgtgattcggatgccttaaagtttatcgttgaacaagaaaacgttggattttgccacttggagaccatgtcttgctttggtgaattcaagcatggtttggtggggctagaatctttactaaaacaaaggctacaggacgctccagaggaatcttatactagaagactattcaacgactctgcattgttagatgccaagatcaaggaagaagctgaagaactgactgaggcaaagggtaagaaggagctttcttgggaggctgccgatttgttctactttgcactggccaaattagtggccaacgatgtttcattgaaggacgtcgagaataatctgaatatgaagcatctgaaggttacaagacggaaaggtgatgctaagccaaagtttgttggacaaccaaaggctgaagaagaaaaactgaccggtccaattcacttggacgtggtgaaggcttccgacaaagttggtgtgcagaaggctttgagcagaccaatccaaaagacttctgaaattatgcatttagtcaatccgatcatcgaaaatgttagagacaaaggtaactctgcccttttggagtacacagaaaagtttgatggtgtaaaattatccaatcctgttcttaatgctccattcccagaagaatactttgaaggtttaaccgaggaaatgaaggaagctttggacctttcaattgaaaacgtccgcaaattccatgctgctcaattgccaacagagactcttgaagttgaaacccaacctggtgtcttgtgttccagattccctcgtcctattgaaaaagttggtttgtatatccctggtggcactgccattttaccaagtactgcattaatgcttggtgttccagcacaagttgcccaatgtaaggagattgtgtttgcatctccaccaagaaaatctgatggtaaagtttcacccgaagttgtttatgtcgcagaaaaagttggcgcttccaagattgttctagctggtggtgcccaagccgttgctgctatggcttacgggacagaaactattcctaaagtggataagatcttgggtccaggtaatcaatttgtgactgccgccaaaatgtatgttcaaaatgacactcaagctctatgttccattgatatgccagctggcccaagtgaagttttggttattgccgatgaagatgccgatgtggattttgttgcaagtgatttgctatcgcaagctgaacacggtattgactcccaagttatccttgttggtgttaacttgagcgaaaagaaaattcaagagattcaagatgctgtccacaatcaagctttacaactgccacgtgtggatattgttcgtaaatgtattgctcacagtacgatcgttctttgtgacggttacgaagaagcccttgaaatgtccaaccaatatgcaccagaacatttgattctacaaatcgccaatgctaacgattatgttaaattggttgacaatgcagggtccgtatttgtgggtgcttacactccagaatcgtgcggtgactattcaagtggtactaaccatacattaccaacctatggttacgctaggcagtacagtggtgccaacactgcaaccttccaaaagtttatcactgcccaaaacattacccctgaaggtttagaaaacatcggtagagctgttatgtgcgttgccaagaaggagggtctagacggtcacagaaacgctgtgaaaatcagaatgagtaagcttgggttgatcccaaaggatttccagtag

SEQ ID NO: 4868 - DNA, 2403 bp, Saccharomyces cerevisiae
atggcttctgtacctaaacgccatacatacggtggcaacgttgtcactgatagggaccgtcattctcttcaaagaaacaatgagattttgcatcctatacataaaaatcagcgaaaacatgctaccttcggaccatacataatcggttccactttgggtgagggagaatttggtaaagttaagctgggttggaccaaggcttcctcctcgaacgaggttcctaagcaagtggcaatcaaattaattagaagagatacaatcaagaaagatgccgataaagaaattaaaatataccgcgaaattaacgcactgaagcatttaactcatcctaacattatctatttagaagaggtcctgcagaattcgaaatacattggaatagtgctagagtttgtatctgggggagaattctataagtatattcaacgtaagaggagattaaaggaatcttctgcatgcagattgtttgcccaattaattagtggggtcaattatatgcactacaaaggacttgttcatagggacttaaaactggaaaatttattattagataagcacgaaaatttagtcatcacggattttggttttgtgaatgaattttttgaagataacgaattaatgaaaacttcttgtggttcgccctgttatgcagcaccagaactagttgttagtaccaaggcatatgaagcaagaaaggcagatgtttggtcgtgtggtgttattctttatgcaatgctcgctggatatttgccgtgggatgacgatcatgaaaatccaacgggtgacgatattgctagactgtacaaatacatcacgcaaacacctcttaaatttcccgaatatataacccctattccaagagatttgctgaggcgaatactggtacccaatccaagaagaagaataaacttacaaacaataaaaaggcatgtgtggttgaagcctcatgaagcgtttttgagcattcagccgaactattgggatgaacacttacagaaggaacgtccgaaaccgccaaacaaaggtgacgttggtcgccactcaacttattcttcatcagcatcttcgtactcaaaaagtagggatagaaactctttaattatagagtcgactctagagcaacatcgaatgtctccacagcttgcgaccagcagaccagcatcaccaacattctctactggttccaaagtggtgttaaacgatacgaaaaatgacatgaaagaatctaatataaatggcgagcgtactagtgcatcatgcaggtacacacgtgattcgaagggcaacggccagacccaaatagaacaagtatcagctagacactcatccagaggcaataagcacacatcggtcgcgggactcgtaacaatccctggctcccccacaactgcaagaacaaggaatgcaccatcatcaaagcttactgagcatgtaaaagattctagtcagacaagctttactcaggaggaattccaccgtattggtaattatcacgtgcctcgcagtagacctaggccaacttcatattatcctggactcagtcgtaacaccgcggataatagtttagcggatattccagtaaataagttgggttcgaatggtaggttgacagatgccaaagacccggtaccgttgaacgcaatacacgataccaacaaagctacaatctccaacaattccattatgctattatcagaaggtccggctgcaaagacttccccagtagattaccattatgctattggcgacttaaaccatggtgacaaacccataactgaggttatcgacaaaattaataaggaccttactcataaagcagctgaaaatggttttcctcgagagagcatcgacccagagagtacctcaacgatattagttacgaaagaacccactaactccaccgatgaagatcatgtagaatctcagctggagaatgttggccactcttctaataaatcagacgcttcttctgataaagatagtaaaaagatctacgaaaaaaaaaggttcagcttcatgtcgttgtactcatccttaaatggttcaagatccactgttgaatctcgtacctcaaaagggaatgcacctcctgtttcatctagaaatccatcaggacaatcgaatagaagtaacattaaaataactcagcagcaaccacgtaacctttccgacagagttccaaatcccgataagaaaattaatgataatagaataagagacaacgcacctagctatgctgaaagcgagaatccgggaaggtctgtacgggcttctgttatggtgtcaacactacgagaagaaaatcgatcggaattgtcgaatgaagggaataatgtcgaggcacagacttcaacagcaagaaaggttctgaattttttcaaaagaaggagcatgagggtttga

SEQ ID NO: 4869 - DNA, 2403 bp, Saccharomyces cerevisiae
atggggttctacaactgtagattcctgtccagacgtctatctgttgagccttgcagaataggtagcgccgctaaaagctatcaacagcgatcgatttatcactttggcgctgctctcacaaatgcccctagtggaagagaaacaccagacaagctacgttctgacctgcatagtgctttagagatggtcgatgaaatatatgacacaaattcgactgtagaggacattggaaacaaggaaaagggaggtcgacaaaaatatacggaagaaatggacaaggcgattaatctactgaaaacaaatataaagaaggagtatagacatgataagtatttggagcggacaaaggtaggaacgtatcctggtagaagaacatatcctggtaggagaacatatcccgctaggagaacatatcccgctagcagaacatattcagatagcaattcatacacttttcggataaatgtccagaagattaggcacgcattagtacgttacaatcaagatggtgttcaaaaacacaaccaaaagcctcctaggattggtcatggattaacgagagtgttataccaaccgttgtcgctacaaaaattgagagataataggagcagaatgtataattttgaccctgcagtggaaaatattaatccagagtatttggaaaagaaaagtgaaaaagatgtgaacacagactcctctggagaaggacaaagcaagccaatattcatcacaccccacaaagatgaatctctgttaaaggttgccaaagaacatagaaaaaagtacatatcttcatcaagttccatgacatcagtactttctcagttgcactatttattatccaatttcagaagattgaatatcattgattcctcgatatcgaaaaattttcctcaaaaaaactgcaattattcagaaagtgcatattttccgtcagcagtcattctgagaaagaagagaaatggcatttgttctattgattcagatagaagtctggatagggagattgtgctttctgtactaggtcattatcttgaagactttttaacggaaaagtccctgaagaatagttcaaaaagtgaaaattatcactattctagtatagatgaattcattgtgagatctcaattggacgcgtacgacccaaatctacctggaacgggtgtatttgatctgaagacaagagcagtttctgccataagatacgatttatcacatgtagagagtaataacaaccaaactggatatgagatagataaagtttatggggaatttgagtctttggaaagagaatattttgaactaatcaggtctgcccttctaaagtattctttgcaagctagaattggcaaaatggacggtattttcgttgcataccacaatatttctaagatgtttggattccaatatctacctttggacgaattagattatataatccattcttcgtataacagcaaattcgacagtttgttaaaggagaagaatgatatcacaaaagggatatatggtgaggaggactacattctacactatgacagggacgataggaaaattgcttgcttggtggctaatagggaatttaagatgtctatgaatctgttcagtaatattttgaaacacgttgagcagttacttaactcaagtaatacgaaatgggaaaaatgcaaaataatgcttaaaaccgaagttgaagaaaaacgatccaaaagtggccgcttctttaacgaaccggtgctaaatattgtagccctgccgttgtcacctgagtacgaggataaatctttattggtaaaggatacttcgaacgaacaattaacagaggagctactaaacctccgctcatataacgaaaatcttttggaggaacacctgaattccttagttggatttaaagtaaatgtcaagcatttctatcaccatcatcctaatactacacatctacctgattttgctttaaaaaagaacgatattctcgacaccgaatcccgtaaatatatttctgacatgatgaaacgagactggtacaaagatataccatctacacagactccaaactttttccacgcttccgatgtttccacttgggaggtgaactctacttttacagatatcaatgacaaacaaattttacgaaaactatactttaaatatttggatgttaaattaaacgcattgaaaaatcaagtaatcacacgtcaggaacctgatatgtctaaaaaggatgaaattatgaatcgaatcaaatcactacaagcccgcaatgatcaccgcgataatggaagtaacaaaagatattctaattttggccctacccgactgcaaactaaactgcgcgcatatgctaaaaaaggtgcccttcgaagaaaactattagaaaggagtaacaagttccatatctag

SEQ ID NO: 4870 - DNA, 2403 bp, Saccharomyces cerevisiae
atgttacaacggagatttatatcctccagtggtataaagagattacttcacagagaatcaaacaaggttatgcacactgttttctttaaagtacgatattactcaactgagttgatcaaaaaaaagcataaggaagatattgaggattgggttaaagcgcaactaaaagattcttcaacaataagcggtgtgtatgagtctcggaataaactcgattggatggactccattaccaaaagccccagcagcttagatattcttaagaatcaatataatatagtgaaagacaaagattttggaatattgtggaagcaaaaattcgaaagtgcagatccagatattttgatgacaataattagcctttccactaaccaaaaggttttgttttcaatacagcaattactgatcttaataaattctcttcactttttgaaaagggactacgatattggacaaatatacacaacatatgagcaattcacgcccttattagcaagccacactgataaaggcacatatggtcagttcatcgaaattatgttggtagtacagcataatttacatcattttgatgtctgtgaaactttatttgcagaatatatcaaatattgcaaagtaaagccacaaatgatatctttaggattaaactctttcataaggagtaataacactcaactagcggtggaattttacacgcaagcaattaccaatcctgatacatttccaataactgaaaagcagctttttgagtttctccgatgtatggaaagatatctagatatgtccagtatgaaacacatcttttatctctggttgaaagtgaaatgtggtgatgagcaatcctcttcaactaaccttccctcgttcaaaaccctcgcgataatacacagaatgttattacgtttttctaatacagatgagctaaacgattttttaaccaatcccgttgttttaagtacgggatatacatcaagtgtgcagtttgagttgattgaattttgtcattctctgtattgcatcaaaggagacagaacaaaaagcattgatgactcaatattgatggaaagagttgataaatttattaccagacttaataataatatttcaacacgaaaagagctatatatgtcagtggttcaagcgtacgtctctactaacaatttcgagaatttaaaagtaatcttggaaaaaatccagagagataatgatattagcatagacggttcgtttcatttgtgcatttctaggtattttgtcaacaccaatcaattcgaaggacttttcaaatattatcgcagtgtagttaaaaccactgatggtaaaacgcgattacggcccgcatttattcaacaattatggtcatgtgccgtaaatgtttatccaatgctggcaaaagaaattacaaatgacctacttgtgactctaaaaaggagccaatacagcaaatgtctcacttgggtgtacacatttttacaagaaaatgcccatatccatacgagaaagatcaatggaggagaagactcttcgttatctggtttcaacgcggttgattttgaaaggtttgaagagttcaagaaaaaagtttctcacaatgatgtatatggagcagaattggtgatttcgaatagtttgaaggagggcattgcgcctcaattttcatttttgtattccgttttggcattatgcttgagaaactctttaactggtttggcacgtgtagttgatgtgatattaaggaccagattccgctatatcccactaaaagtcgatatattatggttgaaatgggagatcatttctaattatagatcttttgaaaagttgtctgctgaacatttaaaagaactggaattcaaactgaaggaatttgaacgagtacatcaaaaggagctttcagttcaaaactatttacaacttactcaaatatgtttccacacccgtgatttcaaatatgcatgttacctaatttcacaagctagaaaaaatttggatacttcaaataacaaacagtggatgatgtattacatgacatctttaaagttggcgtcaagaatgcatgaaagcgaacggtttagtaggattttaaaagactggaattgtaatcatagggcaagcctgattactccaggttgcattagacaaatcaaaggctttatgaaatattttgagaaaaggcctgcttacatttcaactgctgcttccattgataacaaggagataaaggatcgcattgacgagttagtacttagatatgtggactataaataccaggggcttgagaatatgagaaagttaacacttttcttaaaagaatggtttgatgaagagatttcactattaaagttggagcaaaatgaaaggaaaatgaagctttttgaagagaataaaaaggaggaggagtaa

SEQ ID NO: 4871 - DNA, 2406 bp, Saccharomyces cerevisiae
atggcgagaagtagaaagaattcattggttcgagatattgcgtctcatccgactataccagaatctcagaccatagtgggtttactggacgattcgtacctttttgataagctaaaaaagctatctttggctgtggaaaattctgacagtctgcaaagaactgatgtctcagaaggttgttcagaggttaatggttctgaagctacgacttctgcggatgtaaaaaagacaaacaagtatttgtattatactacctatttggaccagttaaacattaagatagacgagtataaagttgttctggatcaaacacgccaggttaacgatcaattggatagttccatcaagaaatttcggaaaatctctcaggatactggagctttcattgaggaaacgaagacgatctatgaaaagcagtctaaattaagcaatctaactgagtcaatccctaaagctctccattattttgaagttttagaccctataatgcgtcgcttgaaccatgccacttctcccgctattgttaagaagagctcctttacgacaatgttggcgactatcgacgagtctttacgttttttggatgagaatagtgacctcaaggatgcggcagcgtacagaatcaagttcaagcaatgcttgatcagagcctgtgaattgatatctcactttttaacgaatctgttgaaacaaacaaatcaagaaattttggataaaaccaaaaacaaaaattcgttaactgggttgccgtcgactacaagagacgccttcttgtacagtaaattctataccatagctgatactttcaaaattcaggtttcggaaattgttaagagaagcaacgaaaaagcctacaacaagtatcacgatgaactgaattccattctttacgagtgtttcaaccactatttccaaacacgtttaagactgctaactccggtcatttggtcacacattgatgaaattgttgttaaagataaggaccagggcttggtcaaattcattcaagacggtaaggtttattttcagcagttatgcgcggacgaatacaaacttttcgtagaatttttccctgaaaaggaatgtcgtttcaagattaatcagtggttcttacagttatgtgaacccctttatgactccattagagtcagggttttgaaagagacagatatttgtactttgtgtgactcagtgactttgtttgctccatattatgaatttgaagaaggttcagaagaatacgtgaagcagtttaccgacattcagtatgataaactattcgaaccgattgtccaaaaagtgcaggctagattaattttaagagtgcaaatatatgtccaacaaaatattttgagctataggcccactagggacgttttcatgatttcaaatagaaggagaaaatcgaagaccagcttacaagggggtaacgaagatgctactactagtgatgacaatccagatcccttgttagaatcttatttatcttctttcaagaatagaagcatattgcccatatcccctaatgatgcagacgataaaagtattgattcagaagaatctactgataaaatttcacagttgcaaacatattatccgcccttgttaaagactttggctttattgtccaaaatttatgaaatgatcaattctgtggtatttgatgatttagctcaccatgtagtccacgactgtattgtatccttgagaaatgcctatgatatggttatcaaatcttcagcgggaaaatctgattttaacaacttagatatttcattagcgtacctaaaaaatttgttgatgttacgtgattccatacagaactttaatattcaatatacagttaatgaaacttatctggatttttctggtgttgaggggtttttcaaatcacttaaagaaaatggtagaaacgttttgaaaaagacaaagtcatcttcaatattgaccctggcaagagagctggttccaaaagttgtaaacaatatggtggacgcccgtacggaactcatatctgaattgagaaacgtcattaaagattttactgaaagcacttctttggagcttattgatgacactttagatatcaatagtgatgaagatctgttaagcaaaaacgtaaaattaagagagaatataaaggccagattaccaagaatatatgaacagatattgaactatatcgatgatcaagagattgttactaatttattagacgctgtgcaagagttaattacacaatcatattccaaatattatgaaactataactgaattggcagaaaatggaaagtttgctaaggatcaagtcgcagacgtaatgtacttggacgtcttcacagatttttttgccaaagaggtggcggatcttttaagaaatggtgatattgataccataacgaaataa

SEQ ID NO: 4872 - DNA, 2409 bp, Saccharomyces cerevisiae
atgagatttcttcaggtttataaatcatcggcattaattggactaataatattgttagccagtaaagtaaatcttgcagaggcaaaaaggaagctggtagccacatcattggtcacatgtatggaaaactcgcagctgtcagcaaatagttttgacgttgttttcaatccagacgacaggtcattacattatgatcttgatatgtcaactcaaattgattcatatatttttgctgatattgatgtctacgcatatggtttcaagatcattactaaaaatgtcgatctttgttcaatcaactggaaacagttttgcccggttcacccaggtaatattcagatcgactctattgaatacatctccagtgagtacgtaaatgaaattcctggtattgcataccaagtccccgatatcgacgcatatgccagggtcaagatcaccaacaatgtgagcgagtacctagcatgtatccaaatatacttctcaaacggtaaaacagtttctcagattggtgtaaaatgggcaactgcagtggtagcgggaattggtcttttactatctgccatcttatccacttttgggaactctaccgcagcctcacatatttctgccaacacaatgtcacttttcttatacttccaatctgttgtcgtggttgccatgcaacatgttcatcgagttccgcctattgcagccgcctgggcggaaaacttggtttggtcaatggggttaattagaatctcattcatgcaaaggattttccggtggtatgtgcaatccactggtggtacgcctagcttatatctgacttcaacatctatgtctgttttggctcaaagaagttggcaatatttgatggagctcccattaatcaaaagagctaccaatgttttgtatggtaatgcaaatacattaatttttagaggaatcaaaaggctaggctataaaatgggaatcgaaaatacgtccatcgtttgtaccggttttactttcttcgtcttatgtggatatgtgttggctggatttatcatagtattcaaatgctgtgtggagttagccacccggttaggatggatccaaaaggcaaggttttgggaattcaggaaacaatggagaatgatcttaaaaggtgctcttttaagatatatttacatcggtttcgttcagttaacaattctcagtttttgggaatttactgaaagagattcacctgctgttatcgtcatcgcatgcctttttattcttttgtcatgtgggttaatgctttgggctgcatggaggactgtttttttcgcaagaagatctgttgcattgtacaacaacccagcagccttattgtatggagatgaatatgtcttacacaaatacggatttttctatacaatgttcaatgccaatcattactggtggaacattgttcttttatcctacatttttgtaaaatcattattggttggatttgctcaggcttctggtcaaacacaagttcttttcatgttcatattggatttgttttacttcgttgctattatctactataagccctatctggaccgtccaacaaacataatgaatattttaattgctactgttactgtagttaattcctttctattcatgtttttttcggacttgtttaaccaaagctacaaagtggctgctattatgggatggatatttttcattatgaacgctgcattttcgttcattttactaatgatgatattggcattcgctggtatgatgcttttctcaaagaaccccgatctaagatttaaacctgctaaggacgatagaacttctttccaaaggaacactatgaaaccagaaggtactgttaatagatcagtagcgaacgagttgcttgcgttgggcaatgtggcaaaagaccatgacgacaattcagattacgaatcaaatgatactggtgtgaatgatgagctaaagcaagcacaggatgaaaccactcccacaaccgtaacatcaagtgatgataacaagcctacgttttcagagaaaatattaagtaaattctctaggcctaagaatgaaaacgcaagcacagatgctctgagagttgaagctccaaaacaacaaacgtttcctcacaacttaacgaatctttcacgagaaaacctatcaacattaggctctaaaccttatccaggacacacaagatcacagtctgatgcgcataatggactgatcaattcctttgaagaggaagatacaagttcaaataccgatccatttcacgactccactgaaggagaccttttagatacctcaagttcggacggaggatttaggtcgcaaaactatgttcgagatgacagcataaatagtttgggaaacaataaacaaccactgaggaaaccccctggattcttcgatgaaggatttatgtga

SEQ ID NO: 4873 - DNA, 2409 bp, Saccharomyces cerevisiae
atgctcaacattctcgttttaggaaacggtgcaagagaacacgttcttgtcaccaagctggctcagtcacccaccgtgggtaagatctatgtcgctccaggtaatggagggaccgcaaccatggatccttcgcgtgtgataaactgggatattacgccagatgtcgccaattttgctcgtttgcagtcgatggctgtggaacataagatcaacttggtcgttcctggtccagaattacctctagtcaacggcatcacctccgtgttccatagcgttggtattcccgtttttggaccttccgtcaaagccgctcagttggaagcttccaaggctttctccaagagatttatgtcaaaacacaatattccaaccgcgtcttatgatgtcttcactaatccagaagaagccatttcattcttgcaagctcatactgacaaagcttttgtcatcaaggccgacgggatcgctgctgggaaaggtgttattatcccatctagcatcgacgagtccgtccaagctatcaaggacataatggtcaccaagcaattcggtgaagaagcgggcaagcaggttgtgatagaacaattcttggaaggtgatgaaatctctctactcaccattgttgacgggtactctcacttcaatctccccgtcgcacaagatcacaagaggatctttgatggcgacaagggcttgaacaccggtgggatgggtgcctatgcccccgctcctgtggccacaccatctttgttgaagaccatagattcacagattgtgaagcctacgattgatgggatgagacgtgatggtatgccctttgttggtgtgctgttcaccgggatgattttggtgaaggattctaagacaaatcaacttgttcccgaagtgttagaatataatgtcagattcggtgacccagagacacaggctgttttgagtttacttgatgatcaaaccgatttggcgcaagtgtttttggctgctgctgaacatcgtttggattccgtaaacataggaatcgatgacacaagatctgccgttactgtcgtagtggctgcaggtggttatcctgaatcatacgccaaaggtgacaaaattaccttggataccgataaattacctccacatacacaaatcttccaagcaggtaccaaatacgattccgccaccgattctttattgaccaatggtggtagagttctttctgtgacctccactgctcaggacttgagaacagcagtagatacagtatatgaagccgtcaaatgcgtccatttccaaaattcttactacagaaaggacatcgcataccgtgcgttccaaaactcagaatcatcaaaagttgccatcacatacgcagactcaggtgtctctgttgataatggtaacaatctcgtacaaactatcaaagaaatggtcagatccacaagaaggccaggtgcagactctgatattggtggttttggtggtttattcgatttggctcaagcaggtttccgtcaaaacgaagataccttactagtaggtgctacagatggtgtcggtactaaattaatcattgcccaagagaccgggattcataatactgtcggtattgacctggtggccatgaatgttaacgatttggtggtacaaggtgctgagcctctattctttttggactactttgccactggtgctcttgacattcaagttgcctctgattttgtgtccggtgttgctaatggttgtattcaaagtggttgtgctcttgtgggtggtgaaacttcggaaatgcccggtatgtatccacccggccactacgatactaatggtaccgctgttggtgctgtattaagacaagatatcttgcccaagataaatgaaatggccgcaggagatgttcttctgggtctcgcctctagcggtgttcattctaatggtttctctttggttagaaaaattattcaacatgtagcattaccatgggacgctccatgtccatgggatgaatctaagacgttaggtgaaggtattcttgaaccaacaaaaatttacgtcaagcaattattgccatcaattagacaaagactactactaggtttagctcatataacaggtggtggtttagtagagaatatcccaagagctattccagaccacctacaggcccgcgttgatatgtcaacctgggaagtaccccgtgtcttcaaatggtttggtcaagcaggtaatgttccacacgatgacattttaagaaccttcaacatgggtgttggtatggttttgattgtcaagagagaaaacgtcaaggctgtttgtgattcattgactgaagaaggtgaaattatttgggagcttggttctttgcaagaaagaccaaaggatgctcccggttgtgtgattgaaaacggaactaagctttactaa

SEQ ID NO: 4874 - DNA, 2409 bp, Saccharomyces cerevisiae
atgtcagatgaaaaccataacagtgatgttcaagatattccttcacctgaactatccgtcgatagtaactctaacgagaatgaattgatgaataactcaagcgcagacgatggaatcgaatttgacgccccagaggaagaaagagaagccgaaagggaggaggaaaatgaagaacaacacgaactggaagatgtgaacgatgaagaggaggaagataaggaggaaaaaggagaggaaaacggggaagtaataaacacagaagaagaagaagaagaagaacatcaacaaaaaggcggaaatgatgatgacgatgatgataatgaagaggaagaagaggaagaagaggatgatgacgatgatgatgatgacgacgatgatgatgaagaagaagaagaagaagaagaagaagaaggcaacgacaacagttcggtaggctcagatagtgccgctgaagacggtgaggatgaggaagacaaaaaggataaaaccaaagataaagaggtcgaacttcgccgtgaaacattggaaaaagaacaaaaggacgtagatgaagctataaaaaaaataactcgtgaagaaaatgataatactcactttccaactaatatggaaaatgttaattacgatcttttacaaaagcaagtcaagtacattatggacagtaacatgctaaatttgcctcagtttcaacatttacctcaagaagaaaagatgtctgcgattttagcaatgttaaattcaaattctgacacagctctttccgtacctcctcatgatagtactatctcaacaacagctagcgcctcagccacaagcggcgcaagaagcaatgatcaaagaaaacctccattgtcagatgcccaaagacgtatgagatttcctagggcggatttatctaagccgattaccgaagaagaacacgaccgttatgcagcctatttgcacggtgaaaataaaatcaccgagatgcacaatattcctccgaagtcaagattattcattggtaatttgccgctaaagaacgtttctaaggaggatttatttaggattttctctccatacggtcatatcatgcaaatcaatatcaaaaatgcctttggattcattcagtttgacaaccctcaaagcgttagagatgcaattgaatgcgagtctcaagaaatgaactttggcaaaaagttgatcctggaagtttctagctcgaatgctcgtcctcaatttgatcatggtgatcacggtacaaacagtagttctacttttatttcttccgcaaaacgaccatttcaaactgaatctggtgacatgtacaatgacgacaatggtgctggctacaagaaatccagaagacacaccgtttcttgcaacattttcgttaaaagaaccgcagatcgtacgtatgccattgaggttttcaacaggtttagggacgggactggtttggaaactgatatgattttcttgaaaccaagaatggaactgggaaagcttatcaatgatgccgcatataatggggtgtggggcgttgttttagttaataaaacacacaatgtagatgttcaaactttctacaaaggctcacaaggtgaaacgaaatttgatgaatatattagcatatccgctgatgacgcagttgccatttttaataacatcaaaaacaacagaaataattctcgtcctactgattaccgtgctatgagccatcagcaaaacatatatggcgctcctcctcttcctgttccaaacggcccagctgtcggacctcctcctcaaacaaactattaccagggttacagtatgcctcctccacaacaacaacagcaacagccatatggtaattatgggatgccaccaccatcccatgaccaaggatatggttctcaacctccaattccaatgaatcagagctacggtcgctaccagacttctattccaccaccacctccacaacaacaaattcctcaagggtatggtcgttatcaggctggtccgcctcctcaaccaccttctcaaactccaatggaccagcaacaactattatctgccattcaaaaccttccacctaacgttgtatcgaatttgctttcaatggcccaacaacagcaacaacaacctcatgctcagcagcaattggttggtttaatacaatcaatgcaaggccaggctcctcaacaacagcaacaacagttgggtggatattcctctatgaactcatcctctccccctcctatgagtaccaattacaatggtcaaaatatatctgcaaaaccctctgccccaccaatgtcacaccaacctccgccacctcaacaacaacaacaacaacaacaacagcaacagcaacagcaacagcaacctgctggcaataatgttcaaagtctattagatagtttagcaaaactacaaaaatag

SEQ ID NO: 4875 - DNA, 2412 bp, Saccharomyces cerevisiae
atggcgttggaagaagtggtacgatacttaggacctcacaatgagatccctttgacactcactagagactcggagactggccatttcctcctgaaacattttctgcccattttgcagcaatatcatgacacggggaatattaacgagaccaaccccgatagtttccccactgatgaggaaagaaataaattactggcacattatggaattgctgtaaatacagacgaccgaggtgagttatggatagagctggaaaaatgtttacaattattaaacatgctaaatttattcggtttgttccaggatgcattcgaatttgaggagcctgaaacagatcaggatgaagaagatcccagccattcgaaactaccagaaaacaagaccaaaagtgaaaattctaaggataatatcagctcaaagaggattaataatttacaagatatgagcctggattctgatgcacacagagaattaggctctcctttaaaaaaactaaaaatagatacctctgtaatagatgctgagagtgactccactccgaatactgccagaggcaagcctaacgatgatattaataagggccctagcggcgacaatgaaaataatggcactgatgacaatgacagaaccgctggacctatcataacattcactcatgacctaacttctgactttttaagcagtccactgaaaatcatgaaagcactaccttctccagttgtaaatgataatgaacagaagatgaaactagaggcattcttacaacggttgttatttccagaaattcaagaaatgcctacatcccttaataatgacagcagtaatagaaattcagaaggggggagctcaaaccaacaacaacagcacgtatcatttgatagccttttgcaagaggtaaacgacgcttttcctaatactcaattaaatcttaatattcctgtagatgagcatggaaacacaccattacattggctgacttcaatagcaaacctggaattagtgaaacacctggttaagcatggttcaaacagattatatggtgataatatgggggagtcatgcctagtgaaagctgtcaaatcagtaaataattacgactctggtacttttgaggcacttctagattatttatatccatgtttaattttggaagactcaatgaatagaacaattttgcaccatatcattattacgtctggtatgactggctgttcagcagctgcgaaatattatttagatattttaatgggatggattgtcaagaaacaaaatagacccattcaaagtggtactaacgaaaaagaaagcaaaccgaatgacaaaaatggggaaagaaaggactctatactagaaaatttggacctgaaatggataatagcaaacatgctcaatgcgcaggactctaatggcgatacttgcttgaacattgcagcaagattgggaaacatttcaatagtagacgctttattagattacggtgctgacccatttattgcaaacaaatcagggttgagacccgtggattttggggcaggtacttcaaaattacaaaatacgaacggcggtgacgaaaactcgaagatggtctctaagggtgattacgacggtcaaaaaaatggaaaggccaaaaaaataaggtctcaactgttgaaaaacccacctgaaacaacttcgttaattaatgatgtccaaaatttactgaattcaatctcgaaagattatgagaatgaaacagtgcaatataatgagaaattagaaaaactacacaaggaattgaacgaacagcgagaagaattagctaattctagagaacaactagcaaatgtgaagcaattgaaagatgaatactcactaatgcaagagcaattgaccaatttaaaagcaggaattgaagaagaagaggaaagttttagggaagagagcaaaaagctaggaataattgcagatgaaagttcaggtattgattgggactctagcgaatatgatgcagatgaacccttcaaagtagagttcctttcagatttcttggaggataaattacaaaagaattatgaaggcgatatttccaaactattagaagcggagtcgaaagagcagataatggaacagatacgaaatcaacttcccgcagaaaaaatccaatcgatgcttccaccaacggtcttattgaaggcaagaataaatgcatacaagcggaatgataaacacctaaccaatgtattggatacaatcagcaccaaacaatcagaattagagaataaatttagaagagtgttatctttatgtttgaaaatcgacgaaaataaagttgacaatatgcttgatggtttgttacaggccatatcttctgaagacccacaagacattgacactgacgaaatgcaagattttttaaaaaagcatgcttcatga

SEQ ID NO: 4876 - DNA, 2415 bp, Saccharomyces cerevisiae
atgatgttttggtcctcaaagacgggtatcacgtcaaaatattcattttcatcatcacctactttcacagctgaaccatggagcatttacaccggtcgtcccaaatcttcatcttcatcttcaccttccaaagtatcgatattcatgtttgacaagaagcagttcgaaaactatttgttacactatggtattattaaatccaaatctggatccagagataaagtattaatacaagaagcgtacgaaatattaagaaaccaggccaataacttggccaagctcaagcacccaaatattctgactttaattgaaccattagaagaacatagcaagaatttcatgttcgtcaccgagtttgtcactagctcattggagaccgttttcagagaaaccgatgatgaagagcagaatttcttacaaggtcatgttaaagataatatcgtggtacagcgaggtatattgcaactggtaaatgcactcgattttgttcataaccgcgcaagctttgtacacttgaacattcaacctagggcaatatttatcaatgaaaattctgattggaaaatttccggcttaggctatttagtaaaaataccaccaggcacaaatacctctgaatacttcttacctcaatatgatcccagagttcccccatttatgcatttacaattgaattatacggccccagaaattgtttttgagaataccctaacctttaagaacgattatttttctttaggattgttgatatattttctgtacactggtaaagacttgtttcgcagcgaaaattcgactagtgaatataaattggagtacaacaagtttgaaagcaaaattagtacaatgtcatgggataatatattcagtaaggttccacaaaagttgaggcattgtatacccaagctaataaacagagacatctattccagatatgataacataacgttgattttagattctgagtttttccaagatccgttagtcaaaaccttgaattttttagacgatttacctaccaaaaataacgaagaaaaatacgtattcttagagggtctcgtgaatctgctgccagagtttccgccagcattattgcaaaagaagttcttgcccattttattggaactattaagtcagttttgtgctgagaaggtcgtaagtgataaatgtgtgggtaaaagtttggatttgataatcaagatagggtccactttatctcagttgtcctttcaagagaaggtttatccagttttattgagtgatgcgaactttccagtattattaaaaaaagccaccatctgcctgatcgataatttagacacattgaagcaaaaagttaaacgctctgatttcttggaaaatatactcaagccgctatttaattatgttttacatgactccgaaagtgacattaccgtggtttgtcaagaaaaacttttatcacaaattccgttagctttagaggtacttgattttcctaccgtgaaacaattcttattaccattactatccaatctatttacaaagacaacaagtttaacggtgaaaaacacatgtgttacgtgctttcaaattatgatagagcataaatccatcgattcttatacttgctcagaaaccgtcttgcctttgtttaagtccatgaaaacaagagatccaagaattttatctaagttattgaagctttttgaaacggtgccgttgatcattactgatgaaattgttcttgttgaccaagtactgcctttgatgtggaattattctatggcttcaacgctaacaaagtcacaatattcaggatatacaaaggcaattaacaaaatgtcttcagacatccaaaagcaccatatcgccaaattggatgataaagtcaatgatattggcgaagatgcctttcacaaagtcattgaaccaacaatcatgaagaaggaggaccctgagacagttgcagctaaaaatattgaagtagcagccatgcaaccagttaaaaaaaagactgggtcctcttatggggagacattaccacaatctaaaagtattttaaactccaaacccctaaatcctaaaaatgcccttgcaactagaggctttccaacaaggattctaaactcccctccacagaccccatcaagtcgaactggttcaaaagttatgaccaaaggtggctccaacgacgcttcgagcactaaggtggaagaggaattcaatgaatttcaatccttttcaagcacagggagcatacgtcaaacttccgcaccatcagacgtctggatgaacagtacccccagccctaccccaacatccgcaagtagtaccaatttaccgcctgggttctcgatatccttgcaaccaaacaaaagaaaggatggttcttctgatattccccgaagtaatgtatatggatctttgatataa

SEQ ID NO: 4877 - DNA, 2415 bp, Saccharomyces cerevisiae
atggctgcgggtcaaaaaaaatatatatgttccttttgtttgaagcctttctcgagatccgagcacaagataaggcatgaaaggtctcatgcgggcgtgaagcctttccagtgccaagtctgtaaacactcttttgttagacgcgatctcttacagcgacacatcaggactgtccacagaaccttcctcttatccagttacgcgtcaatgacaggcgataaggctgatatccctgtatcacttggcgttggtgacgttgattcgacttcacccagagatatcaaaatggaaacactcgttaattcgatgattaaggtcaacagcggccttatcaatattcactatcatagtagtaatgttgaaaaaatggataagcagcaacgttgtgtgattgggaaggagtcctctagtttaaagaaagggaaaagccgctttaagcaggttaaaagccggttggagtcctccatcagtgtaaaaattttgcaagaatattcattagattttattagctcaagagatattctaactttcttcagaatgggtgtaagccacttggtagaaaataagatcttccaaaatttctttccagacctgttctcatcactacaaaatgacgagctggtggaaagtttttggattaacaagccttttggtctcataatagcttgtctgggtatgtccatttcgttaaatcaagattctcaaaaactatggtttatctgttgtacgaatttgtatgctagctcatctaaacatgacaatgactttgacactgaggacattttgtcacagacagagcaacatgatgtttttgccttgattctattttattctcttctagtaatgttggagaataacattcctgtttctaattccattaaaaagttcgatgtgttttcaatgcttcaagatattctgaagccattcaccgtggcatcctccagttaccattatttgaatagtaaggaaaatgcatggttcatattcgatctatgggtcaatatcttgcgcgattcaaacaacttcaacaacgattctttactaatatttggttggttcgtcaatcaagagtttatttcgtctaatccacttaaggacttcatatacaagggaccgtcaatgtccactactgacttaactttaaagcatatcaatattttggcagattccgcgtacgtgtattttataataaagaagacttatccgcaagagctgccatctgattttagagtgcatgatttgctggtttacttgaatgaatgtttcgtaatgcagcagccgatcaaacctgaaactagtgcaaacccctctttatttgcgaacgttatgaacgccaggattacggactgcaaatcgaaaagtaactggttattgtgggaaacgatttggttcgaattcatcaacaacttgactttgagaaatgggaccacaaggaacatatggttcattgataactttccacaggtatcgacctcgtgcttacttcatcattcttcctcatttgttgatgaaaccttgatcaccacgaacttatcaatcatatcaatgcttcttaatttgaagtctttcacgctggcatctttaaacccaaggaatattcagttaattaccgacattgtcagcttccaactaaaattgttttcatcggagttaattgcaagctcggatgtttcaccatcacaagtatctcaattactagtaaaccccaatgttcacctaatgttatatttctggttcgataccatttatgtacaacgtcagagctacctttcatcaacagagaaagaggaatttgagaaggttgaagtgtttgtgaatgactacattataacacaccaaaagaacttggtgacagacttacactccattttgttcgatttttggtcagattccttcattgcttaccatatactactgcatgctattgtatcttcattaagagataatattctttacccatacttaatctactcccctcacctgaatgaccagacgaaagcattgttgactgatatctctaattggtcttgttttgctcttcaacagccgtttcgcaagacttcaagaggttctttatctggtgcttctgatatgaaatcgttttcagtagcatcatgtttgccactctctcctaatttcctaaagagagattcaaactgtaataagattctcctgcccccattagatataaaagccattgaacctatctcaacgagtaattacacctacgtgaactcggcccctaagcaacaagagaaggaacaaccattgttaagggcaacaggaaacaatatcaatttagtccaaacaatagtggtcccaccccaggtaaacatggaatcacaagaattctcagcttcttcaactgacaataaacaaagtaaaaacattgaaatttttagccaaataaaataa

SEQ ID NO: 4878 - DNA, 2418 bp, Saccharomyces cerevisiae
atgaacgtgcctgaaacaagacaatcctccatagtcgtagctataagagtaaggccctttacgtcaatggaaaaaacaagattggtcaatgaagctagtggtgcagaagctaactttcccggtttgggggattcgtcgttaatattacccatgagtaataactccgactccgatatagacatagacgctgaagaaggttctacgcggagcaaaagaaatagcttgctgaggagaaaagtaattagaccggagggtatacgtaaaattgtggattgtgtggatgatagaatgctcatattcgacccagctgatagaaacccattgaacaaagtgagtgatcaggtcctgaactcgatgcgtgcaagggccactaaggccactgcgtcctctatcaataacagcaatgctacgaacaaattttcttcgcaacgtcgaaggcacggtggcgaaatcaagtttgtatttgataaattgtttgatgaaacctcttcccaagcccgtgtatacaaagagaccaccagcccgctcctagattctgttttagatggattcaacagtaccgtatttgcttacggtgctactggttgtggcaagacatatactgtgagtggcacaccttcacagccggggatcatatttctagccatggaggaactattcaataaaattacagacctgaaggacgaaaaagacttcgagatttcactgtcttacttggaaatatacaatgaaagaatcagagaccttttgaaaccagagacaccatctaaaagattggtcattagagaagatacgcagaaccacatcaaagtggcgaatttgtcgtatcaccacccaaatacggtagaagatgtgatggacttagttgtccagggaaacataaacaggactacgtcaccgacggaagcaaacgaagtatcttcacgatctcatgcagtgctgcaaatacacatcatgcagacaaataagcttgtagacttgacctcgcaacatacatttgctacactttcaataatcgatctagctgggagcgaaagagccgccgcaacaagaaaccgtggtataagattacacgaaggtgcgaatataaatagatccctactagcactgggcaattgcattaacgcgttgtgcttgaatgatggcagcagaagctgtcatattccatacagggattccaagttaactaggctgttgaaattttcactgggtggcaattgcaaaacagtcatgattgtttgcatatcgcccagcagttcacattatgatgagacattgaatactttgaaatatgcaaatcgtgctaaagaaataaagaccaaaataatcagaaatcagcagtctttgagtagacacgttggatcttatttgaaaatgattacggaacaaaagcgacaaatcgaagagttacgcgaacgtgaagagaagatgatttctttgaagctaacgaaatacaaactaaacaaagaaaagatccagttagccattaacgagtgcgtcaatcgtgttcagcaaacgtatgcaggagtggaaacgtatcaagtagccaagaccttgaaatcattaatactttgtaaaaggcggtttttgcaaatggtcaagctagaagtggataatttgatactattatttgaacgggaggaaagtacagccgccgagatgcagccggtgattagtaattgccgaatgatcagtggtcagctttataacaaaatacacgagttagaaatgaaatttgatgaaaccgacactctgagttccgtcattcatcaggtacattccattgacttgaacaagttaagagagatggaggactgggatgaaacttacgacctggtgtacttggagtcgtgtttaaatcaaatatcagaattacaaagaaacgaaatcttggttaattcctccataatgacagaaaaattaatgtcagatccgggtttgaactcccgatttaaatttctatcaaagtggctgatgaataggacacctaacattgaatccataattcaagacctggttcatatcgacgaggagtttgaatcttttgccagaacttttatcgccaatcccgatagcaattttacaaacacaaatataaatataataaacacgacggcagctgacttggctgttcccgctgagaccctacaacggcaaaatttttcccaaaaaaaagtaaagtggacgagtcccgaccttagtcccagccctatgattgaaccacaaccggagctagaaccagaactacaccaagatcaagacgccattgcaagtgaagtggacgtaagtatgcaagataccacattcaatgagcaggggccctcgaccccctccgctccgactacagcggttccaagaaggaagatgcgctcctcccttcttactcatcaaagtctactggccactgccaggaaataa

SEQ ID NO: 4879 - DNA, 2418 bp, Saccharomyces cerevisiae
atgggctcagaacaagccttaagtgaggttgtcgaatctgctaaagagcggttcggcaggcttaggcatttagttcagaagtttcttgatgatgacgacgtgccacaagagtgtctgcctttgctccaagaatgcgcagaaatatggtctagttatgtggacgcatgccaggatataaccatgcaggcccctaaagaagatgcaaaccggttgtcaaaggggtttctccgattgaatgaaacagcttttttatattacatgatcgtatatacgctcttggaggatactctaccaagactaaaggaattttcgagcaacaaggaccagaatgttagaaatttgtacggggagagaatccagcttttgcataatgacccaaatattgagcggattcgaaatgtcattgaaaattaccctaaatttatacagttgcaaactatagagcctggaaaattaagttcaatgttgcattttcatggtgacgctctcttgcttatcgatgtacggcccaggtctgaattcgttagggcccatatcaaatgcaaaaacattatatgcatcgatcctgcctcatttaaggattcttttacagaccaacaaattgaaagtgtctctttgatcacttcgccgcactcagatatcactttcttttcaaatcgagacaagttcaagttcattattttatatactgacactcaattgcataataatttccagcaaaggcaaactcgcatccttgcgaagattctttcccaaaattcagtaattaaaccgctgagtgggacgaaaatactcattttggaaaatgggttctcaaactgggttaaattaggtggggcgtatcaatcatctgtcagtgaaacagcgcatcttacatcctcgtcttcaacgccagcttttggtagtccgcaagtcccaacaggcttgttcaatcagaaatctctatctccaaataaagataagagtatgccgatggtatccatgaatacgcagcctttgctaacaacggtgcaaaggcctcaattacccttatactattcagatttgcccattataccgcaaccaagccccaacagaaattctcccaccgttcaaaaatttagtccacatccaccaaccactctctcaaaactcaatacaccctcgaccattcaaaataaagcaaacactgtggaaagaatatcgccagatatccgcgctgcacaagcccatgcctatttgccccctgcatcgaatgtattctcgccacgtattccgcctttaccacaacagaacttgtcttcgtcgaggcagaccatcctaaacaactcacaagtgcttgatctagatcttatagtaggattggaaaatataggtaactgttgttatatgaactgtatacttcaatgtttggtgggaacacacgatttggttcgaatgtttttggataacacatatctgaattttattaattttgatagttcaagaggttctaaggggttgctagctaaaaatttcgccatcttggtcaataatatgcacagacacggtgcattcacacctcctaacgtaagaacgataccagttcagactattcagtttaaaaaaatttgcggccatatcaaccccatgtatagtgattcaatgcagcaagattgtcaagaattttgtcaatttttgcttgatggcttgcacgaggatttgaaccaaaacggcagcaaaaagcatcttaaacagttatcagatgaggaagaacgaatgagagaaaaaatgtccatacgcaaagctagtgctctcgagtgggaaagatttttgcttaccgacttcagtgcgataattgaccttttccaaggacagtacgcatctaggctacaatgtcaagtttgtgaacatacctccacaacttaccaaacattctctgttctttctgttcctgtcccacgcgttaaaacttgtaacatattagactgtttccgggaattcaccaaatgcgaaaggttaggtgtcgatgaacaatggtcatgtcctaaatgcttaaaaaagcagccttccactaaacaactgaagattactagattgcctaagaaactaattattaatttgaaacgatttgacaatcaaatgaataagaataatgtgtttgtccaatatccttactccttagatcttacaccatattgggcgagagattttaatcatgaagctattgttaatgaggacattcctaccaggggccaagtaccaccatttagatacagactgtatggggttgcatgtcattcggggagtttgtatgggggacactatacttcatacgtttataagggaccaaaaaaaggttggtattttttcgatgactcgctttatcgtcctataacgtttagtactgaatttatcacacccagtgcatatgttttattttacgaaagaattttttga

SEQ ID NO: 4880 - DNA, 2418 bp, Saccharomyces cerevisiae
atgtcttcagatcccttgcagcaagtttgtgatttaataaagggagatctatcacttgaaagggtacgagatattaaggaacagttgctaaaagaaaaatccgttgtagaataccaattgaataaagaatcagacaaatactatggcgaagtcgaagaatccctcaaactactgaatctgtccaaaaattcggtcacttcaatcaaacaacaaatcaatgaagttaataaattgggtaatgataatcgatttgcaattaatcgttatgatatacttttccgagccacaaaactttatgaaacggtcaatacgacatcatcgatttatgatcgaatatataactttgttgcactaatggagcatatagaaagactattagtggcggaattagcggaagatgccctggaaactggttgtccccatcttttggaaattcatttcctattaacttcagcacgcgactttcaagagcaggttgttgttatggctaaagaagcaactgaagatgcacaacgtacagtcatgaaattgttttcaagattatccggaataatatcaaaatttgataaattgctggacggcttaacttacgatattgtagaaatggccagagctgagcaaatatctttagcaattcgactttttaaaatttatgacctagaagaaagggaagatttgagaattgaagctatcagaaatataatcaagaagaaagaaattgaaatagaaaaatcctcaattaaaaaacttccaaatagcaaaaacaccgcaaggttacaagatgagacacccaaagttatagaatatccgacaaacaagggattataccaagaaataatgagcggtaccatctcaacaagaacagcacctcgaggttacaagcattttctaataaatggtataaataattccatttctgaaatgtttggtgaaatgagagaaaaatacgttggtgatcaaaaatttgatgttcttgataacatggattggattttcaacgaattgattattgtaaaggaacatattgccaactgctgtccaccacattggaacatatttgaagtatactttgaccaatactataaggaattgcattcattaattacggatctcgtggagtccgaacccgagaccattattattcttgatattcttgcattcgataagacgtttcaagatacacttaagcaagattttggatttaccaaaagcgaagtcaaatctgtcatcggcgataaagaaaaggaaacactatttaaagactatttgaatttgatagtggttaaaatgaccgagtggataggtaatttagaaaaagcagaatttgatgtattcttggaaagaagtaccccgccacattctgattcagatggattgctttttcttgatggtactaagacttgttttcaaatgtttacacagcaagtggaagtggctgcaggtactaatcaggccaaaatacttgtgggtgtggttgaaaggttcagtgatctactaacaaagaggcaaaaaaactggatttctaaaataagtgaagaaatcaaaaagcaaatcaattacaatcacaagtatgatatagatccagagagtataactcctgaagatgagtgtccaggaggtttggtggaatacttaattgctgtatcaaacgaccaaatgaaagctgcggactatgccgttgccatttcatccaagtatggtaaactggtttctaaagtttatgagaagcaaattacaaatcacttggagggcactttagatggttttgctgaagttgctcagtgcagttctttaggcctaatcacattgatgttcgatgatctgagaaaaccctaccaagagatttttagcaagacatggtatatggggagccaagcgcagcaaattgcggacacactagatgaatatcttttggatatcaaacctcagatgaattctgtgctgttcgtgaacttcatagacaatgttattggtgagacaattataaaatttttgactgctttatcgttcgagcattcattcaaaaacaaaaacaataagtttttagaggcgatgaagagggattttgaaattttttatcagctctttgtcaaggtgctggatggtaatgaaagcaaggatacgctaattacacaaaattttactgtaatggagttcttcatggacctaagctgtgagccgatagatagcatattagatatttggcaaaagtatcttgaagtatactgggactcgcgcatagatttactggtaggaatattgaagtgtaggaaagatgtgagtagctcagaaagaaagaagatcgtacaacaggctacggaaatgttacatgaataccgccgtaacatggaggccaacggtgtggatcgcgaacctactttgatgaggcggtttgtattagaattcgaaaagcaataa

SEQ ID NO: 4881 - DNA, 2424 bp, Saccharomyces cerevisiae
atgaactcatccaataataacgactcgtccagctccaatagcaacatgaataactccttgagcccgacccttgtgacccacagtgatgctagtatgggctcgggtagagcaagcccagacaatagccatatggggagaggtatatggaatccatcgtacgtaaatcaaggctctcaaaggtctccacagcagcagcatcagaatcatcaccagcagcagcagcagcagcaacaacaacaacaacagaattctcaattttgctttgttaacccttggaatgaggaaaaagtaactaattctcaacaaaacctggtgtatccccctcaatacgatgacttaaacagtaacgaaagtctagatgcgtacagacgacgtaaatctagtctcgttgtacctccagccagggcacctgccccaaatcctttccagtacgatagttatcccgcttacaccagctctaatacgagtttggcaggaaatagcagtggccagtatccttctggctatcaacaacaacaacagcaagtataccagcagggcgctatccatccttcccaatttggatccagatttgttccctccctttatgatcgtcaagatttccaaagaaggcagagtctggctgcaactaattattcgtccaatttttcttccctaaattcaaatactaatcaaggaacaaactccataccagtcatgtcaccttacaggaggcttagcgcatatcctcctagtacaagtcccccactacaaccccctttcaagcagttacgaagagatgaagtacaaggtcagaaattgtccattcctcagatgcaactttgcaactctaaaaacgatcttcaacctgtcttaaatgctactccaaagtttagacgtgcgtcgctcaattccaagacgatatctcccctagtcagtgtcacgaaaagcctgattaccacatattctttatgttctccagaatttacctaccaaacgtccaaaaaccccaagagagtacttacgaagcccagtgaagggaaatgtaacaacggattcgacaacataaacagtgactatattctttatgtaaatgacgttttgggtgtagagcagaacagaaagtaccttgtgctagacattttgggtcaaggtacatttggtcaagtggtcaaatgtcaaaatttgctgacgaaagagatattggctgtaaaagtggttaaatcgaggacagaatatttgactcaaagtataacggaggctaaaattttagagctactgaatcaaaagatagaccctactaataaacatcattttttaaggatgtatgactcctttgtccacaagaaccacttatgtttagtgtttgaattactaagcaataatttgtacgaattattaaaacaaaacaaatttcatgggctctctatacaacttatcagaacattcaccactcaaatactggattcgttatgcgttttgaaggaaagcaaactgattcattgcgatctgaagccagagaatatcttgctctgcgcacctgataagccggaattgaaaattattgattttggctcatcttgcgaagaggcaagaaccgtttatacatacatccagtccaggttttatcgtgctcctgaaattatactgggtataccgtattcaaccagtattgacatgtggtcgttaggttgtattgttgctgaattatttttgggtataccgatcttcccaggcgcttctgaatataaccaattaacaagaataatagacacgcttggatatcctccatcgtggatgatagatatgggtaaaaactctggaaaatttatgaagaaattggcaccagaagaaagttcttcttctacacaaaagcatcgtatgaaaactattgaagagttttgcagagaatacaatatagtggaaaagcccagtaaacaatattttaagtggagaaagttaccagatattattagaaactacaggtatcctaaaagcatacagaactcccaagaacttatcgaccaagaaatgcagaatagggagtgtttgatccactttttaggcggtgtgctaaatttgaacccgttagaaagatggacaccacaacaagctatgctacaccccttcataacaaagcaggagtttacaggtgagtggtttcctccaggatcgtctttaccgggtccttcagaaaaacatgacgatgcaaaaggccagcaaagtgaatatggaagtgcgaacgactctagtaacaatgcaggccacaactatgtctataatcctagctctgccactggtggtgctgatagcgtcgacattggtgctatcagtaaaaggaaggagaatacatctggcgacatctccaataattttgctgttactcattctgttcaagaagggccaacaagcgcgttcaataaacttcacattgtcgaagaataa

SEQ ID NO: 4882 - DNA, 2424 bp, Saccharomyces cerevisiae
atgatggctaagaacaacaaaactaccgaggcaaagatgtcgaaaaagagagcagctagcgaagaatctgatgtcgaggaagatgaggacaagcttttatccgttgacggtttgatcgatgcggaagcaagtgagagtgacgaggatgatgacgaatacgagtctgccgttgaagaaaaggaatcatcttctgataaagaagcccaagatgattctgatgatgactccgatgctgaattaaacaaactgcttgccgaagaagaaggtgatggggaagaggactatgacagttctgagttttcagacgacacaacttccttaacagacagattatcgggtgtgaaattgcaaacgatcgttgatccgaatatttactcaaaatatgcagatggcagtgatagaattatcaaacctgaaattaatccagtttatgatagcgatgatagtgatgccgaaacgcaaaataccattggtaatattccactttctgcatacgatgaaatgccacacattggatacgatatcaacggtaaaaggattatgagacctgccaagggttctgctttagatcaactgttggattctatcgagctacctgaaggctggactggtttactggacaagaattccggttcaagtttgaacttaaccaaagaggaattagaacttatttccaaaatccaaaggaacgaacaaactgatgatagcataaatccatacgaaccgttaatcgattggttcacgagacacgaagaagtgatgccattaactgctgttccggagccaaaaagaagatttgttccatccaaaaacgaagccaagagagttatgaaaattgtaagagctatcagagagggccgtattattcctcctaaaaaattaaaggaaatgaaagaaaaggaaaaaattgaaaactatcaatacgatttatggggtgattctacggaaacaaatgatcatgtaatgcatctaagggcaccaaaattacctccaccaactaatgaagagagttataatccaccagaagagtatcttttgtctcctgaagaaaaggaggcctgggaaaatactgaatatagtgaaagagaaagaaacttcatacctcaaaagtattctgccttaagaaaggtccctggttacggtgaatctattagggaaagatttgaaagatctttggatttatatttagctcctcgtgtccgtaaaaacaaattgaatattgatcctaattctctaattccagaacttccctctcccaaggatttaagacccttccctattcgttgctcaacaatatacgctggtcacaaaggaaaagtacgcacattatccattgatccttctggattatggctagcaacaggatctgatgacggaacagtcagggtatgggaaattttaactggtagagaagtttatagaactactttaatcgatgacgaggaaaacccagattaccacattgaatgcattgaatggaatcctgatgctaataatggtattctcgccgttgctgttggtgaaaacattcatttaatagtaccaccaatattcggctacgatattgaaaataacggcaaaactaagattgaagatggttttggctacgatacttttgggactgttaaaaaatctaacctagaagtgaacgagaatggtgatggcgatgaagatggagagaatgaatctgctaagaatgctgtaaaaaaacaagtagcccaatggaacaagccttctcaaaagcaactagaaaaggatatttgtatcactatttcttgcaaaaaaacagtaaaaaagctttcatggcatagaaaaggtgattactttgtcactgttcaacctgactctggtaacacttctgttttgattcaccaagtttccaagcatttaacccaatccccattcaaaaaatcgaagggcattattatggatgcgaagttccatccttttaaacctcaattatttgtctgttcccaaagatatgtcagaatttatgatttatctcaacaaatattggtcaagaaactgttgcctggtgcccgttggttatcgaaaatcgatattcacccaaggggtgataatttaattgcgtcatcgtttgacaagagagttttatggcacgacctggatttggctagcacaccttacaagacactaagatatcatgaaaaagccgtcagaagtgtgaatttccacaaaaagttacctctattcagctctgccgctgatgacggtaccatacatgttttccatgccactgtttatgatgacatgatgaaaaatccgatgattgtgccactaaagaaactaaccggtcataaagtaatcaatagtctgggtgttcttgatgctatttggcatccgagggaagcttggctgttttctgccggtgctgataatacggctcgcttatggaccacctag

SEQ ID NO: 4883 - DNA, 2424 bp, Saccharomyces cerevisiae
atgccagatttgaagtccaagaccttgtcaagccaatctttgggagcggctattcctccagaaattgtgtaccaaatacttacataccagtttagggatttgttaagaaatgaccatccaggtacggcagaaaagtttaacgaaaacttaactacatttgtcaaaagtaatttaactgttaataagacattctcccatatttgtcaagttctcatttatagatattgtaatttaactaccgcaaagagatttcacggtcttttacagactttaaagggaaatagatgcctttgcaataagattgaagtagccgatttccaagaattaacgtctattggactggggaggtccagtgagatgaataaaatgattaaaaatctaactaacgaaactcttcttgagtttctaatgctcacaaaagcaaacttaagggaattcttagcatgtgaaaatattcaagacgatttagacgataatatcataaagtatattctatctccaggaaaagtcttgagtgtagtggatttctgtggctgttcaggcaccactttcacagaaagttttattaaggccctggataaatactaccctaataaatcgattgatcagtaccggctggaacctattcaacaaaattatcagattacctgcttaggcctaaatgattgtattgatctaccatcacacgtcctttggaagatcttaaaaatgttaccagaactacaaaaacttgatttatctcatacctccattgatgatagtaccttatatcacggcatacctcactggaaaaatttaactcatctttccctcgctacttgtcttcaagttactccaagagcggttctggagttttttagtcatcacccaacaattacagaccctgacaacacttctacattagaatggctgaatgttagtgtcattgcccattcctcatcttggaatgaggtgcacacaatgtttttactaaaaaaactttgtcaacatggccataacaaaactttgcaatatctaaatatcggcggtttaccgcttcatgttgcaccttctttcggcgaggaccctattagcgaatccacttattattaccaatgccgcgatagcttacagttcataaagtggaattttccgaagttaaaaagtttgagtataaaaggtaatagtatcccgatatctacgctcgtagaatttttgacaccaattgatcaagaccatcctaattgtgctcaaaaattgaagtttttgaatatttctggtaactcttatgtgaataaatggactattcaggactcattattgtacacttgttctccaagtttagtcgcgttagaagtttcctttgactcgtggcaacagattgaaaaactaaatgatagacatgaaattattgcatacagatataaaaacccaaattcggtaattaaagatatttcaacagcagaacaagtaaagtggaaatgttacattgattcttcttatggtaggagatattggttatataagactgatcctttcctgaatcgtgatgacttggattctaagtcaaatttaactaggtatgattttgagggtcacaaaatcatagaaattataaaccagccggatttcctaaagtttgcccaaagtaaaatcatgcttggatgtggtctagttcctcaaagtggtattagacgtaaactatgttacagagatttaaagccaccagtttctcaattcttaaatagaaaaggtgcgatcagccttggtgatactccactaccaataattaccccaacattacctcgtggtgggtggagaatcatccataatgaggacgacaacaacagtcatgtggaagatagccaaaatcacgtgaatgccatcccaagaaggaattctctgttgagcagacccactttaagaagcaacaatggttcttcctctgccaacccctttgctatcaatgtttctcctgcatctcaaatcagggatggtttgtactgggataggtcggtccatgatttacgtgagctatcattgcaagaacaaagaattcaggagttagctgatgagcagcaggaactaagaacaatcgcaaactttgaagagactgacgacgaatatttgcacgatcccgacttgcaacggagaaggtcccaacttcacttatttgaaagttcgcgctcacgttcaggaaataaaacaagaccaagtttaactggtgaacactcgtcctcggcatcgtttctatccttctcccacttcaaccaccttcacaagcgtaagaattattatttcacgcatcccgatgaatttgtctatgatccaaaggatcctctgacgactcaaagatatagattacattttgaaatagtcaacgaatatcaagtttttgggtgcattgagcgtggaatgtatagatactacagtttaaaagcatag

SEQ ID NO: 4884 - DNA, 2424 bp, Saccharomyces cerevisiae
atggttttggaagtgccctcaatcacacctggtgaactgcatgatcttatgcgactacatcaggatgcagaatggcctgaatgtaaaaaaatgttcccctgggctcatgatatttcctttggtcaaccacccgattttcctcattctcttgcaatagtcaaatcgcaatcagatgctaacaattctgcgcttttgcgtaattctctcgaagtgaatgatatcttccagtcctggaaagttcgcacttcctttcatagagagggcgatacctgtgaaactggaaatgattctaatggttttcaatatcccaataacacaaaggaacttttgaacttgctaaagtttcagatacgacaattggaattgcaagtggatgatgttgctttggaaaacgctgctacttattgtcacaatcatagcattttaccatttctgaaagtagatcctcgtggactatcattagaacttaaaaggtattctagaaacaaggttgggtctaataccacgctaaaacggagtgggcaggacgtctggggaaggagaggtctattccgaaggttcgacctgcaatgtgccaagatgatagaaatggttgataatatagtaatttattgttcgcggactggtggcagcactgatatgcaaacagaatcagcgccagcgtgctcacacgagggaaattgccccaattgtacaacccttgcactacttttacagatctgtttaatgtttgttcaaaagggttatgtagggagtggaggatcgctttacaagacgaatctttttatttgcacttatcagaatttcaatacagatatacctcaaactttgattggtacacctttattagacaacgaatttttcaagaataatactcccttgaatttatgttcgtcacctagtgaaatagtgtgtttcaataacgttgataagaatatggttttgtgcgagaagttagagttgaataagctgacttcagctacacgattggaggaaacagggttgatttgcggtaacaccactgattggcataattatcaaataattaaaaaaaacaatatatctctgacccaccgtttcgaagagaatacaagcatagtaaatttaaagtctctaaattatgatacggacaatccgacaacctccatttctcaactgtataacataccgaatacaaaagaggtgtggaaattgatcataaaatgtacgtcaaactcgcaaatgccgtcgttaacgaaaatccgaacatatctagatcttttattagacgatgatgcgtcaaaatcacaagagcatttgcatttgactttccctgcctcaggtagtataggtttggggaacttaaacattcagtctgtggaaattcttttgaatgtttgttatttaatatttcaagtatcccaagttcaagaattattgacgttcatgtattgcgaagacggatatacagaaacgtcattattattaacagcttatattatattccactttaatattccgttacaagacgctcttttgaggatccatccaagaccatttttcctttttccatcagacttgcaaattttaggccatttacaacctgtcctgcgggagtttagtccgcagaatggaagtaatctaaaattatatgccaatgcattgaaatttagggataaaagctttcaattacacatttcttcagagctttttagtagcatattttttatgaagattcctcttgagtctaatttcgttaatttgaagggcccactgccatcccggattctacgtcacttgtatttgggatccctggatcatgcacaaaatcctgccttacttaagtctctaggaattacgcatatagtttctgtcggtgaagttgtttcatggacattgaataaggataaaattgctcatcctgtaaggccacatcgtgcaataactatgacgaataccaatgaagttgcaggtaatactacatgtaataaaagcagaaatagagctgatactgtggtcagcgataagcaagaaaatggcagcaacgtagtaataagtgaaaattctggatttcaaatttgccagatcgaaaatctagatgacaacggcaaagatccgcttttccaccaaatagacaaagttttggattttattagcaattccgaagcaacaggagggaaagttctggtgcattgtatggtcggagtctccagatctgcaacagtttgtatagctgaatgtatgagatatctccagtgtgacctggcaagtgcgtatttgtttgtgagggtacggaggcttaatgttatcattcaaccaaacttgttcttcgtatatgagctcttcaaatggtggaaaaagcattataatcgcgaaaaagacaaaactatggattggcacatcatctgtaggggtatcgctgaggttaatatgaagtacacatga

SEQ ID NO: 4885 - DNA, 2430 bp, Saccharomyces cerevisiae
atgaggagcagttatcaaccagtgtcaactacaaactttgaacatgaaaatgctatacctactgcgtcgtcgtcccataatctgttgatgagccagcgttttgatgattctcctcctagttctaacgacaacagtatagaaactaatataacgcctccacctgaaccaccttcttatgaatttgatatagaggaccctcacgatgatcttcacaaaagaacacatctacagagggtttcaattgggtttcaggaaaaaattttggaacccttaatggaaaacatcattcatccactcttacaaatatcaaaattcgttccagacaaagctgactattacttaagtaaaatcggaaatccctttatacttcgaaggttcttttacatcattttcatgtcatttattgcatattatgtcttgtcaagtggctacttattcaacgaaaaggcatcaggatctaaagggatgttttctcaacacgatatactttttgaatatgccaaaaaatccgtggatttggcaaagtttgagagagatttggaatatattagtagcatgcctcatggatccggaacgaagggtgatgcagctatttatcgatacattcaggaatcttttgacaacaatgggttgaaattggttaaagaaatgggatactcagtttattctaattatccaggcaatgtatcaatttcatattatgataacaagaatgaaaagcatgatctagaactttctaaagaaaatttcaatccgttgagttctaacgggaaattatccaaagtgagcttgatttatggaggcaaaggtacaacatacgatttacaacatttaaaagattcgaaaacgatagaagatgggaaggactatgtgcttttactgcaatatgataaattagtgagtcagcaagtactaattgctgagaaattcggagctaaagctgtaatcttcatatctgagccatatggtgagaatatagacgttgttcaatctaagcctgtaggattgccccaatattcgactggtgatgcatcaggattgaattgggatggttctcctgtagaagaaaaggatcataaattttggcgtcaaactcatattccaactatcccaatctccacgagacaaggaaaagagctactatcgcgtttatcttcaggaggagtaacggttgatgatggtaatagtgatcgtagtaacagtgggaaaatgggagacgtattgatcgatgtagatctgcaaactaatgttagggaaaagcattttattcctaatattgttggtaaaattgaagggagagaacaatcagacaaagctataataattgctgcatcgagaaattccatcaattttggaactacttatcccaattttggtacagctgcattattatctatagttcaattattccaagaggtgaaatataagtttggttggaaacctttgagaaatatctatttcatctcattcggtggtaccgaatttaattatgctggatcttcggagctggttgagcaaaggctaacgccattaaaagacgaaatttattctttgattgatattagtcaactgggtataccctttgccgaaaaatatgagaacggtaaaactagaggagaattaagcattgagacacatcccttattgaagaagtttttcaatagaaacgcgcatggaaactttgatatatctgtggataatgtacagcactatggtgactggactccatttctggcaaatggaattcctgtatctgtaatatcttctgattctacgagaaaccgtgacaccccaactgaaacatctgaggataaatttgaacgtgttgagaagattctggaagacgaacagaaccaacaatctgtcaaggatttgctagtatatcttttacatattagtatggaattgattgatgacccgctacttcattttgacataataagctatgttgaagatatcgatgaaagattgcaaaggttagagcaagcataccctgaaaaactaaacttcacatcaataatcaaaggtttgttattttggaagaaaatcggtagcgaatgggcgtcatggactcaaggttgggagaacatagtatggtcgcatggggatggtatagagccctccttactttcaattaataggtggacatggaataaaaaattgactaatattggtagaagaacatgctctccggcgggtctacctaatagatcattttataagaacgttttgttcggaccaacattgatacaggaggataaatctaaaaatggtggaaatgtagatttctggacatttccaggagtgatggatgcgatttacgatgatgactggaagagggctcaagaacaaattgaccttattggcaaagtactccatcagtctgctgcattgtttgtcgaagagactaatgacatcgggtataaataa

SEQ ID NO: 4886 - DNA, 2430 bp, Saccharomyces cerevisiae
atgccttcatccatatccgtcaagttagtggctgcagagtcattatataagagggacgtattccgttccccggatccgtttgctgttctgactattgatggttaccaaaccaaatctacatccgcagcgaagaaaacgttaaatccctactggaatgagactttcaaattcgacgatatcaatgaaaattctattttaaccatccaagtctttgatcaaaagaaatttaaaaagaaggatcaagggtttcttggcgtggttaacgtccgcgtgggtgatgttttgggccatttggatgaagatactgctacatcgagtggtagacctcgcgaagaaactattactcgtgatttaaaaaaatctaatgacggaatggccgtcagcggtaggttgattgttgttttatcaaaactaccttcgtcaagtccgcattcacaagctccttctggccatactgcatcttctagtacgaatacaagttcaactactcgaacaaatggtcattctacttcctccacccgtaatcattcaacgtctcatccttccagaggcaccgcgcaagcagtagaatcaactcttcaaagcggtacaacagctgctactaatacggcaacaaccagtcaccgttccaccaattccacatccagtgctaccagacaatactcttcgtttgaagaccagtatggtcgtttaccccctggttgggagagaaggaccgataactttggtcgtacatattacgtcgatcataacacaaggactaccacttggaaacgtccaacgctcgatcaaacagaagccgaacgtggcaaccaattaaatgcaaatactgagttagagagaaggcagcataggggaagaactttacctggtggatcatcagataattcctctgtaacagttcaagtgggaggtggttccaatatacctcctgttaatggtgcagcagcagcagcgtttgcagctacaggtggtaccacatctggtttaggcgaattaccttcaggctgggagcagcgatttactccagaaggaagagcttatttcgttgaccataatactagaacaaccacttgggtggatccaaggagacaacagtatatacgtacttatggccctacaaataccaccattcagcaacaaccggtctcccaattaggtcctttgccttctggatgggaaatgagattgaccaatacggcacgtgtatatttcgttgaccacaatacaaaaacaacgacctgggatgacccaagacttccatcatcgctagaccaaaatgttccacaatacaagcgtgacttcagacgtaaggttatttatttcaggtcccagcccgctcttagaatattgccgggacaatgtcatattaaagtacgtagaaagaacatttttgaggatgcttatcaagaaattatgagacaaaccccagaagatttaaagaaaagattaatgatcaagtttgatggtgaggaaggtttagattacggtggtgtttccagagaatttttctttttattatcacatgagatgtttaatccattttattgtttgtttgaatattctgcgtatgacaactataccattcaaataaatcctaacagtggcatcaaccccgaacatttgaactatttcaaattcattggtagagttgtgggtcttggtgttttccatagaagatttttggatgcattctttgtaggtgcactttacaaaatgatgctacgtaaaaaagtcgtattgcaagatatggaaggtgttgacgcagaggtgtataactcattaaactggatgcttgagaatagtatagatggtgtcttggatctgacgttcagtgccgacgatgaaagattcggtgaagttgtaacagtggatttgaagccagatgggagaaatattgaagttactgatggtaataagaaagaatatgtcgaattatatacccaatggagaattgttgatagagttcaagaacaatttaaggcattcatggatggttttaacgaattaatccccgaagacttagtaactgtgtttgatgagcgtgaactagaactattgatcggtggtattgcggaaattgacattgaagattggaagaaacacactgattatcgtggttaccaagagtcagacgaggtcattcaatggttttggaagtgtgtcagtgaatgggataatgaacaaagagcccgtttattgcagttcaccactggtacttctcgtatacctgtcaacgggtttaaagatttgcaaggctctgatggtccaagaagattcactattgaaaaagctggtgaagtacaacaattgccaaaatctcacacatgttttaacagagttgatttgccacaatacgttgattatgacagcatgaaacagaagctaacattggccgtggaagaaaccatagggtttggtcaagaatga

SEQ ID NO: 4887 - DNA, 2430 bp, Saccharomyces cerevisiae
atggatttgtttattgaaagcaagataaacagtttattacaatttttatttggttcccgacaggattttttgagaaattttaaaacttggagtaacaacaataacaatctatcgatttatttattaatttttggcatagtagtatttttttataaaaaaccagaccatctaaactacattgttgagagcgttagtgaaatgacaacaaacttcagaaataataatagccttagccgttggttgcccagaagtaagtttacccacttagacgaagagatcttgaaaagaggtggtttcattgctggtttagttaatgatggtaacacttgttttatgaactctgttttgcaatcattggcatcatccagagaattaatggagttcttggacaataatgtcataaggacctatgaggagatagaacaaaatgaacacaatgaagaaggaaacgggcaagaatctgctcaagatgaagccactcataagaaaaacactcgtaagggtggcaaagtttatggtaagcataagaagaaattgaataggaagtcaagttcgaaagaagacgaagaaaagagccaggagccagatatcactttcagtgtcgccttaagggatctactttctgccttaaatgcgaagtattatcgggataaaccctatttcaaaaccaatagtttattgaaagcaatgtccaaatctccaagaaaaaatattcttcttggctacgaccaagaggacgcgcaagaattcttccagaacatactagccgagttggaaagtaacgttaaatcattgaatactgaaaaactagataccactccagttgcgaaatcagaattacccgatgatgctttagtaggtcaacttaaccttggtgaagttggcactgtttacattccaactgaacagattgatcctaactctatactacatgacaagtccattcaaaatttcacacctttcaaactaatgactcctttagatggtatcacggcagaaagaattggttgtttacagtgtggtgagaacggtggcataagatattccgtattttcgggattaagcttaaatttaccgaacgagaatattggttccactttaaaattatctcagttattaagcgactggagtaaacctgaaatcatcgaaggcgtagaatgtaaccgttgtgccctcacagcagcgcactctcatttatttggtcagttgaaagaatttgaaaaaaaacctgagggttcgatcccagaaaagttaattaacgctgtaaaagatagggtccatcaaatcgaagaagttcttgccaaaccagttattgacgatgaagattataagaagttgcatacagcaaatatggtacgtaaatgctctaaatctaagcagattttaatatcaagacctccaccattattatccattcatatcaacagatccgtatttgatccaagaacgtacatgattagaaaaaataactcgaaagtattgtttaagtcaaggttgaatcttgccccatggtgttgtgatattaatgaaatcaatttggatgctcgtttgccaatgtcaaaaaaggaaaaagctgcgcaacaagattcaagtgaagatgaaaacattggcggtgaatactatacgaaattacatgaacgcttcgagcaggaatttgaagacagcgaggaagaaaaagaatacgatgacgcagaggggaactatgcgtctcattacaatcataccaaggatatcagtaactatgatcccctaaacggtgaagtcgatggcgtgacatccgatgatgaagatgagtacattgaagaaaccgatgctttagggaatacaatcaaaaaaaggatcatagaacattctgatgttgaaaacgagaatgtaaaagataatgaagaactgcaagaaatcgacaatgtgagccttgacgaaccaaagatcaatgttgaagatcaactagaaacatcatctgatgaggaagatgttataccagctccacctatcaattatgctaggtcattttccacagttccagccactccattgacatattcattgcgctctgtcattgttcactacggtacccataattatggtcattacattgcatttagaaaatacaggggttgttggtggagaatatctgatgagactgtgtacgttgtggacgaagctgaagtcctttcaacacccggtgtatttatgttattttacgaatatgactttgatgaagaaactgggaagatgaaggatgatttggaagctattcagagtaataatgaagaagatgatgaaaaagagcaggagcaaaaaggagtccaggagccaaaggaaagccaagagcaaggagaaggtgaagagcaagaggaaggtcaagagcagatgaagttcgagagaacagaagaccatagagatatttctggtaaagatgtaaactaa

SEQ ID NO: 4888 - DNA, 2430 bp, Saccharomyces cerevisiae
atggtagattcaattcaccgtattgcatcggcgttggatacggccaaagtaataacgagggaagctgccgcggtagccacctctaagctgggtgaatcctcctatacttattattctcaaaacatcaatcctcaacagttagtcaccttgttaaattctaggaactctagagaagttagagatgcaatgaagagaataatatctataatggcttccgatgatgactctattgacgttcaattatactttgctgatgttgtaaagaatatcaccactaatgacaccaaagtgaaaagacttattcacctgtatttacttagatttgcagaaaatgacccaaacctgaccctgttatctattaattctcttcaaaaatcattgtctgattcgaattccgaactgagatgctttgctttgagtgccctttctgacatgaaaatgtcatcattagcacctataattttgcatactgtcaagaaattggttacagatccatctgcaatggttcgtggtgaagtcgccttggccattatcaaattatatagggctggaaagaatgactatcatgaagaattgttggatattctgaaagaattaatggcagatacagatcctaaggtgatatcctgtgctgtcctagcttacaaagaatgttatgcggatcacttggagctattgcatggacattttcgcagatattgtagaataattaagcaactagattcgtggtcacaatcatatttaattgagctgctaatcaagtactgtaagcagtatttaccaaaaccaactgtggtcgataaatcatcagaaggttccccaaggagttgtcctttaccagataaatacaacgagattgaatacccatcttacgaggtggtaaatgaccctgatttagatttatttctacagagtttgaattgcttaatttatagttccaaccctacagtgattttatcgtgttgcaatgcgctatatcagttagcttcaccattgcagatgaaaaatactaaatttattgaagcattggttagaacggtaaccatgacagaaaaccaaggtaacaaagaaatgcttttacaagcaattcacttcttatcgatcttagaccagacactatttttaccctacaccaagaaattttacgttttccccaaagatcctattgtggcatcaatttggaagatccaaattttgtccacgttaataaatgaatcaaacgttaaagaaatattcaaagaattgaaatattatgttgccagtgctcatttcccagaaaatgttgttattatggcggttaagtcattatctcgatgtggccaattgtcaacgagttgggaatcacatgtaatgaagtggttaattgatcatatggaatcccacaacctctctgcttctgtcctagatgcatacgtgaatgttatcaggatgctggtgcaaaaaaatcctacaaaacatcttcgcataatcttcaagcttgcagatttattaacagttcaaacgagtttggctgataatgctcgtgcaggtattgtttggttatttggtgaaattgcctcgattgaatttaagatatgtccggacgttttgaggaggctaatccagaatttttcaaatgagggtcctgagacaagatgtcagatcttagtgttatcagcaaaactgttgtcatatgacattgataattttaagcaagcgcaagttactggaagcgaagaaaataaccaaaatcccccatactatgattttagtggttcaagaatctctcaaatgtacaatgcggtcctttacttggcaaaatatgatgacgaatttgatattagggatagagccaggatgatttcatccttgtttgattcagggaaatatgaaattgtgtcactactattacaagcacctaaacctacggcaagaagtgacgattttatcgtttctgcaagattggaaacacataccccagaaataaaagaattttttagaatgcttccttggaatactgaaattactgaggttggcgagacaggtaacgatattagagaaggcgcagaattgaaagactataacaaatacaaaaaaagtttttcatcgcagtcttttattaccaacaactcagcaagatctttcacatctagctccaacgcaaaattgactgggatcaatgacggcgatagcaatagcatctcaggtaaaggtaacgtaaacaccttcacatctcaaaacgggaagaaatatcgtttgcaaagcctggacgagtttttttccgacattccagaaaggaagagtaaaccaaggaaaattataaaggtggtggaagaaagcagtgacgaggatgaagacgaatcggaagagagcagtgacgatgatgagtatagtgactcttctttgggaacgtcttcttcgggaacgtcttcttcgcatctggagctttag

SEQ ID NO: 4889 - DNA, 2430 bp, Saccharomyces cerevisiae
atgtcttctgtagaagaattgactcagctgttttcacaggttgggtttgaagataaaaaggtgaaggagattgtcaagaataaaaaggtttctgattcactttacaaattgattaaggagactccttcggactatcaatggaacaaatctactagagcgctagtacacaacctggcatcttttgtcaaaggtacagatctacccaagtctgaattaattgttaacggcatcattaatggtgatttgaagacatctctgcaagtcgatgccgcatttaaatatgtaaaggctaatggcgaggcatccaccaaaatgggtatgaatgaaaactctggtgttggtattgagattacagaggatcaggttagaaattacgtcatgcagtacattcaagaaaacaaggaaagaattttaactgaacgctataaactggtgccaggtatttttgccgatgttaaaaacttaaaggagctgaagtgggccgatccacgtagtttcaagccaattatcgaccaagaagtcttaaaacttttgggtccaaaggatgagagagacttaatcaagaagaagaccaagaataatgaaaagaagaaaaccaattctgccaagaagagttctgataattctgcatcatccggtccaaagaggactatgttcaatgaaggtttcctaggtgatttgcataaagtgggtgaaaacccacaagcttacccagaattaatgaaggaacaccttgaggttactggtggcaaagttcgtacaaggttccctccggagcccaatggatatttgcatattggtcattctaaagctattatggttaattttggctatgctaaatatcacaatggtacctgttatttaagatttgacgataccaaccccgaaaaggaagctcctgaatattttgaatccattaagagaatggtttcttggttaggttttaaaccatggaaaattacttactcaagtgattattttgacgagctttatcgcctcgctgaagtgttgatcaaaaacggcaaagcttacgtttgtcattgtaccgccgaagaaattaaaagaggtcgtggtattaaagaagacggtactccaggtggggagagatatgcttgtaagcatcgtgatcagtcgatagaacaaaacctgcaagaattcagagatatgagagatggcaagtacaaacctggtgaagctatcttaagaatgaaacaggatctaaattcaccaagcccacaaatgtgggacttgattgcgtatagagttttaaatgctccacatccaagaacgggaacaaaatggagaatttatcctacttacgattttacacattgtttggtcgattcaatggaaaatattacacattctttatgtactactgaattctacctatctagagaaagctatgaatggttatgtgatcaggttcatgtgttcagacccgctcaaagagaatatggtcgtttgaatatcaccggtacagttttatccaaaagaaaaattgcgcaattggtggatgaaaaattcgttagaggctgggacgatcctagactattcacgcttgaagctatacgcagacgtggtgttcctcctggtgccattttatcctttatcaacacattaggtgttaccacaagtaccacaaacattcaagttgtgaggtttgagagcgctgttagaaagtacctagaagataccacaccgagattaatgtttgtgttggatcctgttgaagttgttgtcgataatttatctgacgattatgaagaattggcaactattccttacagacctggtactccagaatttggtgaaagaactgtaccatttacaaacaaattctacattgaaaggtcagatttctcagaaaacgttgatgataaggaatttttcagattaacaccaaaccaaccagttggtttaattaaagtctcacacacagtttctttcaaaagtttggaaaaagatgaagctggtaaaattataagaattcatgtcaactatgataacaaggttgaagaaggttcgaaaccaaagaaaccaaaaacttatattcaatgggttcctatctcttcaaaatataattctccattgagagttactgaaactagggtttacaaccaattgttcaaatctgaaaatccatcttctcatcctgaaggcttcttgaaggacatcaacccagaaagtgaagtcgtttataaagaatctgtcatggaacataacttcggggacgttgtcaagaacagtccatgggtcgttgattctgttaaaaactcggaattttatgttgaagaagataaggattccaaagaagtgtgtagattccaagctatgagagtaggttatttcactctggataaagagagtacgacttctaaggttattttgaatagaatagttagcttgaaggacgcaacttccaagtga

SEQ ID NO: 4890 - DNA, 2433 bp, Saccharomyces cerevisiae
atgaaaagaagaagcgatgctttgttgggaagtttccaggccaccaacgttacgccgccaagcgataatagtaatagtacggccggtggagccaatggaagtaactcaggaacaccaacttctactagcggtaagaagagaaacaagcttataaaatcttgtggcttttgcagaaggagaaaacttcgttgtgatcagcaaaaacctatgtgttctacatgcatttctagaaacttaacaacctgtcaatatgctgaagaattcaacaaaaacatcgaaaagaaagctacctatggtccctatcctaacgccgatttacttaagaaagttgaagaactagaaaacaaaatacgtattctagaagctgaaaaaaacactaattcgtctgcgagctccatgtacacttcgccaaatttccctcctttaggcactagtgtaggtagaggttctactgaaacttcatctccattacccgatggtgtaataaatccatatgccgaccggtactacctacaaagtaaacattccggaagatcaacactatacggccccacttctatgagaacccaaattgcaaatagtaattgggggttcattgaaaaatataaacaattatgggcgaaggttaaagtagaaagaaataaatggaagcaaaacaaccaaaaaacgatgtgcagggaactaggccttttggatgagtcggattggcagccagatccattaatcaaacagatatgtcgtttcctaccatcatataacaaagctttgtctattttagatgatttctttaatgatggagcatgcaatgagatcaacgtgattcttgataaggcaaaagttagaagagactttttagattatttcatgcccgaaaaagaggtaaaggcggaaggtgacagatccatagtttatattttatccaatccaaagaaaaattattacaaagctgctgtgatactattaatcctatgtctgaaatacttccatacagatgtcccaaccccaattgagaagttctttactttactaaagggggcctccaccgctaaggtgttctacattgagcgtgcacaaatgttaatacttttctactaccatcgtgaaacatattcattcggtggagatggctccgatttggttaatataaatgaatgtttagttactacggttactacaatagggttgcatttaaacattagagaaactttcaaggaacatgaggtttttatgggtagcatcgaaagtttagaaaatgtctggttaatggcaatatttatcgattataacatatcttgtaacgttggtagacccttattgattaacaaattttatctagacgaaaaccaagatcattgcatattgaatagtaaaagtaaaacatatgaggggaagctgaaaagatatttaaaacttacaaggccaatgttgttaactctttatgatagagataaattcccggatttgaaagcttattccaagcgaattatcaattttgtagaagaagaacttggtccacttggacattacacaggtgaaaatatatcggaagaagttccattaagggaaagtagaattttaagtatggcagtcggactattattgtcgttttatgcactaatacattctgtgctgaaagtcagaaacatagaatccaaaaataatacgtttcaattggttttgatcaatttttccatcattgtgaataccacaattcgatgctatcgtatcgacaaagcactttacccagagaaattcgaagcctccaacccgcacttaccgccacatatggcgttatcaatgagcctcacggcagggcttttttccaaaacattggtgtttttttgttctctgatctactttaagttgacgcttttcgaaaatggactatgtctatccaacgatatggaagttggatggtcggatttgacgaaattgactgttcctttagacaaggatctatctttaggtacagcaatgagcttgtactcgtcaatcttcgatcgcttgttcacggtcggaaataaagaattaatacgcacaatgcatagatcatcacaatttgtgatagagctagctattgaaaggacctataggactattcttggcaacgttattgaattcagaaagttgaccgaggaaacatggctagcacaaatcaaacaagaactagatccgcagagcgataatccatcatcagaagctaaaattgtgagtgataggcagcgggatctcagccttgcagttccaacgcccacgccctcaataattccaatgttaccctcgcctggtgaaactaagaaccatgcaaagagtcaatcagagatcattcagatgctgacagatgaattttgggcaaattataactcaggctgggaagagttgattaatcaatctgaattttccactcttttcgatgattacaaagacaattaa

SEQ ID NO: 4891 - DNA, 2433 bp, Saccharomyces cerevisiae
atgaatactccacagattagtctgtatgaacccgggacaatattaactgtgggatctcatcatgctaagattatcaaataccttacgagtggtggattcgcacaagtatatactgccgaaatttcccctcctgacccatatagcaatgctaacatagcatgcttgaaaagagtcattgtcccccataaacagggtttaaataccttgagagctgaagtggatgctatgaaactccttagaaataataagcatgttgtttcttacatagattcacatgctgcaaggtctgtaaatggtatagcatatgaggtgtttgtgttaatggaattttgtgaacgtggaggtcttatagattttatgaacaccagattacaaaatagattacaagaatctgaaatattagaaattatgagtcaaaccgtccaaggtataactgcaatgcacgctctgcagccgccattgattcatagagatattaagattgagaatgtacttatttctcatgatggcttgtataaagtttgtgattttggttccgtttccggtgtgataaggccacctagaaatactcaagagtttaattatgttcaacacgacatcctaacaaatactacagctcagtatagatcacctgaaatgattgacctgtacagagggttacctatcgacgaaaaatctgatatttgggctcttggtgtctttctttacaaaatatgttactatactacgccgtttgaaaaaagtggtgaagccggtatactacatgcaaggtatcaatatccatcctttccgcagtatagtgacaggttgaaaaatttgatacgtcttatgttaatggaagcaccatctcagaggccaaatatttgtcaagttttagaggaggtttccaggttacagaataagccttgcccgattagaaatttttacttgttaagagcaatgaatcagaatgcgaatacccaattggccggtgaaccgtcttcgacaacttatgttccaacacagaaatttattcccgtacaaagccttcagagcatcaaccagccaccaaatatgatgcctgtaactcacgtcagtactactcctaatttgggtactttccctatatctattaatgataataacaagacagaagtaacggcgcatgctggcttacaggttggaagccattcaaatttgactagtcccttaatgaaaacaaaatccgttccactttctgatgaatttgcatcactatattataaagagctacacccttttcaaaagtctcagactttcaaatcagtagaaagtttccaatccccacaaaggaagtctatgcctccattatcgcttactcctgttaataatgacatttttgatagagtttcggcaataaatcgtccaaataactacgttgattctgagacgcaaactatagataacatggctgtgccaaacttaaaactatctcccaccattacaagcaaatcactaagctccacaaaagaaattgctgctccagataatataaatggaagcaagattgtgcgttcactaagctctaagttaaaaaaggttattactggtgaatctcgcggcaattctccgattaaatcaaggcaaaatactggtgatagtatcagatcagcatttggtaagcttcgtcatgggtttacaggaaactcagtgaacaatagcaggtctgcttcctttgataataacaatgtcaacggcaatggtaacaatacaaacaggcgattagtttcgtcttcaacctcctcctttcctaaatttaattctgataccaaaagaaaagaggaatcagacaagaatcagagactggaaaaacgtcgcagtatgcctccttcaattttatcagattttgaccagcatgagaggaataactcgagaactggatcaagggactattacaggtctcattctccagtgaagaaaactcaagcatcagctaaaacgacatcaaagcctactttgataccagataatggcaacgttaatataaatcaagaaaagaaggaatcaattcaaagaagagtgcataacttactaaagagttctgatgatccggtaacgtataaatccgcatccgggtatggtaaatatacagatattggtacagaaacttccaatcgacattcaagtgtaagaataacaccaatcacagaagaaaagtttaagaaaacccttaaggatggtgttttggacatcaaaacgaaaagcaacggtaaagataaatcaagaccaccacgtccaccaccaaaaccactacatttaaggacagaaattcagaagataagaaactttagtcgtttacaatcaaagaaactgccgattgaaagaatttccagcgaagccacagaaactattgttgatgttaacgtagatgatttagaagccgattttagaaaaaggtttcccagcaaagtttaa

SEQ ID NO: 4892 - DNA, 2433 bp, Saccharomyces cerevisiae
atgccttcaggtcataacgataaaaacgcaaatcaagagtctgtggaagaggctgttttgaaatatgtcggtgtaggtctagatcaccagaaccatgaccctcaattgcatacgaaggatctggaaaacaaacactcgaaaaagcagaatattgtggaaagtagtagtgatgttgatgttaataacaatgatgacagtaatagaaacgaggataataatgatgattctgaaaatattagcgcattgaatgcgaacgaatcatcttcgaatgtggatcatgccaactccaatgaacaacataacgcagttatggattggtatttaaggcaaacagcgcataatcaacaagacgacgaagatgacgaaaacaataataacactgacaacggcaatgacagtaataatcacttttctcaatctgacatagtcgtggatgacgacgacgacaagaataagaaagatgcgggtgttggtgtggacgatgatcatcaatctatggcgatggccgccgtcgctgctgcttacactctatcgaaaaataacaataataataacagtattgcgaacgatagcaattcgcgtaaaagacagcatgataacggaaataatcatgagaattcacagaaaaagcggaaaaacaataatgatgacgatgacagacaaattggaaacgtagatccggaattaaccaccttgggtgatgcagatgacaacgatactaataatgatgtgattgatcgtgatcaactggtccataaggccattatcgacgctgattcgattacccaacatcctgatttccagcaatacttgaatactgcggctgatactgacgataacgaaaaattaaagcatattaaagatcatttgatgcgtacacacggtttgaatcatcagaacaagaatcacaatgatgatacagatgatttatcaaatagtacaaagcaatactctgaactgcagaaagactctatgctggatagttccctcaacaaatctagaaattatatggaagtcttgcccaaagttatctctcaagatactcaaccacaccaacaaaaatctccctctcatgataatgaagctggcagcgtggacaattcagaaatatctcaactacttcaatcagccgccacaaaggcatcatctttggtatctttatcctcatcctcagcaacgccatcgacttcaaggtctaacaatagcaaagcttttgataaagccgaagacgccgctttagaaagatttattaacgagtatgaggccattgaacgtttgactagacaacaagtttgtgaaaggatatggagttccgacaggccaaaggacaacttttggaataatatttacaaagtcttaccctatagatctagctcctctatctacaaacacatgagaagaaaatatcacatttttgaacaacgtggtaaatggaccgcggaggaggaacaagagctagctaaattatgtgcagaaaaagaaggtcaatgggcagaaataggtaaaactttaggcagaatgccagaagattgtagggatcgttggagaaactacgtaaaatgtggtaccaatagagcatcaaatagatggtccgttgaagaagaagagcttctgaaaaaggttatcagcgatatgttggaagaagcccagcaacaacagtctcaattgcatccaaacttattggaagaagaacagcatttactgcaagatgaccagaatgatcatcgcaataacgatgaagacgatgatgatacagcttctgcagcagcagctgctgctgctgctattcaagaacaacaacaacttcttcaacaaaagcagcaagatgatgacgatgctattgccgctgctgccgctgctgcttcttcatccctgggagacaacaaagacgaagacaaaccccacgattcattaggtatacagctcgatgataattcccagaactcaatggtacctgctccatcagcaacaagcacacattctaaaagtttgtcaaatacaatcagacgtcacaataataaactgaggaaatctttgatgggtaacggtaagttagatttcaaagacatcattaactggaccattgtcagtgagcgtatgggcggtacgagatcacgtattcaatgtcgttataaatggaataaattggtcaaaagggaagcaattgccaaaattcagactgtaaaagatgatgatatgttatggatttttgaaaaattaagagatttaggtataacagaagattctcaagtagattgggatgaacttgcagctttgaagcctggcatgaaattaaatgggttagagttgaaattgtgctatgaaagaatgaagaaaaaggtcaaaggctataagcaaaaatcaatcaatgaaatcagtaaagagctagttgattattttagctccaatatttcaatgaaaacagaaaattaa

SEQ ID NO: 4893 - DNA, 2433 bp, Saccharomyces cerevisiae
atggacaatcaggctacacagaggcttaacgacctttctctagaaccagctccttcacacgatgaacaagatggttcaggactagtcattgacatagatcaaagaaagattggtgatgaacaagctggtgtcgtagtggatgatgagacaccccccttagagcagcaagattcacacgaaagtttagctgctgattctcggaatgctaatttctcgtatcacgagaatcagcagttgttggaaaatggcaccaaacagttggccctagatgagcatgattctcactctgccatcttggagcaaccatcgcattctaccaattgtagctcttccaacatagcagcgatgaataagggccatgactcggcagaccatgcatctcaaaattccgggggtaaaccgaggaccttgtctgctagtgctcagcatatcttgccagagacgctcaagtcatttgccggcgctccggtagtgaataagcaggtacgtacctctgcctcctataaaatgggaatgttggctgatgatgcttcacagcagtttcttgatgatccctcttccgagttgattgacttgtattccaaagtggcagagtgtagaaatttgagagccaaatatcagaccatatctgtgcaaaacgatgatcaaaacccaaaaaataagccaggctgggtagtctatccaccaccacctaaaccttcatacaactcagacactaagactgttgtgccagtaacaaacaagccggatgcggaagttttcgattttacgaaatgtgaaattcctggtgaggatccagattgggaatttaccctcaacgatgacgactcgtacgtggtacacagatcaggtaagacggatgagttaattgctcaaatccctacccttcgtgactactatctggatctagaaaaaatgatttccatctcatcagacggtcccgctaaatcatttgcttatagaaggctgcaatacctagaagcacgctggaatctttactatctcttgaacgaatatcaagaaactagcgtttccaaaagaaacccacacagggatttttataatgttaggaaagtggacactcacgttcaccattctgcttgtatgaaccaaaagcacttattacgtttcattaaacacaaattgagacattccaaagatgaaaaggttattttcagggacgggaaactactaactttagacgaagtattccgttctttgcatttgactggatatgatttatccatcgatactttagatatgcatgcacataaggatacattccacagattcgataaattcaacttaaaatataaccctatcggtgaatctcgtctcagagaaatttttttgaagacaaacaactacatcaagggtacctacttggctgacattaccaaacaagtcatattcgatttagagaattcaaaataccaaaactgtgagtatagaatttctgtttatggcaggtctctcgatgaatgggataaactagctagctgggtgattgacaacaaagttatttcccataatgttcgttggttagtccaaattccgaggttatatgatatttacaagaaaactggcattgttcaaagcttccaggacatctgtaagaatctgtttcagccactatttgaagtgaccaaaaatcctcagtctcatccaaaattgcatgtatttttacagagagtaattgggtttgattctgtcgatgatgaatccaaggttgatcgccgctttcataggaaatatcccaagccatcactctgggaggctcctcaaaaccctccttattcctattacctgtactatttgtattcaaatgtcgcgtctttgaatcaatggagggctaagagagggtttaacactttggttttgagaccacattgtggtgaagccggtgaccccgagcatctcgtttcagcatatctattggcacatggtatatcacatggtattttattgaggaaagttccatttgttcaatacttatactatttagatcaggttggtatcgcaatgtcacccctttctaataacgcattatttttgacctatgataaaaacccatttccgagatactttaaaagaggtttgaatgtctcactatccacagatgatcctttacaattctcatataccagagaaccattaatcgaagaatactcagttgcagcacaaatttataaattgtctaatgtagatatgtgtgaattggcaagaaattccgtgttgcaaagtgggtgggaagcacaaatcaaaaaacattggatagggaaagattttgacaagagtggtgttgaaggtaacgatgtggttagaacaaatgttcctgatattagaattaactacagatacgatacattatcaactgaactggaattagttaatcattttgccaatttcaagagaaccattgaagaaaagtga

SEQ ID NO: 4894 - DNA, 2433 bp, Saccharomyces cerevisiae
atggatggttttcgtgtagctggtgcgttagtagttggtgcgttaaccgctgcatatttatattttggcggaaggttttcgatagcgctggtcattatagtaggttatggtatttattgcaatgaagccagcggtggtagtcaagatagtcaagagaagctcgatttgaacaaacaacagaaaaagccatgttgcagtgataagaagattgcggatggaggaaaaaaaactggcggatgttgttctgataagaagaacggtggtggtaaaggtggaggatgctgttcctcaaaaggtggaaagaaaggggggtgttgttcatctaaaggtggaaagaaaggaggatgttgttcctctaaaaagaatattggtgacaatgaaaatactgccactgaagttgagaaagccgtaaattaccctgttactgtggattttacagaagtttttaggaagcccactaagaaaaggtcgagtacccccaaggttttttcgaaaaatagctcgtctaactctagagtaggtaaaaaattaagtgtttcaaagaagataggtccagatggattgatcaagagcgcgttgactatttcgaatgaaacgcttttgagttcacagatctatgtgttatatagttccctgcaaggtgcagcttcgaaagctgcaaagagcgtttacgacaaactaaaggaattggatgaattgactaatgagccaaaacttttgaaccttgacgatctatccgatttcgatgactattttataaatgttcccgttgaaaatgcattgtatgtgcttgttttaccgtcttatgatatcgattgccctctagattatttcttacaaactcttgaagagaatgcgaatgattttagagtagatagtttcccattacgaaaattggttggctacacagttttggggcttggtgattcagaatcatggcctgaaaagttttgttatcaagccaaaagggccgatcactggatttctcgtttaggtggcaggagaattttccccttaggcaaagtttgtatgaaaacaggaggtagtgccaaaatcgatgagtggacatcattgttagcagagactttgaaagatgatgaaccaattatttatgagtatgatgaaaacgcagactctgaggaagatgaagaagaaggtaatggtagtgatgaattaggcgatgtagaagatattggtggtaagggtagtaatggaaagttttcaggcgcagatgaaatcaaacaaatggtggcgaaagacagtccaacgtacaagaacttgacaaagcaaggttacaaagttattggttcccattcaggcgttaagatctgccgatggactaagaatgaactacgtggtaaagggtcttgttataaaaaatcgctcttcaatatcgcgtccagtagatgcatggaattgactccttctttggcatgttcatccaaatgcgttttctgttggaggcatggtacaaatcccgtgtcaaaaaactggagatgggaagtagatgaaccagaatacattctagaaaatgctctgaagggacactattccatgatcaaacagatgagaggtgtgcccggtgttattgcagaaagatttgcgaaagcgtttgaagttcgtcattgtgccttgtctcttgtcggcgagcctattctttatcctcatatcaataaatttatccaattattacaccaaaagggcataactagtttccttgtgtgcaatgcccaacatccagaggccttgagaaatattgttaaagtaacacaattatatgtttctattgacgcacccaccaagacagagctgaaaaaagtggatagacctttgtacaaagatttctgggagagaatggtagaatgcttagagattttgaaaactgtacaaaaccatcaaaggacagttttcaggttaactttagtgaaaggtttcaatatgggtgatgtcagtgcatatgcagatctggtccaacgtggtttaccaggtttcattgaagttaaaggcgccacgtttagtggctcatctgatgggaatggtaatcctttgacaatgcagaatattccattttacgaggaatgtgtaaaatttgtgaaggcgtttaccacggaattacaaagacgtggattacattacgacttggctgccgaacatgcgcattccaactgtttattaattgcagacacgaaattcaaaattaatggagaatggcatacacatatcgattttgataaatttttcgtattgctaaactcgggcaaagacttcacgtacatggactatttagaaaagacacccgaatgggcattgtttggcaatggtgggtttgcaccagggaatacaagagtgtacagaaaagataagaaaaagcagaataaggaaaatcaagaaactacaacgagagagacgcctctccctcctattcctgcttaa

SEQ ID NO: 4895 - DNA, 2433 bp, Saccharomyces cerevisiae
atggccggttcacaacttaagaatttaaaggccgccttgaaggcccgtggactcacaggtcaaacaaacgtcaaaagtaagaataaaaagaattccaaaagacaagcgaaggagtatgatcgtgaagaaaaaaaaaaggccattgctgaaatcagagaagagtttaatccgtttgaaataaaggctgcaaggaataagaggagagatggtctgccttctaaaactgctgatcgtattgctgtgggtaagcctggtatctctaaacagatcggtgaagaacaaagaaagcgtgcatttgaagcaagaaaaatgatgaagaataaacgtggtggtgtgatcgataagagatttggtgaaagagacaagttgttgacggaagaagaaaaaatgttggaacgtttcaccagagaaagacaaagccaatcaaagagaaacgcaaatttattcaatcttgaagacgatgaagacgacggtgacatgtttggagacggtcttacacatttaggtcaatcgctgtccctagaagatgagcttgccaatgatgaagaggattttttagcttccaaacgattcaatgaagatgatgctgagctacagcaacctcaaagaaaaaaaaccaaagctgaagtcatgaaagaggtcattgccaaatcaaaattttacaaacaagaaagacaaaaggctcaaggtataatggaagatcaaatagataatctggatgataatttcgaggatgttatgtctgaattgatgatgacgcaacccaagaagaatccaatggaacctaagaccgatctagataaggagtatgatatcaaagtgaaagaactacaattggacaaaagagctgcaccctctgatagaactaaaactgaagaggagaaaaacgctgaagctgaagaaaaaaaacgggagttggaacaacagcgtcttgatcgtatgaacggtatgattgaattagaagaaggcgaagaaagaggagtagaggatttggatgatggattctgggaaaatgaagaagactatgaagacgataatgacggtattgctgattctgatgatgatatcaaatttgaagatcaaggcagagatgaagggttttctcaaattttaaagaaaaagaacatttccatttcatgccctagaactcatgatgcgttattagatcaagtaaaaaaattagacttagatgatcatcctaagattgttaagaatattatcaaagcttaccaaccaaaattggctgaaggtaataaggaaaagttaggaaaattcaccgctgttttactgagacacatcatttttctaagcaatcaaaactaccttaaaaacgttcaaagttttaaacgtacacaaaatgcattgatctcaattctaaaatccctttcagagaaatataatagagagctttccgaggagtgtagagattatatcaatgaaatgcaagcacgctataaaaagaaccattttgatgctctatcaaatggtgatctggtatttttttccattattggtattcttttctccacctcggaccagtaccatttagtaataactccagcattgattttaatgagccagttcctggaacaaatcaagtttaattctttaaagaggatagcttttggcgctgtcttggtaaggattgtttcacaatatcaacgcatttccaaacggtacataccggaggtggtttacttctttcaaaaaatattactcacttttatagttgagaaagaaaatcaagaaaaaccattagattttgaaaatattagactagactcttacgagttggggcttccattggacgttgactttacaaaaaagagatcaactattattccattacataccttgtcaacaatggataccgaggcacatccggttgatcaatgtgtctccgttttactaaatgttatggaatctttagatgcaactatctctactgtgtggaagagcttacctgctttcaatgaaattattttaccgattcagcagttattaagtgcatacacctcaaagtattctgattttgaaaagccaagaaatattttgaacaaagttgaaaaattaacgaaattcacagaacatattccgttggctttacagaaccacaaacccgtatccatacctacgcatgctcctaaatacgaagaaaacttcaatcctgataaaaaatcgtacgatcctgatagaacaagaagtgagataaataagatgaaggcccaactaaagaaggaacgtaaattcactatgaaagaaatccgtaaagacgccaaatttgaagctagacaaagaattgaagaaaagaacaaggagagcagcgactaccatgcaaagatggctcatattgttaacactattaataccgaagaaggtgcggaaaaaaacaagtatgaaagagaaagaaaactacgtggcggaaagaaataa

SEQ ID NO: 4896 - DNA, 2436 bp, Saccharomyces cerevisiae
atgagaatgatacagagagagagaaagagagagaaagaggaaggtcaattaaaggagagaactgttgttaatatggcagaccctgatgacaatgaggccgaagccactggattacaacaatatagtggcgagaccactcgcgatgacaatgaagaaagcatgaatgattctttcactttaacatccaggaatagaggcagaagtaatacaatatctagtattgttagtggttatgaaataatgaaagaacatatggacaaggaaaagtttatgtacttgattctagcgagtctccttttgtacatgggatttgttgccgcatttgctcccaggacgtctttatcaagagactttcggcggtttcactcttccagattgacgaatgcagaggtttataggatatacttgaactccttgcaacaggaaaatagagcgaaagaacatgtatacaagtatgctgggtacatgagcaacggagcaagtgattcgtcaacgtttaaatataccttggacgagtttctagatatggggtacaaacccaaagttgaaaaatattacccatggataggtgaaccagtagacactaacgtagctcctttagaaaatggtaaagtggtctacgaagcaagcatgatcgaggatagagttaaaggtgatcctgcttctcacgctaggaaaaggcaaaagggtttccatcaatattcaaaaaatggaagtgtaactgctcgatacgtgttttgcaattatggtagcatcagtgattacaagctacttttgaagaaaaacattgatattgaagataaaatccacatcgtacgatcgggtaaaatattacctggattaaaggtaaagaatgcagaactttatggcgcttccagtgtcattatatatacagacccatttgacgatggtaaagttactgaggaaaatgggtttttacactatccttatggaccagcaagaaacccaagttatattaggagagattctgtaaactatttcagtgacactccaggagatccgacaactccagggtatccctccaaggattccgacactgaacatatgtcaccggtagggagagtgccgaggataccatcggtgccgatgagtgctagagatgtccaaccaattttagaaagattgaatggcaggggttttcaaattgggcccggtagtaatataaaagattttggatcattcactggaccttcaagctctatcgataaagtccatttgcataatgagctaacttacaacatcaaggaaatgagtagtgtagaggttagtatccctggtatattcactgagggggagattattatcggagctcatagggattcgctcgcctcgagtagcgccggtgatgcaaatagtggcagcgctattcttttagaaattgcacgaggaatgagtaaattacttaagcatggttggaagccactgcgtcctatcaaactaataagttgggatggtgaacgatccggccttctgggatctacagattatgcagaagctcatgctgcgattctcaggagaagggccttggtatacctaaatctagataatgcaatctctgggacaaattttcactgtaaagccaacccacttttacaagacgtgatatacgaagctgctaagctcacggaatttaatgggcacgaagactggtcattgttcgaccattggaaatacacttctaatgccactatttctctacttgatgggttgtctagttacacttcatttcagtaccatcttggagtgcccgctgcacattttcagtttaatgccaatgatacttcaggcgcagtctatcatagtaactccgtattcgatagcccaacttggttggaaaaatttaccaattctgactacaagttacacaacaccatggccatgtttgtaggtttgacaacgctgatgctgagtgaaaacgaactggcaagattcaatacacatgtttacctgaagaaaatatataactggtatatcgcatggcactctaatctatcttcagcatttccccaggacgatgaagtgaacagcttagcaaaaagggttctggacttattaaaagttgccacacaggaagatagcatccaatttgaccaacaaaatggtattctctataaagagtgtagggaagctttacctgtttgggctttttacaaaaaaatcaagagctatattaaactgcaacgatccaatagcaaatcaaagcaaattgatcaattatttattacacacagaggactgaaagacagggaatggatgaagtactctcttttagcacctagtaagtttgagggatctgtcggggaagttttgcccggccttcacgaaggattggctgatattgatagaaacgaggtcattcagtggttaaccattttgctaagccaattcagcaacgttcgctatttacttcaataa

SEQ ID NO: 4897 - DNA, 2436 bp, Saccharomyces cerevisiae
atggtaatcttcaaagaacgcaaaccaacagaaaaccttttcactagaaaaatacctgccaagtacttcatcttctcgcctagttttttgtctgttcattattttgaattttatttgcccatgtccggtgataataacattgaacctactagtcggggctcgaacgacaatagcaacggtccaagtaacggatcttcggtaaacagtaatcggtacagtttaaacgcacccaagtacagcagccaaccaccgccagcatcacacacttatttgccccccatgtcagtgaatatcccgcccatagcgagcaaatcatcgtcaatatacagcctgctacaccaaagttccccccgcccggagacgccaaatccaatattaccgccacttatcggtagtggtcccggctcccataaaccatctcctacccctacacagcctcctgcacaacccgcaacacaacggcaacctgccacatactcagtgtatccagcgtctatcagcctgaatagatcgaattcatctgcttacccactttctttcaagtcagaggaaaccttaaacaataatcctcctactgctgccaaacgtaccaataccttcccctcaattccaagcagtacgaaaaaacagaaaacaagccaagagaaacgaatctcttccatttcaaggagaaacacgcaagaaataattgctaagcaaattgcagaaaataacaaatctaaaaccatcgaggagtatgcgcagatcgtgaagcatgcagaaatcaaagtcctgagcatggactcacagaacacttcaaaggcagctttgcagctggcggaacaaaacagagaaagagaaagacaagtgtttgcgttactttggttaatgaaaaattgtaaatctcagcacgatagttacgtaccaagaggcaaaatatttgctcaatacgcttcatcttgttcccaaaacaacctgaagcccttatcacaggcgtcattagggaagttgataagaacagtttttcctgatttaacgactagaaggctgggtatgagaggtcaatccaaataccactactgcggattgaaactaactgtcaacgaaagcggctccgtgtcccttaataacaacaatgcttcgttatccttagtacacaataacgatcccatatcgcccctatcgtctccatcgccctcttcaccttcgccgcaggtacctaacgtttcatcgccgttctcattaaatagaaaaagtctttctcgaactgggtcgcccgttaaacagagtagtaatgacaaccctaacgaaccagaactcgaatcacagcatccaaacgaaacagaagcaaataaactagattcgctgccaccagcggcaaataaccctaccggaacactgtcttcagatgaattaactttcactcatgatttaattgaaaaagttttcaattgtaatgacaagctatcagataactataatacccaaatattatcgaacacagaacatccgcttttgacatcatataagttagacttcccaaaaattcccgcaggtgtactccccacagacactgattcggatgttatatcatccttggagtcattatatcatatccattgcaactccgtttatgaatgcatcaagtttctgaagagtgataatatatcaaatgcattattcttctctaactctaactctatatcgcccacgatgtttaatctattcatttctgagccattgattgattgggtaactaaatgtgacttaatcacctatacagggttaatcaaatttttttcacaatttataattcattctaatgagatcagtgactcaatcattcaaaaactggaaagtatgatcaagctattgcccgaacaaattaataaggctgttttagaattaccaaaagcgctagtgcaaaggaagttatcaattattaataattttaccaaactagtgaaaaaactaataaagttattaaaattcattctaaacttcttgaaaagttttcctatatttaaaagtggcatgaataatgactggaagaatattgtaaatttagacgatattttggaaatgatgattaatgaagacgatacaaattcagagacaaacacaataatgcaacatttacaagggttctgtcaagttttcgtaacaaagttcttaaattcctctatgagcgttagcaatgatccctctgtgtctatcgaatgcaagtccttaaatgaaatgattaaagatttttgttcctttatttccctacaaagcaaattttcgtgcttgaaattaattgattgcagcacaagattcaggaatgcaataatcggcgatattagcttaaaatcaaatgagaatttgctatcatggttgtttctaaataatgtcatgggccaattgctgaactactgttttgaagtcatgaaattcgtcaatggcctaaaagtttaa

SEQ ID NO: 4898 - DNA, 2436 bp, Saccharomyces cerevisiae
atgtcgaatataagtaccaaagatatacgaaaaagtaagccaaaaagaggatccggcttcgatttacttgaagtgactgaatcacttggctatcagacacacaggaaaaatggaagaaattcatggtcaaaggacgacgataatatgctacgatcgctagtaaacgaatccgcaaaggagttaggctatgagaatggacttgaagacgtaaaaacaattcaacaatccaaccatctttctaaatgtattgcttgggatgttttagctacacgattcaaacacaccgtaagaacttcaaaggatgtaagaaagcgttggacaggatctctggacccaaacttgaagaaaggtaaatggacacaagaagaggatgagcagctcttgaaagcttatgaagaacatgggcctcactggctgagtatctccatggatatccctggaagaacagaggatcaatgtgcgaaaaggtacattgaagtgttgggacctggaagtaaaggtagattaagagaatggacgctcgaggaagatttaaatctgataagtaaagtgaaggcatacggcacgaaatggagaaagatttcgtcggaaatggaattcagaccaagtttaacgtgcaggaacagatggcggaaaattattactatggttgtgcgaggacaagcatcagaagtaataacaaaggctataaaagaaaacaagaacatagacatgacagacggaaaactccgacaacatccaatcgccgattctgatatacgctcagattctacaccgaataaagaagaacagttgcagctatctcaacagaacaacccttcattgataaagcaggatatattgaatgttaaagagaacgaatcgagcaaactaccaagattaaaggataatgatggacccattttaaatgacagcaagccacaagcattacctcccttaaaagagatatctgcacctccaccaatcaggatgacgcaagtcggtcagactcataccagtggtagcattaggagcaaagtatctttaccaattgaaggtctttctcaaatgaacaagcaaagtcctggaggaatctcagatagcccacagacaagccttcccccagcattcaatccagcatctctcgatgagcatatgatgaatagtaatagtatttcagattctccgaagcatgcttattctactgtgaaaactagagaaccaaattcctctagcacacaatggaaatttacattaaaagatggtcaaggtttgtcaatttctaacggaactattgacagcacaaaattagtaaaagaattggttgaccaagctaagaagtactctttaaaaatttcgatacatcaacatattcacaatcattatgttacatccacagaccatcctgtcagcagcaatactggattgtcaaatataggaaatataaatggaaaccctctattaatggatagtttcccacatatgggtagacaactgggaaatggtcttccagggttaaattcaaatagtgacacttttaacccagaatataggacttctctggacaacatggatagcgattttttatcaagaacacccaactataacgcattcagcttggaagcaacttcacacaatcccgctgacaatgcaaatgaacttggttcacaaagcaatagagaaacaaacagcccgtctgtattttatcctcaagcaaatacattgatcccaactaattctaccgctacaaataatgaaatcattcaaggaaacgttagtgctaatagtatgtcaccgaatttcaatggaacaaatggcaaggcaccaagttcgacggcatcatatacaacgagcggttcagaaatgccacctgatgtaggtcctaatagaatagcgcatttcaactatttgccaccaactatacggcctcatttaggctcatcagatgcgacaagaggtgctgacttgaataagttactcaatccatctccaaattcagtaagaagtaacggcagtaaaactaagaaaaaagaaaaaagaaaaagtgaatcatctcagcatcattcttcatcatctgtgacaaccaataaattcaatcacattgatcagtcggagatatcaaggactacatccagatctgatactccattgagagatgaagacggcctggatttttgggaaacgttaagatccttggctactacgaatccaaatcctccagttgaaaagtcagctgaaaatgatggtgccaagcctcaagtggtacatcaagggattggctcacatacagaagatagcagcctaggttcccatagcggaggatacgatttttttaacgaactgttggataaaaaggcagatacactgcataatgaggctaagaagacgagcgagcatgatatgacgtcaggaggttctaccgataatgggtcagtcctgccactgaatcctagttga

SEQ ID NO: 4899 - DNA, 2436 bp, Saccharomyces cerevisiae
atgttaagacaagctacaaaagcaccaatacaaaaatatttacagagaacgcaactattaaggcgaagtactccacgaatatacactattgtacagtgtaaaagatctatttgcagttttaatgcaagacctcgagtagccaataaacttctatcagatataaaaacaaatgcattaaatgaagtcgctatttcaacctgcgccctcaagagctcatatggattgcccaatttcaaaagaacgtacgtccaaatgaggatggatcccaatcagcaaccggaaaagccagctttagaacaatttggtacaaacttgacaaaattagcgcgcgacggtaaattagaccctgtcattggcagagacgaagaaatcgcaagagctattcaaattttatcaagaagaacaaaaaataatccatgtttgatcggtcgagctggtgtcggtaaaaccgcccttattgatgggttagctcaaagaattgttgctggggaggtccctgactcgttgaaagataaagatctagtagctttggatttgggatctttgattgctggcgccaaatatagaggtgaattcgaagaacgtttaaaaaaggttttagaagaaattgacaaggccaatggtaaggttattgttttcattgatgaagttcatatgctgcttggcttaggtaaaactgatggtagtatggatgcttctaacatcttaaagccaaaactggcccgtgggctacgttgtatctctgcaaccactcttgatgaattcaaaatcattgaaaaagatccggctttatcgagaaggtttcagcctatcttattgaatgagccgagcgtctccgatacgatttctatactaagaggtttaaaagaaaggtacgaggttcatcatggtgtaaggatcactgatacagctttagtgtctgctgcagttctttcaaatcgttatataacagacaggtttctacctgataaagccattgatctagttgacgaagcttgtgctgtactacgtttacaacatgaatccaaaccggatgaaatacagaaactggatcgtgctattatgaaaatacaaatagaactggaatctttaaagaaagagaccgaccctgtttccgtggaaagaagagaagcgttggaaaaggacctagaaatgaaaaatgatgaattaaacagattaacaaaaatatgggacgctgaaagagctgaaattgaatctatcaaaaatgctaaggcaaatttggaacaagcaagaattgagttggaaaagtgtcagagagagggtgattacactaaagcatccgagttgcgatattccagaattcctgacttggagaagaaggtagctttaagcgagaagagtaaggacggagataaagtaaatttacttcatgattcagttacttctgacgatatttctaaggttgttgccaaaatgactggtattcctacagaaacggtgatgaaaggcgacaaggaccgcctactgtatatggaaaattctttaaaagaaagagtcgttggccaagacgaggccattgctgctatttctgatgctgtacgtcttcaaagggctggtttgaccagtgaaaagagacctattgccagctttatgttcttaggtcctactggtactggtaaaacagaattgaccaaggctttagctgaattcctatttgatgacgaatcaaatgtgattcgttttgacatgtcagaatttcaagagaagcatactgtctctcgtttaatcggtgcacctccaggttacgtcttaagcgaatctggtggccaattaactgaggctgtcagaagaaagccttatgctgtcgttttatttgatgaatttgaaaaagcgcaccccgatgtttccaaactactgttgcaagtgttggatgaaggtaagctgaccgattccctaggccatcatgttgatttccgtaacacgatcattgtgatgacctcaaacattggacaagatattttattaaacgacacaaagttgggtgatgatggtaagattgacaccgcaaccaagaataaagttatcgaagcaatgaaaagatcctatccacctgagttcatcaatcgtattgatgatattctagttttcaataggctatccaagaaagttttgaggtcaattgttgatattagaattgcagaaattcaagatcgtttggccgaaaaaagaatgaaaattgatttaactgatgaagcgaaggattggctaactgacaaaggctacgatcaattatatggtgcaaggccattgaatagattaattcatagacagattttgaactccatggcaactttcttattaaaaggtcaaattagaaacggcgaaactgttagagtggtggttaaagatactaagcttgtcgtgctaccaaatcatgaagaaggcgaagttgttgaagaggaagctgaaaagtaa

SEQ ID NO: 4900 - DNA, 2439 bp, Saccharomyces cerevisiae
atgagaacgaagagaactaggggtacaagaaatgtaggagcgagcatgcctgccggcgctgcgaatgcggatagtgaagactggaaagaatatgtctccgaagacataatagcccaattgaacaagcaccagctgccgtattctgaaatattagatgagaagatcgcggacttggccaatcactggcacttccagtatgtgatggcttggctttccaatgtctgcgaatcatatactacaacgacatttaatactgaccagtatggcggtagctctaccaaatgcttgtggaagaatatcaaattcgatgaaggtgtatttgtaactgacgtattttcgaagatagacgggaaggactcgaactattacaatgatgaagtcgacgtagatgaaggatcgcaaaatttgtacgacagaattagattgcaattattgcatcaattagcgggaaataaaagcgggcaattgaaagattggaatgttatagttaaccatcacttgcaaaactcgagcgcgtattcagatttggttacggacttaccttttttggagcttgaaattgcacgccaattcgacatcatttacagtatcataaaattaattgaaatgaaaaatatgatcttcaaaaactacttagcgaataacttgcatctgtttacgtttagtgaagttatactggatgatgataatagtggaggggaggaaatgaagagcttgtttgccttacccaatgttggtgtactcgtaaagaaaaccattcacagagtaaaagaaggctcttcctcccaagtctctcaaactctgaatatcccaataaaactacagaactgtactataaaagaaagcgacccagacattcctgattcagtggagcttattcatctcgagtactctcacgatatcgatgcatatcttcaatcgattacaattgattatgatgtgattacaactaattgggggtccatgctagaatactggtcagagaataaaagttcgaaagccatagatgagttcataactaacttaataccggtgtatgccgaacatagactatattcggcaaaacttttggccaacagagaaaaggagagagcaattgcggagctaatgacaaggaggaaaagatcttcgagactggtagcgaaagaggaagaaaacaagaaaaaagacttggaaagtgagtggtttgaaaaactagatgaaagagaacaatttataaggcacagaaacaagctagtgtcgaaggaaatcaaaaagataaaagatcttctttggaaccaattgtggcaattgtacgatcaagattatagagatgaaaaattgaccaggcgtaacgagctcaaagatagaagtggttctggtacaccgttttttgaaacgtctttgggcagggaggaggacaatcccttaaatgaaatcgatatcggagttcttgatcacggccctaactttcaatctagtataatcccggtggaaccaccaattcctggaactgttgggccactacagacgggagacgtccctgaattgcctagtgacttctgcataacaaaggaagagctagatgagcttgccaactacgggatctttactccgcagcaagagcccgacaaccaagattctgttttccaatgtccgggcgaaccagagctggcgcccatgattatcaccgaagacacggagactgacctcttcaataaccgcccattgatatgctgtgatcattgttacaggtggcagcattgggaatgccaacctccaaaaattatagagcttatatcttcaaccacaaaatccccacagcacacgctgtcgcaacgtgattttggcgtcatcataatgggaaattcgcacggcaatagaaggtcttctcgcagaccccaatccacacttgaacccagcaccaagtcttcaagacctactgataaacgcaaaccgctgtctgaatgctccacttttatctgcgcttggtgcatcagggacttggaacttgagctgcgcaacatttttgtgcctgaattgaaaataataagggccaaacaaagaaaacaacaggaagaccgtgaaagaagaaaaaaaatgaaggaagaaaagaaaaggctcgaagagcttgcaaagaaaagggaactaaccgagtctgtctcacctccagtgtttaataatgcatttgcaaacatgtcaagtagcacaacgcctagtatcgccgcttacgaaaaaacaaatccagccatcaatccagcacctaatgtaaatgccgctcaccccataattacatactcgcagcaaactggcagcaaaactgtaccacaagcaccacaggcaccacaaacatcacaagcatcaatccaaccacagcagcaacagcaacagcaacagcaacagcaaccgctgcaccctaaagaacagaactttcacttccagttcccaccaaccaactag

SEQ ID NO: 4901 - DNA, 2439 bp, Saccharomyces cerevisiae
atgtcccgtttcttttcgtctaattacgaatacgatgtagccagttcttcatccgaagaagatcttttatcttcgtctgaagaagatttgttaagctcttcctcctctgagtctgaattggaccaagaatctgacgactcctttttcaatgaaagtgaaagtgaaagtgaagctgatgtagactctgatgattctgatgcaaagccttatggtcctgactggttcaagaaatctgagttcagaaaacaaggtggaggttcaaataaatttttgaaaagctctaactatgattccagtgatgaagaatccgatgaagaagatggcaagaaggtagtcaagtctgccaaagaaaaactattggatgaaatgcaagacgtttataataagatctctcaagctgagaactctgatgactggttgactatttctaatgagtttgatttgatctcgcgtctcttagttagggctcaacaacaaaactgggggactccaaatattttcatcaaggttgttgcccaagtggaggacgctgtgaataatacacaacaagctgatttgaagaataaagctgttgcaagagcttataacactacaaagcaaagagtcaagaaagtttctagagaaaatgaagactcaatggctaaattcagaaatgatcctgaatcatttgataaggaaccaaccgcagatttggatatttctgctaatggattcacaatttcttcgtctcaaggcaatgaccaagcggtacaagaagatttcttcactagattacaaacaataattgactcaagaggtaagaagactgtcaatcaacaatccttgatttctactttggaggagttattaactgtagctgaaaaaccatatgaattcataatggcttatttgactttgattccatcaagattcgatgcctcagctaacctatcttaccaaccaattgatcaatggaaatcttcattcaacgatattagtaaattattgtctattttagaccagacaattgacacctaccaagttaatgaatttgctgatccaatcgatttcattgaagatgaacctaaagaagattctgatggtgtcaagaggattctgggttccattttctcatttgttgaaagattagatgacgaattcatgaaatccctgttaaacatcgatcctcattccagtgattatttgatccgtttaagggatgaacaatcaatctataatttgatcctaagaactcaattgtactttgaagcgactttgaaagatgaacacgacctagaaagagcattgacacgtccattcgtcaagagattggatcatatctactataaatccgaaaatttgataaaaattatggaaactgctgcttggaatatcatacctgctcaattcaaatctaaatttacttcaaaagaccagctcgattctgctgattatgtcgacaatttaatagacggattatcgacaatcttatccaagcaaaacaacattgctgttcaaaaacgtgctattttatacaacatttactacactgcattaaacaaagatttccaaactgctaaagatatgttactaacttcccaagttcaaacaaatatcaaccaattcgattcatccctacaaattttattcaacagggttgttgttcaattgggtctatccgcctttaaattatgtttgattgaagaatgtcatcaaattttgaatgatcttctgtcaagttctcacttaagagaaattttgggccaacaatccctacacagaatatctctcaattctagtaacaatgcttcagctgatgagcgtgctagacaatgtttgccatatcaccaacacatcaatctcgatttaatcgatgtcgtcttcttaacatgttccttattgatcgaaattccaagaatgactgccttctattccggtattaaggtcaagagaattccttactctccaaaatccattcgtcgttccttagaacattacgacaagttaagtttccaaggtccaccagaaactttaagagattatgtcttgtttgctgccaaatcaatgcaaaaaggtaactggagagactctgttaaatacttaagagaaataaaatcttgggctttattaccaaacatggaaacggtgttgaatagtttaacggaaagagtacaagttgaatctttgaagacttatttcttttctttcaagaggttctattcaagtttttctgttgctaaactagccgaattatttgatcttccagaaaataaggtggttgaagttttgcaatctgttatcgcagaattggaaatcccagccaaattaaacgacgagaagaccatctttgttgtcgaaaagggtgatgaaattactaaattggaagaagcaatggtaaaattgaacaaagaatataaaatcgctaaagaacgtcttaacccaccatcaaatcgtcgttga

SEQ ID NO: 4902 - DNA, 2445 bp, Saccharomyces cerevisiae
atgaaagtgaggaaatatattactttatgcttttggtgggccttttcaacatccgctcttgtatcatcacaacaaattccattgaaggaccatacgtcacgacagtattttgctgtagaaagcaatgaaacattatcccgcttggaggaaatgcatccaaattggaaatatgaacatgatgttcgagggctaccaaaccattatgttttttcaaaagagttgctaaaattgggcaaaagatcatcattagaagagttacagggggataacaacgaccacatattatctgtccatgatttattcccgcgtaacgacctatttaagagactaccggtgcctgctccaccaatggactcaagcttgttaccggtaaaagaagctgaggataaactcagcataaatgatccgctttttgagaggcagtggcacttggtcaatccaagttttcctggcagtgatataaatgttcttgatctgtggtacaataatattacaggcgcaggggtcgtggctgccattgttgatgatggccttgactacgaaaatgaagacttgaaggataatttttgcgctgaaggttcttgggatttcaacgacaataccaatttacctaaaccaagattatctgatgactaccatggtacgagatgtgcaggtgaaatagctgccaaaaaaggtaacaatttttgcggtgtcggggtaggttacaacgctaaaatctcaggcataagaatcttatccggtgatatcactacggaagatgaagctgcgtccttgatttatggtctagacgtaaacgatatatattcatgctcatggggtcccgctgatgacggaagacatttacaaggccctagtgacctggtgaaaaaggctttagtaaaaggtgttactgagggaagagattccaaaggagcgatttacgtttttgccagtggaaatggtggaactcgtggtgataattgcaattacgacggctatactaattccatatattctattactattggggctattgatcacaaagatctacatcctccttattccgaaggttgttccgccgtcatggcagtcacgtattcttcaggttcaggcgaatatattcattcgagtgatatcaacggcagatgcagtaatagccacggtggaacgtctgcggctgctccattagctgccggtgtttacactttgttactagaagccaacccaaacctaacttggagagacgtacagtatttatcaatcttgtctgcggtagggttagaaaagaacgctgacggagattggagagatagcgccatggggaagaaatactctcatcgctatggctttggtaaaatcgatgcccataagttaattgaaatgtccaagacctgggagaatgttaacgcacaaacctggttttacctgccaacattgtatgtttcccagtccacaaactccacggaagagacattagaatccgtcataaccatatcagaaaaaagtcttcaagatgctaacttcaagagaattgagcacgtcacggtaactgtagatattgatacagaaattaggggaactacgactgtcgatttaatatcaccagcggggataatttcaaaccttggcgttgtaagaccaagagatgtttcatcagagggattcaaagactggacattcatgtctgtagcacattggggtgagaacggcgtaggtgattggaaaatcaaggttaagacaacagaaaatggacacaggattgacttccacagttggaggctgaagctctttggggaatccattgattcatctaaaacagaaactttcgtctttggaaacgataaagaggaggttgaaccagctgctacagaaagtaccgtatcacaatattctgccagttcaacttctatttccatcagcgctacttctacatcttctatctcaattggtgtggaaacgtcggccattccccaaacgactactgcgagtaccgatcctgattctgatccaaacactcctaaaaaactttcctctcctaggcaagccatgcattattttttaacaatatttttgattggcgccacatttttggtgttatacttcatgttttttatgaaatcaaggagaaggatcagaaggtcaagagcggaaacgtatgaattcgatatcattgatacagactctgagtacgattctactttggacaatggaacttccggaattactgagcccgaagaggttgaggacttcgattttgatttgtccgatgaagaccatcttgcaagtttgtcttcatcagaaaacggtgatgctgaacatacaattgatagtgtactaacaaacgaaaatccatttagtgaccctataaagcaaaagttcccaaatgacgccaacgcagaatctgcttccaataaattacaagaattacagcctgatgttcctccatcttccggacgatcgtga

SEQ ID NO: 4903 - DNA, 2445 bp, Saccharomyces cerevisiae
atgacatccgatgatgggaatgctggacaagaaagagagaaggatgctgaactgattgaggttgggggcaagaaagtgagcaagacttcgacagggaaacggaagtttcataacaagtccaagaccggttgcgacaattgtaaaagaagaagagtaaaatgtgatgaaggcaaaccattttgcaagaaatgtacaaacatgaaattggactgtgtttacagccctattcagccaagaagaagaaaagattcttcgtcgtcaaaatttgcatcagcggtccacgatagggtaggcaagaaaaatctgagtgacaatgccatcatgttacaacaacaacaacagcaacttcatcatcaacaagaacagcaatttcgtcaacaacagcaagttcagttacagcagcaactgttgccacatgttggtactgatgaacaaagcaattcccctaatagcgttcctccatccgtatccaataatatggagaatcttttgttaccgcacctattagcgagtttagtgaataacaccagtaacagtaccaacagcagtgcaaatggagctgaagcgcataataatataacacaaacagctcccagttcaatgataaacaacaaccacccaaacatggccctaccagggaattcgccattgagtataccgataacacctagttttcaatcaacggccatgaatttatcaagtagccttaacggcttactctcgcctggtaggctaaattcggtgacgaatggattgcagcagccacaacttcaacaacaaaatcagcaaattccacaacaacaaggaacacagtcccccttcagcaatattcccttcgaccagctagcgcaattgaacaagatgggcttgaacttcaatatgaagagcttcaatacattatttccatacggtgctgcaaatggaatggcctctgagtttcaagagttatttggcctcggaaagtttgctacatctaataacagagcaatcaaagttagcacagcagaggaggcactcgcaaatatgcaacaggaacaggaggacaaaaacaagcaatttacgaagaacccattggataatactaagacggatgctgttaattcgggcaataacccccttaacggaaacgaaaataaagttactgcttctgatatactatctcataacaaaaacttgataatcgacaataccggtctcacaatcagtcccccacacacgttgtccaaaccttccatagatcaaaacattgcgtccccttcaacgggagtatccaatgtaacctctacaaagtcattgttatctataccggacaacaggaccgctttgggaaattctcctactttgaagacgtccccaatgggtgacctgttatccaactcggaggcattgtctccacgttcatcaaattctcacactcaacaacaatcttctccccattcaaacgcttcatcagcctcacgactagtccctgaattagtcgggctgtctagaaaatcaaatttgaatttgatagatctaaaactttttcatcactattgtactgacgtatggcataccataaccgaagcaggcatttctggtcctgaagtatggagcacttatattccggatttggcttttcattttcccttcttgatgcatacaattttggcttttagcgccactcatttgtccagaactgaagccggcttggataactacgtgtctagtcatcgtttagaagcgttgagactgttaagagaggctgtgctcgaaatttcagatgataacacagatgctttggtggctagtgctctaatattaatcctagattcattggcaaatgcttcaagcagctcaccaacggcatggattttccatgttaaaggcgccgtaactatactaactgctgtatggcccctgtcggagacatccaagttttataacttaatttctgttgacttgagtgatttgggtgaagctgtaatcaaccaaagtaatcataataatgataatgacaatagcaataatggtgatggaaataacaataatacgatatcggaactcgtatgctttgacgaaagtatagcagatttatatcccgtagaaattgattcaccgtacttgataactttagcatatttggacaaactgcatcgcgaaaaaaatcaattagattttatgttgagagtcttctcatttcctgctcttttggataggacttttttagcattattaatgacaggcgacctaggggccatgagaataatgaggtcttactatacattattgagaggttataccacagaaataaaggacaaagtgtggttcttggatagcgtatcacaggttttaccacaggatgttgatgagtatagtggaggtggtggtatgcatatgatgctggatttcttaggaggtgggttaccttctatgaccactacaaacttttcagcttttatgtaa

SEQ ID NO: 4904 - DNA, 2448 bp, Saccharomyces cerevisiae
atgggaaacagtccttctactcaggatccatcgcattcaaccaaaaaggagcatggacatcattttcatgatgcattcaataaagatcgtcagggaagcataacctctcaactgtttaacaataggaagagtactcataagagacgcgccagtcatactagcgaacataatggtgccattccccctagaatgcaattacttgcatctcacgatccatcgacagattgtgatgggcgcatgagcagtgatactactatcgataagggcccgtcccatctattcaaaaaggattattctttgtcctctgccgcagacgtaaatgacactacgttggccaatttgactttaagtgatgatcacgatgtgggtgcacccgaagagcaggtgaaatctccgtcgtttttgagcccaggtccatcaatggccactgtcaaacgaactaaaagtgatctggatgatctgtctactttgaattacaccatggttgacgaaacaacagaaaatgaaagaaacgacaaaccacaccatgaaaggcatcgctcaagcatcatagctttgaaaaaaaatcttttagaaagttcagctactgcttccccttctccaacgaggtcttcatcggtgcattcagcatcacttcccgccttgaccaagacggattccattgatattcctgtaagacaaccctattcaaagaaaccatctatccatgcataccaatatcaatatctcaataacgacgaaacattttctgagaactctcaaatggataaagagggaaacagtgatagtgtagatgcagaagcaggcgtacttcaaagtgaagatatggttttgaaccagtctcttttacaaaatgctttaaaaaaggatatgcaacgtctttcaagggtgaattcctctaattcaatgtatactgcagaaaggataagccacgctaataacaatggaaatattgaaaataacacccgtaacaagggaaacgcgggaggctccaacgacgattttaccgcacctatatctgctactgcaaaaatgatgatgaaactgtacggtgataagaccttgatggaaagagatttaaataagcaccataataagacaaagaaagcccagaataaaaaaataaggtcggtttcaaattcgagaagatcctcatttgcttctttgcattctttacaatcaagaaagagtatcttaacaaacggtttgaatttgcagcctttgcatccactacatccaattattaacgacaatgaaagtcaatactctgcaccgcagcatagagaaatatcgcatcactctaattccatgtcgagtatgtcttcaatatcatcaacaaactccaccgaaaatactttagttgttctaaaatggaaagacgatggtaccgtggctgcaaccacggaagtctttatagtaagcacggatattgcttctgctcttaaagagcaaagagagcttaccttggatgagaatgcaagtttagactcagaaaaacagttaaatcctaggatccgcatggtttatgatgatgtgcataaggaatggtttgttccagatctttttttgcctgcaggaatttatagactgcaattctccatcaatggtatattgactcactcaaattttcttcctacagctacggattcagaaggcaattttgtcaactggtttgaagtattgcccggttatcatacgatcgagccatttagaaacgaagcagacatcgactcgcaagtagagccaacactggatgaagaattgcccaagagaccggaacttaaaagatttccttcttcctctcgaaaatcttcctactattctgctaagggtgttgaaaggccaagtacaccgttttcagattatagaggcttaagtaggtccagttcaataaatatgcgtgactcatttgtacgtctgaaggctagcagtttggatttgatggccgaggtcaagcctgagaggttggtgtattcgaacgaaataccaaatttatttaatataggtgacggctctacgatttctgtaaaaggagattctgatgacgtgcatccccaagaacctcccagctttacacatagagttgttgactgtaatcaagatgatttatttgctactttacagcaaggcggtaatattgatgcagaaacagcagaggcggtttttctaagtagatacccagttcctgacttgcccatatacctgaattcatcctatctgaacagaatactaaaccaaagcaatcagaattcagaatcacatgagagggatgaaggtgcgataaatcatattataccccacgtgaatttgaaccatttactgacaagcagtattagagatgaaataatcagcgtagcttgcactactagatatgaggggaaatttatcactcaagtagtttatgcaccttgttattataaaacacaaaagtctcagatcagtaattag

SEQ ID NO: 4905 - DNA, 2448 bp, Saccharomyces cerevisiae
atgtctgagactctgcctagatctgatgatttagaggccacttggaactttatagagccaggaattaaccaaatactgggtaatgagaaaaaccaagcatccacgtctaagcgagtttacaaaattctttctccaaccatgtatatggaagtctataccgcaatttataactactgtgtgaacaaatcacgctcgtctggacattttagtactgacagtagaactggccaatcaacaattttggttggcagtgagatttacgaaaagttaaagaattatttgaagaattacattttaaattttaagcagtctaattcagagacctttttgcagttttacgtcaagcgctggaaaaggtttacaataggtgccatttttttaaaccatgcattcgattatatgaatagatattgggttcaaaaggaaagaagtgacggcaaaaggcatatttttgatgtaaacaccttgtgcttgatgacatggaaagaagtcatgtttgatccgagtaaagatgttttaataaacgaattattagaccaggtaaccttgggaagggaggggcaaataattcaaagaagtaatattagcactgccataaagtctttagttgcactaggtatcgatccacaggatttgaaaaagttgaacctaaatgtctacatccaagttttcgaaaagccatttttaaagaagactcaggagtactacacgcaatatacaaacgattatttagagaaacactcggtaactgagtatatttttgaagcacatgaaatcatcaaacgtgaggaaaaagcaatgacaatatattgggatgatcatacaaaaaaaccactatccatggcattaaacaaggtcttgatcacagaccatattgaaaagttggaaaatgagtttgttgtccttctggatgccagagatattgaaaaaattacttctttgtacgcactaatacgcagagactttacattaatcccaagaatggcttcagtgtttgaaaattatgttaaaaagacaggtgagaatgaaatttcgagtctactggcaatgcataaacacaatattatgaaaaacgaaaacgcaaaccctaaaaaactagcactaatgacagctcactccctttctcctaaagactatatcaagaaattactggaagtacacgatatattctctaagatttttaatgaaagtttccccgacgacatacctttagctaaagctctagataatgcgtgtggtgctttcatcaacatcaacgagttcgcattacctgctggatctccaaaaagtgccacctcgaagacttccgagatgctagctaagtacagtgatatactattaaagaaggccaccaaacctgaagtggcaagtgacatgtcagatgaagatattataacaatattcaaatatttgaccgacaaagatgcgttcgaaactcattatagaagacttttcgccaagcgtttaattcatggcacttcaacatcagcagaagacgaagaaaatattattcaaaggctgcaagcggcaaatagtatggaatatacaggcaagataactaaaatgtttcaagatattagactttccaagatcttggaagacgattttgctgtcgccctgaagaatgaaccagattactctaaagcaaaatatccagatctacaaccatttgtattggcagaaaatatgtggccattttcataccaagaagttgaatttaagctacccaaggaattggtaccatctcacgaaaaattgaaggagtcatacagccaaaagcataatggtagaatattgaagtggctatggccattatgtcgtggcgaattgaaggcagatattggaaaacccggcaggatgccgttcaactttacggtaacactgtttcaaatggcaattttgctactatataacgatgctgatgtattaaccttagaaaatattcaagagggcacgagcttaaccattcagcacatcgcagcggcaatggtaccattcatcaaattcaaactgattcaacaggtcccaccagggctagatgctctcgtgaaacctgaaacacaattcaagctatcacgtccttataaggcgcttaagaccaatattaatttcgctagcggagtcaaaaacgacattctgcaatcgctatccggtggaggccacgataatcacggtaataagttaggaaacaaacgcttgacggaagacgaaagaatagaaaaagaattgaatacagaaaggcagattttcttggaagcttgtattgtgagaataatgaaagcgaaaagaaatctgccacatacaacattggtcaacgaatgcattgcgcaatcacaccaaaggttcaatgcaaaggtttctatggtcaagagagccatcgatagcttaatacaaaagggatacctacagaggggagacgatggtgaatcgtatgcttaccttgcttaa

SEQ ID NO: 4906 - DNA, 2451 bp, Saccharomyces cerevisiae
atgctattcaatatcaaccgtcaagaagacgacccctttacgcaattgatcaatcaatcttcggcaaatacgcaaaatcagcaagcgcatcagcaggaaagcccttatcagtttttgcaaaaggttgtgtccaatgagccaaaaggtaaggaagagtgggtctcgccatttagacaagatgccctcgccaataggcaaaacaaccgggcatatggggaagacgcaaaaaacagaaagtttcctaccgtaagtgctacttctgcctattcaaaacagcaacctaaggatttagggtacaaaaacataccaaaaaatgctaagagagccaaagatattagatttccaacttacctaactcaaaatgaagaaagacaatatcagttactaactgagttggaactaaaggagaaacatttgaaatatttgaagaagtgccagaaaattactgacttaactaaggatgaaaaagatgacactgacactactacttcttcgtccacttctacatcatcatcgtcatcgtcatcgtcatcgtcatcgtcatcgtcttcatcagatgaaggggacgttacttctactaccacatctgaggccactgaagcaactgctgacactgcaactacgacaaccactaccaccagtacttctactaccagcacttctactactaatgctgtcgaaaatagtgctgatgaagcaacttccgtggaggaagaacatgaagacaaagtgagtgagtctacttcaattggcaaaggcactgctgattcagctcaaattaatgtagcggaaccaatctcatccgagaatggggtgttggaaccacgcactacagatcaaagtggcggttcaaagtcaggtgtcgtgccaacagacgaacaaaaggaggaaaaatccgatgtaaaaaaagtcaatcctcccagtggggaagaaaaaaaggaagtggaagcggaaggggatgcagaagaggaaaccgaacaatcgtctgcagaggaatctgctgagagaacgtctactccagaaacctcggaaccggaatccgaagaagatgaaagcccaatcgatccaagcaaggctcccaaggtcccttttcaggaaccttctcgaaaggaaagaaccggaattttcgctttatggaaaagccctacttcttcatctacccaaaaaagtaagaccgccgctccatccaatccagtggccactccagaaaatcctgaattaattgtaaagacaaaagaacatggttacctatcaaaggcagtttatgataaaatcaattatgatgaaaaaattcatcaagcatggttagctgatcttcgagcaaaggaaaaggataaatatgatgctaaaaataaagaatacaaagaaaagctacaagatttacaaaatcagattgacgaaattgaaaattcaatgaaggccatgagagaagaaacttctgagaaaattgaagttagtaaaaaccggttggtcaaaaaaatcattgatgttaatgccgagcataataataagaaactaatgatattaaaagacactgaaaatatgaaaaaccaaaagttgcaggagaaaaatgaggtcttggacaaacaaaccaacgttaagtcagaaatcgatgatttgaacaatgagaaaacgaatgtccaaaaggagttcaatgactggaccacgaacttaagtaacttatctcaacagttggatgctcagatctttaagattaaccagattaatttgaaacaaggcaaagttcaaaacgaaatcgataatctggaaaagaaaaaggaggatttggttacccaaactgaagaaaataagaagctgcatgaaaaaaatgtacaagttttggaaagtgtagagaacaaggaatatcttccacaaattaatgatattgataatcaaatatcaagcttattgaacgaagtgaccataatcaagcaggaaaacgccaatgaaaaaactcaactatcggcaattaccaaaagactcgaagatgagcgccgcgctcatgaagaacagttgaagctagaagctgaagaaagaaaacgcaaagaagagaacttattggaaaaacagcgccaagagctggaggaacaagcgcatcaggctcaattagatcatgagcagcaaattactcaagtcaagcaaacctataatgaccaattgactgaactacaggataagctggcaaccgaagagaaagaactggaggcagtcaagagggaaagaacgcgattacaagctgaaaaggctatcgaggaacaaactcgccagaaaaacgctgatgaggccttgaagcaagaaatattgagtaggcagcacaaacaagctgaaggtatacacgcggctgaaaaccacaaaataccaaatgaccgttcacaaaagaatacgagcgtccttccaaaggacgattccttgtatgaatatcatactgaggaagacgtcatgtatgcctaa

SEQ ID NO: 4907 - DNA, 2451 bp, Saccharomyces cerevisiae
atggatgttgtgcagcagaaacaggataaacagttgcagcatcaaacacaagagcagcagcagatacgagaggaccagcaggaagtcccaccccaacgtccacgacaacaaaacagatggaaaccctggtggaattccactgccgacgatgagccaaacacgggaagaattgcagaatatcctaatggacaaggaaggagtagtccgacaacggattttcaagatagcgtgaactcgaataatgacaataaagggatatggtctaaaatcgcttcttttgcaacatccagatatagaagtgccccaattgttgttgatgataatacccgctactctcaactaaacactgaacaaatcaacttcttggaaaatgaggctaaggatataatttcaaaaaagtcgaaatcatggtgttggtacgaagcaattccacatatatcaaattcatcaaacataattgattccatagataccccaggaataatcagtgtctctggtacaggatcagccaaatgcccattgccattaaacaaatatcctggggagggaggtaaccctgggtataatgtatttattaatgattctttaatcctaccatcagataaccctttgaattttctgcacgtccaaccactaagaactaaggtattgaatactatcaaaaattactataacttccctaatgagcaacatctctatttaagacaaaaaaaaaccgcattactgaaggataagagaattattataatatccgtcgtgggggatttaccagaaaagtatgagcagcgctcattagaatcacaaagatcggcttattatctttctagaaaattgtcacaaaatctagcgcaagaacaacctcaaagagtcttgaccctatcgttccagtgcccactgcataatcaagatttaatacctacatataaagaatgtgtagagttactgaaccactgggctcatcttttcaaagaggtagattcaattttttttgtgggcgtttatcacagcgttcccttaactttgctattagcgaaatatatcgtgcaaaataatgaagttctagagtttgatgaaaacactacagtgagtgtattgagtttccagtcatgtttacaaggctatcgattttgggaccacagcactgactttactagcaatagttataataacttgggttccaattccagtactaacgaaaatgatagtaatgatcatgattcaaataatgatttcacaacgaagagccaacaaatcaaagaaaaacagttatttcagggcattgacaaaaagcaacaagacacattatctaaaatcaaaaattataggcggatagattctagtgaatctaaactagttcaggatgcattggattggctcttgttcaattgggatacgtttcgactgacattttttggtaagctttatgataattttatgacaatttcagaaaaacttgctatagattataatcaccctaaaatcttgagaaatttatggtgcaatgggaagtacatgggcattgatttaaagaatgctaataatttaaaccttgataccgatgatgaagcaactagtaacattaatgacgtccatgtaaggacccctaattttgaatcgagattgaagattcccaccaacagacttttcgaaataaccttatgggatattttgatgataacggagaatttaggatataaacaatttattcccataattaatttactaagtcctttttttatttcaaggtcatttaatgattacacattgcctccaaatattaggaaacagtaccagaacagcaacaaaatctggcttcaagaaatggacagtaagtggaaaatgaatggtcatcaactcaattacgaccaaagggagggtgaaagtctcggttcatcatcggaatcattattgccagagaatatttctacggtaaaggattttttgcagtttgtgcagtatcaaaacgaaaaatcttcggatttcgtaaggatatattcagacatttatgatgacgataaagtctataaatgctttctgtacaatacaatattcacgaaaaacccattaagtcgtaagcatttacgtttaaacatcgacctcgacactcctacaagcatattgaatactgtcaatcaatatgatttggtatggaaaattcatgattccttctccaaattgattcaattgaaaaatttaccgcagcgagagataccacatgcgttgaggctctccatctcattaaactgcttcttggatagtaccacgagtacttctggccctgtttttcagagggacaccgtggaagctttgagaagattaacagagatttggcgaacttaccaggattggtctccaccaacaaggggtttgaaacacctacgtgatatcctgagcgttttagccatgtatgacaaccccaaaaacttgattaatgatgttcgacgtacatag

SEQ ID NO: 4908 - DNA, 2454 bp, Saccharomyces cerevisiae
atgagcactgaacaggtcggtagaaagaaatcgtatagatgggttagcgcatctcaagcaagttatgacggcgctggatgggacagtagtgacgaatatgactactcttccgaggatggcacaaaaggttcagaaattcacaagcaaaaaatatctaatttgcctagtttacccaagctcaattatacagatgttaatggtgagcatgatgaaaatacgggtgaaaataaagacagcaatgataataacgtcagtaagagtgatattagtcctagtgacaaggaagtaggctatctctcagatggggtgcctaaacttatggcttcaagagagtctgtggaattacaagcgaaaaaatccagcgagcactccaaatcagattatctttcgtcgacagcatctttgaaaagtccaagtgaaaacaaaaaatcaccacatacaaatagggctgtaaacgaagacctagacaatttgatagagcaaatatcaagggagatgacaccagaaattaggcaaacatctgattttcggcgtgattcagacagttgtgacgaaatccaaaacgaagcaccattaggggaagcggtaccctcttcatcatctcctgtagaagaagatgaaaaatcacattccttaggggtttcaatggatactaatgaagctgataccactttcaatacgccaacaaggaatggaaatgaacatttgagtagtgatggcgatgtttctgagcagaaagacgacgagtttaaagtttccgaaagaggctaccttgcagatattctgcctgcggagaaagaggagaatttacaacaagaagatgatggtgaagtcgagagctcaggagctttggaaaagaaagaaaaaagtgaagaaaagactagtattaggaataggaactctacatctagtgggcaagataaagtagcaaagccgaaacccgtagcaaatgaaacaaaaactagtgataatggatatcgaaattcttttttcaatgattatcagcattcgtcagactctgaagaagatgataacaacgaaggcaacagtggtagtagtgatgatgataatcgatcttcggttagtgataaacatgctgatattaaccggcaatcgaaacaacttgatacaactgacgatgatgcattgtcgtataccgaatcaataaaatattcgacaaatgagacagaagaagaagataatgaagataatgaatccatagaagacaaaaacgaagataatgaatccatagaagacgaaaatgaagatacagatagctataaattttctaatagggaaaaaggttccattctacttacgagtgatgaagaggaggaggaaaaaggtatgagctctgattcagatgaaggcagtctcaaggcgcccaaatcaggttatttctccaaaatgattggtaatgatgataaaggtgattcagcattgcaacctaatcaaatagacaccattgaaaataccaatttgtcaaatagcggttctgaattggaaaacagcgatggcagcgatgaggaagaccacataaatgaagacaaagttttggaagaaagttcagttaaagactccactgatgttgattcttggaagccggacagtgaggccttacgatcagggttcgtacaggatacagccaataagaaagcgccaccaggttacgtgatcgattctaacgggaagctagtagatttaacacctgctagtatgaaaccacgtgttgtatcgacttattcagagatggagagtacttgggatgcattcccttccaaaggcgaagatgacgatttggagacaatcagggacactaagactatatacgacaacaatacgatttataatgttcccggtttgattggtaaccaatcgaatttgccacctctaccgatggacgcacaggaacaattaaatgcaggaaacgataatagtacaacagataatgataatagtaacaatactgccaatgatttggcagcgcgcagtgcatctttcaaaagtgaaaacagaacagtatctcaaggcgaaatgacaagcgtccatgaacccagtactgaagaaatggcgaaattggggcagcagaataacttaccgaaattagatatgaataaactactgaacagtaagacttcgcacgccggtaagatagaacagttgagaaattataagcgtgagctagatgaatatgatacggggatacaaacatggataaattatacgctaaaatcatcctctaataaggataaggatttcatagctgaggagtataagcagcatagtcacgttagggaagcatatgcgaacgcggacgatttgagtaagaagcatactgtcattaacacggttgctagtgtcaaccaaaatgtaacgcacttaaggagaaaagttttccagcattctatgaaaccaaaggatttattcgcatcaataggtaagaaaaaactgtaa

SEQ ID NO: 4909 - DNA, 2454 bp, Saccharomyces cerevisiae
atgcctaactcaaatgttcggattcctcctactgttccatcgaagataatagatgtggtcgaccaagcgctaagagcgcgactcttaggtggcagcaccttcaattcagggtttgatagtttagattccgtacttaacttacagtttagactacattaccatgttattggatcgaatgggcctgcaaaaccagtttgtgatgttttactgaaggaaagtcaaaatttagaaaagaatatgagtatgatggaggagttgaatgactatccggagattacaaaactagtggagaaaattctgttcaattgcctcggtattcttttcttccacaggggccaatttcaggaatcgcagcggtgcttgctgcactcgttgaaaattcataataacactgcatcgcaaaaaacagcacttatggagcagtatgataggtatttgatcgtagaaaacctgtactaccgtggtctagtttcgcaagacataaatatcatgcaaaatgttttttacaaagaactactggcccacgtggatacgatccctcccgaatcaaacggtcttcttttcgaatacatcagcttgatcgtcgcaaaactcaggttcaatcaaattcaggatttagcagaaaattttaaaactaccgtcgaaaatccttttattcttttcctttacatgataaagaagttccagtcacctctcaaaaagcacattgataatgatgatctttatttgaagttcggacagaacgttttgttgaaggccaaatttcctactgctagtgagacaaatgatgaagctttggagcattttaatgtctttttgcagtattatttcaaattcactcacataaaaaaaataaaagtgaatcccagttggtataatttcataatatcttcaatggaaaagacttttcaaagtattgaagtttcgaaaacagcaatgtttcttttccaaaacctaagcgataacagtaatgacgaaataaagaagaagacatttaaaagagaatctatactaaattttgttaattttgtgaaatacaacgacaagtactatcaactgcacgataactcccaccgtgacataatttcattcattgatgcgtattcttttattttacaaaactcctccaaaaccgattcaatcgaaaatgtttttgattacgataatacggtatctacgtttgcgacttccttgaattccttctacaaagaatataatttgccattaatgagccaatcagaatctttagattggctagaaaacagcaccagatgtgtatacccaggaaacatttcgaaagttctaacaaatgcgtggtcaacattgtacgaaatcagaaaatatcagttagattttcttgtatctaataatttgacttcatatctatgtaatgcaatgatgctgtccacaaaagaaaaagacaatgctgatgtagaagagcaggaagaaggagaggaggagaaggcattacgtgaattacaatttaaatattcttacactctagcacaacagaggcacattgaaactgcaatcaagactctagaatcattgatattaagtaaaaacccaaattactacaaagcttggcatctattagctctttgtaggtctgtgcaagaggataaggaaatgtcgtacaagatagtttgctctgttctagaagctatgaatgaaagtcttcagaacaatactttacttctgaatgatagatggcaatttattcacctaaaattaacgcaattggcgctaattgaagaaatttttggcactttagaggcactggagacacttccagaggtctttgaattatacgcaacattatttccagattcacaacctgaattgaacagcatgggtcccaaatattctcaaactaaagaatatcttttacaaatggtgtggatttttgctgcaaatatgtacatgagaacaaaagacaatgatgaggatgccaaggccgccatcaaagaagcctccaatgtcgaaagtaaattcaagaatttaaattgtaatattgctaacggttatttatcaataataaaagatgaaccaggcgtggcattaaaggaatttgaaacagttctgtactatgatgagaataatttagatgccttggtcggattcgctgaattaattttccctgaagaactaggcgtcgaggaaactaatcttgagcgttattatactctcagccttgataaaaaaccaggtaagagggccaaacttacgttcgttaatgacacagataggtcagcagcgtatgcaagactaaaatttctattggagtgcgcaatactagaatcgatcgaggcttactattccccagaagtttggtggtatttgtccctcatttacgagaaatatcaagatgacgagtacaaaaactctttgctaaaatgtattaaataccaagagttgaatcccattcgctccctaaggtattgcaattactaa

SEQ ID NO: 4910 - DNA, 2454 bp, Saccharomyces cerevisiae
atggatctgaaaacctcatataaaggtatatcgttaaaccctatttatgcaggaagcagtgctgttgccactgtttcagaaaatggtaaaatactagctactccggtgcttgacgaaatcaacataatcgatttaaccccaggctccagaaaaattttgcacaagatttctaatgaagacgagcaagaaattactgcactgaaattaactcctgatggtcaatatctcacgtatgtttcacaagctcagcttttaaaaatctttcaccttaagaccgggaaagttgtcagatcaatgaaaatctcttctccatcgtacattctcgacgcagattccacttcaacgcttctcgcagtcggagggacagatggtagtataattgttgtggatattgaaaatggttacattactcattcgttcaaaggtcatggtggtacaatttccagtttgaagttttatggacaattgaatagtaaaatatggttattagcatccggtgacaccaatggtatggtaaaggtttgggatcttgttaaaaggaagtgcttgcacacattacaagagcacacatctgctgtgagagggttggatatcattgaggtaccagataatgatgagccaagcctaaatttactttccggtggtagagacgatatcatcaatctctgggatttcaatatgaaaaagaaatgtaaattgttgaaaacacttccagtaaatcaacaggtagagtcatgcggattcctaaaggatggtgacggtaaacgcataatttatacagccggcggtgatgctatctttcagttaattgactctgaatctggtagcgtgcttaaaagaaccaataaacctatagaagagttattcattattggtgtacttccaatattgagcaattcacagatgtttttagtattgtctgaccagacattacaactaattaacgttgaagaagacttaaagaatgatgaagacacaatacaggtcacttcgagcattgctggtaatcatggtattattgctgacatgaggtatgttggcccagagctgaataaattagctttagctaccaattctccatcgcttaggataatacccgtccccgatttatcaggcccagaagcttcgctgcctttggatgtcgaaatttatgaaggtcatgaagatttgctaaattcattggatgctactgaggatggcctgtggatcgcaaccgcctctaaagataatacggctattgtttggagatacaatgagaacagctgcaagtttgatatttatgccaagtatattggtcattcagctgccgtaactgctgttggattgccaaatatagtttcaaagggatatcctgaatttttattgacagcatcgaatgatttaacaattaagaaatggataattccaaagccaactgctagtatggatgttcaaatcatcaaggtatccgaatatactcgtcatgcccatgaaaaggatatcaatgctttgtcagtttctcctaacgattctatttttgcaacagcatcatacgacaagacctgtaagatctggaacctagaaaatggtgaattggaagccacgttggccaaccacaagcgtggactatgggatgtatcattttgccaatatgataaattattggcaacttcttcaggtgataaaacagtcaagatatggtcattggatacattcagcgttatgaaaacattggaaggtcataccaatgcggttcaaagatgttcgtttattaataagcaaaaacaactgatcagttgtggtgctgatggcttgatcaaaatatgggattgttctagcggtgaatgtctgaagactttggatggtcataataatagattatgggctttaagtactatgaatgatggtgatatgatcgtaagtgctgatgcagatggtgtttttcagttttggaaagattgtacggaacaagaaatagaagaagaacaagaaaaagctaaattacaagtcgaacaagaacaatcgcttcaaaattatatgagcaaaggtgattggacaaatgcatttttgttagcaatgactttagatcacccaatgaggttgtttaatgttttgaaaagagctttgggcgaatcaaggtctagacaagataccgaagagggcaaaattgaagtcattttcaatgaagaattggaccaagccatctctatcctaaatgatgaacagttaattttgttaatgaaacgatgcagagattggaatacaaatgcaaaaacacataccatagcgcaaagaacaataagatgtattttgatgcatcataacatagcaaaattgagtgagatacccggaatggtaaagatagttgatgcaataattccatacacgcaaaggcatttcacaagggttgataacttagttgaacaaagttacatattagactacgcgctagtggaaatggataagctattctag

SEQ ID NO: 4911 - DNA, 2454 bp, Saccharomyces cerevisiae
atggcaggtgctccagctcctcctcctccaccgcctccaccagcattaggtggtagtgctcctaaaccggcaaaatctgtgatgcagggccgtgacgccctgttaggtgacattagaaagggaatgaaactaaagaaagctgagaccaatgatagaagtgccccaatcgtgggaggtggtgtcgtttcatcggcctcaggaagttctggtaccgtcagtagtaaaggaccctctatgtcagctcctccaatccctgggatgggcgctccgcagttgggcgatattttagctggaggtataccgaagttaaaacatatcaataacaatgcaagcactaaaccctctccatcggcgagcgcaccgccaattccgggcgcggtgccatctgttgcggctccccccattcctaatgcaccattatcaccagcacccgctgttcctagtattccctcgtcttctgcacctccaattcctgatattccatcttctgcggcccctcctattcccattgtaccatcatctccagcaccaccgcttccattatcaggtgcctctgctccaaaggtaccgcaaaatagaccgcatatgccttcagtaaggccagcacacagaagccaccaaagaaaaagctctaatatttctcttcctagtgtgtcagcaccccctttgccttcagcgtctctgccaacacatgttagcaaccctccacaagctccaccccctcccccaactccaacaattggcctggactcaaaaaacattaaacctacagataacgcagtctcaccaccatcttctgaagttcctgcaggcgggttgccatttttggcagaaattaatgccaggaggtctgaacgaggagccgtcgagggcgtttcttccacaaagattcaaaccgaaaatcataaatctccttcacaaccaccacttccatcatctgctccgcccattcctacatcacatgctccgccattaccgcctactgcaccacctccaccatcgttaccaaatgtgacctctgcacctaaaaaagcaacttcagctccagctccgcctccaccaccactaccagcagccatgagctctgcgtcgactaacagcgtaaaagcaaccccggttcccccaactttagcaccaccgttaccaaatactacatcagttcctcctaacaaagcatcgtcaatgcccgcgccaccacctcctcctcccccaccacctggtgctttttcaacatcctctgccttgtcagcatcatctattcctttagcaccactaccacctcctcctcctccttcggttgcaacgtcagtaccatcggctcctcctcctcctccaacactcacgacaaacaaaccctcagcgtccagtaagcaatccaaaatatcttcatccagttcttcctcggccgtaacacctgggggacccttaccatttcttgctgagatccaaaagaagagagatgatagattcgtggttggtggtgatactggatacactacccaagataaacaagaggatgtaataggttcatctaaggatgataacgtaagaccttctcctatttctccatctataaacccgcctaaacagagtagccaaaatggtatgtcgtttctggatgaaattgaatccaaattacataagcaaacatcatcgaatgcttttaacgcaccacccccccatacggatgctatggcgcctcctttgcctcctagtgcacctcctcctcctataacatcgctaccgactccaactgcatcaggtgatgaccacaccaatgataagagtgagactgtgttagggatgaaaaaagcaaaggcccctgcactgcctggacacgttccacctccaccagttccaccagttttatcagatgatagcaagaataatgtccccgccgcttctttattacacgatgttcttccctcctcgaatctcgaaaaacctccttctcctcctgttgcagctgctccgccattgccaacatttagtgcaccaagtctgcctcagcaatccgtgtctacatcaataccatcacctcctcctgttgcgcctacactttccgttcgtaccgaaactgaatcaatttcgaagaaccccactaagtcgccacccccaccaccaagtccatctacgatggataccggtacctctaatagccccagtaaaaaccttaaacaacggttattttctacaggtggatcgacgctgcaacacaagcataatacgcatacaaatcaaccagatgttgatgtaggtaggtatacgatagggggatcgaattctatcgttggggccaaatctggaaatgaaagaattgttatagatgattcaagatttaaatggactaatgtgtcacaaatgcctaagccacgtccctttcaaaataaaacaaaactgtatccaagtggaaagggtagtagtgtgccattggacttaacattatttacgtga

SEQ ID NO: 4912 - DNA, 2454 bp, Saccharomyces cerevisiae
atgtcggaagagaaaacgtacaaacgtgtagagcaggatgatcccgtgcccgaactggatatcaagcagggccccgtaagaccctttattgttaccgatccgagtgccgaattggcctcgttacgaaccatggtcactcttaaagagaagctgttagtggcctgtcttgctgtctttacagcggtcattagattgcatggcttggcatggcctgacagcgtggtgtttgatgaagtacatttcggtgggtttgcctcgcaatacattagggggacttacttcatggatgtgcatcctcctcttgcaaagatgttgtatgctggtgtggcatcgcttggtgggttccagggtgattttgacttcgaaaatattggtgacagctttccatctacgacgccatacgtgttgatgagatttttctctgcttctttgggggctcttactgttattttgatgtacatgactttacgttattctggtgttcgtatgtgggttgctttgatgagcgctatctgctttgccgttgaaaactcgtacgtcactatttctcgttacattctgttggacgccccattgatgtttttcattgcagctgcagtctactctttcaagaaatacgaaatgtaccctgccaactcgctcaatgcttacaagtccttgcttgctactggtattgctcttggtatggcatcttcatccaaatgggttggtcttttcacggttacatgggtgggtcttttatgtatctggagactatggttcatgattggggatttgactaagtcttccaagtccatcttcaaagtagcatttgccaaattggccttcttgttgggtgtgccttttgccctttatctggtcttcttttatatccacttccaatcattaactttggacggggatggcgcaagcttcttttcgcctgaatttagatctacactaaagaacaataagatcccccaaaatgtcgttgctgatgtcggcattggctccattatcagcttgcgtcatctctctaccatgggcggttatttgcattctcattcacacaattatccagctggttcggaacaacaacaaagcactttatatcctcacatggatgccaataacgattggttgttggaactttacaacgcacccggcgaatctttaacaacattccaaaacctaaccgatggtaccaaggtcagactattccacactgttacaagatgtagattacactctcatgaccataagccacccgtttcagaaagcagcgactggcagaaggaggtttcttgttatggttacagcggattcgacggtgatgctaatgatgactgggttgttgagattgataaaaagaattctgctcctggagttgcccaagaacgggtcatagctttggacacaaagtttagattgagacatgctatgacaggctgttatttgttttcccacgaagtcaagttgccagcttgggggttcgaacaacaagaagttacctgtgcctcctccggtagacatgatttaacattgtggtacgttgagaacaacagtaacccattgttaccagaagataccaagcgtatttcctataaacctgcaagcttcatttctaaatttattgaatcccataaaaagatgtggcatatcaataaaaatttggtcgaacctcatgtttatgaatcacaaccaacttcatggccattcttgctacgtggtataagttactggggtgaaaataacagaaacgtctatctattaggtaatgcgatcgtatggtgggctgtcaccgctttcatcggtattttcggattgattgttatcactgagctgttctcgtggcagttaggtaaaccaattttgaaggactccaaggttgttaacttccacgttcaggttattcactacttattgggttttgccgtccattatgctccatctttcttaatgcaacgtcaaatgtttttgcatcactacttacctgcttattatttcggtattcttgcccttggccacgccttggacataatagtttcttatgttttccgcagcaagagacaaatgggctacgcggtagtgatcactttccttgctgcttctgtgtatttcttcaagagcttcagtccaattatttacggtacaccatggactcaagaattgtgtcaaaaatcgcagtggttgtctggttgggactacaattgtaacacatacttttcttcattagaagagtacaaaaaccaaaccttgactaaacgtgaatctcaacctgccgccactagtacagttgaagaaatcactatagaaggggacggtccgtcgtatgaagatctcatgaacgaggatggcaagaaaatctttaaagacacagaaggtaatgaactagatccagaagttgtcaaaaaaatgttggaagaggagggagctaacattttaaaagtagaaaaaagggctgttttggaataa

SEQ ID NO: 4913 - DNA, 2457 bp, Saccharomyces cerevisiae
atggaaggtggcgaagaagaagttgagcgcattcctgatgaacttttcgatacaaaaaagaagcatttgttagataagctcataagggtcggaataatccttgtactcctgatatggggcactgttttgttgctaaaaagtatacctcaccattcaaacacaccagattatcaagaacccaactctaattacaccaatgatgggaaattaaaggtgtcgttttctgttgtaagaaacaatacatttcaacccaaatatcacgagctgcaatggattagtgacaataaaattgaaagcaacgatctaggtctttatgttacatttatgaacgatagttacgttgttaaatctgtctacgatgactcatataatagcgttttattagagggaaaaactttcattcataacggtcaaaacctcactgtggagtcaataactgcgtctcccgacctgaagcggttattaattagaacaaatagcgtacaaaattggagacactcaacgtttggttcttattttgtctacgataagagtagctcgtcctttgaggagattggaaacgaggtggctctagcaatatggtcccctaattctaatgatattgcatacgtccaagataacaatatatatatttattctgctatttccaaaaagaccatacgggctgtgaccaacgacggaagctcctttctttttaacggtaagccagattgggtttacgaggaagaagtttttgaagacgacaaggctgcgtggtggtcaccaactggtgattacctggcattcttgaaaattgatgaatcagaagttggtgagtttatcattccatattatgtccaagatgaaaaggatatataccccgaaatgcgcagtatcaagtatccaaaaagtggcacgccaaatcctcatgcagagctatgggtttacagtatgaaagatggaacatcgttccatccaagaataagtggaaataaaaaagatggaagtctgttaattactgaagttacatgggtaggaaatggaaacgttttagttaaaactaccgatcgatcctcggacatattgactgtgtttttgatagatacaattgcaaagacttcaaacgtggtaaggaacgaaagttctaacggaggatggtgggagattactcataatactctgtttattccggcaaatgaaacatttgataggcctcataatggttatgttgatattcttccgattggtggttacaatcatttggcttatttcgaaaatagtaatagttcacactataaaacattgacagaggggaaatgggaagtggtgaatggcccacttgcctttgattcaatggaaaatcgtctttacttcatttctacacgaaagagttcaaccgaacgccacgtttactacatagatttacggtcaccaaatgaaattattgaagttactgatacttctgaggatggtgtctatgatgtgtccttttcttctggtagaaggtttggtttactcacctataaaggaccaaaagttccatatcaaaaaattgtggacttccattctcgtaaagcagaaaaatgcgacaaaggtaatgttttaggcaaatcactataccatttggaaaagaacgaagtacttaccaaaattttagaagattatgcggtacccagaaaatcattcagggaattgaacctaggaaaggacgaatttggaaaggatatactagtgaactcgtatgaaatcctaccaaatgatttcgatgaaacgttaagtgaccactatcctgtatttttctttgcatatgggggaccgaattctcaacaagttgtcaaaacgttttccgtaggatttaatgaagtggtagcttcacaattaaacgcaattgtagttgttgttgacggtcgtggtactggcttcaaaggtcaagactttagatcccttgttcgcgataggctcggtgattacgaggcccgcgaccaaatatctgcggcttccttatatggttctttaacttttgttgatccgcaaaagatttccttatttggttggtcatacggggggtacctgacactaaaaactttggagaaagatggcggaagacatttcaaatacgggatgtcagttgcgccagtaaccgactggagattttacgattctgtttatactgagaggtacatgcatactcctcaagaaaactttgatggatacgtagaatcaagcgttcataatgtcactgctttggcacaagcaaatagatttttgttgatgcacggaacaggagatgataacgttcactttcaaaattccctaaagtttctggaccttttggatctaaatggtgtggaaaattatgacgtccacgtctttcctgactcagatcatagtataagataccataatgcgaatgtaatcgtttttgacaagctattggattgggcaaagcgtgctttcgatgggcaatttgtcaaatga

SEQ ID NO: 4914 - DNA, 2457 bp, Saccharomyces cerevisiae
atggcattttcacgtcttacatctactcatcagtccaatcataacggctacagtaatagcaacaaaaaaggacaaagtcttccactaaccctttctattgatgtagaatcaccgccatgtgttctttatgggtctgctatggaatcctcaggtgctgtgctaagtggactttttactgtgacggttgtcgatccctacagtagtgctgaagataaatctttaaagaatacagaatctaatgtgtcgactacttctaaaagcctaaaaagaaagagtacatttggttctgcactttcatctagattgtccagcttgtcagcgtcgacgtcaaatatctctccttcaacatcttctacatccatatcgcattctcccacgcctgctaatttaagaataatggctggttataccaagatcaccattacgtcggtaacactaagtttggtacagaagatccatttccataaaccctttgtgcctaatatttcctcaatgcaaacctgtatgaactgtaaaacaaagattacaaacatgaaaagctgggaaattcagagtaatacccaggatctttctgttggaagccactcttacccattttcctatcttataccggggtctgtcccatgttcttcatcgctaggtgctacggctgaaacccaggtcaaatacgaacttatcgctgttgtgacgtatatagatcctcatagaaattccttttcttccggtcattctactcccaggaaagaaggaagctcttctaagaagcggttgttgcaactagcgatgcccatcgccgtgactcgaagtataccgcgcgggcctgataagaattctctaagagtatttcctcctacagagttaactgctgctgctgttcttcctaatgttgtatatcctaaatctacttttcctttggagatgaaattagacggtgtttcttcgggggataggagatggcgaatgcgtaaattgagttggagaattgaagaaactacaagagttaaagcacatgcttgtccagtgcacaagcatgaattgaggcagttagaagagcaggttaaaataaaagagtcagaaaaaagtaaaaagccacgcagtcatattaagcgttatggtgaactaggcccacaaatccgggttgcagtaaactctttagaaaatatgccgtcgcaaaggcttccaggcgagcccggtcgtgaacaagcacctaattcttcgggtccagcgtcaactggtaatgttggacttgatgatgaaaatcctgttaatgaagatgaggaagaccaacccggtagcgaattcatccatcccagtgacgacgctttgcgtcaggagttactaatgcagcaacaacgcgcaagacaacaacaacttcaacaagagctaaaaaacaacagtagtttatttacggaagaggttcggataatatctaagggagaaatgaagagtggatggaaaaccgattttgacaataatggaaagattgagctagttacagaaatagattgtatgggacttaattcaggcgtctctaatccggtaatgcatgcatcgacactacaaactccttccacgggcaataagaagcccagcatcaatgtggcttgcgatatacaggatccaaatttaggtttgtatgtaagccacatcttggcagtggaaatagttgttgcagaagaaacattgcaatatgccaatgggcaacctatacggaaaccaaactccaaaaacaagaaagaaactaataacaatacgatgaatgttcataatcctgatcaacgcttagctgaattatctccaatttttgcaaatagaaatacaccgaaagtacggcgcatggggcctgaagatataacaccggtgaatagtaataagtccaaccatagtactaataaggagaaggcatctaacggtgctagtaactctaatatagtgagtgttcccactggtgcagcacgtgttttaagaatgcaattcagattaacagtcactgaaagatctggacttggaatctcctgggacgaagaagttcctcccatttaccaagatgtcgagttgctctcgccaccatgttacgagctctctataaataatggaatcaaaaataaactttattcaacaatgagtactcctgttagatcagaggatgattttgtgggcggcagcgatgaagatattgggaactatgagagccaagggctcgaacctggtcctaacgtacaggaagtaacgatcacacaaaataaattaacgataccaccaaccgcacatcactaccagcctgcttcctcttcgcaaagatcccttaccacagtacagtcaccaccactggaaagtgttgttagtgtccagggtagtgtaccttttcgtggacatgtgttgacaccacatagcacaagagatatcagaatacaaaacttttccgattttctagattccaatagaataacccagtag

SEQ ID NO: 4915 - DNA, 2457 bp, Saccharomyces cerevisiae
atggcgggaaacggtaaggacaaagaggtagataaaagtccctctgttagtactttgaaactattgggaaaacgcctgtttaattccagcagtcacacggataactcttcgttactgcttagtgccgaacaattgggcaatgggagaagtttaagaaaaaggccaacgtctccgtccattagtggcagtggtagcggtggtaattcaccttcgtcttctgctggggcacggcagagatctgcttctttacatagaagaaaaaacaatgcttctgtaggattttcaaatgggtctgtgtcgtcacacaagtcctctgtcgcattgcaggacttaattaaacataataataacccttacttgaactctccctctgatattctgggcacaggtactggcattgcctcgacaagagatagggatagagcagttttggatagagaaaaggaaaaagaaagggcgagaaacaaagaaagaaatactcatcacgcgggcttaccgcaaaggtctaatagcatggctagtcaccattttcccaacgagaatatagtttataatccatacggcataagcccaaaccatgctaggccagatactgcatttgcagacactctgaatacgaataaggagaacgatttgagtttttacatgcatgatggtaacagcaagatacggatgttgccccttccaattgctaatccgaacgattttttgcccgaagatatgaaacaatatagtgtccatttaacggataatttcgtatttgatacggacaataaacctattggttcgggtgggtctagtgaagttagaaaggttaaatcaagttacaggcaaaaggatgtttacgctctaaaaaaactgaatatgatataccacgagtcacccgagaagttttacaagagatgctccaaagaattcatcatagctaagcatttaagtcataacgttcacatcacgaatactttttatcttctaaaagttcccacgaccacatatacaactcgtggttgggggtttattatggaactaggtgttaaggacctcttccaactgatggaaagaacaggctggaagaacgttcccttcaatgaaaaatattgtcttttcaaacaagtggcccaaggtattaagttttgtcatgacaatggtattgctcaccgtgatttgaagcccgaaaatgttttaatttctaaagaaggtatatgcaaattgacggatttcggtatttctgattggtaccatgtgatacctcatgactacactagtccagtgaaaacatgccaaggtatgattggctctccaccatacactccgccagaggtaatgtacttcgatgccaagaagcactaccccgaaaagttccaaaaaccctataatccgttggccatggattcctatgccctcggaatcatgctgattaccatgattaacaatatcatccccttcatcgattcttgtaacactgatgcgagattcagggaatttgaagtgtcatatgacaacttcatcaatcatcaaaacccacatttcagggacaagggctgccacaagccgggtcctggttccgaatactctttagcaagaaatttcaagaatactgatgccacgcgtatcgcatggagattggctgacccgaaccctgcaactagatatacaatggatgatttatttaatgatccgtttttccaacaaattgaaacatgtgtcgagccaaatgatgatgacttagtaagggttcctgaattaaggaaaagtacttctaccaatgattttagtgaaaattcattagatgcaccccatgatcaagaggtcattcacacgtctaatccattcctaaaaaaggaaacgctcacttctaaaccaagatcgatgttggaaattgcagaatctccttccttgaaacaaaaatccaaggtaaaagatagcgcaaagaccaaaacacacgatgttggggatgaaggggggaatgaaagcaccaaacctaagcagcaagataaaaaggaaaatttgaagaaagatgaggtcaagaacggcgacaaggacaaagtcattgaagaggctaccacgactaatgtggacagcatattggaaaaaccaacaccaacctccacaaaagtagaggacaacttaagcgaagatgattccacaatgaaggaattaaagtcgatgctaaactccacccctactacaccaacacataatggccccactccgctccctgcaaaggctggcactcaattagataagcgtatgagcgacctatcactcaaatcggaaacaccggcttctacaaagaactttagcgcaccgaatgtttcgtcatcaagcaattcactgagaagcctcggaagtccaagcgtgtcatcctcgaaaaagaagaaggtaattcaccaccacttggacattaccaacagcgttacaaacatgtcatccgtgagcgcctttatctcaagatag

SEQ ID NO: 4916 - DNA, 2457 bp, Saccharomyces cerevisiae
atgtcactatggccctttggagagacgctgagtcattccggaattgattcgatacttgaagagtactatctaatttttcgtagtttggagggaaatgagacctcttcaactgacgacaagaagaatgagccttctatggagtcagagtccgaatttggtaccgagtctcgggataggagtgaccttaaccagtcatttattgataggatcttgttggaaacagctttgctggatgaactgaatggagcagccaacgacagactcgtcgacttcatttgcttgggatatttctatgacgaccgttcccagcaggtccgccacatggactacctagtggacatgttgatggcttacctgaaggacatagaccgcactggttatagaaccccatttcttttagagaattcattccatcaaacaggtgaatatgaagatcaggacgatgaagacccaatgctgtatgtcaacattatttccagtattttttgttcgaaaagtgcgcccatagtggaggcactcgtgcaaaataccccatttttgtcctctctgttcgaggttttccagtttgaaaatattgaggcagaaaattgtcctatcttggctgttttccttaagattaacgaaactcttctgtttgaacagacatctagctatttggaatttttcaaatcgcaaccgaacattgtggacaagttcttatatcatattgaagtctcacccttggttgaatttctcattaaaatcatgctgactgatcaagttgaatcacctacgaacattattgacttcttgtatcaccaggatctgatacctaagtgtttgaatctcttggaaaatagcaaatactcacctggtattcaaaacagtagcggagagcttctaaaagcactgatcagcatttccaccaattttaaactggatactttgtggatcggacctaaccgattgacaagacagcttgcctctccgcaatatgtcgaccaacttattaatataatcttatttcaaagaggccatgcaatgggagttgccgtatctattataattgagttgatcaggaagaataattccgactatgacgaagtagatttgttaagtaccaccatagtagacaatccgccttctcaaagagatccagtctatttgggccatttgttatatgagctcactatgcatatggaagatttttatgcattactaattaaacttgaaaatgatgatgacgatgatcatgacactgcttcaaaagctcttccatctgttaagcatcacctactagaaaaccaattgcatgaatcattcaggcctttgggctttgaaagagtcaagattacagaattgatatcggaaatgttacactgttcaaatatgggattgatgaattcaaaaagaggcgaaaaaatagcacgtaccagagataaatgcagggacactcttgatcaaaactcactagagaaagccatgaaaaatttaaatataaatgataatactattacttccaatacattagaagataaatgtaataataatgatagtaatgacagtaatgacaaccaaaaacaaaaaaaaaatattaaaaaaaagtttcatgataatgaattgtattctacttttgatacatctgatgacaatattgatgatgatgatgatatgagttttgaaattccttacgtcagtgaaacgcaaaatttgaaaatacgtaaaaaccctaccattggagatttattcaaaattaaacttcatgaccttgggttttttccaaagtttctacaattattcttaagatatccttggaataacttttggcacaacattgtatttgatattattcagcagatattcaatggtcgaatggatttttcttataactcatttttggtctattctttgtttgatttcaaaaagtctacaagatttatcccaaaacctttgtacggcagcaaccaaaagttacctgttaaagacttccatattatctctgatttcattttacaaggccacaaggattcgtttgaattttacgaaaaagagaaaacaaatttaggttatatgggtcaattagtattaattgccgaagaaattgcgaagtattccaaaatttataagaccgatctaattgctccagatatatatgccttcttacaagatgaagtttggatgtcatattctagtgacatcttgaacgaaacaaggacaatgtgttcaataattcttggtggaggccagttctgtgccgaaagcgatgaaaatactaaccaggactttttggaaaaagctgatatgagtaaaccagctcatccatccacaatggatgagaatgaaattgttcacgaggaggatgttaagttgcatgataaagttgccgagctcatagatgaattgggtcaattaaccgaattagatattcatgataaaattaaagatgttattgttgatcatcattccgacttaaattga

SEQ ID NO: 4917 - DNA, 2460 bp, Saccharomyces cerevisiae
atgagttctttggacgaggatgaagaggacttcgaaatgctggacacggagaacctccagtttatggggaagaagatgtttggcaaacaggccggcgaagacgagagtgatgattttgctatagggggtagcaccccgaccaataaactgaaattttatccatattcgaacaacaaattgacaagaagtacggggaccttgaacctgtcattaagtaatacagctttgtcagaggctaactccaaatttcttgggaaaattgaagaagaggaagaagaggaggaagaaggcaaggatgaggaaagcgtggattctcgtattaaaaggtggtctccgttccatgaaaatgaaagtgttactactcctattacaaaaagatctgcggaaaaaacgaacagtcctatttctctcaaacaatggaaccagcgatggtttccgaaaaatgatgctcgcactgaaaatacatcctcatcctcttcatatagcgtcgctaaacctaaccaatcagcctttacgtcttcgggcctcgtatctaaaatgtctatggacacttcgttataccctgcgaaattgaggataccagaaacaccagtgaaaaaatcacccttagtggagggaagagaccataagcatgtccacctttcgagttcgaaaaatgcatcgtcttctctaagtgtttcccctttaaattttgttgaagacaataatttacaagaagaccttttattttcagattctccgtcttcgaaagctttaccttccatccatgtaccaaccatagactcatccccactgagcgaggcaaaatatcatgcacatgatcgtcacaataaccagacaaacatcctgtctcccactaatagcttggttaccaacagctctccacaaacattgcattctaacaagttcaaaaaaatcaaaagagcaaggaattcggttattttgaaaaatagagagctaacaaacagtttacaacaattcaaagatgatttatacggcacggacgagaatttcccacctccaatcataatatcaagtcatcattcaactagaaagaaccctcaaccttatcaatttcgtggacgctatgacaatgacactgacgaagagatctccactccaacaagacgaaaatctattattggggcaacatctcaaacacatagagaaagcagaccattgtcactctcctctgccatcgtgacaaacacaacaagtgcagagacgcattccatatcttccaccgattcttcgccgttaaattccaaaaggcgtctaatctcttcaaataagttatcagcaaatccagattcccatcttttcgaaaaatttacgaatgtgcattccattggtaaaggccagttttccacggtctaccaggttacgtttgcccaaacaaacaaaaagtatgcaatcaaagccattaaaccaaacaaatataattccttgaaacgcatattactggaaattaaaatactaaacgaggtaacaaaccaaattacaatggatcaagaagggaaggaatacatcatcgattacatcagttcctggaagtttcaaaattcatactatattatgacagaattgtgcgaaaatggtaatttggatggatttttacaagagcaagttatcgcaaagaaaaaaaggttggaagattggagaatttggaaaatcatcgtggaattaagcctggctttacgattcatccatgattcttgtcacattgtgcatctggacttgaaacccgcaaacgtcatgatcacatttgaaggtaacctaaaactaggtgactttggaatggctactcatttaccgttggaggataaaagttttgaaaatgaaggtgacagagaatatattgcaccagaaatcatttctgattgtacgtacgattacaaggcagatattttttccctgggtctgatgattgttgaaattgcagcgaacgttgtgttacctgacaatggcaacgcatggcataagttgagatcgggtgatttatcggatgcaggaagattaagttccacagatattcattctgaatcattattttcagacattacgaaagtagatacaaatgatttatttgattttgaaagagacaatatcagtggtaatagtaacaacgctggcacctccactgttcataacaatagtaatatcaacaaccctaatatgaataatggcaacgataataataatgtcaatactgccgctaccaagaatcgtcttattttgcataaaagttctaaaattcccgcatgggtaccgaaatttcttattgatggtgaatcacttgagagaatagtacgatggatgatagagcccaattatgagagaaggcccacggcaaatcaaatcttacaaactgaggaatgcctgtatgtagaaatgacacgcaatgcaggtgctattatccaggaagacgactttggacctaagccaaaattttttatatga

SEQ ID NO: 4918 - DNA, 2460 bp, Saccharomyces cerevisiae
atgtggaaatggaatgtgcgcagatgggcgggcgcaagagtaaacattagcaagaaccgattaagtgtaattaacgttggaagtagatacttatcgaccgcaagaagtccactgtctaaggttagaaatataggaattatagcccatatcgatgcaggtaaaactaccacaacagagaggatgctttattatgcaggaatctcaaagcatattggagacgtcgacactggcgatacgataactgattttttagagcaggagagatcccgaggtatcacaattcaaagcgctgcgatttcattcccatggcgaaatacttttgcaataaatcttattgatacgccgggacatatagattttacttttgaagtgattagggctttgaaagttattgattcatgcgtggtcattttggacgctgttgccggcgtagaggcacagacagagaaggtttggaagcaaagtaaatcgaagcccaaaatctgctttatcaacaaaatggatcgtatgggggcgagtttcaaccatacagtcaatgacttgataaataaatttatgagaggaacaactaccaaaccggtgttggtaaacattccttactatcgaaaacaaccgactagcaatgattatgttttccaaggtgttattgacgtcgtaaatgggaagcgattaacctggaatccagaaaatcctgatgaaattatcgtggatgagttggatggtacttctcttgagcagtgtaatcgttgtagggaatcgatgatagagactttgactgaatacgacgaagatttagtccagcacttcttagaggaggcagaaggcgattactccaaggtttccgcacagtttttgaacgcttcaataagaaaactgactatgaagaatatgattgtacctgtcttatgcggtgcgtcttttaaaaatattggcgtgcagcctctattagatgctatagttaattatctcccttcgcccattgaagccgaactaccagaactaaatgataaaaccgttccaatgaaatatgaccccaaagttggatgtttagtaaacaacaacaaaaatctttgcattgctcttgcattcaaagtgattacggatccaatcaggggtaaacaaatattcattagaatttattcaggtacactaaacagtggcaataccgtttataattctactactggggaaaaatttaaattgggtaaattactgataccccatgcgggaacatcacaacctgtaaatattttaactgcgggccaaatcggattgcttactggctctacagtcgaaaacaacatatctactggagatacactaataacgcattcgtcgaagaaggatgggttgaaatcacttgataaaaaaaaggagttgacgttaaaaatcaattctatcttcattcccccaccagtttttggtgtttccatcgaaccaaggactttaagtaataaaaaatcgatggaagaagctttaaacactttaattactgaagatcccagtctttcaatttctcaaaatgatgagactggccaaacggttttaaacggtatgggtgaattacaccttgaaattgccaaggatcgattggttaatgacctaaaagcagatgttgaatttggtcagttgatggtgtcctacaaagaaacaattaattcagaaacaaatatagaaacgtatgagagtgatgatggatatagattctccttatctctgctaccaaattccgatgcccttcctaactgccttgcatatccattaggagtcaacgagaattttctgataatggaaaaaaatggtaattgggataaagaatggaaataccaagtttctttcgaatcaattctaaattctattattgcaagttgcattgtgggacttcaaagaggcggaaaaatagctaactttcccttatatgcatgctccatcaaaatcaatagcgattggtcagtcccacctgatattgaaactccacaagaaatcttaaaaattactagaaacttaatttttaaagctctcaatgacttaaaacctgaaaaatacaaccttctggaacccatcatgaatcttgatctaacaatccctcaatctgatgttggtacggtgttacaagatctaacaggagcaagaaaggctcaaattctgtctattgaagacgaatcaagcgtgtcaaattctggcgcatccacttgtaattctccagagaacagcaataggatatatattccctctgatgctgttacaaccctacacgcaaccaaagataaaaaaaacactcaagagaccagttctaatgtaaaaaaaattataaaagcgaaagtgccactaagggaaattaccacctacaccaataagctaaggagcttatcgcaagggaggggtgagttcaatattgaatattccgatatggagaaagttaccaacgatcgcctacaatcaatacttcacgacttgtag

SEQ ID NO: 4919 - DNA, 2466 bp, Saccharomyces cerevisiae
atgaacgaagttcctaccactccagttaggcttattttagggcaagctcagcaacgcgagcagaattcagaaaactgttcgcaagaacgtaacccacgcacgtttaattccgaaccggattccagctttaactctcctggttcctcccagttcgtgatacatcctcatgaaccgctcgagaaggagaaagatgagaagcaggatttagaccgctcgattgattacggtaggtcatcagctcttaacaacaagaataatgccaatccattagagaatatagacataaataaaatgtttgatgacaaaaaatcagattcaggtaccaatgatgataaaggaggcgcaagtactagtgataagcatgtccttgcattgaattattcaccgatcagagttgaaatgaactcctcagagaaacgaagcgacaaaaacgtggacgtagatgaaaatgataaagaaggtagccatattaataaaaaattgaaattgcagttagaatcagtacctgatttgaaacaaagctctactaaagatatcattaatgacaaagaagaaattatgtcgtctccaatggcgattgatatgattgagaccaacataagcccaaataaattcataataaacgacggagttgaaagaaacgatagtttcaatatcaataccgacacacttaaattagaaaatgatataaatgagaaacaacaagaggaagacttcataaaatctaacagtaacaatgtggttaatattgacaatgcttataaggaaaaggaggacgaagaaaatgatataacaaattctcatataaacaggcttactcctttgtatgagacttctgcaagggagtcgaactcaaatgaagaggggaggaatgactacgatgatgacaaccaacttgatattagacatgacaattttcagattgtagcaaaaagaaacgaggagctcactgatcagatatatcacttaaatcaaatgttaaactctttgatttccaaaaatgaatcattgtcttttcaatacgagaaattgaacaaaaatcaccaactactaatagatttgacaaatgaaaagttagataaactaaatacagaaagagagagcgatattgccaaggtggaaaaattcaaaaagaggattaaggagttgaatacagaaattaaggtattgaattccaaccaaaaaatattacaagaaaaattcgatgcctcaattactgaagtaaatcatataaagggcgaacatgaaaatactgtcaacactttgcagcaaaatgagaaaattttaaatgataaaaatgtagaactggaaaatatgaaagcagaattgaaaggcaataatgataaattatccgaatatgagaccacgttaaatgacttgaattctcgcattgtgcaactgaatgataagattgaaagcacagatattgttttgaaatctaaagagaacgaactagataatttaaaattgagtttgaaggaaactttatcgatttctaaggacttcaacgactctgaccttataggacaaattaatgagctaatatctacaaaaaacaacttgcaacaaaaaatggatgatttgaataacctgaacgacgataatttgaaggtagtacaggataaattaattaaaaatgaggagacgctaaaactaaaagaagctgaaattgattcattgaatagtgaaatggacgagctaaaaaaacagatcacttcaaaagatgatgaatttaagatgtggcaaagtaaatacgaaactgtcgaagacgaagctaagatacgcaatgccgaagttacagagttgaacggagatattgaagatctaaaggaatcaaaattgcatttggaagaaacaattacggaactagaaaacaaagttcataaactagaaaatgagtgtgaactggagaaacaaaaattcgaaaaaacttcgctagaattagaaagcttacaactaaaaaatagtaacattcaggctgagcacatcaaagaattggaaaatcttcatgaaaaccttatttctcttcaaaatgaattgaagatttcatccgacaggataacaacattaacaaaagaaaatgaagtattaatggaacaaaataataataacaataatagcgttactttaagcaatgatcaaaaggatagagatgatgaaaaaattaaatcattaggaaaacaagtacaagattggaaagaaaagtatgaggccaaagaaaaagatacaaataaaaggctaaagttattagcagaagatttgtatatccagtattcatccaaacacgaacaaaaggtcaaactgttgaaaaaaggctatgaaaacaagtaccaaaataagtttgatcaattaaatttagaaaataaaactctgtcagaagaaatcgagcaattgaacaagcagctgtcttcagaaagagaagaaaagcaggagttactcaagttgttagaaaatgaaaaaaaataa

SEQ ID NO: 4920 - DNA, 2466 bp, Saccharomyces cerevisiae
atggaaaatattacacaacccacacagcaatccacgcaggctactcaaaggtttttgattgagaagttttctcaagaacagatcggcgaaaacattgtgtgcagggtcatttgtaccacgggtcaaattcccatccgagatttgtcagctgatatttcacaagtgcttaaggaaaaacgatccataaagaaagtttggacatttggtagaaacccagcctgtgactatcatttaggaaacatttcaagactgtcaaataagcatttccaaatactactaggagaagacggtaaccttttattgaatgacatttccactaatgggacctggttaaatgggcaaaaagtcgagaagaacagcaatcagttactgtctcaaggtgatgaaataaccgttggtgtaggcgtggaatcagatattttatctctggtcattttcataaacgacaaatttaagcagtgcctcgagcagaacaaagttgatcgcataagatctaacctgaaaaatacctctaaaatagcttctcctggtcttacatcatctactgcatcatcaatggtggccaacaagactggtatttttaaggatttttcgattattgacgaagtggtgggccagggtgcatttgccacagtaaagaaagccattgaaagaactactgggaaaacattcgcggtgaagattataagtaaacgcaaagtaataggcaatatggatggtgtgacaagagagttagaagtattgcaaaagctcaatcatccaaggatagtacgattgaaaggattttatgaagatactgagagttattatatggtgatggagttcgtttctggtggtgacttaatggattttgttgctgctcatggtgcggttggagaagatgctgggagggagatatccaggcagatactcacagcaataaaatacattcactctatgggcatcagccatcgtgacctaaagcccgataatattcttattgaacaagacgatcctgtattggtaaagataaccgactttggtctggcaaaagtacaaggaaatgggtcttttatgaaaaccttctgtggcactttggcatatgtggcacctgaagtcatcagaggtaaagatacatccgtatctcctgatgaatacgaagaaaggaatgagtactcttcgttagtggatatgtggtcaatgggatgtcttgtgtatgttatcctaacgggccacttaccttttagtggtagcacacaggaccaattatataaacagattggaagaggctcatatcatgaagggcccctcaaagatttccggatatctgaagaagcaagagatttcatagattcattgttacaggtggatccaaataataggtcgacagctgcaaaagccttgaatcatccctggatcaagatgagtccattgggctcacaatcatatggtgatttttcacaaatatccttatcacaatcgttgtcgcagcagaaattattagaaaatatggacgatgctcaatacgaatttgtcaaagcgcaaaggaaattacaaatggagcaacaacttcaagaacaggatcaggaagaccaagatggaaaaattcaaggatttaaaatacccgcacacgcccctattcgatatacacagcccaaaagcattgaagcagaaactagagaacaaaaacttttacattccaataatactgagaatgtcaagagctcaaagaaaaagggtaatggtaggtttttaactttaaaaccattgcctgacagcattattcaagaaagcctggagattcagcaaggtgtgaatccatttttcattggtagatccgaggattgcaattgtaaaattgaagacaataggttgtctcgagttcattgcttcattttcaaaaagaggcatgctgtaggcaaaagcatgtatgaatctccggcacaaggtttagatgatatttggtattgccacaccggaactaacgtgagctatttaaataataaccgcatgatacagggtacgaaattccttttacaagacggagatgaaatcaagatcatttgggataaaaacaataaatttgtcattggctttaaagtggaaattaacgatactacaggtctgtttaacgagggattaggtatgttacaagaacaaagagtagtacttaagcaaacagccgaagaaaaagatttggtgaaaaagttaacccagatgatggcagctcaacgtgcaaatcaaccctcggcttcttcttcatcaatgtcggctaagaagccgccagttagcgatacaaataataacggcaataattcggtactaaacgacttggtagagtcaccgattaatgcgaatacggggaacattttgaagagaatacattcggtaagtttatcgcaatcacaaattgatcctagtaagaaggttaaaagggcaaaattggaccaaacctcaaaaggccccgagaatttgcaattttcgtaa

SEQ ID NO: 4921 - DNA, 2469 bp, Saccharomyces cerevisiae
atgctggaaggtacggtagattatgacccgctggaagatattaccaatatacttttttcaaaagaatccctgaacaacatagatgaactgatcagtattaccagaagctacaaaaagcaattgcaagaggatattctcaaagaagagaatgaattgaaggaacaccctaaaaattccgctgaaatagaggcttctctgaggaaagttttccaagatttcaaagaaactcaagatgtctcagcctccaccgagttgacgatatcgaatctgacagaaggtatctcgtacctggacattgccaagaaaaacctcacccactctttgactcttttccaaaatttaaagatattgacagacagttacatacaatgcaatgaattactctcacagggctcattcaaaaaaatggtgtccccttataagataatgtgttcgcttgctgaaaacacattcatctcttacaaatcattggacgagataaactatttgttgagctccatttcaagactgaaaggagacactttgtccaaaattaaacaaaactacaatgcgctcttttccggcggcaatatctcagagcatgatacagcactcactatggaattgcgcgaaggtgcctgcgagctactcgactgcgatacaagtacgagagcccagatgatagattggtgtttggacaaacttctcttcgaaatgaaagagatatttagggtcgacgatgaagccggatccctagaaaatttatcgagaagatacatttacttcaaaaaaattcttaataacttcaattcaaagttcgcagactatttcttaaaagactgggaaatggcagtcagattgaccaccactttttatcacattacacacaaggaccttcagacacttctgaaaagggaattcaaagacaagaacccttccattgatctattcatgacagcattacaatcgacgctagatttcgaaaaatacatcgacgtacgattttcaaaaaaaattaaggaaccaaaactaagttcctgcttcgaaccttatttgactttatgggtgtctcaccaaaaccaaatgatggaaaagaaatttctttcttatatgagtgagccgaagtacccatctaatgaaacagaatctctcgtgttaccctcgagtgcagaccttttcaggacatatcgttccgtactgactcagaccttagagctcattgataataatgccaatgatagcatattgacttcattggcaaattttttcagtagatggcttcaaacttactcacaaaaaattcttcttcctttactgctgcccgacaatattgaagtccaggataagctagaagctgccaagtataccgttttattgatcaatactgcagattattgtgccacgactatagatcaattggaggataaattatctgaattcagcggtaatcgtgaaaagctggcaaacagttttacgaaaacgaaaaatatatacgacgatttactagcaaaaggaacttcttttctattaaaccgtgtcatacccttagatctaaattttgtatggagagagtttatcaacaatgattggtcaaatgctgcgatagaagattatagcaggtacatggtaaccctcaaatccgtacttaaaatgcccgcattaacagatgcctctattaaacaacagcaagagcaaccttcgactttggcatttattttgtcgcaattcaatagagatgtttataagtggaatttcttggataaggtgattgatatcatcactacaaattttgtaagcaataccatccgccttctgcagcccgttccacccttttccctggcgggcagcaaaaggaaatttgaaaccagaactgttgtcaacattggcgagcagcttctccttgatttagaattgctgaaggagatttttcacactttaccagaaagtgtaagtaacgattctgacttgcgagaaaatacctcttataagagggtgaaaagacatgcagacaataatatagaccagctgctgaagtttattaaacttctaatggctcctctggattccgctgatgactattacgagacctactccaaattgaccaataataaccctgattcagcggtatggtcttttgtcctcgctttaaagggcattccatgggacctggcattatggaaaaagctatggagtgcctacaacttagaaacagacgacactgacgagggcagcaggccagacagtaatcgcgatcttttcatattcaagtgggacaaggtacttttgggtcaatttgaaaacaacttggcaaggatgcaagatccgaattggtcaaaatttgtgaggcaagatctgaaaatatcaccacctgttatgaagaggatagtatccacccctcaaatacaacaacaaaaagaagaacaaaaaaagcaaagtttgagtgtcaaagacttcgtttctcactcaaggttctttaacagaggcacttga

SEQ ID NO: 4922 - DNA, 2469 bp, Saccharomyces cerevisiae
atgtgccataattctgttaggagcggaaataaggctggttttttggggatcaagttcggaagtgctcttctctcaattgccacaggtgccattgctatcgcattgctatgcaagttccacgaccacgaagcggtactgatagttattgtatgctcgacattgttatatggaataccgtcactgatatcgtttatcacagagactgtttttgcgcctagcaagtttcatattggatacttttacaacgttcttaattttgcattgccactgatcaccatgggctgcacagtggactattttcataataccttgaggagcccaatatcggtacaaagcgagtctcacagagtctatataacaactctggattctttgttaattttcacacttttcattaatggcatacaattaggattcttcctgaaggatggcaatgcgaacaatttcggcagctcatctaacaatattagtacggatcaatatgacaaagaagcaaatgcggtggaaaatggtagatttgtaccccttaagaactcttcacagaccttaacaccagatttggaattattacacggtagtcccaagagtatgaatggggtagcgtggctgattaatgaactctccacaaattcaaacacaaacgcaaacaaaaccatatcatccgatgaaaattcaaactcttcagttattcgacacaaattaggaccgattagcaccagcaagtgtcctaaaaagccatctcattcgcatttttctaaattgaaaaaatataacagtttctttttgggtcctaaagaaaatcgatacaaaagaaatacacaacaagctactaaggttccgacagaaaagaaaagcaaccaccgaagtagccagtatgtatccagactatcaaccatatctgacatctcgaaaagtttcctgaatttcttagcattaaacgaaaaaaacgggaattcgacttccactgcgagaacaccaagtgaaggaagagtttcaataataattaacgaaggaaataatactttgaaatacaaaactccccatgattcgcatactattgattctccaaacttggagttagaaagagaagctattgggagaattaatagtgccttacttcctgcatgtttgagagtaacagataaaatgatatccccacagcaaagcactcaaaatgaggactcataccaagcaacaccattgataccccaggtggaagttgacgatgatttctatgtaggtgatatcttaatgactaatgaactacaagacattccacaagtcccaaggatatcatctgatatagaagacgatttcgaacaacaatataccaaacacgtggatttgccagcccgtgtcactttagagatgtgggaaaaggatcaggagaaaatacttcaaaaagtaaccacaaaccgggataaaagcaaattactaccccctttcagattcacctctgaaagtgatatggatccaagtacatccaccgaattggaagttgaactgcatgcccaaaacaacttcagctttccctttaaaagtgcaggattacaaattgctacatcagaccaatttaaccaacaggagtttaaaacttcagatactattagcgaactagatgagtatttacatgatcccagcattcaagaagaggatgcaagtcagctgattgaaagcagtttgaaccaaaacaacctatcctcaactactattgacaatggcccaaaggatatgagtagatttagtacaaggcattcaccaaccaaatcgataatttccatgatcagtggatcaggaagtgtcaagcaccaacattcacacagcaccctaagcaacttttttacgggtcattcaagaaacaattctcaaataaatcagctattacagggttcttcttctaatatgatgtccaacacctcaccgcattcatctccaaccaagtcgttgagaatgagatttggaaagaaattgtcattatcaaatatctctgatacaatgtcgccatatgagggtagtacaacagatccgataaactactcgtttggccatggtcacaataaaaaccagagtattgattttagctacgtacgtactttgcaaagcagtcattcacctacaaaatcaacctcgggaaattctcgtcgggattctttaaacaatgatagaacccagagtactgttaatgaaagagcgcttagaactgcaagtacattattctatctccagcacaataacgccacatgtacattgaacggagaggagccagttctggacacaccacaatctatacagtcatcatcaagcggttctgagcaagaatcggcgggatctggttctggctatccagaagtagtgttcagcgagtatgatagagaaaaatggaatgttttgaggaatctaaaagagatagcgcccgaaaaaactatagagagcggacctgttgaagaactagtctctcccagtaaataa

SEQ ID NO: 4923 - DNA, 2472 bp, Saccharomyces cerevisiae
atgacacagcttcagatttcattattgctgacagctactatatcactactccatctagtagtggccacgccctatgaggcatatcctatcggaaaacaataccccccagtggcaagagtcaatgaatcgtttacatttcaaatttccaatgatacctataaatcgtctgtagacaagacagctcaaataacatacaattgcttcgacttaccgagctggctttcgtttgactctagttctagaacgttctcaggtgaaccttcttctgacttactatctgatgcgaacaccacgttgtatttcaatgtaatactcgagggtacggactctgccgacagcacgtctttgaacaatacataccaatttgttgttacaaaccgtccatccatctcgctatcgtcagatttcaatctattggcgttgttaaaaaactatggttatactaacggcaaaaacgctctgaaactagatcctaatgaagtcttcaacgtgacttttgaccgttcaatgttcactaacgaagaatccattgtgtcgtattacggacgttctcagttgtataatgcgccgttacccaattggctgttcttcgattctggcgagttgaagtttactgggacggcaccggtgataaactcggcgattgctccagaaacaagctacagttttgtcatcatcgctacagacattgaaggattttctgccgttgaggtagaattcgaattagtcatcggggctcaccagttaactacctctattcaaaatagtttgataatcaacgttactgacacaggtaacgtttcatatgacttacctctaaactatgtttatctcgatgacgatcctatttcttctgataaattgggttctataaacttattggatgctccagactgggtggcattagataatgctaccatttccgggtctgtcccagatgaattactcggtaagaactccaatcctgccaatttttctgtgtccatttatgatacttatggtgatgtgatttatttcaacttcgaagttgtctccacaacggatttgtttgccattagttctcttcccaatattaacgctacaaggggtgaatggttctcctactattttttgccttctcagtttacagactacgtgaatacaaacgtttcattagagtttactaattcaagccaagaccatgactgggtgaaattccaatcatctaatttaacattagctggagaagtgcccaagaatttcgacaagctttcattaggtttgaaagcgaaccaaggttcacaatctcaagagctatattttaacatcattggcatggattcaaagataactcactcaaaccacagtgcgaatgcaacgtccacaagaagttctcaccactccacctcaacaagttcttacacatcttctacttacactgcaaaaatttcttctacctccgctgctgctacttcttctgctccagcagcgctgccagcagccaataaaacttcatctcacaataaaaaagcagtagcaattgcgtgcggtgttgctatcccattaggcgttatcctagtagctctcatttgcttcctaatattctggagacgcagaagggaaaatccagacgatgaaaacttaccgcatgctattagtggacctgatttgaataatcctgcaaataaaccaaatcaagaaaacgctacacctttgaacaacccctttgatgatgatgcttcctcgtacgatgatacttcaatagcaagaagattggctgctttgaacactttgaaattggataaccactctgccactgaatctgatatttccagcgtggatgaaaagagagattctctatcaggtatgaatacatacaatgatcagttccaatcccaaagtaaagaagaattattagcaaaacccccagtacagcctccagagagcccgttctttgacccacagaataggtcttcttctgtgtatatggatagtgaaccagcagtaaataaatcctggcgatatactggcaacctgtcaccagtctctgatattgtcagagacagttacggatcacaaaaaactgttgatacagaaaaacttttcgatttagaagcaccagagaaggaaaaacgtacgtcaagggatgtcactatgtcttcactggacccttggaacagcaatattagcccttctcccgtaagaaaatcagtaacaccatcaccatataacgtaacgaagcatcgtaaccgccacttacaaaatattcaagactctcaaagcggtaaaaacggaatcactcccacaacaatgtcaacttcatcttctgacgattttgttccggttaaagatggtgaaaatttttgctgggtccatagcatggaaccagacagaagaccaagtaagaaaaggttagtagatttttcaaataagagtaatgtcaatgttggtcaagttaaggacattcacggacgcatcccagaaatgctgtga

SEQ ID NO: 4924 - DNA, 2472 bp, Saccharomyces cerevisiae
atggaaatcaaagaggtagatgacagggcagagctactgagatataccaacaatattccgttacttggaaagctagtcaaccatcaaccattatggagtacaaatcctaagttaaagtccttttcgctagaaaaaatatcagcccctgatcaaaggcgtgtacaagaggcattagttgtaaaagacctattaaatgtattgattggacttgaaggaacatacatcagatattttaatgattatgaacctagtgacccagagacaccgatagaatttaagattgccaagaaaatggatccatcattcaaaacattcagtagaagaattgttaggtatggtaagcaatacatgatattaacaagggcgtatgaaaaatggtctgacacaagctttgggatggttttgcaaagatttgcttatgaaatcagaagattcttagaagacgtctacttaaaaacgttagttgaaaggcttgaaagggactttaacaaagtgccaaacttttctatcagagaactagaacaaatcattaatgaaacagaagtaaacaaacaaatggagttgctgtacaatatttatgaagaaatttttagagaaatagaagaaagaaggacgaaccaatcttcacaagaagatttcaataattttatggacagtatgaagaatgaaagcagcttgcacttacgattaatggtagcatttgacacaacagtatatccggtacccaaaggtggtgccatattgaaaatttttcagcaaaaaatactggaaaatttgggtgataggtcaagcgtaatgtttttgaagaagctattgaataatataagccaagactattgcacaatgctgtatgaatggctaacacagggtattttaaacgacccttaccaagaattcatgacttatgatgatttggaaggtaagacggataacatatttgacacaagagacagagcgtgggatacgcaatacttcataagaaaagatgttttgttgcgggattgtgactcagaagaggataagaatctactattcaagatgttaaggaccggtattttactcaaagttgttcgagctagcttacaaatacccaccataccttctaatagcagtgatataaccattcaagaaatcaatgatttcgctgacttaatggagggttctaatcttgaactttacgtggataaatgttacagcagagccaatgaaatatttttaaagctattttttcaaggttacgatttgatcaatgtattaaaacatttgcaacaaatttttcttgggtatcaatctggtcataatgttttaaagtttctaacaaaaaatatgggtgagttgaccaaacactacaggaatgataataatgcaaactatgacaagctgctacaaaattttgagttagagagacaatccgaaaatccaaacaacctgatgaggcaactcctgatgatacagttcgatacagaaacacttccacaagtcttatcgcactacctccaaatttatccagaagtacctgagaataactcagcaaatgacgacagcgacccattgatgcacgcgaataatttcaagaatatgaatgccattctttttgatgaattaagcaaagaacgaacgggagcctaccatggatccaatctagaactatatactccaaaaagcgcaatttatcatttaaaatttgacatcaacataccttatccattgaatattattattagtaggacatgcatgataaaataccaaataatcctgcgctaccaactagttttacaataccactcaaggcttttggatgagacttggatggacttaaacaaaacacccagctggaaatacagaggctattcgcacactgtgaagaggaggatagtaagggcaacgagagtgctgcatgctaagatgaaccacttcattaaaaccatcatggaatatttcaaccaaaacgtaattgataaagaggtatactcattagaaaagtgctacagaaatcctactcttgccgttgccatccaaaatgagctagaaggtggattaacaaatataatgacaaatcgttgcttgtctgacttgattccactacagttacaaatatttgacattgtatataagttttgcaagttcatcaaatctatgagagcaaaattatgtcaactggaccccgtactatatgagaaacacaaaagcgggatgatgaaaacactaaacgaaggctatcgtacaaacaatggcggtcaggaagatgttggttaccaagaagatgccgccctggaattaattcagaagctgattgaatacattagcaacgcgtccagcatttttcggaagtgtctcataaactttactcaagagttaagtactgaaaaattcgacttttatgatagttcaagtgtcgacgctgcgggtatagaaagggttctttactctatagtacctcctcgctcagcatctgcttcttcccaaagatga
